United States Patent 9,782,462 (MODIFIED POLYNUCLEOTIDES FOR THE PRODUCTION OF PROTEINS ASSOCIATED WITH HUMAN DISEASE) - sequence listing, part 53

SEQ ID NO: 100983 - DNA, 4770 bp, Artificial Sequence
  Description of Artificial Sequence: Synthetic coding sequence
atggccaagcagctgaacctgcccgagaacaccgacgactggaccaaggaggacgtgaaccagtggctggagagccacaagatcgaccagaagcacagagagatcctgaccgagcaggacgtgaacggcgccgtgctgaagtggctgaagaaggagcacctggtggacatgggcatcacccacggccccgccatccagatcgaggagctgttcaaggagctgagaaagaccgccatcgaggacagcatccagaccagcaagatgggcaagcccagcaagaacgcccccaaggaccagaccgtgagccagaaggagagaagagagaccagcaagcagaagcagaagggcaaggagaaccccgacatggccaaccccagcgccatgagcaccaccgccaagggcagcaagagcctgaaggtggagctgatcgaggacaagatcgactacaccaaggagagacagcccagcatcgacctgacctgcgtgagctaccccttcgacgagttcagcaacccctacagatacaagctggacttcagcctgcagcccgagaccggccccggcaacctgatcgaccccatccacgagttcaaggccttcaccaacaccgccaccgccaccgaggaggacgtgaagatgaagttcagcaacgaggtgttcagattcgccagcgcctgcatgaacagcagaaccaacggcaccatccacttcggcgtgaaggacaagccccacggcaagatcgtgggcatcaaggtgaccaacgacaccaaggaggccctgatcaaccacttcaacctgatgatcaacaagtacttcgaggaccaccaggtgcagcaggccaagaagtgcatcagagagcccagattcgtggaggtgctgctgcccaacagcaccctgagcgacagattcgtgatcgaggtggacatcatcccccagttcagcgagtgccagtacgactacttccagatcaagatgcagaactacaacaacaagatctgggagcagagcaagaagttcagcctgttcgtgagagacggcaccagcagcaaggacatcaccaagaacaaggtggacttcagagccttcaaggccgacttcaagaccctggccgagagcagaaaggccgccgaggagaagttcagagccaagaccaacaagaaggagagagagggccccaagctggtgaagctgctgaccggcaaccaggacctgctggacaacagctactacgagcagtacatcctggtgaccaacaagtgccaccccgaccagaccaagcacctggacttcctgaaggagatcaagtggttcgccgtgctggagttcgaccccgagagcaacatcaacggcgtggtgaaggcctacaaggagagcagagtggccaacctgcacttccccagcgtgtacgtggagcagaagaccacccccaacgagaccatcagcaccctgaacctgtaccaccagcccagctggatcttctgcaacggcagactggacctggacagcgagaagtacaagcccttcgaccccagcagctggcagagagagagagccagcgacgtgagaaagctgatcagcttcctgacccacgaggacatcatgcccagaggcaagttcctggtggtgttcctgctgctgagcagcgtggacgaccccagagaccccctgatcgagaccttctgcgccttctaccaggacctgaagggcatggagaacatcctgtgcatctgcgtgcacccccacatcttccagggctggaaggacctgctggaggccagactgatcaagcaccaggacgagatcagcagccagtgcatcagcgccctgagcctggaggagatcaacggcaccatcctgaagctgaagagcgtgacccagagcagcaagagactgctgcccagcatcggcctgagcaccgtgctgctgaagaaggaggaggacatcatgaccgccctggagatcatctgcgagaacgagtgcgagggcaccctgctggagaaggacaagaacaagttcctggagttcaaggccagcaaggaggaggacttctacagaggcggcaaggtgagctggtggaacttctacttcagcagcgagagctacagcagccccttcgtgaagagagacaagtacgagagactggaggccatgatccagaactgcgccgacagcagcaagcccaccagcaccaagatcatccacctgtaccaccaccccggctgcggcggcaccaccctggccatgcacatcctgtgggagctgagaaagaagttcagatgcgccgtgctgaagaacaagaccgtggacttcagcgagatcggcgagcaggtgaccagcctgatcacctacggcgccatgaacagacaggagtacgtgcccgtgctgctgctggtggacgacttcgaggagcaggacaacgtgtacctgctgcagtacagcatccagaccgccatcgccaagaagtacatcagatacgagaagcccctggtgatcatcctgaactgcatgagaagccagaaccccgagaagagcgccagaatccccgacagcatcgccgtgatccagcagctgagccccaaggagcagagagccttcgagctgaagctgaaggagatcaaggagcagcacaagaacttcgaggacttctacagcttcatgatcatgaagaccaacttcaacaaggagtacatcgagaacgtggtgagaaacatcctgaagggccagaacatcttcaccaaggaggccaagctgttcagcttcctggccctgctgaacagctacgtgcccgacaccaccatcagcctgagccagtgcgagaagttcctgggcatcggcaacaagaaggccttctggggcaccgagaagttcgaggacaagatgggcacctacagcaccatcctgatcaagaccgaggtgatcgagtgcggcaactactgcggcgtgagaatcatccacagcctgatcgccgagttcagcctggaggagctgaagaagagctaccacctgaacaagagccagatcatgctggacatgctgaccgagaacctgttcttcgacaccggcatgggcaagagcaagttcctgcaggacatgcacaccctgctgctgaccagacacagagacgagcacgagggcgagaccggcaactggttcagccccttcatcgaggccctgcacaaggacgagggcaacgaggccgtggaggccgtgctgctggagagcatccacagattcaaccccaacgccttcatctgccaggccctggccagacacttctacatcaagaagaaggacttcggcaacgccctgaactgggccaagcaggccaagatcatcgagcccgacaacagctacatcagcgacaccctgggccaggtgtacaagagcaagatcagatggtggatcgaggagaacggcggcaacggcaacatcagcgtggacgacctgatcgccctgctggacctggccgagcacgccagcagcgccttcaaggagagccagcagcagagcgaggacagagagtacgaggtgaaggagagactgtaccccaagagcaagagaagatacgacacctacaacatcgccggctaccagggcgagatcgaggtgggcctgtacaccatccagatcctgcagctgatccccttcttcgacaacaagaacgagctgagcaagagatacatggtgaacttcgtgagcggcagcagcgacatccccggcgaccccaacaacgagtacaagctggccctgaagaactacatcccctacctgaccaagctgaagttcagcctgaagaagagcttcgacttcttcgacgagtacttcgtgctgctgaagcccagaaacaacatcaagcagaacgaggaggccaagaccagaagaaaggtggccggctacttcaagaagtacgtggacatcttctgcctgctggaggagagccagaacaacaccggcctgggcagcaagttcagcgagcccctgcaggtggagagatgcagaagaaacctggtggccctgaaggccgacaagttcagcggcctgctggagtacctgatcaagagccaggaggacgccatcagcaccatgaagtgcatcgtgaacgagtacaccttcctgctggagcagtgcaccgtgaagatccagagcaaggagaagctgaacttcatcctggccaacatcatcctgagctgcatccagcccaccagcagactggtgaagcccgtggagaagctgaaggaccagctgagagaggtgctgcagcccatcggcctgacctaccagttcagcgagccctacttcctggccagcctgctgttctggcccgagaaccagcagctggaccagcacagcgagcagatgaaggagtacgcccaggccctgaagaacagcttcaagggccagtacaagcacatgcacagaaccaagcagcccatcgcctacttcttcctgggcaagggcaagagactggagagactggtgcacaagggcaagatcgaccagtgcttcaagaagacccccgacatcaacagcctgtggcagagcggcgacgtgtggaaggaggagaaggtgcaggagctgctgctgagactgcagggcagagccgagaacaactgcctgtacatcgagtacggcatcaacgagaagatcaccatccccatcacccccgccttcctgggccagctgagaagcggcagaagcatcgagaaggtgagcttctacctgggcttcagcatcggcggccccctggcctacgacatcgagatcgtgtag

SEQ ID NO: 100984 - DNA, 3852 bp, Artificial Sequence
  Description of Artificial Sequence: Synthetic coding sequence
atggccaagcagctgaacctgcccgagaacaccgacgactggaccaaggaggacgtgaaccagtggctggagagccacaagatcgaccagaagcacagagagatcctgaccgagcaggacgtgaacggcgccgtgctgaagtggctgaagaaggagcacctggtggacatgggcatcacccacggccccgccatccagatcgaggagctgttcaaggagctgagaaagaccgccatcgaggacagcatccagaccagcaagatgggcaagcccagcaagaacgcccccaaggaccagaccgtgagccagaaggagagaagagagaccagcaagcagaagcagaagggcaaggagaaccccgacatggccaaccccagcgccatgagcaccaccgccaagggcagcaagagcctgaaggtggagctgatcgaggacaagatcgactacaccaaggagagacagcccagcatcgacctgacctgcgtgagctaccccttcgacgagttcagcaacccctacagatacaagctggacttcagcctgcagcccgagaccggccccggcaacctgatcgaccccatccacgagttcaaggccttcaccaacaccgccaccgccaccgaggaggacgtgaagatgaagttcagcaacgaggtgttcagattcgccagcgcctgcatgaacagcagaaccaacggcaccatccacttcggcgtgaaggacaagccccacggcaagatcgtgggcatcaaggtgaccaacgacaccaaggaggccctgatcaaccacttcaacctgatgatcaacaagtacttcgaggaccaccaggtgcagcaggccaagaagtgcatcagagagcccagattcgtggaggtgctgctgcccaacagcaccctgagcgacagattcgtgatcgaggtggacatcatcccccagttcagcgagtgccagtacgactacttccagatcaagatgcagaactacaacaacaagatctgggagcagagcaagaagttcagcctgttcgtgagagacggcaccagcagcaaggacatcaccaagaacaaggtggacttcagagccttcaaggccgacttcaagaccctggccgagagcagaaaggccgccgaggagaagttcagagccaagaccaacaagaaggagagagagggccccaagctggtgaagctgctgaccggcaaccaggacctgctggacaacagctactacgagcagtacatcctggtgaccaacaagtgccaccccgaccagaccaagcacctggacttcctgaaggagatcaagtggttcgccgtgctggagttcgaccccgagagcaacatcaacggcgtggtgaaggcctacaaggagagcagagtggccaacctgcacttccccagcgtgtacgtggagcagaagaccacccccaacgagaccatcagcaccctgaacctgtaccaccagcccagctggatcttctgcaacggcagactggacctggacagcgagaagtacaagcccttcgaccccagcagctggcagagagagagagccagcgacgtgagaaagctgatcagcttcctgacccacgaggacatcatgcccagaggcaagttcctggtggtgttcctgctgctgagcagcgtggacgaccccagagaccccctgatcgagaccttctgcgccttctaccaggacctgaagggcatggagaacatcctgtgcatctgcgtgcacccccacatcttccagggctggaaggacctgctggaggccagactgatcaagcaccaggacgagatcagcagccagtgcatcagcgccctgagcctggaggagatcaacggcaccatcctgaagctgaagagcgtgacccagagcagcaagagactgctgcccagcatcggcctgagcaccgtgctgctgaagaaggaggaggacatcatgaccgccctggagatcatctgcgagaacgagtgcgagggcaccctgctggagaaggacaagaacaagttcctggagttcaaggccagcaaggaggaggacttctacagaggcggcaaggtgagctggtggaacttctacttcagcagcgagagctacagcagccccttcgtgaagagagacaagtacgagagactggaggccatgatccagaactgcgccgacagcagcaagcccaccagcaccaagatcatccacctgtaccaccaccccggctgcggcggcaccaccctggccatgcacatcctgtgggagctgagaaagaagttcagatgcgccgtgctgaagaacaagaccgtggacttcagcgagatcggcgagcaggtgaccagcctgatcacctacggcgccatgaacagacaggagtacgtgcccgtgctgctgctggtggacgacttcgaggagcaggacaacgtgtacctgctgcagtacagcatccagaccgccatcgccaagaagtacatcagatacgagaagcccctggtgatcatcctgaactgcatgagaagccagaaccccgagaagagcgccagaatccccgacagcatcgccgtgatccagcagctgagccccaaggagcagagagccttcgagctgaagctgaaggagatcaaggagcagcacaagaacttcgaggacttctacagcttcatgatcatgaagaccaacttcaacaaggagtacatcgagaacgtggtgagaaacatcctgaagggccagaacatcttcaccaaggaggccaagctgttcagcttcctggccctgctgaacagctacgtgcccgacaccaccatcagcctgagccagtgcgagaagttcctgggcatcggcaacaagaaggccttctggggcaccgagaagttcgaggacaagatgggcacctacagcaccatcctgatcaagaccgaggtgatcgagtgcggcaactactgcggcgtgagaatcatccacagcctgatcgccgagttcagcctggaggagctgaagaagagctaccacctgaacaagagccagatcatgctggacatgctgaccgagaacctgttcttcgacaccggcatgggcaagagcaagttcctgcaggacatgcacaccctgctgctgaccagacacagagacgagcacgagggcgagaccggcaactggttcagccccttcatcgaggccctgcacaaggacgagggcaacgaggccgtggaggccgtgctgctggagagcatccacagattcaaccccaacgccttcatctgccaggccctggccagacacttctacatcaagaagaaggacttcggcaacgccctgaactgggccaagcaggccaagatcatcgagcccgacaacagctacatcagcgacaccctgggccaggtgtacaagagcaagatcagatggtggatcgaggagaacggcggcaacggcaacatcagcgtggacgacctgatcgccctgctggacctggccgagcacgccagcagcgccttcaaggagagccagcagcagagcgaggacagagagtacgaggtgaaggagagactgtaccccaagagcaagagaagatacgacacctacaacatcgccggctaccagggcgagatcgaggtgggcctgtacaccatccagatcctgcagctgatccccttcttcgacaacaagaacgagctgagcaagagatacatggtgaacttcgtgagcggcagcagcgacatccccggcgaccccaacaacgagtacaagctggccctgaagaactacatcccctacctgaccaagctgaagttcagcctgaagaagagcttcgacttcttcgacgagtacttcgtgctgctgaagcccagaaacaactag

SEQ ID NO: 100985 - DNA, 4755 bp, Artificial Sequence
  Description of Artificial Sequence: Synthetic coding sequence
atgagcaagcaggtgagcctgcccgagatgatcaaggactggaccaaggagcacgtgaagaagtgggtgaacgaggacctgaagatcaacgagcagtacggccagatcctgctgagcgaggaggtgaccggcctggtgctgcaggagctgaccgagaaggacctggtggagatgggcctgccctggggccccgccctgctgatcaagagaagctacaacaagctgaacagcaagagccccgagagcgacaaccacgaccccggccagctggacaacagcaagcccagcaagaccgagcaccagaagaaccccaagcacaccaagaaggaggaggagaacagcatgagcagcaacatcgactacgaccccagagagatcagagacatcaagcaggaggagagcatcctgatgaaggagaacgtgctggacgaggtggccaacgccaagcacaagaagaagggcaagctgaagcccgagcagctgacctgcatgccctaccccttcgaccagttccacgacagccacagatacatcgagcactacaccctgcagcccgagaccggcgccctgaacctgatcgaccccatccacgagttcaaggccctgaccaacaccgagaccgccaccgaggtggacatcaagatgaagttcagcaacgaggtgttcagattcgccagcgcctgcatgaacagcagaaccaacggcaccatccacttcggcgtgaaggacaagccccacggcgagatcgtgggcgtgaagatcaccagcaaggccgccttcatcgaccacttcaacgtgatgatcaagaagtacttcgaggagagcgagatcaacgaggccaagaagtgcatcagagagcccagattcgtggaggtgctgctgcagaacaacacccccagcgacagattcgtgatcgaggtggacaccatccccaagcacagcatctgcaacgacaagtacttctacatccagatgcagatctgcaaggacaagatctggaagcagaaccagaacctgagcctgttcgtgagagagggcgccagcagcagagacatcctggccaacagcaagcagagagacgtggacttcaaggccttcctgcagaacctgaagagcctggtggccagcagaaaggaggccgaggaggagtacggcatgaaggccatgaagaaggagagcgagggcctgaagctggtgaagctgctgatcggcaacagagacagcctggacaacagctactacgactggtacatcctggtgaccaacaagtgccaccccaaccagatcaagcacctggacttcctgaaggagatcaagtggttcgccgtgctggagttcgaccccgagagcatgatcaacggcgtggtgaaggcctacaaggagagcagagtggccaacctgcacttccccaaccagtacgaggacaagaccaccaacatgtgggagaagatcagcaccctgaacctgtaccagcagcccagctggatcttctgcaacggcagaagcgacctgaagagcgagacctacaagcccctggagccccacctgtggcagagagagagagccagcgaggtgagaaagctgatcctgttcctgaccgacgagaacatcatgaccagaggcaagttcctggtggtgttcctgctgctgagcagcgtggagagccccggcgaccccctgatcgagaccttctgggccttctaccaggccctgaagggcatggagaacatgctgtgcatcagcgtgaacagccacatctaccagagatggaaggacctgctgcagaccagaatgaagatggaggacgagctgaccaaccacagcatcagcaccctgaacatcgagctggtgaacagcaccatcctgaagctgaagagcgtgaccagaagcagcagaagattcctgcccgccagaggcagcagcagcgtgatcctggagaagaagaaggaggacgtgctgaccgccctggagatcctgtgcgagaacgagtgcaccgagaccgacatcgagaaggacaagagcaagttcctggagttcaagaagagcaaggaggagcacttctacagaggcggcaaggtgagctggtggaacttctacttcagcagcgagaactacagcagcgacttcgtgaagagagacagctacgagaagctgaaggacctgatccactgctgggccgagagccccaagcccatcttcgccaagatcatcaacctgtaccaccaccccggctgcggcggcaccaccctggccatgcacgtgctgtgggacctgaagaagaacttcagatgcgccgtgctgaagaacaagaccaccgacttcgccgagatcgccgagcaggtgatcaacctggtgacctacagagccaagagccaccaggactacatccccgtgctgctgctggtggacgacttcgaggagcaggagaacgtgtacttcctgcagaacgccatccacagcgtgctggccgagaaggacctgagatacgagaagaccctggtgatcatcctgaactgcatgagaagcagaaaccccgacgagagcgccaagctggccgacagcatcgccctgaactaccagctgagcagcaaggagcagagagccttcggcgccaagctgaaggagatcgagaagcagcacaagaactgcgagaacttctacagcttcatgatcatgaagagcaacttcgacgagacctacatcgagaacgtggtgagaaacatcctgaagggccaggacgtggacagcaaggaggcccagctgatcagcttcctggccctgctgagcagctacgtgaccgacagcaccatcagcgtgagccagtgcgagatcttcctgggcatcatctacaccagcaccccctgggagcccgagagcctggaggacaagatgggcacctacagcaccctgctgatcaagaccgaggtggccgagtacggcagatacaccggcgtgagaatcatccaccccctgatcgccctgtactgcctgaaggagctggagagaagctaccacctggacaagtgccagatcgccctgaacatcctggaggagaacctgttctacgacagcggcatcggcagagacaagttccagcacgacgtgcagaccctgctgctgaccagacagagaaaggtgtacggcgacgagaccgacaccctgttcagccccctgatggaggccctgcagaacaaggacatcgagaaggtgctgagcgccggcagcagaagattcccccagaacgccttcatctgccaggccctggccagacacttctacatcaaggagaaggacttcaacaccgccctggactgggccagacaggccaagatgaaggcccccaagaacagctacatcagcgacaccctgggccaggtgtacaagagcgagatcaagtggtggctggacggcaacaagaactgcagaagcatcaccgtgaacgacctgacccacctgctggaggccgccgagaaggccagcagagccttcaaggagagccagagacagaccgacagcaagaactacgagaccgagaactggagcccccagaagagccagagaagatacgacatgtacaacaccgcctgcttcctgggcgagatcgaggtgggcctgtacaccatccagatcctgcagctgacccccttcttccacaaggagaacgagctgagcaagaagcacatggtgcagttcctgagcggcaagtggaccatcccccccgaccccagaaacgagtgctacctggccctgagcaagttcaccagccacctgaagaacctgcagagcgacctgaagagatgcttcgacttcttcatcgactacatggtgctgctgaagatgagatacacccagaaggagatcgccgagatcatgctgagcaagaaggtgagcagatgcttcagaaagtacaccgagctgttctgccacctggacccctgcctgctgcagagcaaggagagccagctgctgcaggaggagaactgcagaaagaagctggaggccctgagagccgacagattcgccggcctgctggagtacctgaaccccaactacaaggacgccaccaccatggagagcatcgtgaacgagtacgccttcctgctgcagcagaacagcaagaagcccatgaccaacgagaagcagaacagcatcctggccaacatcatcctgagctgcctgaagcccaacagcaagctgatccagcccctgaccaccctgaagaagcagctgagagaggtgctgcagttcgtgggcctgagccaccagtaccccggcccctacttcctggcctgcctgctgttctggcccgagaaccaggagctggaccaggacagcaagctgatcgagaagtacgtgagcagcctgaacagaagcttcagaggccagtacaagagaatgtgcagaagcaagcaggccagcaccctgttctacctgggcaagagaaagggcctgaacagcatcgtgcacaaggccaagatcgagcagtacttcgacaaggcccagaacaccaacagcctgtggcacagcggcgacgtgtggaagaagaacgaggtgaaggacctgctgagaagactgaccggccaggccgagggcaagctgatcagcgtggagtacggcaccgaggagaagatcaagatccccgtgatcagcgtgtacagcggccccctgagaagcggcagaaacatcgagagagtgagcttctacctgggcttcagcatcgagggccccctggcctacgacatcgaggtgatctag

SEQ ID NO: 100986 - DNA, 1221 bp, Artificial Sequence
  Description of Artificial Sequence: Synthetic coding sequence
atgagcaagcaggtgagcctgcccgagatgatcaaggactggaccaaggagcacgtgaagaagtgggtgaacgaggacctgaagatcaacgagcagtacggccagatcctgctgagcgaggaggtgaccggcctggtgctgcaggagctgaccgagaaggacctggtggagatgggcctgccctggggccccgccctgctgatcaagagaagctacaacaagctgaacagcaagagccccgagagcgacaaccacgaccccggccagctggacaacagcaagcccagcaagaccgagcaccagaagaaccccaagcacaccaagaaggaggaggagaacagcatgagcagcaacatcgactacgaccccagagagatcagagacatcaagcaggaggagagcatcctgatgaaggagaacgtgctggacgaggtggccaacgccaagcacaagaagaagctggaggccctgagagccgacagattcgccggcctgctggagtacctgaaccccaactacaaggacgccaccaccatggagagcatcgtgaacgagtacgccttcctgctgcagcagaacagcaagaagcccatgaccaacgagaagcagaacagcatcctggccaacatcatcctgagctgcctgaagcccaacagcaagctgatccagcccctgaccaccctgaagaagcagctgagagaggtgctgcagttcgtgggcctgagccaccagtaccccggcccctacttcctggcctgcctgctgttctggcccgagaaccaggagctggaccaggacagcaagctgatcgagaagtacgtgagcagcctgaacagaagcttcagaggccagtacaagagaatgtgcagaagcaagcaggccagcaccctgttctacctgggcaagagaaagggcctgaacagcatcgtgcacaaggccaagatcgagcagtacttcgacaaggcccagaacaccaacagcctgtggcacagcggcgacgtgtggaagaagaacgaggtgaaggacctgctgagaagactgaccggccaggccgagggcaagctgatcagcgtggagtacggcaccgaggagaagatcaagatccccgtgatcagcgtgtacagcggccccctgagaagcggcagaaacatcgagagagtgagcttctacctgggcttcagcatcgagggccccctggcctacgacatcgaggtgatctag

SEQ ID NO: 100987 - DNA, 4755 bp, Artificial Sequence; identical to SEQ ID NO: 100985
  Description of Artificial Sequence: Synthetic coding sequence

SEQ ID NO: 100988 - DNA, 213 bp, Artificial Sequence
  Description of Artificial Sequence: Synthetic coding sequence
atgagcaagcaggtgagcctgcccgagatgatcaaggactggaccaaggagcacgtgaagaagtgggtgaacgaggacctgaagatcaacgagcagtacggccagatcctgctgagcgaggaggtgaccggcctggtgctgcaggagctgaccgagaaggacctggtggagatgggcctgccctggggccccgccctgctgatcaagagatag

SEQ ID NO: 100989 - DNA, 4755 bp, Artificial Sequence; identical to SEQ ID NO: 100985
  Description of Artificial Sequence: Synthetic coding sequence

SEQ ID NO: 100990 - DNA, 213 bp, Artificial Sequence; identical to SEQ ID NO: 100988
  Description of Artificial Sequence: Synthetic coding sequence

SEQ ID NO: 100991 - DNA, 213 bp, Artificial Sequence; identical to SEQ ID NO: 100988
  Description of Artificial Sequence: Synthetic coding sequence

SEQ ID NO: 100992 - DNA, 213 bp, Artificial Sequence; identical to SEQ ID NO: 100988
  Description of Artificial Sequence: Synthetic coding sequence

SEQ ID NO: 100993 - DNA, 957 bp, Artificial Sequence
  Description of Artificial Sequence: Synthetic coding sequence
atggccccctgggccgaggccgagcacagcgccctgaaccccctgagagccgtgtggctgaccctgaccgccgccttcctgctgaccctgctgctgcagctgctgccccccggcctgctgcccggctgcgccatcttccaggacctgatcagatacggcaagaccaagtgcggcgagcccagcagacccgccgcctgcagagccttcgacgtgcccaagagatacttcagccacttctacatcatcagcgtgctgtggaacggcttcctgctgtggtgcctgacccagagcctgttcctgggcgcccccttccccagctggctgcacggcctgctgagaatcctgggcgccgcccagttccagggcggcgagctggccctgagcgccttcctggtgctggtgttcctgtggctgcacagcctgagaagactgttcgagtgcctgtacgtgagcgtgttcagcaacgtgatgatccacgtggtgcagtactgcttcggcctggtgtactacgtgctggtgggcctgaccgtgctgagccaggtgcccatggacggcagaaacgcctacatcaccggcaagaacctgctgatgcaggccagatggttccacatcctgggcatgatgatgttcatctggagcagcgcccaccagtacaagtgccacgtgatcctgggcaacctgagaaagaacaaggccggcgtggtgatccactgcaaccacagaatccccttcggcgactggttcgagtacgtgagcagccccaactacctggccgagctgatgatctacgtgagcatggccgtgaccttcggcttccacaacctgacctggtggctggtggtgaccaacgtgttcttcaaccaggccctgagcgccttcctgagccaccagttctacaagagcaagttcgtgagctaccccaagcacagaaaggccttcctgcccttcctgttctag

SEQ ID NO: 100994 - DNA, 711 bp, Artificial Sequence
  Description of Artificial Sequence: Synthetic coding sequence
atgaccagatgccccgccggccaggccgaggtggagatggccgagctgtacgtgaagcccggcaacaaggagagaggctggaacgaccccccccagttcagctacggcctgcagacccaggccggcggccccagaagaagcctgctgaccaagagagtggccgccccccaggacggcagccccagagtgcccgccagcgagaccagccccggccccccccccatgggcccccccccccccagcagcaaggcccccagaagcccccccgtgggcagcggccccgccagcggcgtggagcccaccagcttccccgtggagagcgaggccgtgatggaggacgtgctgagacccctggagcaggccctggaggactgcagaggccacaccagaaagcaggtgtgcgacgacatcagcagaagactggccctgctgcaggagcagtgggccggcggcaagctgagcatccccgtgaagaagagaatggccctgctggtgcaggagctgagcagccacagatgggacgccgccgacgacatccacagaagcctgatggtggaccacgtgaccgaggtgagccagtggatggtgggcgtgaagagactgatcgccgagaagagaagcctgttcagcgaggaggccgccaacgaggagaagagcgccgccaccgccgagaagaaccacaccatccccggcttccagcaggccagctag

SEQ ID NO: 100995 - DNA, 681 bp, Artificial Sequence
  Description of Artificial Sequence: Synthetic coding sequence
atggagggctgcgtgagcaacctgatggtgtgcaacctggcctacagcggcaagctggaggagctgaaggagagcatcctggccgacaagagcctggccaccagaaccgaccaggacagcagaaccgccctgcactgggcctgcagcgccggccacaccgagatcgtggagttcctgctgcagctgggcgtgcccgtgaacgacaaggacgacgccggctggagccccctgcacatcgccgccagcgccggcagagacgagatcgtgaaggccctgctgggcaagggcgcccaggtgaacgccgtgaaccagaacggctgcacccccctgcactacgccgccagcaagaacagacacgagatcgccgtgatgctgctggagggcggcgccaaccccgacgccaaggaccactacgaggccaccgccatgcacagagccgccgccaagggcaacctgaagatgatccacatcctgctgtactacaaggccagcaccaacatccaggacaccgagggcaacacccccctgcacctggcctgcgacgaggagagagtggaggaggccaagctgctggtgagccagggcgccagcatctacatcgagaacaaggaggagaagacccccctgcaggtggccaagggcggcctgggcctgatcctgaagagaatggtggagggctag

SEQ ID NO: 100996 - DNA, 780 bp, Artificial Sequence
  Description of Artificial Sequence: Synthetic coding sequence
atggccaccgccaccggcgtggccgaggagagactgctggccgccctggcctacctgcagtgcgccgtgggctgcgccgtgttcgccagaaacagacagaccaacagcgtgtacggcagacacgccctgcccagccacagactgagagtgcccgccagagccgcctgggtggtgcaggagctgcccagcctggccctgcccctgtaccagtacgccagcgagagcgcccccagactgagaagcgcccccaactgcatcctgctggccatgttcctggtgcactacggccacagatgcctgatctaccccttcctgatgagaggcggcaagcccatgcccctgctggcctgcaccatggccatcatgttctgcacctgcaacggctacctgcagagcagatacctgagccactgcgccgtgtacgccgacgactgggtgaccgaccccagattcctgatcggcttcggcctgtggctgaccggcatgctgatcaacatccacagcgaccacatcctgagaaacctgagaaagcccggcgacaccggctacaagatccccagaggcggcctgttcgagtacgtgaccgccgccaactacttcggcgagatcatggagtggtgcggctacgccctggccagctggagcgtgcagggcgccgccttcgccttcttcaccttctgcttcctgagcggcagagccaaggagcaccacgagtggtacctgagaaagttcgaggagtaccccaagttcagaaagatcatcatccccttcctgttctag

SEQ ID NO: 100997 - DNA, 585 bp, Artificial Sequence
  Description of Artificial Sequence: Synthetic coding sequence
atggagcacgccgcccagccctggagatggcagagaagaagaggctggagaagaagcgcctgctggcccagaagccccacctgcagcgccccctgggccgccagaagcagcagagccatcgtgagaagaacccagtgcaccgccgccaccagatgccccgccaccggcagcgagtgcagaagaggcccccccggctggtgcagaagctgccccagatggccctgcagaagcaccagcacccccgccagcccccccagagtgagcgccgccagacccaccgccagcagctggccctgcagcagcagcaccaccggcatcggcaacgtgggcatgcaggccctggccgtgtgcctgcaccccaagtgccagcccatggtgcccatcgtgtgccccgacctgaaccacgacagcaagacccagagagagatcgccggcatcagatgcagctacagcctgctgggcaacaccgccgccagcagaagaatccccaccagcctgatgacccagcacctgaacgcccacctgctggccaacacctgcttcgccgtgaaccagtacgaggtgttcctgggcgtgctggcctag

SEQ ID NO: 100998 - DNA, 639 bp, Artificial Sequence
  Description of Artificial Sequence: Synthetic coding sequence
atggagcacgccgcccagccctggagatggcagagaagaagaggctggagaagaagcgcctgctggcccagaagccccacctgcagcgccccctgggccgccagaagcagcagagccatcgtgagaagaacccagtgcaccgccgccaccagatgccccgccaccggcagcgagtgcagaagaggcccccccggctggtgcagaagctgccccagatggccctgcagaagcaccagcacccccgccagcccccccagagtgagcgccgccagacccaccgccagcagctggccctgcagcagcagcaccaccggcatcggcttcggcctgtggctgaccggcatgctgatcaacatccacagcgaccacatcctgagaaacctgagaaagcccggcgacaccggctacaagatccccagaggcggcctgttcgagtacgtgaccgccgccaactacttcggcgagatcatggagtggtgcggctacgccctggccagctggagcgtgcagggcgccgccttcgccttcttcaccttctgcttcctgagcggcagagccaaggagcaccacgagtggtacctgagaaagttcgaggagtaccccaagttcagaaagatcatcatccccttcctgttctag

SEQ ID NO: 100999 - DNA, 858 bp, Artificial Sequence
  Description of Artificial Sequence: Synthetic coding sequence
atgctgctggccaccttcaagctgtgcgccggcagcagctacagacacatgagaaacatgaagggcctgagacagcaggccgtgatggccatcagccaggagctgaacagaagagccctgggcggccccacccccagcacctggatcaaccaggtgagaagaagaagcagcctgctgggcagcagactggaggagaccctgtacagcgaccaggagctggcctacctgcagcagggcgaggaggccatgcagaaggccctgggcatcctgagcaaccaggagggctggaagaaggagagccagcaggacaacggcgacaaggtgatgagcaaggtggtgcccgacgtgggcaaggtgttcagactggaggtggtggtggaccagcccatggagagactgtacgaggagctggtggagagaatggaggccatgggcgagtggaaccccaacgtgaaggagatcaaggtgctgcagaagatcggcaaggacaccttcatcacccacgagctggccgccgaggccgccggcaacctggtgggccccagagacttcgtgagcgtgagatgcgccaagagaagaggcagcacctgcgtgctggccggcatggccaccgacttcggcaacatgcccgagcagaagggcgtgatcagagccgagcacggccccacctgcatggtgctgcaccccctggccggcagccccagcaagaccaagctgacctggctgctgagcatcgacctgaagggctggctgcccaagagcatcatcaaccaggtgctgagccagacccaggtggacttcgccaaccacctgagaaagagactggagagccaccccgccagcgaggccagatgctag

SEQ ID NO: 101000 - DNA, 744 bp, Artificial Sequence
  Description of Artificial Sequence: Synthetic coding sequence
atgctgctggccaccttcaagctgtgcgccggcagcagctacagacacatgagaaacatgaagggcagcagactggaggagaccctgtacagcgaccaggagctggcctacctgcagcagggcgaggaggccatgcagaaggccctgggcatcctgagcaaccaggagggctggaagaaggagagccagcaggacaacggcgacaaggtgatgagcaaggtggtgcccgacgtgggcaaggtgttcagactggaggtggtggtggaccagcccatggagagactgtacgaggagctggtggagagaatggaggccatgggcgagtggaaccccaacgtgaaggagatcaaggtgctgcagaagatcggcaaggacaccttcatcacccacgagctggccgccgaggccgccggcaacctggtgggccccagagacttcgtgagcgtgagatgcgccaagagaagaggcagcacctgcgtgctggccggcatggccaccgacttcggcaacatgcccgagcagaagggcgtgatcagagccgagcacggccccacctgcatggtgctgcaccccctggccggcagccccagcaagaccaagctgacctggctgctgagcatcgacctgaagggctggctgcccaagagcatcatcaaccaggtgctgagccagacccaggtggacttcgccaaccacctgagaaagagactggagagccaccccgccagcgaggccagatgctag

SEQ ID NO: 101001 - DNA, 969 bp, Artificial Sequence
  Description of Artificial Sequence: Synthetic coding sequence
atgagcagcagcccctgggagcccgccaccctgagaagagtgttcgtggtgggcgtgggcatgaccaagttcgtgaagcccggcgccgagaacagcagagactaccccgacctggccgaggaggccggcaagaaggccctggccgacgcccagatcccctacagcgccgtggaccaggcctgcgtgggctacgtgttcggcgtggccgagtgcgtgctggccctgggcttcgagaagatgagcaagggcagcctgggcatcaagttcagcgacagaaccatccccaccgacaagcacgtggacctgctgatcaacaagtacggcctgagcgcccaccccgtggccccccagatgttcggctacgccggcaaggagcacatggagaagtacggcaccaagatcgagcacttcgccaagatcggctggaagaaccacaagcacagcgtgaacaacccctacagccagttccaggacgagtacagcctggacgaggtgatggccagcaaggaggtgttcgacttcctgaccatcctgcagtgctgccccaccagcgacggcgccgccgccgccatcctggccagcgaggccttcgtgcagaagtacggcctgcagagcaaggccgtggagatcctggcccaggagatgatgaccgacctgcccagcagcttcgaggagaagagcatcatcaagatggtgggcttcgacatgagcaaggaggccgccagaaagtgctacgagaagagcggcctgacccccaacgacatcgacgtgatcgagctgcacgactgcttcagcaccaacgagctgctgacctacgaggccctgggcctgtgccccgagggccagggcgccaccctggtggacagaggcgacaacacctacggcggcaagtgggtgatcaaccccagcggcggcctgatcagcaagggccaccccctgggcgccaccggcggccacagctgcagctag

SEQ ID NO: 101002 - DNA, 1644 bp, Artificial Sequence
  Description of Artificial Sequence: Synthetic coding sequence
atgagcagcagcccctgggagcccgccaccctgagaagagtgttcgtggtgggcgtgggcatgaccaagttcgtgaagcccggcgccgagaacagcagagactaccccgacctggccgaggaggccggcaagaaggccctggccgacgcccagatcccctacagcgccgtggaccaggcctgcgtgggctacgtgttcggcgacagcacctgcggccagagagccatctaccacagcctgggcatgaccggcatccccatcatcaacgtgaacaacaactgcgccaccggcagcaccgccctgttcatggccagacagctgatccagggcggcgtggccgagtgcgtgctggccctgggcttcgagaagatgagcaagggcagcctgggcatcaagttcagcgacagaaccatccccaccgacaagcacgtggacctgctgatcaacaagtacggcctgagcgcccaccccgtggccccccagatgttcggctacgccggcaaggagcacatggagaagtacggcaccaagatcgagcacttcgccaagatcggctggaagaaccacaagcacagcgtgaacaacccctacagccagttccaggacgagtacagcctggacgaggtgatggccagcaaggaggtgttcgacttcctgaccatcctgcagtgctgccccaccagcgacggcgccgccgccgccatcctggccagcgaggccttcgtgcagaagtacggcctgcagagcaaggccgtggagatcctggcccaggagatgatgaccgacctgcccagcagcttcgaggagaagagcatcatcaagatggtgggcttcgacatgagcaaggaggccgccagaaagtgctacgagaagagcggcctgacccccaacgacatcgacgtgatcgagctgcacgactgcttcagcaccaacgagctgctgacctacgaggccctgggcctgtgccccgagggccagggcgccaccctggtggacagaggcgacaacacctacggcggcaagtgggtgatcaaccccagcggcggcctgatcagcaagggccaccccctgggcgccaccggcctggcccagtgcgccgagctgtgctggcagctgagaggcgaggccggcaagagacaggtgcccggcgccaaggtggccctgcagcacaacctgggcatcggcggcgccgtggtggtgaccctgtacaagatgggcttccccgaggccgccagcagcttcagaacccaccagatcgaggccgtgcccaccagcagcgccagcgacggcttcaaggccaacctggtgttcaaggagatcgagaagaagctggaggaggagggcgagcagttcgtgaagaagatcggcggcatcttcgccttcaaggtgaaggacggccccggcggcaaggaggccacctgggtggtggacgtgaagaacggcaagggcagcgtgctgcccaacagcgacaagaaggccgactgcaccatcaccatggccgacagcgacttcctggccctgatgaccggcaagatgaacccccagagcgccttcttccagggcaagctgaagatcaccggcaacatgggcctggccatgaagctgcagaacctgcagctgcagcccggcaacgccaagctgtag

SEQ ID NO: 101003 - DNA, 1572 bp, Artificial Sequence
  Description of Artificial Sequence: Synthetic coding sequence
atgagcagcagcccctgggagcccgccaccctgagaagagtgttcgtggtgggcgtgggcatgaccaagttcgtgaagcccggcgccgagaacagcagagactaccccgacctggccgaggaggccggcgacagcacctgcggccagagagccatctaccacagcctgggcatgaccggcatccccatcatcaacgtgaacaacaactgcgccaccggcagcaccgccctgttcatggccagacagctgatccagggcggcgtggccgagtgcgtgctggccctgggcttcgagaagatgagcaagggcagcctgggcatcaagttcagcgacagaaccatccccaccgacaagcacgtggacctgctgatcaacaagtacggcctgagcgcccaccccgtggccccccagatgttcggctacgccggcaaggagcacatggagaagtacggcaccaagatcgagcacttcgccaagatcggctggaagaaccacaagcacagcgtgaacaacccctacagccagttccaggacgagtacagcctggacgaggtgatggccagcaaggaggtgttcgacttcctgaccatcctgcagtgctgccccaccagcgacggcgccgccgccgccatcctggccagcgaggccttcgtgcagaagtacggcctgcagagcaaggccgtggagatcctggcccaggagatgatgaccgacctgcccagcagcttcgaggagaagagcatcatcaagatggtgggcttcgacatgagcaaggaggccgccagaaagtgctacgagaagagcggcctgacccccaacgacatcgacgtgatcgagctgcacgactgcttcagcaccaacgagctgctgacctacgaggccctgggcctgtgccccgagggccagggcgccaccctggtggacagaggcgacaacacctacggcggcaagtgggtgatcaaccccagcggcggcctgatcagcaagggccaccccctgggcgccaccggcctggcccagtgcgccgagctgtgctggcagctgagaggcgaggccggcaagagacaggtgcccggcgccaaggtggccctgcagcacaacctgggcatcggcggcgccgtggtggtgaccctgtacaagatgggcttccccgaggccgccagcagcttcagaacccaccagatcgaggccgtgcccaccagcagcgccagcgacggcttcaaggccaacctggtgttcaaggagatcgagaagaagctggaggaggagggcgagcagttcgtgaagaagatcggcggcatcttcgccttcaaggtgaaggacggccccggcggcaaggaggccacctgggtggtggacgtgaagaacggcaagggcagcgtgctgcccaacagcgacaagaaggccgactgcaccatcaccatggccgacagcgacttcctggccctgatgaccggcaagatgaacccccagagcgccttcttccagggcaagctgaagatcaccggcaacatgggcctggccatgaagctgcagaacctgcagctgcagcccggcaacgccaagctgtag

SEQ ID NO: 101004 - DNA, 180 bp, Artificial Sequence
  Description of Artificial Sequence: Synthetic coding sequence
atgggcttccccgaggccgccagcagcttcagaacccaccagatcgaggccgtgcccaccagcagcgccagcgacggcttcaaggccaacctggtgttcaaggagatcgagaagaagctggaggagatcagaagactgaccgcccagagccagtggctgacccagaccagctggctgtag

SEQ ID NO: 101005 - DNA, 423 bp, Artificial Sequence
  Description of Artificial Sequence: Synthetic coding sequence
atgggcttccccgaggccgccagaacccaccagatcgaggccgtgcccaccagcagcgccagcgacggcttcaaggccaacctggtgttcaaggagatcgagaagaagctggaggaggagggcgagcagttcgtgaagaagatcggcggcatcttcgccttcaaggtgaaggacggccccggcggcaaggaggccacctgggtggtggacgtgaagaacggcaagggcagcgtgctgcccaacagcgacaagaaggccgactgcaccatcaccatggccgacagcgacttcctggccctgatgaccggcaagatgaacccccagagcgccttcttccagggcaagctgaagatcaccggcaacatgggcctggccatgaagctgcagaacctgcagctgcagcccggcaacgccaagctgtag

SEQ ID NO: 101006 - DNA, 432 bp, Artificial Sequence
  Description of Artificial Sequence: Synthetic coding sequence
atgggcttccccgaggccgccagcagcttcagaacccaccagatcgaggccgtgcccaccagcagcgccagcgacggcttcaaggccaacctggtgttcaaggagatcgagaagaagctggaggaggagggcgagcagttcgtgaagaagatcggcggcatcttcgccttcaaggtgaaggacggccccggcggcaaggaggccacctgggtggtggacgtgaagaacggcaagggcagcgtgctgcccaacagcgacaagaaggccgactgcaccatcaccatggccgacagcgacttcctggccctgatgaccggcaagatgaacccccagagcgccttcttccagggcaagctgaagatcaccggcaacatgggcctggccatgaagctgcagaacctgcagctgcagcccggcaacgccaagctgtag

SEQ ID NO: 101007 - DNA, 180 bp, Artificial Sequence; identical to SEQ ID NO: 101004
  Description of Artificial Sequence: Synthetic coding sequence

SEQ ID NO: 101008 - DNA, 1401 bp, Artificial Sequence
  Description of Artificial Sequence: Synthetic coding sequence
atgaccggcatccccatcatcaacgtgaacaacaactgcgccaccggcagcaccgccctgttcatggccagacagctgatccagggcggcgtggccgagtgcgtgctggccctgggcttcgagaagatgagcaagggcagcctgggcatcaagttcagcgacagaaccatccccaccgacaagcacgtggacctgctgatcaacaagtacggcctgagcgcccaccccgtggccccccagatgttcggctacgccggcaaggagcacatggagaagtacggcaccaagatcgagcacttcgccaagatcggctggaagaaccacaagcacagcgtgaacaacccctacagccagttccaggacgagtacagcctggacgaggtgatggccagcaaggaggtgttcgacttcctgaccatcctgcagtgctgccccaccagcgacggcgccgccgccgccatcctggccagcgaggccttcgtgcagaagtacggcctgcagagcaaggccgtggagatcctggcccaggagatgatgaccgacctgcccagcagcttcgaggagaagagcatcatcaagatggtgggcttcgacatgagcaaggaggccgccagaaagtgctacgagaagagcggcctgacccccaacgacatcgacgtgatcgagctgcacgactgcttcagcaccaacgagctgctgacctacgaggccctgggcctgtgccccgagggccagggcgccaccctggtggacagaggcgacaacacctacggcggcaagtgggtgatcaaccccagcggcggcctgatcagcaagggccaccccctgggcgccaccggcctggcccagtgcgccgagctgtgctggcagctgagaggcgaggccggcaagagacaggtgcccggcgccaaggtggccctgcagcacaacctgggcatcggcggcgccgtggtggtgaccctgtacaagatgggcttccccgaggccgccagcagcttcagaacccaccagatcgaggccgtgcccaccagcagcgccagcgacggcttcaaggccaacctggtgttcaaggagatcgagaagaagctggaggaggagggcgagcagttcgtgaagaagatcggcggcatcttcgccttcaaggtgaaggacggccccggcggcaaggaggccacctgggtggtggacgtgaagaacggcaagggcagcgtgctgcccaacagcgacaagaaggccgactgcaccatcaccatggccgacagcgacttcctggccctgatgaccggcaagatgaacccccagagcgccttcttccagggcaagctgaagatcaccggcaacatgggcctggccatgaagctgcagaacctgcagctgcagcccggcaacgccaagctgtag

SEQ ID NO: 101009 - DNA, 1512 bp, Artificial Sequence
  Description of Artificial Sequence: Synthetic coding sequence
atgagcagcagcccctgggagcccgccaccctgagaagagtgttcgtggtgggcgtgggcatgaccaagttcgtgaagcccggcgccgagaacagcagagactaccccgacctggccgaggaggccggcaagaaggccctggccgacgcccagatcccctacagcgccgtggaccaggcctgcgtgggctacgtgttcggcgtggccgagtgcgtgctggccctgggcttcgagaagatgagcaagggcagcctgggcatcaagttcagcgacagaaccatccccaccgacaagcacgtggacctgctgatcaacaagtacggcctgagcgcccaccccgtggccccccagatgttcggctacgccggcaaggagcacatggagaagtacggcaccaagatcgagcacttcgccaagatcggctggaagaaccacaagcacagcgtgaacaacccctacagccagttccaggacgagtacagcctggacgaggtgatggccagcaaggaggtgttcgacttcctgaccatcctgcagtgctgccccaccagcgacggcgccgccgccgccatcctggccagcgaggccttcgtgcagaagtacggcctgcagagcaaggccgtggagatcctggcccaggagatgatgaccgacctgcccagcagcttcgaggagaagagcatcatcaagatggtgggcttcgacatgagcaaggaggccgccagaaagtgctacgagaagagcggcctgacccccaacgacatcgacgtgatcgagctgcacgactgcttcagcaccaacgagctgctgacctacgaggccctgggcctgtgccccgagggccagggcgccaccctggtggacagaggcgacaacacctacggcggcaagtgggtgatcaaccccagcggcggcctgatcagcaagggccaccccctgggcgccaccggcctggcccagtgcgccgagctgtgctggcagctgagaggcgaggccggcaagagacaggtgcccggcgccaaggtggccctgcagcacaacctgggcatcggcggcgccgtggtggtgaccctgtacaagatgggcttccccgaggccgccagcagcttcagaacccaccagatcgaggccgtgcccaccagcagcgccagcgacggcttcaaggccaacctggtgttcaaggagatcgagaagaagctggaggaggagggcgagcagttcgtgaagaagatcggcggcatcttcgccttcaaggtgaaggacggccccggcggcaaggaggccacctgggtggtggacgtgaagaacggcaagggcagcgtgctgcccaacagcgacaagaaggccgactgcaccatcaccatggccgacagcgacttcctggccctgatgaccggcaagatgaacccccagagcgccttcttccagggcaagctgaagatcaccggcaacatgggcctggccatgaagctgcagaacctgcagctgcagcccggcaacgccaagctgtag

SEQ ID NO: 101010 - DNA, 1653 bp, Artificial Sequence
  Description of Artificial Sequence: Synthetic coding sequence
atggtgggcgaggagaagatgagcctgagaaacagactgagcaagagcagagagaaccccgaggaggacgaggaccagagaaaccccgccaaggagagcctggagacccccagcaacggcagaatcgacatcaagcagctgatcgccaagaagatcaagctgaccgccgaggccgaggagctgaagcccttcttcatgaaggaggtgggcagccacttcgacgacttcgtgaccaacctgatcgagaagagcgccagcctggacaacggcggctgcgccctgaccaccttcagcgtgctggagggcgagaagaacaaccacagagccaaggacctgagagccccccccgagcagggcaagatcttcatcgccagaagaagcctgctggacgagctgctggaggtggaccacatcagaaccatctaccacatgttcatcgccctgctgatcctgttcatcctgagcaccctggtggtggactacatcgacgagggcagactggtgctggagttcagcctgctgagctacgccttcggcaagttccccaccgtggtgtggacctggtggatcatgttcctgagcaccttcagcgtgccctacttcctgttccagcactgggccaccggctacagcaagagcagccaccccctgatcagaagcctgttccacggcttcctgttcatgatcttccagatcggcgtgctgggcttcggccccacctacgtggtgctggcctacaccctgccccccgccagcagattcatcatcatcttcgagcagatcagattcgtgatgaaggcccacagcttcgtgagagagaacgtgcccagagtgctgaacagcgccaaggagaagagcagcaccgtgcccatccccaccgtgaaccagtacctgtacttcctgttcgcccccaccctgatctacagagacagctaccccagaaaccccaccgtgagatggggctacgtggccatgaagttcgcccaggtgttcggctgcttcttctacgtgtactacatcttcgagagactgtgcgcccccctgttcagaaacatcaagcaggagcccttcagcgccagagtgctggtgctgtgcgtgttcaacagcatcctgcccggcgtgctgatcctgttcctgaccttcttcgccttcctgcactgctggctgaacgccttcgccgagatgctgagattcggcgacagaatgttctacaaggactggtggaacagcaccagctacagcaactactacagaacctggaacgtggtggtgcacgactggctgtactactacgcctacaaggacttcctgtggttcttcagcaagagattcaagagcgccgccatgctggccgtgttcgccgtgagcgccgtggtgcacgagtacgccctggccgtgtgcctgagcttcttctaccccgtgctgttcgtgctgttcatgttcttcggcatggccttcaacttcatcgtgaacgacagcagaaagaagcccatctggaacgtgctgatgtggaccagcctgttcctgggcaacggcgtgctgctgtgcttctacagccaggagtggtacgccagacagcactgccccctgaagaaccccaccttcctggactacgtgagacccagaagctggacctgcagatacgtgttctag

SEQ ID NO: 101011 - DNA, 783 bp, Artificial Sequence
  Description of Artificial Sequence: Synthetic coding sequence
atggtgggcgaggagaagatgagcctgagaaacagactgagcaagagcagagagaaccccgaggaggacgaggaccagagaaaccccgccaaggagagcctggagacccccagcaacggcagaatcgacatcaagcagctgatcgccaagaagatcaagctgaccgccgaggccgaggagctgaagcccttcttcatgaaggaggtgggcagccacttcgacgacttcgtgaccaacctgatcgagaagagcgccagcctggacaacggcggctgcgccctgaccaccttcagcgtgctggagggcgagaagaacaaccacagagccaaggacctgagagccccccccgagcagggcaagatcttcatcgccagaagaagcctgctggacgagctgctggaggtggaccacatcagaaccatctaccacatgttcatcgccctgctgatcctgttcatcctgagcaccctggtggtggactacatcgacgagggcagactggtgctggagttcagcctgctgagctacgccttcggcaagttccccaccgtggtgtggacctggtggatcatgttcctgagcaccttcagcgtgccctacttcctgttccagcactgggccaccggctacagcaagagcagccaccccctgatcagaagcctgttccacggcttcctgttcatgatcttccagatcggcgtgctgggcttcggccccacctacgtggtgctggcctacaccctgccccccgccagcagattcatcatcatcttcgagcagtag

SEQ ID NO: 101012 - DNA, 861 bp, Artificial Sequence
  Description of Artificial Sequence: Synthetic coding sequence
atgaaggcccacagcttcgtgagagagaacgtgcccagagtgctgaacagcgccaaggagaagagcagcaccgtgcccatccccaccgtgaaccagtacctgtacttcctgttcgcccccaccctgatctacagagacagctaccccagaaaccccaccgtgagatggggctacgtggccatgaagttcgcccaggtgttcggctgcttcttctacgtgtactacatcttcgagagactgtgcgcccccctgttcagaaacatcaagcaggagcccttcagcgccagagtgctggtgctgtgcgtgttcaacagcatcctgcccggcgtgctgatcctgttcctgaccttcttcgccttcctgcactgctggctgaacgccttcgccgagatgctgagattcggcgacagaatgttctacaaggactggtggaacagcaccagctacagcaactactacagaacctggaacgtggtggtgcacgactggctgtactactacgcctacaaggacttcctgtggttcttcagcaagagattcaagagcgccgccatgctggccgtgttcgccgtgagcgccgtggtgcacgagtacgccctggccgtgtgcctgagcttcttctaccccgtgctgttcgtgctgttcatgttcttcggcatggccttcaacttcatcgtgaacgacagcagaaagaagcccatctggaacgtgctgatgtggaccagcctgttcctgggcaacggcgtgctgctgtgcttctacagccaggagtggtacgccagacagcactgccccctgaagaaccccaccttcctggactacgtgagacccagaagctggacctgcagatacgtgttctag

SEQ ID NO: 101013 - DNA, 1458 bp, Artificial Sequence
  Description of Artificial Sequence: Synthetic coding sequence
atgaaggaggtgggcagccacttcgacgacttcgtgaccaacctgatcgagaagagcgccagcctggacaacggcggctgcgccctgaccaccttcagcgtgctggagggcgagaagaacaaccacagagccaaggacctgagagccccccccgagcagggcaagatcttcatcgccagaagaagcctgctggacgagctgctggaggtggaccacatcagaaccatctaccacatgttcatcgccctgctgatcctgttcatcctgagcaccctggtggtggactacatcgacgagggcagactggtgctggagttcagcctgctgagctacgccttcggcaagttccccaccgtggtgtggacctggtggatcatgttcctgagcaccttcagcgtgccctacttcctgttccagcactgggccaccggctacagcaagagcagccaccccctgatcagaagcctgttccacggcttcctgttcatgatcttccagatcggcgtgctgggcttcggccccacctacgtggtgctggcctacaccctgccccccgccagcagattcatcatcatcttcgagcagatcagattcgtgatgaaggcccacagcttcgtgagagagaacgtgcccagagtgctgaacagcgccaaggagaagagcagcaccgtgcccatccccaccgtgaaccagtacctgtacttcctgttcgcccccaccctgatctacagagacagctaccccagaaaccccaccgtgagatggggctacgtggccatgaagttcgcccaggtgttcggctgcttcttctacgtgtactacatcttcgagagactgtgcgcccccctgttcagaaacatcaagcaggagcccttcagcgccagagtgctggtgctgtgcgtgttcaacagcatcctgcccggcgtgctgatcctgttcctgaccttcttcgccttcctgcactgctggctgaacgccttcgccgagatgctgagattcggcgacagaatgttctacaaggactggtggaacagcaccagctacagcaactactacagaacctggaacgtggtggtgcacgactggctgtactactacgcctacaaggacttcctgtggttcttcagcaagagattcaagagcgccgccatgctggccgtgttcgccgtgagcgccgtggtgcacgagtacgccctggccgtgtgcctgagcttcttctaccccgtgctgttcgtgctgttcatgttcttcggcatggccttcaacttcatcgtgaacgacagcagaaagaagcccatctggaacgtgctgatgtggaccagcctgttcctgggcaacggcgtgctgctgtgcttctacagccaggagtggtacgccagacagcactgccccctgaagaaccccaccttcctggactacgtgagacccagaagctggacctgcagatacgtgttctag

SEQ ID NO: 101014 - DNA, 1479 bp, Artificial Sequence
  Description of Artificial Sequence: Synthetic coding sequence
atggagctgaagcccttcttcatgaaggaggtgggcagccacttcgacgacttcgtgaccaacctgatcgagaagagcgccagcctggacaacggcggctgcgccctgaccaccttcagcgtgctggagggcgagaagaacaaccacagagccaaggacctgagagccccccccgagcagggcaagatcttcatcgccagaagaagcctgctggacgagctgctggaggtggaccacatcagaaccatctaccacatgttcatcgccctgctgatcctgttcatcctgagcaccctggtggtggactacatcgacgagggcagactggtgctggagttcagcctgctgagctacgccttcggcaagttccccaccgtggtgtggacctggtggatcatgttcctgagcaccttcagcgtgccctacttcctgttccagcactgggccaccggctacagcaagagcagccaccccctgatcagaagcctgttccacggcttcctgttcatgatcttccagatcggcgtgctgggcttcggccccacctacgtggtgctggcctacaccctgccccccgccagcagattcatcatcatcttcgagcagatcagattcgtgatgaaggcccacagcttcgtgagagagaacgtgcccagagtgctgaacagcgccaaggagaagagcagcaccgtgcccatccccaccgtgaaccagtacctgtacttcctgttcgcccccaccctgatctacagagacagctaccccagaaaccccaccgtgagatggggctacgtggccatgaagttcgcccaggtgttcggctgcttcttctacgtgtactacatcttcgagagactgtgcgcccccctgttcagaaacatcaagcaggagcccttcagcgccagagtgctggtgctgtgcgtgttcaacagcatcctgcccggcgtgctgatcctgttcctgaccttcttcgccttcctgcactgctggctgaacgccttcgccgagatgctgagattcggcgacagaatgttctacaaggactggtggaacagcaccagctacagcaactactacagaacctggaacgtggtggtgcacgactggctgtactactacgcctacaaggacttcctgtggttcttcagcaagagattcaagagcgccgccatgctggccgtgttcgccgtgagcgccgtggtgcacgagtacgccctggccgtgtgcctgagcttcttctaccccgtgctgttcgtgctgttcatgttcttcggcatggccttcaacttcatcgtgaacgacagcagaaagaagcccatctggaacgtgctgatgtggaccagcctgttcctgggcaacggcgtgctgctgtgcttctacagccaggagtggtacgccagacagcactgccccctgaagaaccccaccttcctggactacgtgagacccagaagctggacctgcagatacgtgttctag

SEQ ID NO: 101015 - DNA, 1569 bp, Artificial Sequence
  Description of Artificial Sequence: Synthetic coding sequence
atggagcccggcggcgccagactgagactgcagagaaccgagggcctgggcggcgagagagagagacagccctgcggcgacggcaacaccgagacccacagagcccccgacctggtgcagtggaccagacacatggaggccgtgaaggcccagctgctggagcaggcccagggccagctgagagagctgctggacagagccatgagagaggccatccagagctaccccagccaggacaagcccctgcccccccccccccccggcagcctgagcagaacccaggagcccagcctgggcaagcagaaggtgttcatcatcagaaagagcctgctggacgagctgatggaggtgcagcacttcagaaccatctaccacatgttcatcgccggcctgtgcgtgttcatcatcagcaccctggccatcgacttcatcgacgagggcagactgctgctggagttcgacctgctgatcttcagcttcggccagctgcccctggccctggtgacctgggtgcccatgttcctgagcaccctgctggccccctaccaggccctgagactgtgggccagaggcacctggacccaggccaccggcctgggctgcgccctgctggccgcccacgccgtggtgctgtgcgccctgcccgtgcacgtggccgtggagcaccagctgccccccgccagcagatgcgtgctggtgttcgagcaggtgagattcctgatgaagagctacagcttcctgagagaggccgtgcccggcaccctgagagccagaagaggcgagggcatccaggcccccagcttcagcagctacctgtacttcctgttctgccccaccctgatctacagagagacctaccccagaaccccctacgtgagatggaactacgtggccaagaacttcgcccaggccctgggctgcgtgctgtacgcctgcttcatcctgggcagactgtgcgtgcccgtgttcgccaacatgagcagagagcccttcagcaccagagccctggtgctgagcatcctgcacgccaccctgcccggcatcttcatgctgctgctgatcttcttcgccttcctgcactgctggctgaacgccttcgccgagatgctgagattcggcgacagaatgttctacagagactggtggaacagcaccagcttcagcaactactacagaacctggaacgtggtggtgcacgactggctgtacagctacgtgtaccaggacggcctgagactgctgggcgccagagccagaggcgtggccatgctgggcgtgttcctggtgagcgccgtggcccacgagtacatcttctgcttcgtgctgggcttcttctaccccgtgatgctgatcctgttcctggtgatcggcggcatgctgaacttcatgatgcacgaccagagaaccggccccgcctggaacgtgctgatgtggaccatgctgttcctgggccagggcatccaggtgagcctgtactgccaggagtggtacgccagaagacactgccccctgccccaggccaccttctggggcctggtgacccccagaagctggagctgccacacctag

SEQ ID NO: 101016 - DNA, 3426 bp, Artificial Sequence
  Description of Artificial Sequence: Synthetic coding sequence
atggacgacagcggcgagctgggcggcctggagaccatggagaccctgaccgagctgggcgacgagctgaccctgggcgacatcgacgagatgctgcagttcgtgagcaaccaggtgggcgagttccccgacctgttcagcgagcagctgtgcagcagcttccccggcagcggcggcagcggcagcagcagcggcagcagcggcagcagcagcagcagcagcaacggcagaggcagcagcagcggcgccgtggaccccagcgtgcagagaagcttcacccaggtgaccctgcccagcttcagccccagcgccgccagcccccaggcccccaccctgcaggtgaaggtgagccccaccagcgtgcccaccacccccagagccacccccatcctgcagcccagaccccagccccagccccagccccagacccagctgcagcagcagaccgtgatgatcacccccaccttcagcaccaccccccagaccagaatcatccagcagcccctgatctaccagaacgccgccaccagcttccaggtgctgcagccccaggtgcagagcctggtgaccagcagccaggtgcagcccgtgaccatccagcagcaggtgcagaccgtgcaggcccagagagtgctgacccagaccgccaacggcaccctgcagaccctggcccccgccaccgtgcagaccgtggccgccccccaggtgcagcaggtgcccgtgctggtgcagccccagatcatcaagaccgacagcctggtgctgaccaccctgaagaccgacggcagccccgtgatggccgccgtgcagaaccccgccctgaccgccctgaccacccccatccagaccgccgccctgcaggtgcccaccctggtgggcagcagcggcaccatcctgaccaccatgcccgtgatgatgggccaggagaaggtgcccatcaagcaggtgcccggcggcgtgaagcagctggagccccccaaggagggcgagagaagaaccacccacaacatcatcgagaagagatacagaagcagcatcaacgacaagatcatcgagctgaaggacctggtgatgggcaccgacgccaagatgcacaagagcggcgtgctgagaaaggccatcgactacatcaagtacctgcagcaggtgaaccacaagctgagacaggagaacatggtgctgaagctggccaaccagaagaacaagctgctgaagggcatcgacctgggcagcctggtggacaacgaggtggacctgaagatcgaggacttcaaccagaacgtgctgctgatgagcccccccgccagcgacagcggcagccaggccggcttcagcccctacagcatcgacagcgagcccggcagccccctgctggacgacgccaaggtgaaggacgagcccgacagcccccccgtggccctgggcatggtggacagaagcagaatcctgctgtgcgtgctgaccttcctgtgcctgagcttcaaccccctgaccagcctgctgcagtggggcggcgcccacgacagcgaccagcacccccacagcggcagcggcagaagcgtgctgagcttcgagagcggcagcggcggctggttcgactggatgatgcccaccctgctgctgtggctggtgaacggcgtgatcgtgctgagcgtgttcgtgaagctgctggtgcacggcgagcccgtgatcagaccccacagcagaagcagcgtgaccttctggagacacagaaagcaggccgacctggacctggccagaggcgacttcgccgccgccgccggcaacctgcagacctgcctggccgtgctgggcagagccctgcccaccagcagactggacctggcctgcagcctgagctggaacgtgatcagatacagcctgcagaagctgagactggtgagatggctgctgaagaaggtgttccagtgcagaagagccacccccgccaccgaggccggcttcgaggacgaggccaagaccagcgccagagacgccgccctggcctaccacagactgcaccagctgcacatcaccggcaagctgcccgccggcagcgcctgcagcgacgtgcacatggccctgtgcgccgtgaacctggccgagtgcgccgaggagaagatcccccccagcaccctggtggagatccacctgaccgccgccatgggcctgaagaccagatgcggcggcaagctgggcttcctggccagctacttcctgagcagagcccagagcctgtgcggccccgagcacagcgccgtgcccgacagcctgagatggctgtgccaccccctgggccagaagttcttcatggagagaagctggagcgtgaagagcgccgccaaggagagcctgtactgcgcccagagaaaccccgccgaccccatcgcccaggtgcaccaggccttctgcaagaacctgctggagagagccatcgagagcctggtgaagccccaggccaagaagaaggccggcgaccaggaggaggagagctgcgagttcagcagcgccctggagtacctgaagctgctgcacagcttcgtggacagcgtgggcgtgatgagcccccccctgagcagaagcagcgtgctgaagagcgccctgggccccgacatcatctgcagatggtggaccagcgccatcaccgtggccatcagctggctgcagggcgacgacgccgccgtgagaagccacttcaccaaggtggagagaatccccaaggccctggaggtgaccgagagccccctggtgaaggccatcttccacgcctgcagagccatgcacgccagcctgcccggcaaggccgacggccagcagagcagcttctgccactgcgagagagccagcggccacctgtggagcagcctgaacgtgagcggcgccaccagcgaccccgccctgaaccacgtggtgcagctgctgacctgcgacctgctgctgagcctgagaaccgccctgtggcagaagcaggccagcgccagccaggccgtgggcgagacctaccacgccagcggcgccgagctggccggcttccagagagacctgggcagcctgagaagactggcccacagcttcagacccgcctacagaaaggtgttcctgcacgaggccaccgtgagactgatggccggcgccagccccaccagaacccaccagctgctggagcacagcctgagaagaagaaccacccagagcaccaagcacggcgaggtggacgcctggcccggccagagagagagagccaccgccatcctgctggcctgcagacacctgcccctgagcttcctgagcagccccggccagagagccgtgctgctggccgaggccgccagaaccctggagaaggtgggcgacagaagaagctgcaacgactgccagcagatgatcgtgaagctgggcggcggcaccgccatcgccgccagctag

SEQ ID NO: 101017 - DNA, 2055 bp, Artificial Sequence
  Description of Artificial Sequence: Synthetic coding sequence
atggacgacagcggcgagctgggcggcctggagaccatggagaccctgaccgagctgggcgacgagctgaccctgggcgacatcgacgagatgctgcagttcgtgagcaaccaggtgggcgagttccccgacctgttcagcgagcagctgtgcagcagcttccccggcagcggcggcagcggcagcagcagcggcagcagcggcagcagcagcagcagcagcaacggcagaggcagcagcagcggcgccgtggaccccagcgtgcagagaagcttcacccaggtgaccctgcccagcttcagccccagcgccgccagcccccaggcccccaccctgcaggtgaaggtgagccccaccagcgtgcccaccacccccagagccacccccatcctgcagcccagaccccagccccagccccagccccagacccagctgcagcagcagaccgtgatgatcacccccaccttcagcaccaccccccagaccagaatcatccagcagcccctgatctaccagaacgccgccaccagcttccaggtgctgcagccccaggtgcagagcctggtgaccagcagccaggtgcagcccgtgaccatccagcagcaggtgcagaccgtgcaggcccagagagtgctgacccagaccgccaacggcaccctgcagaccctggcccccgccaccgtgcagaccgtggccgccccccaggtgcagcaggtgcccgtgctggtgcagccccagatcatcaagaccgacagcctggtgctgaccaccctgaagaccgacggcagccccgtgatggccgccgtgcagaaccccgccctgaccgccctgaccacccccatccagaccgccgccctgcaggtgcccaccctggtgggcagcagcggcaccatcctgaccaccatgcccgtgatgatgggccaggagaaggtgcccatcaagcaggtgcccggcggcgtgaagcagctggagccccccaaggagggcgagagaagaaccacccacaacatcatcgagaagagatacagaagcagcatcaacgacaagatcatcgagctgaaggacctggtgatgggcaccgacgccaagatgcacaagagcggcgtgctgagaaaggccatcgactacatcaagtacctgcagcaggtgaaccacaagctgagacaggagaacatggtgctgaagctggccaaccagaagaacaagctgctgaagggcatcgacctgggcagcctggtggacaacgaggtggacctgaagatcgaggacttcaaccagaacgtgctgctgatgagcccccccgccagcgacagcggcagccaggccggcttcagcccctacagcatcgacagcgagcccggcagccccctgctggacgacgccaaggtgaaggacgagcccgacagcccccccgtggccctgggcatggtggacagaagcagaatcctgctgtgcgtgctgaccttcctgtgcctgagcttcaaccccctgaccagcctgctgcagtggggcggcgcccacgacagcgaccagcacccccacagcggcagcggcagaagcgtgctgagcttcgagagcggcagcggcggctggttcgactggatgatgcccaccctgctgctgtggctggtgaacggcgtgatcgtgctgagcgtgttcgtgaagctgctggtgcacggcgagcccgtgatcagaccccacagcagaagcagcgtgaccttctggagacacagaaagcaggccgacctggacctggccagaggcgtgtacggcaagaagagcggcgccacccacagcatcgaggaggagctgaacatccacatcagcagaggcaccagaaccagaaccctgctgagcagcagaagattctgcagctgctgcagacagcccaccaacctgcccggcagcttcggccccggcaccgcccacctgccccccggccccggcctgcagcccctgctggagagagaccccctgcagcccgccgaggccacccccggcgccctggccgcccaggagagcctgcccgtgcccgccggccacgccagccactag

SEQ ID NO: 101018 - DNA, 3309 bp, Artificial Sequence
  Description of Artificial Sequence: Synthetic coding sequence
atggacgacagcggcgagctgggcggcctggagaccatggagaccctgaccgagctgggcgacgagctgaccctgggcgacatcgacgagatgctgcagttcgtgagcaaccaggtgggcgagttccccgacctgttcagcgagcagctgtgcagcagcttccccggcagcggcggcagcggcagcagcagcggcagcagcggcagcagcagcagcagcagcaacggcagaggcagcagcagcggcgccgtggaccccagcgtgcagagaagcttcacccaggtgaccctgcccagcttcagccccagcgccgccagcccccaggcccccaccctgcaggtgaaggtgagccccaccagcgtgcccaccacccccagagccacccccatcctgcagcccagaccccagccccagccccagccccagacccagctgcagcagcagaccgtgatgatcacccccaccttcagcaccaccccccagaccagaatcatccagcagcccctgatctaccagaacgccgccaccagcttccaggtgctgcagccccaggtgcagagcctggtgaccagcagccaggtgcagcccgtgaccatccagcagcaggtgcagaccgtgcaggcccagagagtgctgacccagaccgccaacggcaccctgcagaccctggcccccgccaccgtgcagaccgtggccgccccccaggtgcagcaggtgcccgtgctggtgcagccccagatcatcaagaccgacagcctggtgctgaccaccctgaagaccgacggcagccccgtgatggccgccgtgcagaaccccgccctgaccgccctgaccacccccatccagaccgccgccctgcaggtgcccaccctggtgggcagcagcggcaccatcctgaccaccatgcccgtgatgatgggccaggagaaggtgcccatcaagcaggtgcccggcggcgtgaagcagctggagccccccaaggagggcgagagaagaaccacccacaacatcatcgagaagagatacagaagcagcatcaacgacaagatcatcgagctgaaggacctggtgatgggcaccgacgccaagatgcacaagagcggcgtgctgagaaaggccatcgactacatcaagtacctgcagcaggtgaaccacaagctgagacaggagaacatggtgctgaagctggccaaccagaagaacaagctgctgaagggcatcgacctgggcagcctggtggacaacgaggtggacctgaagatcgaggacttcaaccagaacgtgctgctgatgagcccccccgccagcgacagcggcagccaggccggcttcagcccctacagcatcgacagcgagcccggcagccccctgctggacgacgccaaggtgaaggacgagcccgacagcccccccgtggccctgggcatggtggacagaagcagaatcctgctgtgcgtgctgaccttcctgtgcctgagcttcaaccccctgaccagcctgctgcagtggggcggcgcccacgacagcgaccagcacccccacagcggcagcggcagaagcgtgctgagcttcgagagcggcagcggcggctggttcgactggatgatgcccaccctgctgctgtggctggtgaacggcgtgatcgtgctgagcgtgttcgtgaagctgctggtgcacggcgagcccgtgatcagaccccacagcagaagcagcgtgaccttctggagacacagaaagcaggccgacctggacctggccagaggcgacttcgccgccgccgccggcaacctgcagacctgcctggccgtgctgggcagagccctgcccaccagcagactggacctggcctgcagcctgagctggaacgtgatcagatacagcctgcagaagctgagactggtgagatggctgctgaagaaggtgttccagtgcagaagagccacccccgccaccgaggccggcttcgaggacgaggccaagaccagcgccagagacgccgccctggcctaccacagactgcaccagctgcacatcaccggcaagctgcccgccggcagcgcctgcagcgacgtgcacatggccctgtgcgccgtgaacctggccgagtgcgccgaggagaagatcccccccagcaccctggtggagatccacctgaccgccgccatgggcctgaagaccagatgcggcggcaagctgggcttcctggccagctacttcctgagcagagcccagagcctgtgcggccccgagcacagcgccgtgcccgacagcctgagatggctgtgccaccccctgggccagaagttcttcatggagagaagctggagcgtgaagagcgccgccaaggagagcctgtactgcgcccagagaaaccccgccgaccccatcgcccaggtgcaccaggccttctgcaagaacctgctggagagagccatcgagagcctggtgaagccccaggccaagaagaaggccggcgaccaggaggaggagagctgcgagttcagcagcgccctggagtacctgaagctgctgcacagcttcgtggacagcgtgggcgtgatgagcccccccctgagcagaagcagcgtgctgaagagcgccctgggccccgacatcatctgcagatggtggaccagcgccatcaccgtggccatcagctggctgcagggcgacgacgccgccgtgagaagccacttcaccaaggtggagagaatccccaaggccctggaggtgaccgagagccccctggtgaaggccatcttccacgcctgcagagccatgcacgccagcctgcccggcaaggccgacggccagcagagcagcttctgccactgcgagagagccagcggccacctgtggagcagcctgaacgtgagcggcgccaccagcgaccccgccctgaaccacgtggtgcagctgctgacctgcgacctgctgctgagcctgagaaccgccctgtggcagaagcaggccagcgccagccaggccgtgggcgagacctaccacgccagcggcgccgagctggccggcttccagagagacctgggcagcctgagaagactggcccacagcttcagacccgcctacagaaaggtgttcctgcacgaggccaccgtgagactgatggccggcgccagccccaccagaacccaccagctgctggagcacagcctgagaagaagaaccacccagagcaccaagcacggcgaggtggacgcctggcccggccagagagagagagccaccgccatcctgctggcctgcagacacctgcccctgagcttcctgccctgcctgcagcccagctag

SEQ ID NO: 101019 - DNA, 648 bp, Artificial Sequence
  Description of Artificial Sequence: Synthetic coding sequence
atgcacgccagcctgcccggcaaggccgacggccagcagagcagcttctgccactgcgagagagccagcggccacctgtggagcagcctgaacgtgagcggcgccaccagcgaccccgccctgaaccacgtggtgcagctgctgacctgcgacctgctgctgagcctgagaaccgccctgtggcagaagcaggccagcgccagccaggccgtgggcgagacctaccacgccagcggcgccgagctggccggcttccagagagacctgggcagcctgagaagactggcccacagcttcagacccgcctacagaaaggtgttcctgcacgaggccaccgtgagactgatggccggcgccagccccaccagaacccaccagctgctggagcacagcctgagaagaagaaccacccagagcaccaagcacggcgaggtggacgcctggcccggccagagagagagagccaccgccatcctgctggcctgcagacacctgcccctgagcttcctgagcagccccggccagagagccgtgctgctggccgaggccgccagaaccctggagaaggtgggcgacagaagaagctgcaacgactgccagcagatgatcgtgaagctgggcggcggcaccgccatcgccgccagctag

SEQ ID NO: 101020 - DNA, 900 bp, Artificial Sequence
  Description of Artificial Sequence: Synthetic coding sequence
atggacctggtgctgagagtggccgactactacttcttcaccccctacgtgtaccccgccacctggcccgaggacgacatcttcagacaggccatcagcctgctgatcgtgaccaacgtgggcgcctacatcctgtacttcttctgcgccaccctgagctactacttcgtgttcgaccacgccctgatgaagcacccccagttcctgaagaaccaggtgagaagagagatcaagttcaccgtgcaggccctgccctggatcagcatcctgaccgtggccctgttcctgctggagatcagaggctacagcaagctgcacgacgacctgggcgagttcccctacggcctgttcgagctggtggtgagcatcatcagcttcctgttcttcaccgacatgttcatctactggatccacagaggcctgcaccacagactggtgtacaagagactgcacaagccccaccacatctggaagatccccacccccttcgccagccacgccttccaccccatcgacggcttcctgcagagcctgccctaccacatctaccccttcatcttccccctgcacaaggtggtgtacctgagcctgtacatcctggtgaacatctggaccatcagcatccacgacggcgacttcagagtgccccagatcctgcagcccttcatcaacggcagcgcccaccacaccgaccaccacatgttcttcgactacaactacggccagtacttcaccctgtgggacagaatcggcggcagcttcaagaaccccagcagcttcgagggcaagggccccctgagctacgtgaaggagatgaccgagggcaagagaagcagccacagcggcaacggctgcaagaacgagaagctgttcaacggcgagttcaccaagaccgagtag

SEQ ID NO: 101021 - DNA, 900 bp, Artificial Sequence; identical to SEQ ID NO: 101020
  Description of Artificial Sequence: Synthetic coding sequence

SEQ ID NO: 101022 - DNA, 192 bp, Artificial Sequence
  Description of Artificial Sequence: Synthetic coding sequence
atggagggcgccggcgccggcagcggcttcagaaaggagctggtgagcagactgctgcacctgcacttcaaggacgacaagaccaaggaggccgccgtgagaggcgtgagacaggcccaggccgaggacgccctgagagtggacgtggaccagctggagaaggtgctgccccagctgctgctggacttctag

SEQ ID NO: 101023 - DNA, 246 bp, Artificial Sequence
  Description of Artificial Sequence: Synthetic coding sequence
atggagggcgccggcgccggcagcggcttcagaaaggagctggtgagcagactgctgcacctgcacttcaaggacgacaagaccaaggtgagcggcgacgccctgcagctgatggtggagctgctgaaggtgttcgtggtggaggccgccgtgagaggcgtgagacaggcccaggccgaggacgccctgagagtggacgtggaccagctggagaaggtgctgccccagctgctgctggacttctag

SEQ ID NO: 101024 - DNA, 2121 bp, Artificial Sequence
  Description of Artificial Sequence: Synthetic coding sequence
atgggcggcaagggcggcggcgacaccagaggccccgtgctgttcccctgccagctggcccaggccctgagccccagaagagccttccccagagagctgaaggagaagggccagagaatgagcagccagcccgccggcaaccagaccagccccggcgccaccgaggactacagctacggcagctggtacatcgacgagccccagggcggcgaggagctgcagcccgagggcgaggtgcccagctgccacaccagcatcccccccggcctgtaccacgcctgcctggccagcctgagcatcctggtgctgctgctgctggccatgctggtgagaagaagacagctgtggcccgactgcgtgagaggcagacccggcctgcccagccccgtggacttcctggccggcgacagacccagagccgtgcccgccgccgtgttcatggtgctgctgagcagcctgtgcctgctgctgcccgacgaggacgccctgcccttcctgaccctggccagcgcccccagccaggacggcaagaccgaggcccccagaggcgcctggaagatcctgggcctgttctactacgccgccctgtactaccccctggccgcctgcgccaccgccggccacaccgccgcccacctgctgggcagcaccctgagctgggcccacctgggcgtgcaggtgtggcagagagccgagtgcccccaggtgcccaagatctacaagtactacagcctgctggccagcctgcccctgctgctgggcctgggcttcctgagcctgtggtaccccgtgcagctggtgagaagcttcagcagaagaaccggcgccggcagcaagggcctgcagagcagctacagcgaggagtacctgagaaacctgctgtgcagaaagaagctgggcagcagctaccacaccagcaagcacggcttcctgagctgggccagagtgtgcctgagacactgcatctacaccccccagcccggcttccacctgcccctgaagctggtgctgagcgccaccctgaccggcaccgccatctaccaggtggccctgctgctgctggtgggcgtggtgcccaccatccagaaggtgagagccggcgtgaccaccgacgtgagctacctgctggccggcttcggcatcgtgctgagcgaggacaagcaggaggtggtggagctggtgaagcaccacctgtgggccctggaggtgtgctacatcagcgccctggtgctgagctgcctgctgaccttcctggtgctgatgagaagcctggtgacccacagaaccaacctgagagccctgcacagaggcgccgccctggacctgagccccctgcacagaagcccccaccccagcagacaggccatcttctgctggatgagcttcagcgcctaccagaccgccttcatctgcctgggcctgctggtgcagcagatcatcttcttcctgggcaccaccgccctggccttcctggtgctgatgcccgtgctgcacggcagaaacctgctgctgttcagaagcctggagagcagctggcccttctggctgaccctggccctggccgtgatcctgcagaacatggccgcccactgggtgttcctggagacccacgacggccacccccagctgaccaacagaagagtgctgtacgccgccaccttcctgctgttccccctgaacgtgctggtgggcgccatggtggccacctggagagtgctgctgagcgccctgtacaacgccatccacctgggccagatggacctgagcctgctgccccccagagccgccaccctggaccccggctactacacctacagaaacttcctgaagatcgaggtgagccagagccaccccgccatgaccgccttctgcagcctgctgctgcaggcccagagcctgctgcccagaaccatggccgccccccaggacagcctgagacccggcgaggaggacgagggcatgcagctgctgcagaccaaggacagcatggccaagggcgccagacccggcgccagcagaggcagagccagatggggcctggcctacaccctgctgcacaaccccaccctgcaggtgttcagaaagaccgccctgctgggcgccaacggcgcccagccctag

SEQ ID NO: 101025 - DNA, 2004 bp, Artificial Sequence
  Description of Artificial Sequence: Synthetic coding sequence
atgagcagccagcccgccggcaaccagaccagccccggcgccaccgaggactacagctacggcagctggtacatcgacgagccccagggcggcgaggagctgcagcccgagggcgaggtgcccagctgccacaccagcatcccccccggcctgtaccacgcctgcctggccagcctgagcatcctggtgctgctgctgctggccatgctggtgagaagaagacagctgtggcccgactgcgtgagaggcagacccggcctgcccagccccgtggacttcctggccggcgacagacccagagccgtgcccgccgccgtgttcatggtgctgctgagcagcctgtgcctgctgctgcccgacgaggacgccctgcccttcctgaccctggccagcgcccccagccaggacggcaagaccgaggcccccagaggcgcctggaagatcctgggcctgttctactacgccgccctgtactaccccctggccgcctgcgccaccgccggccacaccgccgcccacctgctgggcagcaccctgagctgggcccacctgggcgtgcaggtgtggcagagagccgagtgcccccaggtgcccaagatctacaagtactacagcctgctggccagcctgcccctgctgctgggcctgggcttcctgagcctgtggtaccccgtgcagctggtgagaagcttcagcagaagaaccggcgccggcagcaagggcctgcagagcagctacagcgaggagtacctgagaaacctgctgtgcagaaagaagctgggcagcagctaccacaccagcaagcacggcttcctgagctgggccagagtgtgcctgagacactgcatctacaccccccagcccggcttccacctgcccctgaagctggtgctgagcgccaccctgaccggcaccgccatctaccaggtggccctgctgctgctggtgggcgtggtgcccaccatccagaaggtgagagccggcgtgaccaccgacgtgagctacctgctggccggcttcggcatcgtgctgagcgaggacaagcaggaggtggtggagctggtgaagcaccacctgtgggccctggaggtgtgctacatcagcgccctggtgctgagctgcctgctgaccttcctggtgctgatgagaagcctggtgacccacagaaccaacctgagagccctgcacagaggcgccgccctggacctgagccccctgcacagaagcccccaccccagcagacaggccatcttctgctggatgagcttcagcgcctaccagaccgccttcatctgcctgggcctgctggtgcagcagatcatcttcttcctgggcaccaccgccctggccttcctggtgctgatgcccgtgctgcacggcagaaacctgctgctgttcagaagcctggagagcagctggcccttctggctgaccctggccctggccgtgatcctgcagaacatggccgcccactgggtgttcctggagacccacgacggccacccccagctgaccaacagaagagtgctgtacgccgccaccttcctgctgttccccctgaacgtgctggtgggcgccatggtggccacctggagagtgctgctgagcgccctgtacaacgccatccacctgggccagatggacctgagcctgctgccccccagagccgccaccctggaccccggctactacacctacagaaacttcctgaagatcgaggtgagccagagccaccccgccatgaccgccttctgcagcctgctgctgcaggcccagagcctgctgcccagaaccatggccgccccccaggacagcctgagacccggcgaggaggacgagggcatgcagctgctgcagaccaaggacagcatggccaagggcgccagacccggcgccagcagaggcagagccagatggggcctggcctacaccctgctgcacaaccccaccctgcaggtgttcagaaagaccgccctgctgggcgccaacggcgcccagccctag

SEQ ID NO: 101026 - DNA, 2004 bp, Artificial Sequence; identical to SEQ ID NO: 101025
  Description of Artificial Sequence: Synthetic coding sequence

SEQ ID NO: 101027 - DNA, 1800 bp, Artificial Sequence
  Description of Artificial Sequence: Synthetic coding sequence
atgctggtgagaagaagacagctgtggcccgactgcgtgagaggcagacccggcctgcccagccccgtggacttcctggccggcgacagacccagagccgtgcccgccgccgtgttcatggtgctgctgagcagcctgtgcctgctgctgcccgacgaggacgccctgcccttcctgaccctggccagcgcccccagccaggacggcaagaccgaggcccccagaggcgcctggaagatcctgggcctgttctactacgccgccctgtactaccccctggccgcctgcgccaccgccggccacaccgccgcccacctgctgggcagcaccctgagctgggcccacctgggcgtgcaggtgtggcagagagccgagtgcccccaggtgcccaagatctacaagtactacagcctgctggccagcctgcccctgctgctgggcctgggcttcctgagcctgtggtaccccgtgcagctggtgagaagcttcagcagaagaaccggcgccggcagcaagggcctgcagagcagctacagcgaggagtacctgagaaacctgctgtgcagaaagaagctgggcagcagctaccacaccagcaagcacggcttcctgagctgggccagagtgtgcctgagacactgcatctacaccccccagcccggcttccacctgcccctgaagctggtgctgagcgccaccctgaccggcaccgccatctaccaggtggccctgctgctgctggtgggcgtggtgcccaccatccagaaggtgagagccggcgtgaccaccgacgtgagctacctgctggccggcttcggcatcgtgctgagcgaggacaagcaggaggtggtggagctggtgaagcaccacctgtgggccctggaggtgtgctacatcagcgccctggtgctgagctgcctgctgaccttcctggtgctgatgagaagcctggtgacccacagaaccaacctgagagccctgcacagaggcgccgccctggacctgagccccctgcacagaagcccccaccccagcagacaggccatcttctgctggatgagcttcagcgcctaccagaccgccttcatctgcctgggcctgctggtgcagcagatcatcttcttcctgggcaccaccgccctggccttcctggtgctgatgcccgtgctgcacggcagaaacctgctgctgttcagaagcctggagagcagctggcccttctggctgaccctggccctggccgtgatcctgcagaacatggccgcccactgggtgttcctggagacccacgacggccacccccagctgaccaacagaagagtgctgtacgccgccaccttcctgctgttccccctgaacgtgctggtgggcgccatggtggccacctggagagtgctgctgagcgccctgtacaacgccatccacctgggccagatggacctgagcctgctgccccccagagccgccaccctggaccccggctactacacctacagaaacttcctgaagatcgaggtgagccagagccaccccgccatgaccgccttctgcagcctgctgctgcaggcccagagcctgctgcccagaaccatggccgccccccaggacagcctgagacccggcgaggaggacgagggcatgcagctgctgcagaccaaggacagcatggccaagggcgccagacccggcgccagcagaggcagagccagatggggcctggcctacaccctgctgcacaaccccaccctgcaggtgttcagaaagaccgccctgctgggcgccaacggcgcccagccctag

SEQ ID NO: 101028 - DNA, 1977 bp, Artificial Sequence
  Description of Artificial Sequence: Synthetic coding sequence
atgagcagccagcccgccggcaaccagaccagccccggcgccaccgaggactacagctacggcagctggtacatcgacgagccccagggcggcgaggagctgcagcccgagggcgaggtgcccagctgccacaccagcatcccccccggcctgtaccacgcctgcctggccagcctgagcatcctggtgctgctgctgctggccatgctggtgagaagaagacagctgtggcccgactgcgtgagaggcagacccggcctgcccagacccagagccgtgcccgccgccgtgttcatggtgctgctgagcagcctgtgcctgctgctgcccgacgaggacgccctgcccttcctgaccctggccagcgcccccagccaggacggcaagaccgaggcccccagaggcgcctggaagatcctgggcctgttctactacgccgccctgtactaccccctggccgcctgcgccaccgccggccacaccgccgcccacctgctgggcagcaccctgagctgggcccacctgggcgtgcaggtgtggcagagagccgagtgcccccaggtgcccaagatctacaagtactacagcctgctggccagcctgcccctgctgctgggcctgggcttcctgagcctgtggtaccccgtgcagctggtgagaagcttcagcagaagaaccggcgccggcagcaagggcctgcagagcagctacagcgaggagtacctgagaaacctgctgtgcagaaagaagctgggcagcagctaccacaccagcaagcacggcttcctgagctgggccagagtgtgcctgagacactgcatctacaccccccagcccggcttccacctgcccctgaagctggtgctgagcgccaccctgaccggcaccgccatctaccaggtggccctgctgctgctggtgggcgtggtgcccaccatccagaaggtgagagccggcgtgaccaccgacgtgagctacctgctggccggcttcggcatcgtgctgagcgaggacaagcaggaggtggtggagctggtgaagcaccacctgtgggccctggaggtgtgctacatcagcgccctggtgctgagctgcctgctgaccttcctggtgctgatgagaagcctggtgacccacagaaccaacctgagagccctgcacagaggcgccgccctggacctgagccccctgcacagaagcccccaccccagcagacaggccatcttctgctggatgagcttcagcgcctaccagaccgccttcatctgcctgggcctgctggtgcagcagatcatcttcttcctgggcaccaccgccctggccttcctggtgctgatgcccgtgctgcacggcagaaacctgctgctgttcagaagcctggagagcagctggcccttctggctgaccctggccctggccgtgatcctgcagaacatggccgcccactgggtgttcctggagacccacgacggccacccccagctgaccaacagaagagtgctgtacgccgccaccttcctgctgttccccctgaacgtgctggtgggcgccatggtggccacctggagagtgctgctgagcgccctgtacaacgccatccacctgggccagatggacctgagcctgctgccccccagagccgccaccctggaccccggctactacacctacagaaacttcctgaagatcgaggtgagccagagccaccccgccatgaccgccttctgcagcctgctgctgcaggcccagagcctgctgcccagaaccatggccgccccccaggacagcctgagacccggcgaggaggacgagggcatgcagctgctgcagaccaaggacagcatggccaagggcgccagacccggcgccagcagaggcagagccagatggggcctggcctacaccctgctgcacaaccccaccctgcaggtgttcagaaagaccgccctgctgggcgccaacggcgcccagccctag

SEQ ID NO: 101029 - DNA, 480 bp, Artificial Sequence
  Description of Artificial Sequence: Synthetic coding sequence
atgagcagccagcccgccggcaaccagaccagccccggcgccaccgaggactacagctacggcagctggtacatcgacgagccccagggcggcgaggagctgcagcccgagggcgaggtgcccagctgccacaccagcatcccccccggcctgtaccacgcctgcctggccagcctgagcatcctggtgctgctgctgctggccatgctggtgagaagaagacagctgtggcccgactgcgtgagaggcagacccggcctgcccagccccgtggacttcctggccggcgacagacccagagccgtgcccgccgccgtgttcatggtgctgctgagcagcctgtgcctgctgctgcccgacgaggacgccctgcccttcctgaccctggccagcgcccccagccaggacggcaagaccgaggcccccagaggcaacctgcccaagatcaccgagctgagactggtgagagcctggatctag

SEQ ID NO: 101030 - DNA, 2121 bp, Artificial Sequence; identical to SEQ ID NO: 101024
  Description of Artificial Sequence: Synthetic coding sequence

SEQ ID NO: 101031 - DNA, 2115 bp, Artificial Sequence
  Description of Artificial Sequence: Synthetic coding sequence
atgcagatcagactgctgagagccgagctggtggtgcccctgtggcagttcatcagacagtggccccccggcagcgacggctggggccagatggaggagaagggccagagaatgagcagccagcccgccggcaaccagaccagccccggcgccaccgaggactacagctacggcagctggtacatcgacgagccccagggcggcgaggagctgcagcccgagggcgaggtgcccagctgccacaccagcatcccccccggcctgtaccacgcctgcctggccagcctgagcatcctggtgctgctgctgctggccatgctggtgagaagaagacagctgtggcccgactgcgtgagaggcagacccggcctgcccagccccgtggacttcctggccggcgacagacccagagccgtgcccgccgccgtgttcatggtgctgctgagcagcctgtgcctgctgctgcccgacgaggacgccctgcccttcctgaccctggccagcgcccccagccaggacggcaagaccgaggcccccagaggcgcctggaagatcctgggcctgttctactacgccgccctgtactaccccctggccgcctgcgccaccgccggccacaccgccgcccacctgctgggcagcaccctgagctgggcccacctgggcgtgcaggtgtggcagagagccgagtgcccccaggtgcccaagatctacaagtactacagcctgctggccagcctgcccctgctgctgggcctgggcttcctgagcctgtggtaccccgtgcagctggtgagaagcttcagcagaagaaccggcgccggcagcaagggcctgcagagcagctacagcgaggagtacctgagaaacctgctgtgcagaaagaagctgggcagcagctaccacaccagcaagcacggcttcctgagctgggccagagtgtgcctgagacactgcatctacaccccccagcccggcttccacctgcccctgaagctggtgctgagcgccaccctgaccggcaccgccatctaccaggtggccctgctgctgctggtgggcgtggtgcccaccatccagaaggtgagagccggcgtgaccaccgacgtgagctacctgctggccggcttcggcatcgtgctgagcgaggacaagcaggaggtggtggagctggtgaagcaccacctgtgggccctggaggtgtgctacatcagcgccctggtgctgagctgcctgctgaccttcctggtgctgatgagaagcctggtgacccacagaaccaacctgagagccctgcacagaggcgccgccctggacctgagccccctgcacagaagcccccaccccagcagacaggccatcttctgctggatgagcttcagcgcctaccagaccgccttcatctgcctgggcctgctggtgcagcagatcatcttcttcctgggcaccaccgccctggccttcctggtgctgatgcccgtgctgcacggcagaaacctgctgctgttcagaagcctggagagcagctggcccttctggctgaccctggccctggccgtgatcctgcagaacatggccgcccactgggtgttcctggagacccacgacggccacccccagctgaccaacagaagagtgctgtacgccgccaccttcctgctgttccccctgaacgtgctggtgggcgccatggtggccacctggagagtgctgctgagcgccctgtacaacgccatccacctgggccagatggacctgagcctgctgccccccagagccgccaccctggaccccggctactacacctacagaaacttcctgaagatcgaggtgagccagagccaccccgccatgaccgccttctgcagcctgctgctgcaggcccagagcctgctgcccagaaccatggccgccccccaggacagcctgagacccggcgaggaggacgagggcatgcagctgctgcagaccaaggacagcatggccaagggcgccagacccggcgccagcagaggcagagccagatggggcctggcctacaccctgctgcacaaccccaccctgcaggtgttcagaaagaccgccctgctgggcgccaacggcgcccagccctag

SEQ ID NO: 101032 - DNA, 1674 bp, Artificial Sequence
  Description of Artificial Sequence: Synthetic coding sequence
atggccgccggcaccagcatgagccccgacgaggacgccctgcccttcctgaccctggccagcgcccccagccaggacggcaagaccgaggcccccagaggcgcctggaagatcctgggcctgttctactacgccgccctgtactaccccctggccgcctgcgccaccgccggccacaccgccgcccacctgctgggcagcaccctgagctgggcccacctgggcgtgcaggtgtggcagagagccgagtgcccccaggtgcccaagatctacaagtactacagcctgctggccagcctgcccctgctgctgggcctgggcttcctgagcctgtggtaccccgtgcagctggtgagaagcttcagcagaagaaccggcgccggcagcaagggcctgcagagcagctacagcgaggagtacctgagaaacctgctgtgcagaaagaagctgggcagcagctaccacaccagcaagcacggcttcctgagctgggccagagtgtgcctgagacactgcatctacaccccccagcccggcttccacctgcccctgaagctggtgctgagcgccaccctgaccggcaccgccatctaccaggtggccctgctgctgctggtgggcgtggtgcccaccatccagaaggtgagagccggcgtgaccaccgacgtgagctacctgctggccggcttcggcatcgtgctgagcgaggacaagcaggaggtggtggagctggtgaagcaccacctgtgggccctggaggtgtgctacatcagcgccctggtgctgagctgcctgctgaccttcctggtgctgatgagaagcctggtgacccacagaaccaacctgagagccctgcacagaggcgccgccctggacctgagccccctgcacagaagcccccaccccagcagacaggccatcttctgctggatgagcttcagcgcctaccagaccgccttcatctgcctgggcctgctggtgcagcagatcatcttcttcctgggcaccaccgccctggccttcctggtgctgatgcccgtgctgcacggcagaaacctgctgctgttcagaagcctggagagcagctggcccttctggctgaccctggccctggccgtgatcctgcagaacatggccgcccactgggtgttcctggagacccacgacggccacccccagctgaccaacagaagagtgctgtacgccgccaccttcctgctgttccccctgaacgtgctggtgggcgccatggtggccacctggagagtgctgctgagcgccctgtacaacgccatccacctgggccagatggacctgagcctgctgccccccagagccgccaccctggaccccggctactacacctacagaaacttcctgaagatcgaggtgagccagagccaccccgccatgaccgccttctgcagcctgctgctgcaggcccagagcctgctgcccagaaccatggccgccccccaggacagcctgagacccggcgaggaggacgagggcatgcagctgctgcagaccaaggacagcatggccaagggcgccagacccggcgccagcagaggcagagccagatggggcctggcctacaccctgctgcacaaccccaccctgcaggtgttcagaaagaccgccctgctgggcgccaacggcgcccagccctag

SEQ ID NO: 101033 - DNA, 1431 bp, Artificial Sequence
  Description of Artificial Sequence: Synthetic coding sequence
atgggcaagctgagactgcaggagatctacaagtactacagcctgctggccagcctgcccctgctgctgggcctgggcttcctgagcctgtggtaccccgtgcagctggtgagaagcttcagcagaagaaccggcgccggcagcaagggcctgcagagcagctacagcgaggagtacctgagaaacctgctgtgcagaaagaagctgggcagcagctaccacaccagcaagcacggcttcctgagctgggccagagtgtgcctgagacactgcatctacaccccccagcccggcttccacctgcccctgaagctggtgctgagcgccaccctgaccggcaccgccatctaccaggtggccctgctgctgctggtgggcgtggtgcccaccatccagaaggtgagagccggcgtgaccaccgacgtgagctacctgctggccggcttcggcatcgtgctgagcgaggacaagcaggaggtggtggagctggtgaagcaccacctgtgggccctggaggtgtgctacatcagcgccctggtgctgagctgcctgctgaccttcctggtgctgatgagaagcctggtgacccacagaaccaacctgagagccctgcacagaggcgccgccctggacctgagccccctgcacagaagcccccaccccagcagacaggccatcttctgctggatgagcttcagcgcctaccagaccgccttcatctgcctgggcctgctggtgcagcagatcatcttcttcctgggcaccaccgccctggccttcctggtgctgatgcccgtgctgcacggcagaaacctgctgctgttcagaagcctggagagcagctggcccttctggctgaccctggccctggccgtgatcctgcagaacatggccgcccactgggtgttcctggagacccacgacggccacccccagctgaccaacagaagagtgctgtacgccgccaccttcctgctgttccccctgaacgtgctggtgggcgccatggtggccacctggagagtgctgctgagcgccctgtacaacgccatccacctgggccagatggacctgagcctgctgccccccagagccgccaccctggaccccggctactacacctacagaaacttcctgaagatcgaggtgagccagagccaccccgccatgaccgccttctgcagcctgctgctgcaggcccagagcctgctgcccagaaccatggccgccccccaggacagcctgagacccggcgaggaggacgagggcatgcagctgctgcagaccaaggacagcatggccaagggcgccagacccggcgccagcagaggcagagccagatggggcctggcctacaccctgctgcacaaccccaccctgcaggtgttcagaaagaccgccctgctgggcgccaacggcgcccagccctag

SEQ ID NO: 101034 - DNA, 993 bp, Artificial Sequence
  Description of Artificial Sequence: Synthetic coding sequence
atgggcaagatcgacgtggacaagatcctgttcttcaaccaggagatcagactgtggcagctgatcatggccacccccgaggagaacagcaacccccacgacagagccaccccccagctgcccgcccagctgcaggagctggagcacagagtggccagaagaagactgagccaggccagacacagagccaccctggccgccctgttcaacaacctgagaaagaccgtgtacagccagagcgacctgatcgccagcaagtggcaggtgctgaacaaggccaagagccacatccccgagctggagcagaccctggacaacctgctgaagctgaaggccagcttcaacctggaggacggccacgccagcagcctggaggaggtgaagaaggagtacgccagcatgtacagcggcaacgacagcttcccccagaacggcagcagcccctggtacctgaacttctacaagcagaccatggacctgctgaccggcagcggcatcatcaccccccaggaggccgccctgcccatcgtgagcgccgccatcagccacctgtggcagaacctgagcgaggagagaaaggccagcctgagacaggcctgggcccagaagcacagaggccccgccaccctggccgaggcctgcagagagcccgcctgcgccgagggcagcgtgaaggacagcggcgtggacagccagggcgccagctgcagcctggtgagcacccccgaggagatcctgttcgaggacgccttcgacgtggccagcttcctggacaagagcgaggtgcccagcaccagcagcagcagcagcgtgctggccagctgcaaccccgagaaccccgaggagaagttccagctgtacatgcagatcatcaacttcttcaagggcctgagctgcgccaacacccaggtgaagcaggaggccagcttccccgtggacgaggagatgatcatgctgcagtgcaccgagaccttcgacgacgaggacctgtag

SEQ ID NO: 101035 - DNA, 882 bp, Artificial Sequence
  Description of Artificial Sequence: Synthetic coding sequence
atgggcttccccgccgccgccctgctgtgcgccctgtgctgcggcctgctggcccccgccgccagagccggctacagcgaggagagatgcagctggagaggcagcggcctgacccaggagcccggcagcgtgggccagctggccctggcctgcgccgagggcgccgtggagtggctgtaccccgccggcgccctgagactgaccctgggcggccccgaccccagagccagacccggcatcgcctgcctgagacccgtgagacccttcgccggcgcccaggtgttcgccgagagagccggcggcgccctggagctgctgctggccgagggccccggccccgccggcggcagatgcgtgagatggggccccagagagagaagagccctgttcctgcaggccaccccccaccaggacatcagcagaagagtggccgccttcagattcgagctgagagaggacggcagacccgagctgcccccccaggcccacggcctgggcgtggacggcgcctgcagaccctgcagcgacgccgagctgctgctggccgcctgcaccagcgacttcgtgatccacggcatcatccacggcgtgacccacgacgtggagctgcaggagagcgtgatcaccgtggtggccgccagagtgctgagacagaccccccccctgttccaggccggcagaagcggcgaccagggcctgaccagcatcagaacccccctgagatgcggcgtgcaccccggccccggcaccttcctgttcatgggctggagcagattcggcgaggccagactgggctgcgcccccagattccaggagttcagaagagcctacgaggccgccagagccgcccacctgcacccctgcgaggtggccctgcactag

SEQ ID NO: 101036 - DNA, 1197 bp, Artificial Sequence
  Description of Artificial Sequence: Synthetic coding sequence
atgctgggcagaagcggctacagagccctgcccctgggcgacttcgacagattccagcagagcagcttcggcttcctgggcagccagaagggctgcctgagccccgagagaggcggcgtgggcaccggcgccgacgtgccccagagctggcccagctgcctgtgccacggcctgatcagcttcctgggcttcctgctgctgctggtgaccttccccatcagcggctggttcgccctgaagatcgtgcccacctacgagagaatgatcgtgttcagactgggcagaatcagaaccccccagggccccggcatggtgctgctgctgcccttcatcgacagcttccagagagtggacctgagaaccagagccttcaacgtgcccccctgcaagctggccagcaaggacggcgccgtgctgagcgtgggcgccgacgtgcagttcagaatctgggaccccgtgctgagcgtgatgaccgtgaaggacctgaacaccgccaccagaatgaccgcccagaacgccatgaccaaggccctgctgaagagacccctgagagagatccagatggagaagctgaagatcagcgaccagctgctgctggagatcaacgacgtgaccagagcctggggcctggaggtggacagagtggagctggccgtggaggccgtgctgcagcccccccaggacagccccgccggccccaacctggacagcaccctgcagcagctggccctgcacttcctgggcggcagcatgaacagcatggccggcggcgcccccagccccggccccgccgacaccgtggagatggtgagcgaggtggagccccccgccccccaggtgggcgccagaagcagccccaagcagcccctggccgagggcctgctgaccgccctgcagcccttcctgagcgaggccctggtgagccaggtgggcgcctgctaccagttcaacgtggtgctgcccagcggcacccagagcgcctacttcctggacctgaccaccggcagaggcagagtgggccacggcgtgcccgacggcatccccgacgtggtggtggagatggccgaggccgacctgagagccctgctgtgcagagagctgagacccctgggcgcctacatgagcggcagactgaaggtgaagggcgacctggccatggccatgaagctggaggccgtgctgagagccctgaagtag

SEQ ID NO: 101037 - DNA, 1047 bp, Artificial Sequence
  Description of Artificial Sequence: Synthetic coding sequence
atgctgggcagaagcggctacagagccctgcccctgggcgacttcgacagattccagcagagcagcttcggcttcctgggcagccagaagggctgcctgagccccgagagaggcggcgtgggcaccggcgccgacgtgccccagagctggcccagctgcctgtgccacggcctgatcagcttcctgggcttcctgctgctgctggtgaccttccccatcagcggctggttcgccctgaagctggccagcaaggacggcgccgtgctgagcgtgggcgccgacgtgcagttcagaatctgggaccccgtgctgagcgtgatgaccgtgaaggacctgaacaccgccaccagaatgaccgcccagaacgccatgaccaaggccctgctgaagagacccctgagagagatccagatggagaagctgaagatcagcgaccagctgctgctggagatcaacgacgtgaccagagcctggggcctggaggtggacagagtggagctggccgtggaggccgtgctgcagcccccccaggacagccccgccggccccaacctggacagcaccctgcagcagctggccctgcacttcctgggcggcagcatgaacagcatggccggcggcgcccccagccccggccccgccgacaccgtggagatggtgagcgaggtggagccccccgccccccaggtgggcgccagaagcagccccaagcagcccctggccgagggcctgctgaccgccctgcagcccttcctgagcgaggccctggtgagccaggtgggcgcctgctaccagttcaacgtggtgctgcccagcggcacccagagcgcctacttcctggacctgaccaccggcagaggcagagtgggccacggcgtgcccgacggcatccccgacgtggtggtggagatggccgaggccgacctgagagccctgctgtgcagagagctgagacccctgggcgcctacatgagcggcagactgaaggtgaagggcgacctggccatggccatgaagctggaggccgtgctgagagccctgaagtag

SEQ ID NO: 101038 - DNA, 984 bp, Artificial Sequence
  Description of Artificial Sequence: Synthetic coding sequence
atgctgggcagaagcggctacagagccctgcccctgggcgacttcgacagattccagcagagcagcttcggcttcctgggcagccagaagggctgcctgagccccgagagaggcggcgtgggcaccggcgccgacgtgccccagagctggcccagctgcctgtgccacggcctgatcagcttcctgggcttcctgctgctgctggtgaccttccccatcagcggctggttcgccctgaagatcgtgcccacctacgagagaatgatcgtgttcagactgggcagaatcagaaccccccagggccccggcatggtgctgctgctgcccttcatcgacagcttccagagagtggacctgagaaccagagccttcaacgtgcccccctgcaagctggccagcaaggacggcgccgtgctgagcgtgggcgccgacgtgcagttcagaatctgggaccccgtgctgagcgtgatgaccgtgaaggacctgaacaccgccaccagaatgaccgcccagaacgccatgaccaaggccctgctgaagagacccctgagagagatccagatggagaagctgaagatcagcgaccagctgctgctggagatcaacgacgtgaccagagcctggggcctggaggtggacagagtggagctggccgtggaggccgtgctgcagcccccccaggacagccccgccggccccaacctggacagcaccctgcagcagctggccctgcacttcctgggcggcagcatgaacagcatggccggcggcgcccccagccccggccccggcagaggcagagtgggccacggcgtgcccgacggcatccccgacgtggtggtggagatggccgaggccgacctgagagccctgctgtgcagagagctgagacccctgggcgcctacatgagcggcagactgaaggtgaagggcgacctggccatggccatgaagctggaggccgtgctgagagccctgaagtag

SEQ ID NO: 101039 - DNA, 1068 bp, Artificial Sequence
  Description of Artificial Sequence: Synthetic coding sequence
atgcccgacgtgccccagagctggcccagctgcctgtgccacggcctgatcagcttcctgggcttcctgctgctgctggtgaccttccccatcagcggctggttcgccctgaagatcgtgcccacctacgagagaatgatcgtgttcagactgggcagaatcagaaccccccagggccccggcatggtgctgctgctgcccttcatcgacagcttccagagagtggacctgagaaccagagccttcaacgtgcccccctgcaagctggccagcaaggacggcgccgtgctgagcgtgggcgccgacgtgcagttcagaatctgggaccccgtgctgagcgtgatgaccgtgaaggacctgaacaccgccaccagaatgaccgcccagaacgccatgaccaaggccctgctgaagagacccctgagagagatccagatggagaagctgaagatcagcgaccagctgctgctggagatcaacgacgtgaccagagcctggggcctggaggtggacagagtggagctggccgtggaggccgtgctgcagcccccccaggacagccccgccggccccaacctggacagcaccctgcagcagctggccctgcacttcctgggcggcagcatgaacagcatggccggcggcgcccccagccccggccccgacaccgtggagatggtgagcgaggtggagccccccgccccccaggtgggcgccagaagcagccccaagcagcccctggccgagggcctgctgaccgccctgcagcccttcctgagcgaggccctggtgagccaggtgggcgcctgctaccagttcaacgtggtgctgcccagcggcacccagagcgcctacttcctggacctgaccaccggcagaggcagagtgggccacggcgtgcccgacggcatccccgacgtggtggtggagatggccgaggccgacctgagagccctgctgtgcagagagctgagacccctgggcgcctacatgagcggcagactgaaggtgaagggcgacctggccatggccatgaagctggaggccgtgctgagagccctgaagtag

SEQ ID NO: 101040 - DNA, 933 bp, Artificial Sequence
  Description of Artificial Sequence: Synthetic coding sequence
atgatcgtgttcagactgggcagaatcagaaccccccagggccccggcatggtgctgctgctgcccttcatcgacagcttccagagagtggacctgagaaccagagccttcaacgtgcccccctgcaagctggccagcaaggacggcgccgtgctgagcgtgggcgccgacgtgcagttcagaatctgggaccccgtgctgagcgtgatgaccgtgaaggacctgaacaccgccaccagaatgaccgcccagaacgccatgaccaaggccctgctgaagagacccctgagagagatccagatggagaagctgaagatcagcgaccagctgctgctggagatcaacgacgtgaccagagcctggggcctggaggtggacagagtggagctggccgtggaggccgtgctgcagcccccccaggacagccccgccggccccaacctggacagcaccctgcagcagctggccctgcacttcctgggcggcagcatgaacagcatggccggcggcgcccccagccccggccccgacaccgtggagatggtgagcgaggtggagccccccgccccccaggtgggcgccagaagcagccccaagcagcccctggccgagggcctgctgaccgccctgcagcccttcctgagcgaggccctggtgagccaggtgggcgcctgctaccagttcaacgtggtgctgcccagcggcacccagagcgcctacttcctggacctgaccaccggcagaggcagagtgggccacggcgtgcccgacggcatccccgacgtggtggtggagatggccgaggccgacctgagagccctgctgtgcagagagctgagacccctgggcgcctacatgagcggcagactgaaggtgaagggcgacctggccatggccatgaagctggaggccgtgctgagagccctgaagtag

SEQ ID NO: 101041 - DNA, 1044 bp, Artificial Sequence
  Description of Artificial Sequence: Synthetic coding sequence
atgctgggcagaagcggctacagagccctgcccctgggcgacttcgacagattccagcagagcagcttcggcttcctgggcagccagaagggctgcctgagccccgagagaggcggcgtgggcaccggcgccgacgtgccccagagctggcccagctgcctgtgccacggcctgatcagcttcctgggcttcctgctgctgctggtgaccttccccatcagcggctggttcgccctgaagctggccagcaaggacggcgccgtgctgagcgtgggcgccgacgtgcagttcagaatctgggaccccgtgctgagcgtgatgaccgtgaaggacctgaacaccgccaccagaatgaccgcccagaacgccatgaccaaggccctgctgaagagacccctgagagagatccagatggagaagctgaagatcagcgaccagctgctgctggagatcaacgacgtgaccagagcctggggcctggaggtggacagagtggagctggccgtggaggccgtgctgcagcccccccaggacagccccgccggccccaacctggacagcaccctgcagcagctggccctgcacttcctgggcggcagcatgaacagcatggccggcggcgcccccagccccggccccgacaccgtggagatggtgagcgaggtggagccccccgccccccaggtgggcgccagaagcagccccaagcagcccctggccgagggcctgctgaccgccctgcagcccttcctgagcgaggccctggtgagccaggtgggcgcctgctaccagttcaacgtggtgctgcccagcggcacccagagcgcctacttcctggacctgaccaccggcagaggcagagtgggccacggcgtgcccgacggcatccccgacgtggtggtggagatggccgaggccgacctgagagccctgctgtgcagagagctgagacccctgggcgcctacatgagcggcagactgaaggtgaagggcgacctggccatggccatgaagctggaggccgtgctgagagccctgaagtag

SEQ ID NO: 101042 - DNA, 1071 bp, Artificial Sequence
  Description of Artificial Sequence: Synthetic coding sequence
atgctggccagagccgccagaggcaccggcgccctgctgctgagaggcagcctgctggccagcggcagagcccccagaagagccagcagcggcctgcccagaaacaccgtggtgctgttcgtgccccagcaggaggcctgggtggtggagagaatgggcagattccacagaatcctggagcccggcctgaacatcctgatccccgtgctggacagaatcagatacgtgcagagcctgaaggagatcgtgatcaacgtgcccgagcagagcgccgtgaccctggacaacgtgaccctgcagatcgacggcgtgctgtacctgagaatcatggacccctacaaggccagctacggcgtggaggaccccgagtacgccgtgacccagctggcccagaccaccatgagaagcgagctgggcaagctgagcctggacaaggtgttcagagagagagagagcctgaacgccagcatcgtggacgccatcaaccaggccgccgactgctggggcatcagatgcctgagatacgagatcaaggacatccacgtgccccccagagtgaaggagagcatgcagatgcaggtggaggccgagagaagaaagagagccaccgtgctggagagcgagggcaccagagagagcgccatcaacgtggccgagggcaagaagcaggcccagatcctggccagcgaggccgagaaggccgagcagatcaaccaggccgccggcgaggccagcgccgtgctggccaaggccaaggccaaggccgaggccatcagaatcctggccgccgccctgacccagcacaacggcgacgccgccgccagcctgaccgtggccgagcagtacgtgagcgccttcagcaagctggccaaggacagcaacaccatcctgctgcccagcaaccccggcgacgtgaccagcatggtggcccaggccatgggcgtgtacggcgccctgaccaaggcccccgtgcccggcacccccgacagcctgagcagcggcagcagcagagacgtgcagggcaccgacgccagcctggacgaggagctggacagagtgaagatgagctag

SEQ ID NO: 101043 - DNA, 936 bp, Artificial Sequence
  Description of Artificial Sequence: Synthetic coding sequence
atgctggccagagccgccagaggcaccggcgccctgctgctgagaggcagcctgctggccagcggcagagcccccagaagagccagcagcggcctgcccagaaacaccgtggtgctgttcgtgccccagcaggaggcctgggtggtggagagaatgggcagattccacagaatcctggagcccggcctgaacatcctgatccccgtgctggacagaatcagatacgtgcagagcctgaaggagatcgtgatcaacgtgcccgagcagagcgccgtgaccctggacaacgtgaccctgcagatcgacggcgtgctgtacctgagaatcatggacccctacaaggccagctacggcgtggaggaccccgagtacgccgtgacccagctggcccagaccaccatgagaagcgagctgggcaagctgagcctggacaaggtgttcagagtggaggccgagagaagaaagagagccaccgtgctggagagcgagggcaccagagagagcgccatcaacgtggccgagggcaagaagcaggcccagatcctggccagcgaggccgagaaggccgagcagatcaaccaggccgccggcgaggccagcgccgtgctggccaaggccaaggccaaggccgaggccatcagaatcctggccgccgccctgacccagcacaacggcgacgccgccgccagcctgaccgtggccgagcagtacgtgagcgccttcagcaagctggccaaggacagcaacaccatcctgctgcccagcaaccccggcgacgtgaccagcatggtggcccaggccatgggcgtgtacggcgccctgaccaaggcccccgtgcccggcacccccgacagcctgagcagcggcagcagcagagacgtgcagggcaccgacgccagcctggacgaggagctggacagagtgaagatgagctag

SEQ ID NO: 101044 - DNA, 876 bp, Artificial Sequence
  Description of Artificial Sequence: Synthetic coding sequence
atggacagcagagtgagcagccccgagaagcaggacaaggagaacttcgtgggcgtgaacaacaagagactgggcgtgtgcggctggatcctgttcagcctgagcttcctgctggtgatcatcaccttccccatcagcatctggatgtgcctgaagatcatcaaggagtacgagagagccgtggtgttcagactgggcagaatccaggccgacaaggccaagggccccggcctgatcctggtgctgccctgcatcgacgtgttcgtgaaggtggacctgagaaccgtgacctgcaacatccccccccaggagatcctgaccagagacagcgtgaccacccaggtggacggcgtggtgtactacagaatctacagcgccgtgagcgccgtggccaacgtgaacgacgtgcaccaggccaccttcctgctggcccagaccaccctgagaaacgtgctgggcacccagaccctgagccagatcctggccggcagagaggagatcgcccacagcatccagaccctgctggacgacgccaccgagctgtggggcatcagagtggccagagtggagatcaaggacgtgagaatccccgtgcagctgcagagaagcatggccgccgaggccgaggccaccagagaggccagagccaaggtgctggccgccgagggcgagatgaacgccagcaagagcctgaagagcgccagcatggtgctggccgagagccccatcgccctgcagctgagatacctgcagaccctgagcaccgtggccaccgagaagaacagcaccatcgtgttccccctgcccatgaacatcctggagggcatcggcggcgtgagctacgacaaccacaagaagctgcccaacaaggcctag

SEQ ID NO: 101045 - DNA, 849 bp, Artificial Sequence
  Description of Artificial Sequence: Synthetic coding sequence
atgaacagcagaggcgagctggtgggcgtgaacaacaagagactgggcgtgtgcggctggatcctgttcagcctgagcttcctgctggtgatcatcaccttccccatcagcatctggatgtgcctgaagatcatcaaggagtacgagagagccgtggtgttcagactgggcagaatccaggccgacaaggccaagggccccggcctgatcctggtgctgccctgcatcgacgtgttcgtgaaggtggacctgagaaccgtgacctgcaacatccccccccaggagatcctgaccagagacagcgtgaccacccaggtggacggcgtggtgtactacagaatctacagcgccgtgagcgccgtggccaacgtgaacgacgtgcaccaggccaccttcctgctggcccagaccaccctgagaaacgtgctgggcacccagaccctgagccagatcctggccggcagagaggagatcgcccacagcatccagaccctgctggacgacgccaccgagctgtggggcatcagagtggccagagtggagatcaaggacgtgagaatccccgtgcagctgcagagaagcatggccgccgaggccgaggccaccagagaggccagagccaaggtgctggccgccgagggcgagatgaacgccagcaagagcctgaagagcgccagcatggtgctggccgagagccccatcgccctgcagctgagatacctgcagaccctgagcaccgtggccaccgagaagaacagcaccatcgtgttccccctgcccatgaacatcctggagggcatcggcggcgtgagctacgacaaccacaagaagctgcccaacaaggcctag

SEQ ID NO: 101046 - DNA, 2970 bp, Artificial Sequence
  Description of Artificial Sequence: Synthetic coding sequence
atggccagacccgtgcagctggcccccggcagcctggccctggtgctgtgcagactggaggcccagaaggccgccggcgccgccgaggagcccggcggcagagccgtgttcagagccttcagaagagccaacgccagatgcttctggaacgccagactggccagagccgccagcagactggccttccagggctggctgagaagaggcgtgctgctggtgagagccccccccgcctgcctgcaggtgctgagagacgcctggagaagaagagccctgagaccccccagaggcttcagaatcagagccgtgggcgacgtgttccccgtgcagatgaaccccatcacccagagccagttcgtgcccctgggcgaggtgctgtgctgcgccatcagcgacatgaacaccgcccagatcgtggtgacccaggagagcctgctggagagactgatgaagcactaccccggcatcgccatccccagcgaggacatcctgtacaccaccctgggcaccctgatcaaggagagaaagatctaccacaccggcgagggctacttcatcgtgaccccccagacctacttcatcaccaacaccaccacccaggagaacaagagaatgctgcccagcgacgagagcagactgatgcccgccagcatgacctacctggtgagcatggagagctgcgccgagagcgcccaggagaacgccgcccccatcagccactgccagagctgccagtgcttcagagacatgcacacccaggacgtgcaggaggcccccgtggccgccgaggtgaccagaaagagccacagaggcctgggcgagagcgtgagctgggtgcagaacggcgccgtgagcgtgagcgccgagcaccacatctgcgagagcaccaagcccctgccctacaccagagacaaggagaagggcaagaagttcggcttcagcctgctgtggagaagcctgagcagaaaggagaagcccaagaccgagcacagcagcttcagcgcccagttcccccccgaggagtggcccgtgagagacgaggacgacctggacaacatccccagagacgtggagcacgagatcatcaagagaatcaaccccatcctgaccgtggacaacctgatcaagcacaccgtgctgatgcagaagtacgaggagcagaagaagtacaacagccagggcaccagcaccgacatgctgaccatcggccacaagtaccccagcaaggagggcgtgaagaagagacagggcctgagcgccaagccccagggccagggccacagcagaagagacagacacaaggccagaaaccagggcagcgagttccagcccggcagcatcagactggagaagcaccccaagctgcccgccacccagcccatccccagaatcaagagccccaacgagatggtgggccagaagcccctgggcgagatcaccaccgtgctgggcagccacctgatctacaagaagagaatcagcaaccccttccagggcctgagccacagaggcagcaccatcagcaagggccacaagatccagaagaccagcgacctgaagcccagccagaccggccccaaggagaagcccttccagaagcccagaagcctggacagcagcagaatcttcgacggcaaggccaaggagccctacgccgagcagcccaacgacaagatggaggccgagagcatctacatcaacgaccccaccgtgaagcccatcaacgacgacttcagaggccacctgttcagccacccccagcagagcatgctgcagaacgacggcaagtgctgccccttcatggagagcatgctgagatacgaggtgtacggcggcgagaacgaggtgatccccgaggtgctgagaaagagccacagccacttcgacaagctgggcgagaccaagcagaccccccacagcctgcccagcagaggcgccagcttcagcgacagaacccccagcgcctgcagactggtggacaacaccatccaccagttccagaacctgggcctgctggactaccccgtgggcgtgaaccccctgagacaggccgccagacaggacaaggacagcgaggagctgctgagaaagggcttcgtgcaggacgccgagaccaccagcctggagaacgagcagctgagcaacgacgaccaggccctgtaccagaacgaggtggaggacgacgacggcgcctgcagcagcctgtacctggaggaggacgacatcagcgagaacgacgacctgagacagatgctgcccggccacagccagtacagcttcaccggcggcagccagggcaaccacctgggcaagcagaaggtgatcgagagaagcctgaccgagtacaacagcaccatggagagagtggagagccaggtgctgaagagaaacgagtgctacaagcccaccggcctgcacgccacccccggcgagagccaggagcccaacctgagcgccgagagctgcggcctgaacagcggcgcccagttcggcttcaactacgaggaggagcccagcgtggccaagtgcgtgcaggccagcgcccccgccgacgagagaatcttcgactactacagcgccagaaaggccagcttcgaggccgaggtgatccaggacaccatcggcgacaccggcaagaagcccgccagctggagccagagcccccagaaccaggagatgagaaagcacttcccccagaagttccagctgttcaacaccagccacatgcccgtgctggcccaggacgtgcagtacgagcacagccacctggagggcaccgagaaccacagcatggccggcgacagcggcatcgacagccccagaacccagagcctgggcagcaacaacagcgtgatcctggacggcctgaagagaagacagaacttcctgcagaacgtggagggcaccaagagcagccagcccctgaccagcaacagcctgctgcccctgacccccgtgatcaacgtgtag

SEQ ID NO: 101047 - DNA, 510 bp, Artificial Sequence
  Description of Artificial Sequence: Synthetic coding sequence
atggccagacccgtgcagctggcccccggcagcctggccctggtgctgtgcagactggaggcccagaaggccgccggcgccgccgaggagcccggcggcagagccgtgttcagagccttcagaagagccaacgccagatgcttctggaacgccagactggccagagccgccagcagactggccttccagggctggctgagaagaggcgtgctgctggtgagagccccccccgcctgcctgcaggtgctgagagacgcctggagaagaagagccctgagaccccccagaggcttcagaatcagagccgtgggcgacgtgttccccgtgcagatgaaccccatcacccagagccagttcgtgcccctgggcgaggtgctgtgctgcgccatcagcgacatgaacaccgcccagatcgtggtgacccaggagagcctgctggagagactgatgaagcactaccccggccacagagtgtgggacctgatcatccagagcttctggatggactag

SEQ ID NO: 101048 - DNA, 684 bp, Artificial Sequence
  Description of Artificial Sequence: Synthetic coding sequence
atggccagacccgtgcagctggcccccggcagcctggccctggtgctgtgcagactggaggcccagaaggccgccggcgccgccgaggagcccggcggcagagccgtgttcagagccttcagaagagccaacgccagatgcttctggaacgccagactggccagagccgccagcagactggccttccagggctggctgagaagaggcgtgctgctggtgagagccccccccgcctgcctgcaggtgctgagagacgcctggagaagaagagccctgagaccccccagaggcttcagaatcagagccgtgggcgacgtgttccccgtgcagatgaaccccatcacccagagccagttcgtgcccctgggcgaggtgctgtgctgcgccatcagcgacatgaacaccgcccagatcgtggtgacccaggagagcctgctggagagactgatgaagcactaccccggcatcgccatccccagcgaggacatcctgtacaccaccctgggcaccctgatcaaggagagaaagatctaccacaccggcgagggctacttcatcgtgaccccccagacctacttcatcaccaacaccaccacccaggagaacaagagaatgctgcccagcgacgagagcagactgatgcccgccagcatgacctacctggacaccgagagcggcatctag

SEQ ID NO: 101049 - DNA, 2970 bp, Artificial Sequence; identical to SEQ ID NO: 101046
  Description of Artificial Sequence: Synthetic coding sequence

SEQ ID NO: 101050 - DNA, 2640 bp, Artificial Sequence
  Description of Artificial Sequence: Synthetic coding sequence
atgaaccccatcacccagagccagttcgtgcccctgggcgaggtgctgtgctgcgccatcagcgacatgaacaccgcccagatcgtggtgacccaggagagcctgctggagagactgatgaagcactaccccggcatcgccatccccagcgaggacatcctgtacaccaccctgggcaccctgatcaaggagagaaagatctaccacaccggcgagggctacttcatcgtgaccccccagacctacttcatcaccaacaccaccacccaggagaacaagagaatgctgcccagcgacgagagcagactgatgcccgccagcatgacctacctggtgagcatggagagctgcgccgagagcgcccaggagaacgccgcccccatcagccactgccagagctgccagtgcttcagagacatgcacacccaggacgtgcaggaggcccccgtggccgccgaggtgaccagaaagagccacagaggcctgggcgagagcgtgagctgggtgcagaacggcgccgtgagcgtgagcgccgagcaccacatctgcgagagcaccaagcccctgccctacaccagagacaaggagaagggcaagaagttcggcttcagcctgctgtggagaagcctgagcagaaaggagaagcccaagaccgagcacagcagcttcagcgcccagttcccccccgaggagtggcccgtgagagacgaggacgacctggacaacatccccagagacgtggagcacgagatcatcaagagaatcaaccccatcctgaccgtggacaacctgatcaagcacaccgtgctgatgcagaagtacgaggagcagaagaagtacaacagccagggcaccagcaccgacatgctgaccatcggccacaagtaccccagcaaggagggcgtgaagaagagacagggcctgagcgccaagccccagggccagggccacagcagaagagacagacacaaggccagaaaccagggcagcgagttccagcccggcagcatcagactggagaagcaccccaagctgcccgccacccagcccatccccagaatcaagagccccaacgagatggtgggccagaagcccctgggcgagatcaccaccgtgctgggcagccacctgatctacaagaagagaatcagcaaccccttccagggcctgagccacagaggcagcaccatcagcaagggccacaagatccagaagaccagcgacctgaagcccagccagaccggccccaaggagaagcccttccagaagcccagaagcctggacagcagcagaatcttcgacggcaaggccaaggagccctacgccgagcagcccaacgacaagatggaggccgagagcatctacatcaacgaccccaccgtgaagcccatcaacgacgacttcagaggccacctgttcagccacccccagcagagcatgctgcagaacgacggcaagtgctgccccttcatggagagcatgctgagatacgaggtgtacggcggcgagaacgaggtgatccccgaggtgctgagaaagagccacagccacttcgacaagctgggcgagaccaagcagaccccccacagcctgcccagcagaggcgccagcttcagcgacagaacccccagcgcctgcagactggtggacaacaccatccaccagttccagaacctgggcctgctggactaccccgtgggcgtgaaccccctgagacaggccgccagacaggacaaggacagcgaggagctgctgagaaagggcttcgtgcaggacgccgagaccaccagcctggagaacgagcagctgagcaacgacgaccaggccctgtaccagaacgaggtggaggacgacgacggcgcctgcagcagcctgtacctggaggaggacgacatcagcgagaacgacgacctgagacagatgctgcccggccacagccagtacagcttcaccggcggcagccagggcaaccacctgggcaagcagaaggtgatcgagagaagcctgaccgagtacaacagcaccatggagagagtggagagccaggtgctgaagagaaacgagtgctacaagcccaccggcctgcacgccacccccggcgagagccaggagcccaacctgagcgccgagagctgcggcctgaacagcggcgcccagttcggcttcaactacgaggaggagcccagcgtggccaagtgcgtgcaggccagcgcccccgccgacgagagaatcttcgactactacagcgccagaaaggccagcttcgaggccgaggtgatccaggacaccatcggcgacaccggcaagaagcccgccagctggagccagagcccccagaaccaggagatgagaaagcacttcccccagaagttccagctgttcaacaccagccacatgcccgtgctggcccaggacgtgcagtacgagcacagccacctggagggcaccgagaaccacagcatggccggcgacagcggcatcgacagccccagaacccagagcctgggcagcaacaacagcgtgatcctggacggcctgaagagaagacagaacttcctgcagaacgtggagggcaccaagagcagccagcccctgaccagcaacagcctgctgcccctgacccccgtgatcaacgtgtag

SEQ ID NO: 101051 - DNA, 4179 bp, Artificial Sequence
  Description of Artificial Sequence: Synthetic coding sequence
atggtggagcccggccaggacctgctgctggccgccctgagcgagagcggcatcagccccaacgacctgttcgacatcgacggcggcgacgccggcctggccacccccatgcccacccccagcgtgcagcagagcgtgcccctgagcgccctggagctgggcctggagaccgaggccgccgtgcccgtgaagcaggagcccgagaccgtgcccacccccgccctgctgaacgtgagacagccccccagcaccaccaccttcgtgctgaaccagatcaaccacctgccccccctgggcagcaccatcgtgatgaccaagaccccccccgtgaccaccaacagacagaccatcaccctgaccaagttcatccagaccaccgccagcaccagacccagcgtgagcgcccccaccgtgagaaacgccatgaccagcgcccccagcaaggaccaggtgcagctgaaggacctgctgaagaacaacagcctgaacgagctgatgaagctgaagccccccgccaacatcgcccagcccgtggccaccgccgccaccgacgtgagcaacggcaccgtgaagaaggagagcagcaacaaggagggcgccagaatgtggatcaacgacatgaagatgagaagcttcagccccaccatgaaggtgcccgtggtgaaggaggacgacgagcccgaggaggaggacgaggaggagatgggccacgccgagacctacgccgagtacatgcccatcaagctgaagatcggcctgagacaccccgacgccgtggtggagaccagcagcctgagcagcgtgaccccccccgacgtgtggtacaagaccagcatcagcgaggagaccatcgacaacggctggctgagcgccctgcagctggaggccatcacctacgccgcccagcagcacgagaccttcctgcccaacggcgacagagccggcttcctgatcggcgacggcgccggcgtgggcaagggcagaaccatcgccggcatcatctacgagaactacctgctgagcagaaagagagccctgtggttcagcgtgagcaacgacctgaagtacgacgccgagagagacctgagagacatcggcgccaagaacatcctggtgcacagcctgaacaagttcaagtacggcaagatcagcagcaagcacaacggcagcgtgaagaagggcgtgatcttcgccacctacagcagcctgatcggcgagagccagagcggcggcaagtacaagaccagactgaagcagctgctgcactggtgcggcgacgacttcgacggcgtgatcgtgttcgacgagtgccacaaggccaagaacctgtgccccgtgggcagcagcaagcccaccaagaccggcctggccgtgctggagctgcagaacaagctgcccaaggccagagtggtgtacgccagcgccaccggcgccagcgagcccagaaacatggcctacatgaacagactgggcatctggggcgagggcacccccttcagagagttcagcgacttcatccaggccgtggagagaagaggcgtgggcgccatggagatcgtggccatggacatgaagctgagaggcatgtacatcgccagacagctgagcttcaccggcgtgaccttcaagatcgaggaggtgctgctgagccagagctacgtgaagatgtacaacaaggccgtgaagctgtgggtgatcgccagagagagattccagcaggccgccgacctgatcgacgccgagcagagaatgaagaagagcatgtggggccagttctggagcgcccaccagagattcttcaagtacctgtgcatcgccagcaaggtgaagagagtggtgcagctggccagagaggagatcaagaacggcaagtgcgtggtgatcggcctgcagagcaccggcgaggccagaaccctggaggccctggaggagggcggcggcgagctgaacgacttcgtgagcaccgccaagggcgtgctgcagagcctgatcgagaagcacttccccgcccccgacagaaagaagctgtacagcctgctgggcatcgacctgaccgcccccagcaacaacagcagccccagagacagcccctgcaaggagaacaagatcaagaagagaaagggcgaggagatcaccagagaggccaagaaggccagaaaggtgggcggcctgaccggcagcagcagcgacgacagcggcagcgagagcgacgccagcgacaacgaggagagcgactacgagagcagcaagaacatgagcagcggcgacgacgacgacttcaaccccttcctggacgagagcaacgaggacgacgagaacgacccctggctgatcagaaaggaccacaagaagaacaaggagaagaagaagaagaagagcatcgaccccgacagcatccagagcgccctgctggccagcggcctgggcagcaagagacccagcttcagcagcacccccgtgatcagccccgcccccaacagcacccccgccaacagcaacaccaacagcaacagcagcctgatcaccagccaggacgccgtggagagagcccagcagatgaagaaggacctgctggacaagctggagaagctggccgaggacctgccccccaacaccctggacgagctgatcgacgagctgggcggccccgagaacgtggccgagatgaccggcagaaagggcagagtggtgagcaacgacgacggcagcatcagctacgagagcagaagcgagctggacgtgcccgtggagatcctgaacatcaccgagaagcagagattcatggacggcgacaagaacatcgccatcatcagcgaggccgccagcagcggcatcagcctgcaggccgacagaagagccaagaaccagagaagaagagtgcacatgaccctggagctgccctggagcgccgacagagccatccagcagttcggcagaacccacagaagcaaccaggtgaccgcccccgagtacgtgttcctgatcagcgagctggccggcgagcagagattcgccagcatcgtggccaagagactggagagcctgggcgccctgacccacggcgacagaagagccaccgagagcagagacctgagcagattcaacttcgacaacaagtacggcagaaacgccctggagatcgtgatgaagagcatcgtgaacctggacagccccatggtgagccccccccccgactaccccggcgagttcttcaaggacgtgagacagggcctgatcggcgtgggcctgatcaacgtggaggacagaagcggcatcctgaccctggacaaggactacaacaacatcggcaagttcctgaacagaatcctgggcatggaggtgcaccagcagaacgccctgttccagtacttcgccgacaccctgaccgccgtggtgcagaacgccaagaagaacggcagatacgacatgggcatcctggacctgggcagcggcgacgagaaggtgagaaagagcgacgtgaagaagttcctgacccccggctacagcaccagcggccacgtggagctgtacaccatcagcgtggagagaggcatgagctgggaggaggccaccaagatctgggccgagctgaccggccccgacgacggcttctacctgagcctgcagatcagaaacaacaagaagaccgccatcctggtgaaggaggtgaaccccaagaagaagctgttcctggtgtacagacccaacaccggcaagcagctgaagctggagatctacgccgacctgaagaagaagtacaagaaggtggtgagcgacgacgccctgatgcactggctggaccagtacaacagcagcgccgacacctgcacccacgcctactggagaggcaactgcaagaaggccagcctgggcctggtgtgcgagatcggcctgagatgcagaacctactacgtgctgtgcggcagcgtgctgagcgtgtggaccaaggtggagggcgtgctggccagcgtgagcggcaccaacgtgaagatgcagatcgtgagactgagaaccgaggacggccagagaatcgtgggcctgatcatccccgccaactgcgtgagccccctggtgaacctgctgagcaccagcgaccagagccagcagctggccgtgcagcagaagcagctgtggcagcagcaccacccccagagcatcaccaacctgagcaacgcctag

SEQ ID NO: 101052 - DNA, 4182 bp, Artificial Sequence
  Description of Artificial Sequence: Synthetic coding sequence
atggtggagcccggccaggacctgctgctggccgccctgagcgagagcggcatcagccccaacgacctgttcgacatcgacggcggcgacgccggcctggccacccccatgcccacccccagcgtgcagcagagcgtgcccctgagcgccctggagctgggcctggagaccgaggccgccgtgcccgtgaagcaggagcccgagaccgtgcccacccccgccctgctgaacgtgagacagcagccccccagcaccaccaccttcgtgctgaaccagatcaaccacctgccccccctgggcagcaccatcgtgatgaccaagaccccccccgtgaccaccaacagacagaccatcaccctgaccaagttcatccagaccaccgccagcaccagacccagcgtgagcgcccccaccgtgagaaacgccatgaccagcgcccccagcaaggaccaggtgcagctgaaggacctgctgaagaacaacagcctgaacgagctgatgaagctgaagccccccgccaacatcgcccagcccgtggccaccgccgccaccgacgtgagcaacggcaccgtgaagaaggagagcagcaacaaggagggcgccagaatgtggatcaacgacatgaagatgagaagcttcagccccaccatgaaggtgcccgtggtgaaggaggacgacgagcccgaggaggaggacgaggaggagatgggccacgccgagacctacgccgagtacatgcccatcaagctgaagatcggcctgagacaccccgacgccgtggtggagaccagcagcctgagcagcgtgaccccccccgacgtgtggtacaagaccagcatcagcgaggagaccatcgacaacggctggctgagcgccctgcagctggaggccatcacctacgccgcccagcagcacgagaccttcctgcccaacggcgacagagccggcttcctgatcggcgacggcgccggcgtgggcaagggcagaaccatcgccggcatcatctacgagaactacctgctgagcagaaagagagccctgtggttcagcgtgagcaacgacctgaagtacgacgccgagagagacctgagagacatcggcgccaagaacatcctggtgcacagcctgaacaagttcaagtacggcaagatcagcagcaagcacaacggcagcgtgaagaagggcgtgatcttcgccacctacagcagcctgatcggcgagagccagagcggcggcaagtacaagaccagactgaagcagctgctgcactggtgcggcgacgacttcgacggcgtgatcgtgttcgacgagtgccacaaggccaagaacctgtgccccgtgggcagcagcaagcccaccaagaccggcctggccgtgctggagctgcagaacaagctgcccaaggccagagtggtgtacgccagcgccaccggcgccagcgagcccagaaacatggcctacatgaacagactgggcatctggggcgagggcacccccttcagagagttcagcgacttcatccaggccgtggagagaagaggcgtgggcgccatggagatcgtggccatggacatgaagctgagaggcatgtacatcgccagacagctgagcttcaccggcgtgaccttcaagatcgaggaggtgctgctgagccagagctacgtgaagatgtacaacaaggccgtgaagctgtgggtgatcgccagagagagattccagcaggccgccgacctgatcgacgccgagcagagaatgaagaagagcatgtggggccagttctggagcgcccaccagagattcttcaagtacctgtgcatcgccagcaaggtgaagagagtggtgcagctggccagagaggagatcaagaacggcaagtgcgtggtgatcggcctgcagagcaccggcgaggccagaaccctggaggccctggaggagggcggcggcgagctgaacgacttcgtgagcaccgccaagggcgtgctgcagagcctgatcgagaagcacttccccgcccccgacagaaagaagctgtacagcctgctgggcatcgacctgaccgcccccagcaacaacagcagccccagagacagcccctgcaaggagaacaagatcaagaagagaaagggcgaggagatcaccagagaggccaagaaggccagaaaggtgggcggcctgaccggcagcagcagcgacgacagcggcagcgagagcgacgccagcgacaacgaggagagcgactacgagagcagcaagaacatgagcagcggcgacgacgacgacttcaaccccttcctggacgagagcaacgaggacgacgagaacgacccctggctgatcagaaaggaccacaagaagaacaaggagaagaagaagaagaagagcatcgaccccgacagcatccagagcgccctgctggccagcggcctgggcagcaagagacccagcttcagcagcacccccgtgatcagccccgcccccaacagcacccccgccaacagcaacaccaacagcaacagcagcctgatcaccagccaggacgccgtggagagagcccagcagatgaagaaggacctgctggacaagctggagaagctggccgaggacctgccccccaacaccctggacgagctgatcgacgagctgggcggccccgagaacgtggccgagatgaccggcagaaagggcagagtggtgagcaacgacgacggcagcatcagctacgagagcagaagcgagctggacgtgcccgtggagatcctgaacatcaccgagaagcagagattcatggacggcgacaagaacatcgccatcatcagcgaggccgccagcagcggcatcagcctgcaggccgacagaagagccaagaaccagagaagaagagtgcacatgaccctggagctgccctggagcgccgacagagccatccagcagttcggcagaacccacagaagcaaccaggtgaccgcccccgagtacgtgttcctgatcagcgagctggccggcgagcagagattcgccagcatcgtggccaagagactggagagcctgggcgccctgacccacggcgacagaagagccaccgagagcagagacctgagcagattcaacttcgacaacaagtacggcagaaacgccctggagatcgtgatgaagagcatcgtgaacctggacagccccatggtgagccccccccccgactaccccggcgagttcttcaaggacgtgagacagggcctgatcggcgtgggcctgatcaacgtggaggacagaagcggcatcctgaccctggacaaggactacaacaacatcggcaagttcctgaacagaatcctgggcatggaggtgcaccagcagaacgccctgttccagtacttcgccgacaccctgaccgccgtggtgcagaacgccaagaagaacggcagatacgacatgggcatcctggacctgggcagcggcgacgagaaggtgagaaagagcgacgtgaagaagttcctgacccccggctacagcaccagcggccacgtggagctgtacaccatcagcgtggagagaggcatgagctgggaggaggccaccaagatctgggccgagctgaccggccccgacgacggcttctacctgagcctgcagatcagaaacaacaagaagaccgccatcctggtgaaggaggtgaaccccaagaagaagctgttcctggtgtacagacccaacaccggcaagcagctgaagctggagatctacgccgacctgaagaagaagtacaagaaggtggtgagcgacgacgccctgatgcactggctggaccagtacaacagcagcgccgacacctgcacccacgcctactggagaggcaactgcaagaaggccagcctgggcctggtgtgcgagatcggcctgagatgcagaacctactacgtgctgtgcggcagcgtgctgagcgtgtggaccaaggtggagggcgtgctggccagcgtgagcggcaccaacgtgaagatgcagatcgtgagactgagaaccgaggacggccagagaatcgtgggcctgatcatccccgccaactgcgtgagccccctggtgaacctgctgagcaccagcgaccagagccagcagctggccgtgcagcagaagcagctgtggcagcagcaccacccccagagcatcaccaacctgagcaacgcctag

SEQ ID NO: 101053 - DNA, 2199 bp, Artificial Sequence
  Description of Artificial Sequence: Synthetic coding sequence
atggtggagcccggccaggacctgctgctggccgccctgagcgagagcggcatcagccccaacgacctgttcgacatcgacggcggcgacgccggcctggccacccccatgcccacccccagcgtgcagcagagcgtgcccctgagcgccctggagctgggcctggagaccgaggccgccgtgcccgtgaagcaggagcccgagaccgtgcccacccccgccctgctgaacgtgagacagccccccagcaccaccaccttcgtgctgaaccagatcaaccacctgccccccctgggcagcaccatcgtgatgaccaagaccccccccgtgaccaccaacagacagaccatcaccctgaccaagttcatccagaccaccgccagcaccagacccagcgtgagcgcccccaccgtgagaaacgccatgaccagcgcccccagcaaggaccaggtgcagctgaaggacctgctgaagaacaacagcctgaacgagctgatgaagctgaagccccccgccaacatcgcccagcccgtggccaccgccgccaccgacgtgagcaacggcaccgtgaagaaggagagcagcaacaaggagggcgccagaatgtggatcaacgacatgaagatgagaagcttcagccccaccatgaaggtgcccgtggtgaaggaggacgacgagcccgaggaggaggacgaggaggagatgggccacgccgagacctacgccgagtacatgcccatcaagctgaagatcggcctgagacaccccgacgccgtggtggagaccagcagcctgagcagcgtgaccccccccgacgtgtggtacaagaccagcatcagcgaggagaccatcgacaacggctggctgagcgccctgcagctggaggccatcacctacgccgcccagcagcacgagaccttcctgcccaacggcgacagagccggcttcctgatcggcgacggcgccggcgtgggcaagggcagaaccatcgccggcatcatctacgagaactacctgctgagcagaaagagagccctgtggttcagcgtgagcaacgacctgaagtacgacgccgagagagacctgagagacatcggcgccaagaacatcctggtgcacagcctgaacaagttcaagtacggcaagatcagcagcaagcacaacggcagcgtgaagaagggcgtgatcttcgccacctacagcagcctgatcggcgagagccagagcggcggcaagtacaagaccagactgaagcagctgctgcactggtgcggcgacgacttcgacggcgtgatcgtgttcgacgagtgccacaaggccaagaacctgtgccccgtgggcagcagcaagcccaccaagaccggcctggccgtgctggagctgcagaacaagctgcccaaggccagagtggtgtacgccagcgccaccggcgccagcgagcccagaaacatggcctacatgaacagactgggcatctggggcgagggcacccccttcagagagttcagcgacttcatccaggccgtggagagaagaggcgtgggcgccatggagatcgtggccatggacatgaagctgagaggcatgtacatcgccagacagctgagcttcaccggcgtgaccttcaagatcgaggaggtgctgctgagccagagctacgtgaagatgtacaacaaggccgtgaagctgtgggtgatcgccagagagagattccagcaggccgccgacctgatcgacgccgagcagagaatgaagaagagcatgtggggccagttctggagcgcccaccagagattcttcaagtacctgtgcatcgccagcaaggtgaagagagtggtgcagctggccagagaggagatcaagaacggcaagtgcgtggtgatcggcctgcagagcaccggcgaggccagaaccctggaggccctggaggagggcggcggcgagctgaacgacttcgtgagcaccgccaagggcgtgctgcagagcctgatcgagaagcacttccccgcccccgacagaaagaagctgtacagcctgctgggcatcgacctgaccgcccccagcaacaacagcagccccagagacagcccctgcaaggagaacaagatcaagaagagaaagggcgaggagatcaccagagaggccaagaaggccagaaagatgagcctgatgagaatgatgaagatggtgagcagctag

SEQ ID NO: 101054 - DNA, 1632 bp, Artificial Sequence
  Description of Artificial Sequence: Synthetic coding sequence
atggagcaggtgaacgagctgaaggagaagggcaacaaggccctgagcgtgggcaacatcgacgacgccctgcagtgctacagcgaggccatcaagctggacccccacaaccacgtgctgtacagcaacagaagcgccgcctacgccaagaagggcgactaccagaaggcctacgaggacggctgcaagaccgtggacctgaagcccgactggggcaagggctacagcagaaaggccgccgccctggagttcctgaacagattcgaggaggccaagagaacctacgaggagggcctgaagcacgaggccaacaacccccagctgaaggagggcctgcagaacatggaggccagactggccgagagaaagttcatgaaccccttcaacatgcccaacctgtaccagaagctggagagcgaccccagaaccagaaccctgctgagcgaccccacctacagagagctgatcgagcagctgagaaacaagcccagcgacctgggcaccaagctgcaggaccccagaatcatgaccaccctgagcgtgctgctgggcgtggacctgggcagcatggacgaggaggaggagatcgccacccccccccccccccccccccccaagaaggagaccaagcccgagcccatggaggaggacctgcccgagaacaagaagcaggccctgaaggagaaggagctgggcaacgacgcctacaagaagaaggacttcgacaccgccctgaagcactacgacaaggccaaggagctggaccccaccaacatgacctacatcaccaaccaggccgccgtgtacttcgagaagggcgactacaacaagtgcagagagctgtgcgagaaggccatcgaggtgggcagagagaacagagaggactacagacagatcgccaaggcctacgccagaatcggcaacagctacttcaaggaggagaagtacaaggacgccatccacttctacaacaagagcctggccgagcacagaacccccgacgtgctgaagaagtgccagcaggccgagaagatcctgaaggagcaggagagactggcctacatcaaccccgacctggccctggaggagaagaacaagggcaacgagtgcttccagaagggcgactacccccaggccatgaagcactacaccgaggccatcaagagaaaccccaaggacgccaagctgtacagcaacagagccgcctgctacaccaagctgctggagttccagctggccctgaaggactgcgaggagtgcatccagctggagcccaccttcatcaagggctacaccagaaaggccgccgccctggaggccatgaaggactacaccaaggccatggacgtgtaccagaaggccctggacctggacagcagctgcaaggaggccgccgacggctaccagagatgcatgatggcccagtacaacagacacgacagccccgaggacgtgaagagaagagccatggccgaccccgaggtgcagcagatcatgagcgaccccgccatgagactgatcctggagcagatgcagaaggacccccaggccctgagcgagcacctgaagaaccccgtgatcgcccagaagatccagaagctgatggacgtgggcctgatcgccatcagatag

SEQ ID NO: 101055 - DNA, 1359 bp, Artificial Sequence
  Description of Artificial Sequence: Synthetic coding sequence
atgaacagacagctggtgaacatcctgaccgccctgttcgccttcttcctggagaccaaccacttcagaaccgccttctgcaaggaccacgacagcagaagcggcaagcagcccagccagaccctgagccccagcgacttcctggacaagctgatgggcagaaccagcggctacgacgccagaatcagacccaacttcaagggcccccccgtgaacgtgacctgcaacatcttcatcaacagcttcggcagcgtgaccgagaccaccatggactacagagtgaacatcttcctgagacagcagtggaacgacagcagactggcctacagcgagtaccccgacgacagcctggacctggaccccagcatgctggacagcatctggaagcccgacctgttcttcgccaacgagaagggcgccaacttccacgacgtgaccaccgacaacaagctgctgagaatcagcaagaacggcaaggtgctgtacagcatcagactgaccctgaccctgagctgccccatggacctgaagaacttccccatggacgtgcagacctgcaccatgcagctggagagcttcggctacaccatgaacgacctgatcttcgagtggctgagcgacggccccgtgcaggtggccgagggcctgaccctgccccagttcatcctgaaggaggagaaggagctgggctactgcaccaagcactacaacaccggcaagttcacctgcatcgaggtgaagttccacctggagagacagatgggctactacctgatccagatgtacatccccagcctgctgatcgtgatcctgagctgggtgagcttctggatcaacatggacgccgcccccgccagagtggccctgggcatcaccaccgtgctgaccatgaccacccagagcagcggcagcagagccagcctgcccaaggtgagctacgtgaaggccatcgacatctggatggccgtgtgcctgctgttcgtgttcgccgccctgctggagtacgccgccgtgaacttcgtgagcagacagcacaaggagttcctgagactgagaagaagacagaagagacagaacaaggaggaggacgtgaccagagagagcagattcaacttcagcggctacggcatgggccactgcctgcaggtgaaggacggcaccgccgtgaaggccacccccgccaaccccctgccccagccccccaaggacggcgacgccatcaagaagaagttcgtggacagagccaagagaatcgacaccatcagcagagccgccttccccctggccttcctgatcttcaacatcttctactggatcacctacaagatcatcagacacgaggacgtgcacaagaagtag

SEQ ID NO: 101056 - DNA, 3489 bp, Artificial Sequence
  Description of Artificial Sequence: Synthetic coding sequence
atgaacggccaccaccagcagaacggcgtggagaacatgatgctgttcgaggtggtgaagatgggcaagagcgccatgcagagcgtggtggacgactggatcgagagctacaagcacgacagagacatcgccctgctggacctgatcaacttcttcatccagtgcagcggctgcaagggcgtggtgaccgccgagatgttcagacacatgcagaacagcgagatcatcagaaagatgaccgaggagttcgacgaggacagcggcgactaccccctgaccatggccggcccccagtggaagaagttcaagagcagcttctgcgagttcatcggcgtgctggtgagacagtgccagtacagcatcatctacgacgagtacatgatggacaccgtgatcagcctgctgaccggcctgagcgacagccaggtgagagccttcagacacaccagcaccctggccgccatgaagctgatgaccgccctggtgaacgtggccctgaacctgagcatcaacatggacaacacccagagacagtacgaggccgagagaaacaagatgatcggcaagagagccaacgagagactggagctgctgctgcagaagagaaaggagctgcaggagaaccaggacgagatcgagaacatgatgaacgccatcttcaagggcgtgttcgtgcacagatacagagacgccatcgccgagatcagagccatctgcatcgaggagatcggcatctggatgaagatgtacagcgacgccttcctgaacgacagctacctgaagtacgtgggctggaccatgcacgacaagcagggcgaggtgagactgaagtgcctgaccgccctgcagggcctgtactacaacaaggagctgaacagcaagctggagctgttcaccagcagattcaaggacagaatcgtgagcatgaccctggacaaggagtacgacgtggccgtgcaggccatcaagctgctgaccctggtgctgcagagcagcgaggaggtgctgaccgccgaggactgcgagaacgtgtaccacctggtgtacagcgcccacagacccgtggccgtggccgccggcgagttcctgtacaagaagctgttcagcagaagagaccccgaggaggacggcatgatgaagagaagaggcagacagggccccaacgccaacctggtgaagaccctggtgttcttcttcctggagagcgagctgcacgagcacgccgcctacctggtggacagcatgtgggactgcgccaccgagctgctgaaggactgggagtgcatgaacagcctgctgctggaggagcccctgagcggcgaggaggccctgaccgacagacaggagagcgccctgatcgagatcatgctgtgcaccatcagacaggccgccgagtgccacccccccgtgggcagaggcaccggcaagagagtgctgaccgccaaggagaagaagacccagctggacgacagaaccaagatcaccgagctgttcgccgtggccctgccccagctgctggccaagtacagcgtggacgccgagaaggtgaccaacctgctgcagctgccccagtacttcgacctggagatctacaccaccggcagactggagaagcacctggacgccctgctgagacagatcagaaacatcgtggagaagcacaccgacaccgacgtgctggaggcctgcagcaagacctaccacgccctgtgcaacgaggagttcaccatcttcaacagagtggacatcagcagaagccagctgatcgacgagctggccgacaagttcaacagactgctggaggacttcctgcaggagggcgaggagcccgacgaggacgacgcctaccaggtgctgagcaccctgaagagaatcaccgccttccacaacgcccacgacctgagcaagtgggacctgttcgcctgcaactacaagctgctgaagaccggcatcgagaacggcgacatgcccgagcagatcgtgatccacgccctgcagtgcacccactacgtgatcctgtggcagctggccaagatcaccgagagcagcagcaccaaggaggacctgctgagactgaagaagcagatgagagtgttctgccagatctgccagcactacctgaccaacgtgaacaccaccgtgaaggagcaggccttcaccatcctgtgcgacatcctgatgatcttcagccaccagatcatgagcggcggcagagacatgctggagcccctggtgtacacccccgacagcagcctgcagagcgagctgctgagcttcatcctggaccacgtgttcatcgagcaggacgacgacaacaacagcgccgacggccagcaggaggacgaggccagcaagatcgaggccctgcacaagagaagaaacctgctggccgccttctgcaagctgatcgtgtacaccgtggtggagatgaacaccgccgccgacatcttcaagcagtacatgaagtactacaacgactacggcgacatcatcaaggagaccatgagcaagaccagacagatcgacaagatccagtgcgccaagaccctgatcctgagcctgcagcagctgttcaacgagatgatccaggagaacggctacaacttcgacagaagcagcagcaccttcagcggcatcaaggagctggccagaagattcgccctgaccttcggcctggaccagctgaagaccagagaggccatcgccatgctgcacaaggacggcatcgagttcgccttcaaggagcccaacccccagggcgagagccacccccccctgaacctggccttcctggacatcctgagcgagttcagcagcaagctgctgagacaggacaagagaaccgtgtacgtgtacctggagaagttcatgaccttccagatgagcctgagaagagaggacgtgtggctgcccctgatgagctacagaaacagcctgctggccggcggcgacgacgacaccatgagcgtgatcagcggcatcagcagcagaggcagcaccgtgagaagcaagaagagcaagcccagcaccggcaagagaaaggtggtggagggcatgcagctgagcctgaccgaggagagcagcagcagcgacagcatgtggctgagcagagagcagaccctgcacacccccgtgatgatgcagaccccccagctgaccagcaccatcatgagagagcccaagagactgagacccgaggacagcttcatgagcgtgtaccccatgcagaccgagcaccaccagacccccctggactacaacagaagaggcaccagcctgatggaggacgacgaggagcccatcgtggaggacgtgatgatgagcagcgagggcagaatcgaggacctgaacgagggcatggacttcgacaccatggacatcgacctgccccccagcaagaacagaagagagagaaccgagctgaagcccgacttcttcgaccccgccagcatcatggacgagagcgtgctgggcgtgagcatgttctag

SEQ ID NO: 101057 - DNA, 3696 bp, Artificial Sequence
  Description of Artificial Sequence: Synthetic coding sequence
atgatcgccgcccccgagatccccaccgacttcaacctgctgcaggagagcgagacccacttcagcagcgacaccgacttcgaggacatcgagggcaagaaccagaagcagggcaagggcaagacctgcaagaagggcaagaagggccccgccgagaagggcaagggcggcaacggcggcggcaagccccccagcggccccaacagaatgaacggccaccaccagcagaacggcgtggagaacatgatgctgttcgaggtggtgaagatgggcaagagcgccatgcagagcgtggtggacgactggatcgagagctacaagcacgacagagacatcgccctgctggacctgatcaacttcttcatccagtgcagcggctgcaagggcgtggtgaccgccgagatgttcagacacatgcagaacagcgagatcatcagaaagatgaccgaggagttcgacgaggacagcggcgactaccccctgaccatggccggcccccagtggaagaagttcaagagcagcttctgcgagttcatcggcgtgctggtgagacagtgccagtacagcatcatctacgacgagtacatgatggacaccgtgatcagcctgctgaccggcctgagcgacagccaggtgagagccttcagacacaccagcaccctggccgccatgaagctgatgaccgccctggtgaacgtggccctgaacctgagcatcaacatggacaacacccagagacagtacgaggccgagagaaacaagatgatcggcaagagagccaacgagagactggagctgctgctgcagaagagaaaggagctgcaggagaaccaggacgagatcgagaacatgatgaacgccatcttcaagggcgtgttcgtgcacagatacagagacgccatcgccgagatcagagccatctgcatcgaggagatcggcatctggatgaagatgtacagcgacgccttcctgaacgacagctacctgaagtacgtgggctggaccatgcacgacaagcagggcgaggtgagactgaagtgcctgaccgccctgcagggcctgtactacaacaaggagctgaacagcaagctggagctgttcaccagcagattcaaggacagaatcgtgagcatgaccctggacaaggagtacgacgtggccgtgcaggccatcaagctgctgaccctggtgctgcagagcagcgaggaggtgctgaccgccgaggactgcgagaacgtgtaccacctggtgtacagcgcccacagacccgtggccgtggccgccggcgagttcctgtacaagaagctgttcagcagaagagaccccgaggaggacggcatgatgaagagaagaggcagacagggccccaacgccaacctggtgaagaccctggtgttcttcttcctggagagcgagctgcacgagcacgccgcctacctggtggacagcatgtgggactgcgccaccgagctgctgaaggactgggagtgcatgaacagcctgctgctggaggagcccctgagcggcgaggaggccctgaccgacagacaggagagcgccctgatcgagatcatgctgtgcaccatcagacaggccgccgagtgccacccccccgtgggcagaggcaccggcaagagagtgctgaccgccaaggagaagaagacccagctggacgacagaaccaagatcaccgagctgttcgccgtggccctgccccagctgctggccaagtacagcgtggacgccgagaaggtgaccaacctgctgcagctgccccagtacttcgacctggagatctacaccaccggcagactggagaagcacctggacgccctgctgagacagatcagaaacatcgtggagaagcacaccgacaccgacgtgctggaggcctgcagcaagacctaccacgccctgtgcaacgaggagttcaccatcttcaacagagtggacatcagcagaagccagctgatcgacgagctggccgacaagttcaacagactgctggaggacttcctgcaggagggcgaggagcccgacgaggacgacgcctaccaggtgctgagcaccctgaagagaatcaccgccttccacaacgcccacgacctgagcaagtgggacctgttcgcctgcaactacaagctgctgaagaccggcatcgagaacggcgacatgcccgagcagatcgtgatccacgccctgcagtgcacccactacgtgatcctgtggcagctggccaagatcaccgagagcagcagcaccaaggaggacctgctgagactgaagaagcagatgagagtgttctgccagatctgccagcactacctgaccaacgtgaacaccaccgtgaaggagcaggccttcaccatcctgtgcgacatcctgatgatcttcagccaccagatcatgagcggcggcagagacatgctggagcccctggtgtacacccccgacagcagcctgcagagcgagctgctgagcttcatcctggaccacgtgttcatcgagcaggacgacgacaacaacagcgccgacggccagcaggaggacgaggccagcaagatcgaggccctgcacaagagaagaaacctgctggccgccttctgcaagctgatcgtgtacaccgtggtggagatgaacaccgccgccgacatcttcaagcagtacatgaagtactacaacgactacggcgacatcatcaaggagaccatgagcaagaccagacagatcgacaagatccagtgcgccaagaccctgatcctgagcctgcagcagctgttcaacgagatgatccaggagaacggctacaacttcgacagaagcagcagcaccttcagcggcatcaaggagctggccagaagattcgccctgaccttcggcctggaccagctgaagaccagagaggccatcgccatgctgcacaaggacggcatcgagttcgccttcaaggagcccaacccccagggcgagagccacccccccctgaacctggccttcctggacatcctgagcgagttcagcagcaagctgctgagacaggacaagagaaccgtgtacgtgtacctggagaagttcatgaccttccagatgagcctgagaagagaggacgtgtggctgcccctgatgagctacagaaacagcctgctggccggcggcgacgacgacaccatgagcgtgatcagcggcatcagcagcagaggcagcaccgtgagaagcaagaagagcaagcccagcaccggcaagagaaaggtggtggagggcatgcagctgagcctgaccgaggagagcagcagcagcgacagcatgtggctgagcagagagcagaccctgcacacccccgtgatgatgcagaccccccagctgaccagcaccatcatgagagagcccaagagactgagacccgaggacagcttcatgagcgtgtaccccatgcagaccgagcaccaccagacccccctggactacaacagaagaggcaccagcctgatggaggacgacgaggagcccatcgtggaggacgtgatgatgagcagcgagggcagaatcgaggacctgaacgagggcatggacttcgacaccatggacatcgacctgccccccagcaagaacagaagagagagaaccgagctgaagcccgacttcttcgaccccgccagcatcatggacgagagcgtgctgggcgtgagcatgttctag

SEQ ID NO: 101058 - DNA, 3807 bp, Artificial Sequence
  Description of Artificial Sequence: Synthetic coding sequence
atgatcgccgcccccgagatccccaccgacttcaacctgctgcaggagagcgagacccacttcagcagcgacaccgacttcgaggacatcgagggcaagaaccagaagcagggcaagggcaagacctgcaagaagggcaagaagggccccgccgagaagggcaagggcggcaacggcggcggcaagccccccagcggccccaacagaatgaacggccaccaccagcagaacggcgtggagaacatgatgctgttcgaggtggtgaagatgggcaagagcgccatgcagagcgtggtggacgactggatcgagagctacaagcacgacagagacatcgccctgctggacctgatcaacttcttcatccagtgcagcggctgcaagggcgtggtgaccgccgagatgttcagacacatgcagaacagcgagatcatcagaaagatgaccgaggagttcgacgaggacagcggcgactaccccctgaccatggccggcccccagtggaagaagttcaagagcagcttctgcgagttcatcggcgtgctggtgagacagtgccagtacagcatcatctacgacgagtacatgatggacaccgtgatcagcctgctgaccggcctgagcgacagccaggtgagagccttcagacacaccagcaccctggccgccatgaagctgatgaccgccctggtgaacgtggccctgaacctgagcatcaacatggacaacacccagagacagtacgaggccgagagaaacaagatgatcggcaagagagccaacgagagactggagctgctgctgcagaagagaaaggagctgcaggagaaccaggacgagatcgagaacatgatgaacgccatcttcaagggcgtgttcgtgcacagatacagagacgccatcgccgagatcagagccatctgcatcgaggagatcggcatctggatgaagatgtacagcgacgccttcctgaacgacagctacctgaagtacgtgggctggaccatgcacgacaagcagggcgaggtgagactgaagtgcctgaccgccctgcagggcctgtactacaacaaggagctgaacagcaagctggagctgttcaccagcagattcaaggacagaatcgtgagcatgaccctggacaaggagtacgacgtggccgtgcaggccatcaagctgctgaccctggtgctgcagagcagcgaggaggtgctgaccgccgaggactgcgagaacgtgtaccacctggtgtacagcgcccacagacccgtggccgtggccgccggcgagttcctgtacaagaagctgttcagcagaagagaccccgaggaggacggcatgatgaagagaagaggcagacagggccccaacgccaacctggtgaagaccctggtgttcttcttcctggagagcgagctgcacgagcacgccgcctacctggtggacagcatgtgggactgcgccaccgagctgctgaaggactgggagtgcatgaacagcctgctgctggaggagcccctgagcggcgaggaggccctgaccgacagacaggagagcgccctgatcgagatcatgctgtgcaccatcagacaggccgccgagtgccacccccccgtgggcagaggcaccggcaagagagtgctgaccgccaaggagaagaagacccagctggacgacagaaccaagatcaccgagctgttcgccgtggccctgccccagctgctggccaagtacagcgtggacgccgagaaggtgaccaacctgctgcagctgccccagtacttcgacctggagatctacaccaccggcagactggagaagcacctggacgccctgctgagacagatcagaaacatcgtggagaagcacaccgacaccgacgtgctggaggcctgcagcaagacctaccacgccctgtgcaacgaggagttcaccatcttcaacagagtggacatcagcagaagccagctgatcgacgagctggccgacaagttcaacagactgctggaggacttcctgcaggagggcgaggagcccgacgaggacgacgcctaccaggtgctgagcaccctgaagagaatcaccgccttccacaacgcccacgacctgagcaagtgggacctgttcgcctgcaactacaagctgctgaagaccggcatcgagaacggcgacatgcccgagcagatcgtgatccacgccctgcagtgcacccactacgtgatcctgtggcagctggccaagatcaccgagagcagcagcaccaaggaggacctgctgagactgaagaagcagatgagagtgttctgccagatctgccagcactacctgaccaacgtgaacaccaccgtgaaggagcaggccttcaccatcctgtgcgacatcctgatgatcttcagccaccagatcatgagcggcggcagagacatgctggagcccctggtgtacacccccgacagcagcctgcagagcgagctgctgagcttcatcctggaccacgtgttcatcgagcaggacgacgacaacaacagcgccgacggccagcaggaggacgaggccagcaagatcgaggccctgcacaagagaagaaacctgctggccgccttctgcaagctgatcgtgtacaccgtggtggagatgaacaccgccgccgacatcttcaagcagtacatgaagtactacaacgactacggcgacatcatcaaggagaccatgagcaagaccagacagatcgacaagatccagtgcgccaagaccctgatcctgagcctgcagcagctgttcaacgagatgatccaggagaacggctacaacttcgacagaagcagcagcaccttcagcggcatcaaggagctggccagaagattcgccctgaccttcggcctggaccagctgaagaccagagaggccatcgccatgctgcacaaggacggcatcgagttcgccttcaaggagcccaacccccagggcgagagccacccccccctgaacctggccttcctggacatcctgagcgagttcagcagcaagctgctgagacaggacaagagaaccgtgtacgtgtacctggagaagttcatgaccttccagatgagcctgagaagagaggacgtgtggctgcccctgatgagctacagaaacagcctgctggccggcggcgacgacgacaccatgagcgtgatcagcggcatcagcagcagaggcagcaccgtgagaagcaagaagagcaagcccagcaccggcaagagaaaggtggtggagggcatgcagctgagcctgaccgaggagagcagcagcagcgacagcatgtggctgagcagagagcagaccctgcacacccccgtgatgatgcagaccccccagctgaccagcaccatcatgagagagcccaagagactgagacccgaggacagcttcatgagcgtgtaccccatgcagaccgagcaccaccagacccccctggactacaacacccaggtgacctggatgctggcccagagacagcaggaggaggccagacagcagcaggagagagccgccatgagctacgtgaagctgagaaccaacctgcagcacgccatcagaagaggcaccagcctgatggaggacgacgaggagcccatcgtggaggacgtgatgatgagcagcgagggcagaatcgaggacctgaacgagggcatggacttcgacaccatggacatcgacctgccccccagcaagaacagaagagagagaaccgagctgaagcccgacttcttcgaccccgccagcatcatggacgagagcgtgctgggcgtgagcatgttctag

SEQ ID NO: 101059 - DNA, 3696 bp, Artificial Sequence; identical to SEQ ID NO: 101057
  Description of Artificial Sequence: Synthetic coding sequence

SEQ ID NO: 101060 - DNA, 3696 bp, Artificial Sequence; identical to SEQ ID NO: 101057
  Description of Artificial Sequence: Synthetic coding sequence

SEQ ID NO: 101061 - DNA, 213 bp, Artificial Sequence
  Description of Artificial Sequence: Synthetic coding sequence
atgatcgccgcccccgagatccccaccgacttcaacctgctgcaggagagcgagacccacttcagcagcgacaccgacttcgaggacatcgagggcaagaaccagaagcagggcaagggcaagacctgcaagaagggcaagaagggccccgccgagaagggcaagggcggcaacggcggcggcaagccccccagcggccccaacagaatgtag

SEQ ID NO: 101062 - DNA, 348 bp, Artificial Sequence
  Description of Artificial Sequence: Synthetic coding sequence
atgatcgccgcccccgagatccccaccgacttcaacctgctgcaggagagcgagacccacttcagcagcgacaccgacttcgaggacatcgagggcaagaaccagaagcagggcaagggcaagacctgcaagaagggcaagaagggccccgccgagaagggcaagggcggcaacggcggcggcaagccccccagcggccccaacagaatgaacggccaccaccagcagaacggcgtggagaacatgatgctgttcgaggtggtgaagatgggcaagagcgccatgcagagcgtggtggacgactggatcgagagctacaagcacgacagagacatcgccctgctgtag

SEQ ID NO: 101063 - DNA, 510 bp, Artificial Sequence
  Description of Artificial Sequence: Synthetic coding sequence
atgatcgccgcccccgagatccccaccgacttcaacctgctgcaggagagcgagacccacttcagcagcgacaccgacttcgaggacatcgagggcaagaaccagaagcagggcaagggcaagacctgcaagaagggcaagaagggccccgccgagaagggcaagggcggcaacggcggcggcaagccccccagcggccccaacagaatgaacggccaccaccagcagaacggcgtggagaacatgatgctgttcgaggtggtgaagatgggcaagagcgccatgcagagcgtggtggacgactggatcgagagctacaagcacgacagagacatcgccctgctggacctgatcaacttcttcatccagtgcagcggctgcaagggcgtggtgaccgccgagatgttcagacacatgcagaacagcgagatcatcagaaagatgaccgaggagttcgacgaggacagcggcgactaccccctgaccatggccggcccccagtggaagtag

SEQ ID NO: 101064 - DNA, 465 bp, Artificial Sequence
  Description of Artificial Sequence: Synthetic coding sequence
atgatcgccgcccccgagatccccaccgacttcaacctgctgcaggagagcgagacccacttcagcagcgacaccgacttcgaggacatcgagggcaagaaccagaagcagggcaagggcaagacctgcaagaagggcaagaagggccccgccgagaagggcaagggcggcaacggcggcggcaagccccccagcggccccaacagaatgaacggccaccaccagcagaacggcgtggagaacatgatgctgttcgaggtggtgaagatgggcaagagcgccatgcagagcgtggtggacgactggatcgagagctacaagcacgacagagacatcgccctgctggacctgatcaacttcttcatccagtgcagcggctgcaagggcgtggtgaccgccgagatgttcagacacatgcagaacagcgagatcatcagaaagatgaccgaggagttcgacgagtag

SEQ ID NO: 101065 - DNA, 627 bp, Artificial Sequence
  Description of Artificial Sequence: Synthetic coding sequence
atgatcgccgcccccgagatccccaccgacttcaacctgctgcaggagagcgagacccacttcagcagcgacaccgacttcgaggacatcgagggcaagaaccagaagcagggcaagggcaagacctgcaagaagggcaagaagggccccgccgagaagggcaagggcggcaacggcggcggcaagccccccagcggccccaacagaatgaacggccaccaccagcagaacggcgtggagaacatgatgctgttcgaggtggtgaagatgggcaagagcgccatgcagagcgtggtggacgactggatcgagagctacaagcacgacagagacatcgccctgctggacctgatcaacttcttcatccagtgcagcggctgcaagggcgtggtgaccgccgagatgttcagacacatgcagaacagcgagatcatcagaaagatgaccgaggagttcgacgaggacagcggcgactaccccctgaccatggccggcccccagtggaagaagttcaagagcagcttctgcgagttcatcggcgtgctggtgagacagtgccagtacagcatcatctacgacgagtacatgatggacaccgtgatcagcctgctgaccggcctgagctag

SEQ ID NO: 101066 - DNA, 1647 bp, Artificial Sequence
  Description of Artificial Sequence: Synthetic coding sequence
atgatcgccgcccccgagatccccaccgacttcaacctgctgcaggagagcgagacccacttcagcagcgacaccgacttcgaggacatcgagggcaagaaccagaagcagggcaagggcaagacctgcaagaagggcaagaagggccccgccgagaagggcaagggcggcaacggcggcggcaagccccccagcggccccaacagaatgaacggccaccaccagcagaacggcgtggagaacatgatgctgttcgaggtggtgaagatgggcaagagcgccatgcagagcgtggtggacgactggatcgagagctacaagcacgacagagacatcgccctgctggacctgatcaacttcttcatccagtgcagcggctgcaagggcgtggtgaccgccgagatgttcagacacatgcagaacagcgagatcatcagaaagatgaccgaggagttcgacgaggacagcggcgactaccccctgaccatggccggcccccagtggaagaagttcaagagcagcttctgcgagttcatcggcgtgctggtgagacagtgccagtacagcatcatctacgacgagtacatgatggacaccgtgatcagcctgctgaccggcctgagcgacagccaggtgagagccttcagacacaccagcaccctggccgccatgaagctgatgaccgccctggtgaacgtggccctgaacctgagcatcaacatggacaacacccagagacagtacgaggccgagagaaacaagatgatcggcaagagagccaacgagagactggagctgctgctgcagaagagaaaggagctgcaggagaaccaggacgagatcgagaacatgatgaacgccatcttcaagggcgtgttcgtgcacagatacagagacgccatcgccgagatcagagccatctgcatcgaggagatcggcatctggatgaagatgtacagcgacgccttcctgaacgacagctacctgaagtacgtgggctggaccatgcacgacaagcagggcgaggtgagactgaagtgcctgaccgccctgcagggcctgtactacaacaaggagctgaacagcaagctggagctgttcaccagcagattcaaggacagaatcgtgagcatgaccctggacaaggagtacgacgtggccgtgcaggccatcaagctgctgaccctggtgctgcagagcagcgaggaggtgctgaccgccgaggactgcgagaacgtgtaccacctggtgtacagcgcccacagacccgtggccgtggccgccggcgagttcctgtacaagaagctgttcagcagaagagaccccgaggaggacggcatgatgaagagaagaggcagacagggccccaacgccaacctggtgaagaccctggtgttcttcttcctggagagcgagctgcacgagcacgccgcctacctggtggacagcatgtgggactgcgccaccgagctgctgaaggactgggagtgcatgaacagcctgctgctggaggagcccctgagcggcgaggaggccctgaccgacagacaggagagcgccctgatcgagatcatgctgtgcaccatcagacaggccgccgagtgccacccccccgtgggcagaggcaccggcaagagagtgctgtag

SEQ ID NO: 101067 - DNA, 123 bp, Artificial Sequence
  Description of Artificial Sequence: Synthetic coding sequence
atgatcgccgcccccgagatccccaccgacttcaacctgctgcaggagagcgagacccacttcagcagcgacaccgacttcgaggacatcgagggcaagaaccagaagcagggcaagggctag

SEQ ID NO: 101068 - DNA, 3678 bp, Artificial Sequence
  Description of Artificial Sequence: Synthetic coding sequence
atgagcagccccctgcagagagccgtgggcgacaccaagagagccctgagcgccagcagcagcagcagcgccagcctgcccttcgacgacagagacagcaaccacaccagcgagggcaacggcgacagcctgctggccgacgaggacaccgacttcgaggacagcctgaacagaaacgtgaagaagagagccgccaagagaccccccaagaccacccccgtggccaagcaccccaagaagggcagcagagtggtgcacagacacagcagaaagcagagcgagccccccgccaacgacctgttcaacgccgtgaaggccgccaagagcgacatgcagagcctggtggacgagtggctggacagctacaagcaggaccaggacgccggcttcctggagctggtgaacttcttcatccagagctgcggctgcaagggcatcgtgacccccgagatgttcaagaagatgagcaacagcgagatcatccagcacctgaccgagcagttcaacgaggacagcggcgactaccccctgatcgcccccggccccagctggaagaagttccagggcagcttctgcgagttcgtgagaaccctggtgtgccagtgccagtacagcctgctgtacgacggcttccccatggacgacctgatcagcctgctgaccggcctgagcgacagccaggtgagagccttcagacacaccagcaccctggccgccatgaagctgatgaccagcctggtgaaggtggccctgcagctgagcgtgcaccaggacaacaaccagagacagtacgaggccgagagaaacaagggccccggccagagagcccccgagagactggagagcctgctggagaagagaaaggagctgcaggagcaccaggaggagatcgagggcatgatgaacgccctgttcagaggcgtgttcgtgcacagatacagagacgtgctgcccgagatcagagccatctgcatcgaggagatcggctgctggatgcagagctacagcaccagcttcctgaccgacagctacctgaagtacatcggctggaccctgcacgacaagcacagagaggtgagactgaagtgcgtgaaggccctgaagggcctgtacggcaacagagacctgaccaccagactggagctgttcaccagcagattcaaggacagaatggtgagcatggtgatggacagagagtacgacgtggccgtggaggccgtgagactgctgatcctgatcctgaagaacatggagggcgtgctgaccgacgccgactgcgagagcgtgtaccccgtggtgtacgccagccacagaggcctggccagcgccgccggcgagttcctgtactggaagctgttctaccccgagtgcgagatcagaatgatgggcggcagagagcagagacagagccccggcgcccagagaaccttcttccagctgctgctgagcttcttcgtggagagcgagctgcacgaccacgccgcctacctggtggacagcctgtgggactgcgccggcgccagactgaaggactgggagggcctgaccagcctgctgctggagaaggaccagaacctgggcgacgtgcaggagagcaccctgatcgagatcctggtgagcagcgccagacaggccagcgagggccacccccccgtgggcagagtgaccggcagaaagggcctgaccagcaaggagagaaagacccaggccgacgacagagtgaagctgaccgagcacctgatccccctgctgccccagctgctggccaagttcagcgccgacgccgagaaggtgacccccctgctgcagctgctgagctgcttcgacctgcacatctactgcaccggcagactggagaagcacctggagctgttcctgcagcagctgcaggaggtggtggtgaagcacgccgagcccgccgtgctggaggccggcgcccacgccctgtacctgctgtgcaaccccgagttcaccttcttcagcagagccgacttcgccagaagccagctggtggacctgctgaccgacagattccagcaggagctggaggagctgctgcagagcagcttcctggacgaggacgaggtgtacaacctggccgccaccctgaagagactgagcgccttctacaacacccacgacctgaccagatgggagctgtacgagccctgctgccagctgctgcagaaggccgtggacaccggcgaggtgccccaccaggtgatcctgcccgccctgaccctggtgtacttcagcatcctgtggaccctgacccacatcagcaagagcgacgccagccagaagcagctgagcagcctgagagacagaatggtggccttctgcgagctgtgccagagctgcctgagcgacgtggacaccgagatccaggagcaggccttcgtgctgctgagcgacctgctgctgatcttcagcccccagatgatcgtgggcggcagagacttcctgagacccctggtgttcttccccgaggccaccctgcagagcgagctggccagcttcctgatggaccacgtgttcatccagcccggcgacctgggcagcggcgacagccaggaggaccacctgcagatcgagagactgcaccagagaagaagactgctggccggcttctgcaagctgctgctgtacggcgtgctggagatggacgccgccagcgacgtgttcaagcactacaacaagttctacaacgactacggcgacatcatcaaggagaccctgaccagagccagacagatcgacagaagccactgcagcagaatcctgctgctgagcctgaagcagctgtacaccgagctgctgcaggagcacggcccccagggcctgaacgagctgcccgccttcatcgagatgagagacctggccagaagattcgccctgagcttcggcccccagcagctgcagaacagagacctggtggtgatgctgcacaaggagggcatccagttcagcctgagcgagctgccccccgccggcagcagcaaccagccccccaacctggccttcctggagctgctgagcgagttcagccccagactgttccaccaggacaagcagctgctgctgagctacctggagaagtgcctgcagcacgtgagccaggcccccggccacccctggggccccgtgaccacctactgccacagcctgagccccgtggagaacaccgccgagaccagcccccaggtgctgcccagcagcaagagaagaagagtggagggccccgccaagcccaacagagaggacgtgagcagcagccaggaggagagcctgcagctgaacagcatcccccccacccccaccctgaccagcaccgccgtgaagagcagacagcccctgtggggcctgaaggagatggaggaggaggacggcagcgagctggacttcgcccagggccagcccgtggccggcaccgagagaagcagattcctgggcccccagtacttccagaccccccacaaccccagcggccccggcctgggcaaccagctgatgagactgagcctgatggaggaggacgaggaggaggagctggagatccaggacgagagcaacgaggagagacaggacaccgacatgcaggccagcagctacagcagcaccagcgagagaggcctggacctgctggacagcaccgagctggacatcgaggacttctag

SEQ ID NO: 101069 - DNA, 2667 bp, Artificial Sequence
  Description of Artificial Sequence: Synthetic coding sequence
atgagcagccccctgcagagagccgtgggcgacaccaagagagccctgagcgccagcagcagcagcagcgccagcctgcccttcgacgacagagacagcaaccacaccagcgagggcaacggcgacagcctgctggccgacgaggacaccgacttcgaggacagcctgaacagaaacgtgaagaagagagccgccaagagaccccccaagaccacccccgtggccaagcaccccaagaagggcagcagagtggtgcacagacacagcagaaagcagagcgagccccccgccaacgacctgttcaacgccgtgaaggccgccaagagcgacatgcagagcctggtggacgagtggctggacagctacaagcaggaccaggacgccggcttcctggagctggtgaacttcttcatccagagctgcggctgcaagggcatcgtgacccccgagatgttcaagaagatgagcaacagcgagatcatccagcacctgaccgagcagttcaacgagatggacgacctgatcagcctgctgaccggcctgagcgacagccaggtgagagccttcagacacaccagcaccctggccgccatgaagctgatgaccagcctggtgaaggtggccctgcagctgagcgtgcaccaggacaacaaccagagacagtacgaggccgagagaaacaagggccccggccagagagcccccgagagactggagagcctgctggagaagagaaaggagctgcaggagcaccaggaggagatcgagggcatgatgaacgccctgttcagaggcgtgttcgtgcacagatacagagacgtgctgcccgagatcagagccatctgcatcgaggagatcggctgctggatgcagagctacagcaccagcttcctgaccgacagctacctgaagtacatcggctggaccctgcacgacaagcacagagaggtgagactgaagtgcgtgaaggccctgaagggcctgtacggcaacagagacctgaccaccagactggagctgttcaccagcagattcaaggacagaatggtgagcatggtgatggacagagagtacgacgtggccgtggaggccgtgagactgctgatcctgatcctgaagaacatggagggcgtgctgaccgacgccgactgcgagagcgtgtaccccgtggtgtacgccagccacagaggcctggccagcgccgccggcgagttcctgtactggaagctgttctaccccgagtgcgagatcagaatgatgggcggcagagagcagagacagagccccggcgcccagagaaccttcttccagctgctgctgagcttcttcgtggagagcgagctgcacgaccacgccgcctacctggtggacagcctgtgggactgcgccggcgccagactgaaggactgggagggcctgaccagcctgctgctggagaaggaccagaacctgggcgacgtgcaggagagcaccctgatcgagatcctggtgagcagcgccagacaggccagcgagggccacccccccgtgggcagagtgaccggcagaaagggcctgaccagcaaggagagaaagacccaggccgacgacagagtgaagctgaccgagcacctgatccccctgctgccccagctgctggccaagttcagcgccgacgccgagaaggtgacccccctgctgcagctgctgagctgcttcgacctgcacatctactgcaccggcagactggagaagcacctggagctgttcctgcagcagctgcaggaggtggtggtgaagcacgccgagcccgccgtgctggaggccggcgcccacgccctgtacctgctgtgcaaccccgagttcaccttcttcagcagagccgacttcgccagaagccagctggtggacctgctgaccgacagattccagcaggagctggaggagctgctgcagagcagcttcctggacgaggacgaggtgtacaacctggccgccaccctgaagagactgagcgccttctacaacacccacgacctgaccagatgggagctgtacgagccctgctgccagctgctgcagaaggccgtggacaccggcgaggtgccccaccaggtgatcctgcccgccctgaccctggtgtacttcagcatcctgtggaccctgacccacagcctgagccccgtggagaacaccgccgagaccagcccccaggtgctgcccagcagcaagagaagaagagtggagggccccgccaagcccaacagagaggacgtgagcagcagccaggaggagagcctgcagctgaacagcatcccccccacccccaccctgaccagcaccgccgtgaagagcagacagcccctgtggggcctgaaggagatggaggaggaggacggcagcgagctggacttcgcccagggccagcccgtggccggcaccgagagaagcagattcctgggcccccagtacttccagaccccccacaaccccagcggccccggcctgggcaaccagctgatgagactgagcctgatggaggaggacgaggaggaggagctggagatccaggacgagagcaacgaggagagacaggacaccgacatgcaggccagcagctacagcagcaccagcgagagaggcctggacctgctggacagcaccgagctggacatcgaggacttctag

SEQ ID NO: 101070 - DNA, 789 bp, Artificial Sequence
  Description of Artificial Sequence: Synthetic coding sequence
atgctgcacaaggagggcatccagttcagcctgagcgagctgccccccgccggcagcagcaaccagccccccaacctggccttcctggagctgctgagcgagttcagccccagactgttccaccaggacaagcagctgctgctgagctacctggagaagtgcctgcagcacgtgagccaggcccccggccacccctggggccccgtgaccacctactgccacagcctgagccccgtggagaacaccgccgagaccagcccccaggtgctgcccagcagcaagagaagaagagtggagggccccgccaagcccaacagagaggacgtgagcagcagccaggaggagagcctgcagctgaacagcatcccccccacccccaccctgaccagcaccgccgtgaagagcagacagcccctgtggggcctgaaggagatggaggaggaggacggcagcgagctggacttcgcccagggcagccagcccgtggccggcaccgagagaagcagattcctgggcccccagtacttccagaccccccacaaccccagcggccccggcctgggcaaccagctgatgagactgagcctgatggaggaggacgaggaggaggagctggagatccaggacgagagcaacgaggagagacaggacaccgacatgcaggccagcagctacagcagcaccagcgagagaggcctggacctgctggacagcaccgagctggacatcgagatcaccgagagcctgcccctgctgggcaagagcccccacccctacaacagcagatag

SEQ ID NO: 101071 - DNA, 438 bp, Artificial Sequence
  Description of Artificial Sequence: Synthetic coding sequence
atgagcagccccctgcagagagccgtgggcgacaccaagagagccctgagcgccagcagcagcagcagcgccagcctgcccttcgacgacagagacagcaaccacaccagcgagggcaacggcgacagcctgctggccgacgaggacaccgacttcgaggacagcctgaacagaaacgtgaagaagagagccgccaagagaccccccaagaccacccccgtggccaagcaccccaagaagggcagcagagtggtgcacagacacagcagaaagcagagcgagccccccgccaacgacctgttcaacgccgtgaaggccgccaagagcgacatgcagagcctggtggacgagtggctggacagctacaagcaggaccaggacgccggcttcctggagctggtgaacttcttcatccagagctgcggctgcaagggctag

SEQ ID NO: 101072 - DNA, 339 bp, Artificial Sequence
  Description of Artificial Sequence: Synthetic coding sequence
atgagcagccccctgcagagagccgtgggcgacaccaagagagccctgagcgccagcagcagcagcagcgccagcctgcccttcgacgacagagacagcaaccacaccagcgagggcaacggcgacagcctgctggccgacgaggacaccgacttcgaggacagcctgaacagaaacgtgaagaagagagccgccaagagaccccccaagaccacccccgtggccaagcaccccaagaagggcagcagagtggtgcacagacacagcagaaagcagagcgagccccccgccaacgacctgttcaacgccgtgaaggccgccaagagcgacatgcagtag

SEQ ID NO: 101073 - DNA, 3678 bp, Artificial Sequence; identical to SEQ ID NO: 101068
  Description of Artificial Sequence: Synthetic coding sequence

SEQ ID NO: 101074 - DNA, 567 bp, Artificial Sequence
  Description of Artificial Sequence: Synthetic coding sequence
atgagcagccccctgcagagagccgtgggcgacaccaagagagccctgagcgccagcagcagcagcagcgccagcctgcccttcgacgacagagacagcaaccacaccagcgagggcaacggcgacagcctgctggccgacgaggacaccgacttcgaggacagcctgaacagaaacgtgaagaagagagccgccaagagaccccccaagaccacccccgtggccaagcaccccaagaagggcagcagagtggtgcacagacacagcagaaagcagagcgagccccccgccaacgacctgttcaacgccgtgaaggccgccaagagcgacatgcaggacagcggcgactaccccctgatcgcccccggccccagctggaagaagttccagggcagcttctgcgagttcgtgagaaccctggtgtgccagtgccagtacagcctgctgtacgacggcttccccatggacgacctgatcagcctgctgaccggcctgagcgacagccaggtgagagccttcagacacaccagcaccctggccgccatgaagctgatgaccagcctgtag

SEQ ID NO: 101075 - DNA, 1047 bp, Artificial Sequence
  Description of Artificial Sequence: Synthetic coding sequence
atggtgtggccctgggtggccatggccagcagatggggccccctgatcggcctggccccctgctgcctgtggctgctgggcgccgtgctgctgatggacgccagcgccagacccgccaaccacagcagcaccagagagagagtggccaacagagaggagaacgagatcctgccccccgaccacctgaacggcgtgaagctggagatggacggccacctgaacagaggcttccaccaggaggtgttcctgggcaaggacctgggcggcttcgacgaggacgccgagcccagaagaagcagaagaaagctgatggtgatcttcagcaaggtggacgtgaacaccgacagaaagatcagcgccaaggagatgcagagatggatcatggagaagaccgccgagcacttccaggaggccatggaggagagcaagacccacttcagagccgtggaccccgacggcgacggccacgtgagctgggacgagtacaaggtgaagttcctggccagcaagggccacagcgagaaggaggtggccgacgccatcagactgaacgaggagctgaaggtggacgaggagacccaggaggtgctggagaacctgaaggacagatggtaccaggccgacagcccccccgccgacctgctgctgaccgaggaggagttcctgagcttcctgcaccccgagcacagcagaggcatgctgagattcatggtgaaggagatcgtgagagacctggaccaggacggcgacaagcagctgagcgtgcccgagttcatcagcctgcccgtgggcaccgtggagaaccagcagggccaggacatcgacgacaactgggtgaaggacagaaagaaggagttcgaggagctgatcgacagcaaccacgacggcatcgtgaccgccgaggagctggagaacgtgcccaccctgcccctgcagcccatcggcaccctgaacagccacttcgtgagactggccgccgagctgggcggcggcaaggccaccctgacctgcgcccccctggccagaagagccacctggaccccctag

SEQ ID NO: 101076 - DNA, 1089 bp, Artificial Sequence
  Description of Artificial Sequence: Synthetic coding sequence
atggtgtggccctgggtggccatggccagcagatggggccccctgatcggcctggccccctgctgcctgtggctgctgggcgccgtgctgctgatggacgccagcgccagacccgccaaccacagcagcaccagagagagagtggccaacagagaggagaacgagatcctgccccccgaccacctgaacggcgtgaagctggagatggacggccacctgaacagaggcttccaccaggaggtgttcctgggcaaggacctgggcggcttcgacgaggacgccgagcccagaagaagcagaagaaagctgatggtgatcttcagcaaggtggacgtgaacaccgacagaaagatcagcgccaaggagatgcagagatggatcatggagaagaccgccgagcacttccaggaggccatggaggagagcaagacccacttcagagccgtggaccccgacggcgacggccacgtgagctgggacgagtacaaggtgaagttcctggccagcaagggccacagcgagaaggaggtggccgacgccatcagactgaacgaggagctgaaggtggacgaggagacccaggaggtgctggagaacctgaaggacagatggtaccaggccgacagcccccccgccgacctgctgctgaccgaggaggagttcctgagcttcctgcaccccgagcacagcagaggcatgctgagattcatggtgaaggagatcgtgagagacctggaccaggacggcgacaagcagctgagcgtgcccgagttcatcagcctgcccgtgggcaccgtggagaaccagcagggccaggacatcgacgacaactgggtgaaggacagaaagaaggagttcgaggagctgatcgacagcaaccacgacggcatcgtgaccgccgaggagctggagagctacatggaccccatgaacgagtacaacgccctgaacgaggccaagcagatgatcgccgtggccgacgagaaccagaaccaccacctggagcccgaggaggtgctgaagtacagcgagttcttcaccggcagcaagctggtggactacgccagaagcgtgcacgaggagttctag

SEQ ID NO: 101077 - DNA, 732 bp, Artificial Sequence
  Description of Artificial Sequence: Synthetic coding sequence
tgactggagatggacggccacctgaacagaggcttccaccaggaggtgttcctgggcaaggacctgggcggcttcgacgaggacgccgagcccagaagaagcagaagaaagctgatggtgatcttcagcaaggtggacgtgaacaccgacagaaagatcagcgccaaggagatgcagagatggatcatggagaagaccgccgagcacttccaggaggccatggaggagagcaagacccacttcagagccgtggaccccgacggcgacggccacgtgagctgggacgagtacaaggtgaagttcctggccagcaagggccacagcgagaaggaggtggccgacgccatcagactgaacgaggagctgaaggtggacgaggagagcagcaccagcagaaacttcctggacctgagagccggcgtgtgcagacccagatacccccaggccgcccccctgagcgcccaggaggtgctggagaacctgaaggacagatggtaccaggccgacagcccccccgccgacctgctgctgaccgaggaggagttcctgagcttcctgcaccccgagcacagcagaggcatgctgagattcatggtgaaggagatcgtgagagacctggaccaggacggcgacaagcagctgagcgtgcccgagttcatcagcctgcccgtgggcaccgtggagaaccagcagggccaggacatcgacgacaactgggtgaaggacagatag

SEQ ID NO: 101078 - DNA, 609 bp, Artificial Sequence
  Description of Artificial Sequence: Synthetic coding sequence
atggtgtggccctgggtggccatggccagcagatggggccccctgatcggcctggccccctgctgcctgtggctgctgggcgccgtgctgctgatggacgccagcgccagacccgccaaccacagcagcaccagagagagagtggccaacagagaggagaacgagatcctgccccccgaccacctgaacggcgtgaagctggagatggacggccacctgaacagaggcttccaccaggaggtgttcctgggcaaggacctgggcggcttcgacgaggacgccgagcccagaagaagcagaagaaagctgatggtgatcttcagcaaggtggacgtgaacaccgacagaaagatcagcgccaaggagatgcagagatggatcatggagaagaccgccgagcacttccaggaggccatggaggagagcaagacccacttcagagccgtggaccccgacggcgacggccacgtgagctgggacgagtacaaggtgaagttcctggccagcaagggccacagcgagaaggaggtggccgacgccatcagactgaacgaggagctgaaggtggacgaggagagacacggcccccccggccccagagccctgtag

SEQ ID NO: 101079 - DNA, 636 bp, Artificial Sequence
  Description of Artificial Sequence: Synthetic coding sequence
atggccgtggtgcccctgctgctgctgggcggcctgtggagcgccgtgggcgccagcagcctgggcgtggtgacctgcggcagcgtggtgaagctgctgaacaccagacacaacgtgagactgcacagccacgacgtgagatacggcagcggcagcggccagcagagcgtgaccggcgtgaccagcgtggacgacagcaacagctactggagaatcagaggcaagagcgccaccgtgtgcgagagaggcacccccatcaagtgcggccagcccatcagactgacccacgtgaacaccggcagaaacctgcacagccaccacttcaccagccccctgagcggcaaccaggaggtgagcgccttcggcgaggagggcgagggcgactacctggacgactggaccgtgctgtgcaacggcccctactgggtgagagacggcgaggtgagattcaagcacagcagcaccgaggtgctgctgagcgtgaccggcgagcagtacggcagacccatcagcggccagaaggaggtgcacggcatggcccagcccagccagaacaactactggaaggccatggagggcatcttcatgaagcccagcgagctgctgaaggccgaggcccaccacgccgagctgtag

SEQ ID NO: 101080 - DNA, 666 bp, Artificial Sequence
  Description of Artificial Sequence: Synthetic coding sequence
atgtggagcgccggcagaggcggcgccgcctggcccgtgctgctgggcctgctgctggccctgctggtgcccggcggcggcgccgccaagaccggcgccgagctggtgacctgcggcagcgtgctgaagctgctgaacacccaccacagagtgagactgcacagccacgacatcaagtacggcagcggcagcggccagcagagcgtgaccggcgtggaggccagcgacgacgccaacagctactggagaatcagaggcggcagcgagggcggctgccccagaggcagccccgtgagatgcggccaggccgtgagactgacccacgtgctgaccggcaagaacctgcacacccaccacttccccagccccctgagcaacaaccaggaggtgagcgccttcggcgaggacggcgagggcgacgacctggacctgtggaccgtgagatgcagcggccagcactgggagagagaggccgccgtgagattccagcacgtgggcaccagcgtgttcctgagcgtgaccggcgagcagtacggcagccccatcagaggccagcacgaggtgcacggcatgcccagcgccaacacccacaacacctggaaggccatggagggcatcttcatcaagcccagcgtggagcccagcgccggccacgacgagctgtag

SEQ ID NO: 101081 - DNA, 2058 bp, Artificial Sequence
  Description of Artificial Sequence: Synthetic coding sequence
atggacgtgtgcgtgagactggccctgtggctgctgtggggcctgctgctgcaccagggccagagcctgagccacagccacagcgagaaggccaccggcaccagcagcggcgccaacagcgaggagagcaccgccgccgagttctgcagaatcgacaagcccctgtgccacagcgaggacgagaagctgagcttcgaggccgtgagaaacatccacaagctgatggacgacgacgccaacggcgacgtggacgtggaggagagcgacgagttcctgagagaggacctgaactaccacgaccccaccgtgaagcacagcaccttccacggcgaggacaagctgatcagcgtggaggacctgtggaaggcctggaagagcagcgaggtgtacaactggaccgtggacgaggtggtgcagtggctgatcacctacgtggagctgccccagtacgaggagaccttcagaaagctgcagctgagcggccacgccatgcccagactggccgtgaccaacaccaccatgaccggcaccgtgctgaagatgaccgacagaagccacagacagaagctgcagctgaaggccctggacaccgtgctgttcggcccccccctgctgaccagacacaaccacctgaaggacttcatgctggtggtgagcatcgtgatcggcgtgggcggctgctggttcgcctacatccagaacagatacagcaaggagcacatgaagaagatgatgaaggacctggagggcctgcacagagccgagcagagcctgcacgacctgcaggagagactgcacaaggcccaggaggagcacagaaccgtggaggtggagaaggtgcacctggagaagaagctgagagacgagatcaacctggccaagcaggaggcccagagactgaaggagctgagagagggcaccgagaacgagagaagcagacagaagtacgccgaggaggagctggagcaggtgagagaggccctgagaaaggccgagaaggagctggagagccacagcagctggtacgcccccgaggccctgcagaagtggctgcagctgacccacgaggtggaggtgcagtactacaacatcaagaagcagaacgccgagaagcagctgctggtggccaaggagggcgccgagaagatcaagaagaagagaaacaccctgttcggcaccttccacgtggcccacagcagcagcctggacgacgtggaccacaagatcctgaccgccaagcaggccctgagcgaggtgaccgccgccctgagagagagactgcacagatggcagcagatcgagatcctgtgcggcttccagatcgtgaacaaccccggcatccacagcctggtggccgccctgaacatcgaccccagctggatgggcagcaccagacccaaccccgcccacttcatcatgaccgacgacgtggacgacatggacgaggagatcgtgagccccctgagcatgcagagccccagcctgcagagcagcgtgagacagagactgaccgagccccagcacggcctgggcagccagagagacctgacccacagcgacagcgagagcagcctgcacatgagcgacagacagagagtggcccccaagcccccccagatgagcagagccgccgacgaggccctgaacgccatgaccagcaacggcagccacagactgatcgagggcgtgcaccccggcagcctggtggagaagctgcccgacagccccgccctggccaagaaggccctgctggccctgaaccacggcctggacaaggcccacagcctgatggagctgagccccagcgccccccccggcggcagcccccacctggacagcagcagaagccacagccccagcagccccgaccccgacacccccagccccgtgggcgacagcagagccctgcaggccagcagaaacaccagaatcccccacctggccggcaagaaggccgtggccgaggaggacaacggcagcatcggcgaggagaccgacagcagccccggcagaaagaagttccccctgaagatcttcaagaagcccctgaagaagtag

SEQ ID NO: 101082 - DNA, 2502 bp, Artificial Sequence
  Description of Artificial Sequence: Synthetic coding sequence
atgaacgccgccggcatcagagcccccgaggccgccggcgccgacggcaccagactggcccccggcggcagcccctgcctgagaagaagaggcagacccgaggagagccccgccgccgtggtggcccccagaggcgccggcgagctgcaggccgccggcgcccccctgagattccaccccgccagccccagaagactgcaccccgccagcacccccggccccgcctggggctggctgctgagaagaagaagatgggccgccctgctggtgctgggcctgctggtggccggcgccgccgacggctgcgagctggtgcccagacacctgagaggcagaagagccaccggcagcgccgccaccgccgccagcagccccgccgccgccgccggcgacagccccgccctgatgaccgacccctgcatgagcctgagccccccctgcttcaccgaggaggacagattcagcctggaggccctgcagaccatccacaagcagatggacgacgacaaggacggcggcatcgaggtggaggagagcgacgagttcatcagagaggacatgaagtacaaggacgccaccaacaagcacagccacctgcacagagaggacaagcacatcaccatcgaggacctgtggaagagatggaagaccagcgaggtgcacaactggaccctggaggacaccctgcagtggctgatcgagttcgtggagctgccccagtacgagaagaacttcagagacaacaacgtgaagggcaccaccctgcccagaatcgccgtgcacgagcccagcttcatgatcagccagctgaagatcagcgacagaagccacagacagaagctgcagctgaaggccctggacgtggtgctgttcggccccctgaccagacccccccacaactggatgaaggacttcatcctgaccgtgagcatcgtgatcggcgtgggcggctgctggttcgcctacacccagaacaagaccagcaaggagcacgtggccaagatgatgaaggacctggagagcctgcagaccgccgagcagagcctgatggacctgcaggagagactggagaaggcccaggaggagaacagaaacgtggccgtggagaagcagaacctggagagaaagatgatggacgagatcaactacgccaaggaggaggcctgcagactgagagagctgagagagggcgccgagtgcgagctgagcagaagacagtacgccgagcaggagctggagcaggtgagaatggccctgaagaaggccgagaaggagttcgagctgagaagcagctggagcgtgcccgacgccctgcagaagtggctgcagctgacccacgaggtggaggtgcagtactacaacatcaagagacagaacgccgagatgcagctggccatcgccaaggacgaggccgagaagatcaagaagaagagaagcaccgtgttcggcaccctgcacgtggcccacagcagcagcctggacgaggtggaccacaagatcctggaggccaagaaggccctgagcgagctgaccacctgcctgagagagagactgttcagatggcagcagatcgagaagatctgcggcttccagatcgcccacaacagcggcctgcccagcctgaccagcagcctgtacagcgaccacagctgggtggtgatgcccagagtgagcatccccccctaccccatcgccggcggcgtggacgacctggacgaggacaccccccccatcgtgagccagttccccggcaccatggccaagccccccggcagcctggccagaagcagcagcctgtgcagaagcagaagaagcatcgtgcccagcagcccccagccccagagagcccagctggccccccacgccccccaccccagccaccccagacacccccaccacccccagcacaccccccacagcctgcccagccccgaccccgacatcctgagcgtgagcagctgccccgccctgtacagaaacgaggaggaggaggaggccatctacttcagcgccgagaagcagtgggaggtgcccgacaccgccagcgagtgcgacagcctgaacagcagcatcggcagaaagcagagcccccccctgagcctggagatctaccagaccctgagccccagaaagatcagcagagacgaggtgagcctggaggacagcagcagaggcgacagccccgtgaccgtggacgtgagctggggcagccccgactgcgtgggcctgaccgagaccaagagcatgatcttcagccccgccagcaaggtgtacaacggcatcctggagaagagctgcagcatgaaccagctgagcagcggcatccccgtgcccaagcccagacacaccagctgcagcagcgccggcaacgacagcaagcccgtgcaggaggcccccagcgtggccagaatcagcagcatcccccacgacctgtgccacaacggcgagaagagcaagaagcccagcaagatcaagagcctgttcaagaagaagagcaagtag

SEQ ID NO: 101083 - DNA, 2526 bp, Artificial Sequence
  Description of Artificial Sequence: Synthetic coding sequence
atgaacgccgccggcatcagagcccccgaggccgccggcgccgacggcaccagactggcccccggcggcagcccctgcctgagaagaagaggcagacccgaggagagccccgccgccgtggtggcccccagaggcgccggcgagctgcaggccgccggcgcccccctgagattccaccccgccagccccagaagactgcaccccgccagcacccccggccccgcctggggctggctgctgagaagaagaagatgggccgccctgctggtgctgggcctgctggtggccggcgccgccgacggctgcgagctggtgcccagacacctgagaggcagaagagccaccggcagcgccgccaccgccgccagcagccccgccgccgccgccggcgacagccccgccctgatgaccgacccctgcatgagcctgagccccccctgcttcaccgaggaggacagattcagcctggaggccctgcagaccatccacaagcagatggacgacgacaaggacggcggcatcgaggtggaggagagcgacgagttcatcagagaggacatgaagtacaaggacgccaccaacaagcacagccacctgcacagagaggacaagcacatcaccatcgaggacctgtggaagagatggaagaccagcgaggtgcacaactggaccctggaggacaccctgcagtggctgatcgagttcgtggagctgccccagtacgagaagaacttcagagacaacaacgtgaagggcaccaccctgcccagaatcgccgtgcacgagcccagcttcatgatcagccagctgaagatcagcgacagaagccacagacagaagctgcagctgaaggccctggacgtggtgctgttcggccccctgaccagacccccccacaactggatgaaggacttcatcctgaccgtgagcatcgtgatcggcgtgggcggctgctggttcgcctacacccagaacaagaccagcaaggagcacgtggccaagatgatgaaggacctggagagcctgcagaccgccgagcagagcctgatggacctgcaggagagactggagaaggcccaggaggagaacagaaacgtggccgtggagaagcagaacctggagagaaagatgatggacgagatcaactacgccaaggaggaggcctgcagactgagagagctgagagagggcgccgagtgcgagctgagcagaagacagtacgccgagcaggagctggagcaggtgagaatggccctgaagaaggccgagaaggagttcgagctgagaagcagctggagcgtgcccgacgccctgcagaagtggctgcagctgacccacgaggtggaggtgcagtactacaacatcaagagacagaacgccgagatgcagctggccatcgccaaggacgaggtggccgccagctacctgatccaggccgagaagatcaagaagaagagaagcaccgtgttcggcaccctgcacgtggcccacagcagcagcctggacgaggtggaccacaagatcctggaggccaagaaggccctgagcgagctgaccacctgcctgagagagagactgttcagatggcagcagatcgagaagatctgcggcttccagatcgcccacaacagcggcctgcccagcctgaccagcagcctgtacagcgaccacagctgggtggtgatgcccagagtgagcatccccccctaccccatcgccggcggcgtggacgacctggacgaggacaccccccccatcgtgagccagttccccggcaccatggccaagccccccggcagcctggccagaagcagcagcctgtgcagaagcagaagaagcatcgtgcccagcagcccccagccccagagagcccagctggccccccacgccccccaccccagccaccccagacacccccaccacccccagcacaccccccacagcctgcccagccccgaccccgacatcctgagcgtgagcagctgccccgccctgtacagaaacgaggaggaggaggaggccatctacttcagcgccgagaagcagtgggaggtgcccgacaccgccagcgagtgcgacagcctgaacagcagcatcggcagaaagcagagcccccccctgagcctggagatctaccagaccctgagccccagaaagatcagcagagacgaggtgagcctggaggacagcagcagaggcgacagccccgtgaccgtggacgtgagctggggcagccccgactgcgtgggcctgaccgagaccaagagcatgatcttcagccccgccagcaaggtgtacaacggcatcctggagaagagctgcagcatgaaccagctgagcagcggcatccccgtgcccaagcccagacacaccagctgcagcagcgccggcaacgacagcaagcccgtgcaggaggcccccagcgtggccagaatcagcagcatcccccacgacctgtgccacaacggcgagaagagcaagaagcccagcaagatcaagagcctgttcaagaagaagagcaagtag

SEQ ID NO: 101084 - DNA, 2061 bp, Artificial Sequence
  Description of Artificial Sequence: Synthetic coding sequence
atgaacgccgccggcatcagagcccccgaggccgccggcgccgacggcaccagactggcccccggcggcagcccctgcctgagaagaagaggcagacccgaggagagccccgccgccgtggtggcccccagaggcgccggcgagctgcaggccgccggcgcccccctgagattccaccccgccagccccagaagactgcaccccgccagcacccccggccccgcctggggctggctgctgagaagaagaagatgggccgccctgctggtgctgggcctgctggtggccggcgccgccgacggctgcgagctggtgcccagacacctgagaggcagaagagccaccggcagcgccgccaccgccgccagcagccccgccgccgccgccggcgacagccccgccctgatgaccgacccctgcatgagcctgagccccccctgcttcaccgaggaggacagattcagcctggaggccctgcagaccatccacaagcagatggacgacgacaaggacggcggcatcgaggtggaggagagcgacgagttcatcagagaggacatgaagtacaaggacgccaccaacaagcacagccacctgcacagagaggacaagcacatcaccatcgaggacctgtggaagagatggaagaccagcgaggtgcacaactggaccctggaggacaccctgcagtggctgatcgagttcgtggagctgccccagtacgagaagaacttcagagacaacaacgtgaagggcaccaccctgcccagaatcgccgtgcacgagcccagcttcatgatcagccagctgaagatcagcgacagaagccacagacagaagctgcagctgaaggccctggacgtggtgctgttcggccccctgaccagacccccccacaactggatgaaggacttcatcctgaccgtgagcatcgtgatcggcgtgggcggctgctggttcgcctacacccagaacaagaccagcaaggagcacgtggccaagatgatgaaggacctggagagcctgcagaccgccgagcagagcctgatggacctgcaggagagactggagaaggcccaggaggagaacagaaacgtggccgtggagaagcagaacctggagagaaagatgatggacgagatcaactacgccaaggaggaggcctgcagactgagagagctgagagagggcgccgagtgcgagctgagcagaagacagtacgccgagcaggagctggagcaggtgagaatggccctgaagaaggccgagaaggagttcgagctgagaagcagctggagcgtgcccgacgccctgcagaagtggctgcagctgacccacgaggtggaggtgcagtactacaacatcaagagacagaacgccgagatgcagctggccatcgccaaggacgaggccgagaagatcaagaagaagagaagcaccgtgttcggcaccctgcacgtggcccacagcagcagcctggacgaggtggaccacaagatcctggaggccaagaaggccctgagcgagctgaccacctgcctgagagagagactgttcagatggcagcagatcgagaagatctgcggcttccagatcgcccacaacagcggcctgcccagcctgaccagcagcctgtacagcgaccacagctgggtggtgatgcccagagtgagcatccccccctaccccatcgccggcggcgtggacgacctggacgaggacaccccccccatcgtgagccagttccccggcaccatggccaagccccccggcagcctggccagaagcagcagcctgtgcagaagcagaagaagcatcgtgcccagcagcccccagccccagagagcccagctggccccccacgccccccaccccagccaccccagacacccccaccacccccagcacaccccccacagcctgcccagccccgaccccgacatcctgagcgtgagcagctgccccgccctgtacagaaacgaggaggaggaggaggccatctacttcagcgccgagaagcagtgcatccacctgggcctgggcgcctgcaagagcgagtag

SEQ ID NO: 101085 - DNA, 2241 bp, Artificial Sequence
  Description of Artificial Sequence: Synthetic coding sequence
ctgctggtgctgggcctgctggtggccggcgccgccgacggctgcgagctggtgcccagacacctgagaggcagaagagccaccggcagcgccgccaccgccgccagcagccccgccgccgccgccggcgacagccccgccctgatgaccgacccctgcatgagcctgagccccccctgcttcaccgaggaggacagattcagcctggaggccctgcagaccatccacaagcagatggacgacgacaaggacggcggcatcgaggtggaggagagcgacgagttcatcagagaggacatgaagtacaaggacgccaccaacaagcacagccacctgcacagagaggacaagcacatcaccatcgaggacctgtggaagagatggaagaccagcgaggtgcacaactggaccctggaggacaccctgcagtggctgatcgagttcgtggagctgccccagtacgagaagaacttcagagacaacaacgtgaagggcaccaccctgcccagaatcgccgtgcacgagcccagcttcatgatcagccagctgaagatcagcgacagaagccacagacagaagctgcagctgaaggccctggacgtggtgctgttcggccccctgaccagacccccccacaactggatgaaggacttcatcctgaccgtgagcatcgtgatcggcgtgggcggctgctggttcgcctacacccagaacaagaccagcaaggagcacgtggccaagatgatgaaggacctggagagcctgcagaccgccgagcagagcctgatggacctgcaggagagactggagaaggcccaggaggagaacagaaacgtggccgtggagaagcagaacctggagagaaagatgatggacgagatcaactacgccaaggaggaggcctgcagactgagagagctgagagagggcgccgagtgcgagctgagcagaagacagtacgccgagcaggagctggagcaggtgagaatggccctgaagaaggccgagaaggagttcgagctgagaagcagctggagcgtgcccgacgccctgcagaagtggctgcagctgacccacgaggtggaggtgcagtactacaacatcaagagacagaacgccgagatgcagctggccatcgccaaggacgaggccgagaagatcaagaagaagagaagcaccgtgttcggcaccctgcacgtggcccacagcagcagcctggacgaggtggaccacaagatcctggaggccaagaaggccctgagcgagctgaccacctgcctgagagagagactgttcagatggcagcagatcgagaagatctgcggcttccagatcgcccacaacagcggcctgcccagcctgaccagcagcctgtacagcgaccacagctgggtggtgatgcccagagtgagcatccccccctaccccatcgccggcggcgtggacgacctggacgaggacaccccccccatcgtgagccagttccccggcaccatggccaagccccccggcagcctggccagaagcagcagcctgtgcagaagcagaagaagcatcgtgcccagcagcccccagccccagagagcccagctggccccccacgccccccaccccagccaccccagacacccccaccacccccagcacaccccccacagcctgcccagccccgaccccgacatcctgagcgtgagcagctgccccgccctgtacagaaacgaggaggaggaggaggccatctacttcagcgccgagaagcagtgggaggtgcccgacaccgccagcgagtgcgacagcctgaacagcagcatcggcagaaagcagagcccccccctgagcctggagatctaccagaccctgagccccagaaagatcagcagagacgaggtgagcctggaggacagcagcagaggcgacagccccgtgaccgtggacgtgagctggggcagccccgactgcgtgggcctgaccgagaccaagagcatgatcttcagccccgccagcaaggtgtacaacggcatcctggagaagagctgcagcatgaaccagctgagcagcggcatccccgtgcccaagcccagacacaccagctgcagcagcgccggcaacgacagcaagcccgtgcaggaggcccccagcgtggccagaatcagcagcatcccccacgacctgtgccacaacggcgagaagagcaagaagcccagcaagatcaagagcctgttcaagaagaagagcaagtag

SEQ ID NO: 101086 - DNA, 2265 bp, Artificial Sequence
  Description of Artificial Sequence: Synthetic coding sequence
ctgctggtgctgggcctgctggtggccggcgccgccgacggctgcgagctggtgcccagacacctgagaggcagaagagccaccggcagcgccgccaccgccgccagcagccccgccgccgccgccggcgacagccccgccctgatgaccgacccctgcatgagcctgagccccccctgcttcaccgaggaggacagattcagcctggaggccctgcagaccatccacaagcagatggacgacgacaaggacggcggcatcgaggtggaggagagcgacgagttcatcagagaggacatgaagtacaaggacgccaccaacaagcacagccacctgcacagagaggacaagcacatcaccatcgaggacctgtggaagagatggaagaccagcgaggtgcacaactggaccctggaggacaccctgcagtggctgatcgagttcgtggagctgccccagtacgagaagaacttcagagacaacaacgtgaagggcaccaccctgcccagaatcgccgtgcacgagcccagcttcatgatcagccagctgaagatcagcgacagaagccacagacagaagctgcagctgaaggccctggacgtggtgctgttcggccccctgaccagacccccccacaactggatgaaggacttcatcctgaccgtgagcatcgtgatcggcgtgggcggctgctggttcgcctacacccagaacaagaccagcaaggagcacgtggccaagatgatgaaggacctggagagcctgcagaccgccgagcagagcctgatggacctgcaggagagactggagaaggcccaggaggagaacagaaacgtggccgtggagaagcagaacctggagagaaagatgatggacgagatcaactacgccaaggaggaggcctgcagactgagagagctgagagagggcgccgagtgcgagctgagcagaagacagtacgccgagcaggagctggagcaggtgagaatggccctgaagaaggccgagaaggagttcgagctgagaagcagctggagcgtgcccgacgccctgcagaagtggctgcagctgacccacgaggtggaggtgcagtactacaacatcaagagacagaacgccgagatgcagctggccatcgccaaggacgaggtggccgccagctacctgatccaggccgagaagatcaagaagaagagaagcaccgtgttcggcaccctgcacgtggcccacagcagcagcctggacgaggtggaccacaagatcctggaggccaagaaggccctgagcgagctgaccacctgcctgagagagagactgttcagatggcagcagatcgagaagatctgcggcttccagatcgcccacaacagcggcctgcccagcctgaccagcagcctgtacagcgaccacagctgggtggtgatgcccagagtgagcatccccccctaccccatcgccggcggcgtggacgacctggacgaggacaccccccccatcgtgagccagttccccggcaccatggccaagccccccggcagcctggccagaagcagcagcctgtgcagaagcagaagaagcatcgtgcccagcagcccccagccccagagagcccagctggccccccacgccccccaccccagccaccccagacacccccaccacccccagcacaccccccacagcctgcccagccccgaccccgacatcctgagcgtgagcagctgccccgccctgtacagaaacgaggaggaggaggaggccatctacttcagcgccgagaagcagtgggaggtgcccgacaccgccagcgagtgcgacagcctgaacagcagcatcggcagaaagcagagcccccccctgagcctggagatctaccagaccctgagccccagaaagatcagcagagacgaggtgagcctggaggacagcagcagaggcgacagccccgtgaccgtggacgtgagctggggcagccccgactgcgtgggcctgaccgagaccaagagcatgatcttcagccccgccagcaaggtgtacaacggcatcctggagaagagctgcagcatgaaccagctgagcagcggcatccccgtgcccaagcccagacacaccagctgcagcagcgccggcaacgacagcaagcccgtgcaggaggcccccagcgtggccagaatcagcagcatcccccacgacctgtgccacaacggcgagaagagcaagaagcccagcaagatcaagagcctgttcaagaagaagagcaagtag

SEQ ID NO: 101087 - DNA, 1800 bp, Artificial Sequence
  Description of Artificial Sequence: Synthetic coding sequence
ctgctggtgctgggcctgctggtggccggcgccgccgacggctgcgagctggtgcccagacacctgagaggcagaagagccaccggcagcgccgccaccgccgccagcagccccgccgccgccgccggcgacagccccgccctgatgaccgacccctgcatgagcctgagccccccctgcttcaccgaggaggacagattcagcctggaggccctgcagaccatccacaagcagatggacgacgacaaggacggcggcatcgaggtggaggagagcgacgagttcatcagagaggacatgaagtacaaggacgccaccaacaagcacagccacctgcacagagaggacaagcacatcaccatcgaggacctgtggaagagatggaagaccagcgaggtgcacaactggaccctggaggacaccctgcagtggctgatcgagttcgtggagctgccccagtacgagaagaacttcagagacaacaacgtgaagggcaccaccctgcccagaatcgccgtgcacgagcccagcttcatgatcagccagctgaagatcagcgacagaagccacagacagaagctgcagctgaaggccctggacgtggtgctgttcggccccctgaccagacccccccacaactggatgaaggacttcatcctgaccgtgagcatcgtgatcggcgtgggcggctgctggttcgcctacacccagaacaagaccagcaaggagcacgtggccaagatgatgaaggacctggagagcctgcagaccgccgagcagagcctgatggacctgcaggagagactggagaaggcccaggaggagaacagaaacgtggccgtggagaagcagaacctggagagaaagatgatggacgagatcaactacgccaaggaggaggcctgcagactgagagagctgagagagggcgccgagtgcgagctgagcagaagacagtacgccgagcaggagctggagcaggtgagaatggccctgaagaaggccgagaaggagttcgagctgagaagcagctggagcgtgcccgacgccctgcagaagtggctgcagctgacccacgaggtggaggtgcagtactacaacatcaagagacagaacgccgagatgcagctggccatcgccaaggacgaggccgagaagatcaagaagaagagaagcaccgtgttcggcaccctgcacgtggcccacagcagcagcctggacgaggtggaccacaagatcctggaggccaagaaggccctgagcgagctgaccacctgcctgagagagagactgttcagatggcagcagatcgagaagatctgcggcttccagatcgcccacaacagcggcctgcccagcctgaccagcagcctgtacagcgaccacagctgggtggtgatgcccagagtgagcatccccccctaccccatcgccggcggcgtggacgacctggacgaggacaccccccccatcgtgagccagttccccggcaccatggccaagccccccggcagcctggccagaagcagcagcctgtgcagaagcagaagaagcatcgtgcccagcagcccccagccccagagagcccagctggccccccacgccccccaccccagccaccccagacacccccaccacccccagcacaccccccacagcctgcccagccccgaccccgacatcctgagcgtgagcagctgccccgccctgtacagaaacgaggaggaggaggaggccatctacttcagcgccgagaagcagtgcatccacctgggcctgggcgcctgcaagagcgagtag

SEQ ID NO: 101088 - DNA, 3654 bp, Artificial Sequence
  Description of Artificial Sequence: Synthetic coding sequence
atgtacatcaagcaggtgatcatccagggcttcagaagctacagagaccagaccatcgtggaccccttcagcagcaagcacaacgtgatcgtgggcagaaacggcagcggcaagagcaacttcttctacgccatccagttcgtgctgagcgacgagttcagccacctgagacccgagcagagactggccctgctgcacgagggcaccggccccagagtgatcagcgccttcgtggagatcatcttcgacaacagcgacaacagactgcccatcgacaaggaggaggtgagcctgagaagagtgatcggcgccaagaaggaccagtacttcctggacaagaagatggtgaccaagaacgacgtgatgaacctgctggagagcgccggcttcagcagaagcaacccctactacatcgtgaagcagggcaagatcaaccagatggccaccgcccccgacagccagagactgaagctgctgagagaggtggccggcaccagagtgtacgacgagagaaaggaggagagcatcagcctgatgaaggagaccgagggcaagagagagaagatcaacgagctgctgaagtacatcgaggagagactgcacaccctggaggaggagaaggaggagctggcccagtaccagaagtgggacaagatgagaagagccctggagtacaccatctacaaccaggagctgaacgagaccagagccaagctggacgagctgagcgccaagagagagaccagcggcgagaagagcagacagctgagagacgcccagcaggacgccagagacaagatggaggacatcgagagacaggtgagagagctgaagaccaagatcagcgccatgaaggaggagaaggagcagctgagcgccgagagacaggagcagatcaagcagagaaccaagctggagctgaaggccaaggacctgcaggacgagctggccggcaacagcgagcagagaaagagactgctgaaggagagacagaagctgctggagaagatcgaggagaagcagaaggagctggccgagaccgagcccaagttcaacagcgtgaaggagaaggaggagagaggcatcgccagactggcccaggccacccaggagagaaccgacctgtacgccaagcagggcagaggcagccagttcaccagcaaggaggagagagacaagtggatcaagaaggagctgaagagcctggaccaggccatcaacgacaagaagagacagatcgccgccatccacaaggacctggaggacaccgaggccaacaaggagaagaacctggagcagtacaacaagctggaccaggacctgaacgaggtgaaggccagagtggaggagctggacagaaagtactacgaggtgaagaacaagaaggacgagctgcagagcgagagaaactacctgtggagagaggagaacgccgagcagcaggccctggccgccaagagagaggacctggagaagaagcagcagctgctgagagccgccaccggcaaggccatcctgaacggcatcgacagcatcaacaaggtgctggaccacttcagaagaaagggcatcaaccagcacgtgcagaacggctaccacggcatcgtgatgaacaacttcgagtgcgagcccgccttctacacctgcgtggaggtgaccgccggcaacagactgttctaccacatcgtggacagcgacgaggtgagcaccaagatcctgatggagttcaacaagatgaacctgcccggcgaggtgaccttcctgcccctgaacaagctggacgtgagagacaccgcctaccccgagaccaacgacgccatccccatgatcagcaagctgagatacaaccccagattcgacaaggccttcaagcacgtgttcggcaagaccctgatctgcagaagcatggaggtgagcacccagctggccagagccttcaccatggactgcatcaccctggagggcgaccaggtgagccacagaggcgccctgaccggcggctactacgacaccagaaagagcagactggagctgcagaaggacgtgagaaaggccgaggaggagctgggcgagctggaggccaagctgaacgagaacctgagaagaaacatcgagagaatcaacaacgagatcgaccagctgatgaaccagatgcagcagatcgagacccagcagagaaagttcaaggccagcagagacagcatcctgagcgagatgaagatgctgaaggagaagagacagcagagcgagaagaccttcatgcccaagcagagaagcctgcagagcctggaggccagcctgcacgccatggagagcaccagagagagcctgaaggccgagctgggcaccgacctgctgagccagctgagcctggaggaccagaagagagtggacgccctgaacgacgagatcagacagctgcagcaggagaacagacagctgctgaacgagagaatcaagctggagggcatcatcaccagagtggagacctacctgaacgagaacctgagaaagagactggaccaggtggagcaggagctgaacgagctgagagagaccgagggcggcaccgtgctgaccgccaccaccagcgagctggaggccatcaacaagagagtgaaggacaccatggccagaagcgaggacctggacaacagcatcgacaagaccgaggccggcatcaaggagctgcagaagagcatggagagatggaagaacatggagaaggagcacatggacgccatcaaccacgacaccaaggagctggagaagatgaccaacagacagggcatgctgctgaagaagaaggaggagtgcatgaagaagatcagagagctgggcagcctgccccaggaggccttcgagaagtaccagaccctgagcctgaagcagctgttcagaaagctggagcagtgcaacaccgagctgaagaagtacagccacgtgaacaagaaggccctggaccagttcgtgaacttcagcgagcagaaggagaagctgatcaagagacaggaggagctggacagaggctacaagagcatcatggagctgatgaacgtgctggagctgagaaagtacgaggccatccagctgaccttcaagcaggtgagcaagaacttcagcgaggtgttccagaagctggtgcccggcggcaaggccaccctggtgatgaagaagggcgacgtggagggcagccagagccaggacgagggcgagggcagcggcgagagcgagagaggcagcggcagccagagcagcgtgcccagcgtggaccagttcaccggcgtgggcatcagagtgagcttcaccggcaagcagggcgagatgagagagatgcagcagctgagcggcggccagaagagcctggtggccctggccctgatcttcgccatccagaagtgcgaccccgcccccttctacctgttcgacgagatcgaccaggccctggacgcccagcacagaaaggccgtgagcgacatgatcatggagctggccgtgcacgcccagttcatcaccaccaccttcagacccgagctgctggagagcgccgacaagttctacggcgtgaagttcagaaacaaggtgagccacatcgacgtgatcaccgccgagatggccaaggacttcgtggaggacgacaccacccacggctag

SEQ ID NO: 101089 - DNA, 3306 bp, Artificial Sequence
  Description of Artificial Sequence: Synthetic coding sequence
atggccacccccagcaagaagaccagcacccccagcccccagcccagcaagagagccctgcccagagaccccagcagcgaggtgcccagcaagagaaagaacagcgccccccagctgcccctgctgcagagcagcggccccttcgtggagggcagcatcgtgagaatcagcatggagaacttcctgacctacgacatctgcgaggtgagccccggcccccacctgaacatgatcgtgggcgccaacggcaccggcaagagcagcatcgtgtgcgccatctgcctgggcctggccggcaagcccgccttcatgggcagagccgacaaggtgggcttcttcgtgaagagaggctgcagcagaggcatggtggagatcgagctgttcagagccagcggcaacctggtgatcaccagagagatcgacgtggccaagaaccagagcttctggttcatcaacaagaagagcaccacccagaagatcgtggaggagaaggtggccgccctgaacatccaggtgggcaacctgtgccagttcctgccccaggacaaggtgggcgagttcgccaagctgagcaagatcgagctgctggaggccaccgagaagagcatcggcccccccgagatgcacaagtaccactgcgagctgaagaacctgagagagaaggagaagcagctggagaccagctgcaaggagaagaccgagtacctgcagaagatggtgcagagaaacgagagatacaagcaggacgtggagagattctacgagagaaagagacacctggacctgatcgagatgctggaggccaagagaccctgggtggagtacgagaacgtgagacaggagtacgaggaggtgaagctggtgagagacagagtgaaggaggaggtgagaaagctgaaggagggccagatccccgtgacctgcagaatcgaggagatggagaacgagagacacaacctggaggccagaatcaaggagaaggccaccgacatcaaggaggccagccagaagtgcaagcagaagcaggacgtgatcgagagaaaggacaagcacatcgaggagctgcagcaggccctgatcgtgaagcagaacgaggagctggacagacagagaagaatcggcaacaccagaaagatgatcgaggacctgcagaacgagctgaagaccaccgagaactgcgagaacctgcagccccagatcgacgccatcaccaacgacctgagaagaatccaggacgagaaggccctgtgcgagggcgagatcatcgacaagagaagagagagagagaccctggagaaggagaagaagagcgtggacgaccacatcgtgagattcgacaacctgatgaaccagaaggaggacaagctgagacagagattcagagacacctacgacgccgtgctgtggctgagaaacaacagagacaagttcaagcagagagtgtgcgagcccatcatgctgaccatcaacatgaaggacaacaagaacgccaagtacatcgagaaccacatccccagcaacgacctgagagccttcgtgttcgagagccaggaggacatggaggtgttcctgaaggaggtgagagacaacaagaagctgagagtgaacgccgtgatcgcccccaagagcagctacgccgacaaggcccccagcagaagcctgaacgagctgaagcagtacggcttcttcagctacctgagagagctgttcgacgcccccgaccccgtgatgagctacctgtgctgccagtaccacatccacgaggtgcccgtgggcaccgagaagaccagagagagaatcgagagagtgatccaggagaccagactgaagcagatctacaccgccgaggagaagtacgtggtgaagaccagcttctacagcaacaaggtgatcagcagcaacaccagcctgaaggtggcccagttcctgaccgtgaccgtggacctggagcagagaagacacctggaggagcagctgaaggagatccacagaaagctgcaggccgtggacagcggcctgatcgccctgagagagaccagcaagcacctggagcacaaggacaacgagctgagacagaagaagaaggagctgctggagagaaagaccaagaagagacagctggagcagaagatcagcagcaagctgggcagcctgaagctgatggagcaggacacctgcaacctggaggaggaggagagaaaggccagcaccaagatcaaggagatcaacgtgcagaaggccaagctggtgaccgagctgaccaacctgatcaagatctgcaccagcctgcacatccagaaggtggacctgatcctgcagaacaccaccgtgatcagcgagaagaacaagctggagagcgactacatggccgccagcagccagctgagactgaccgagcagcacttcatcgagctggacgagaacagacagagactgctgcagaagtgcaaggagctgatgaagagagccagacaggtgtgcaacctgggcgccgagcagaccctgccccaggagtaccagacccaggtgcccaccatccccaacggccacaacagcagcctgcccatggtgttccaggacctgcccaacaccctggacgagatcgacgccctgctgaccgaggagagaagcagagccagctgcttcaccggcctgaaccccaccatcgtgcaggagtacaccaagagagaggaggagatcgagcagctgaccgaggagctgaagggcaagaaggtggagctggaccagtacagagagaacatcagccaggtgaaggagagatggctgaaccccctgaaggagctggtggagaagatcaacgagaagttcagcaacttcttcagcagcatgcagtgcgccggcgaggtggacctgcacaccgagaacgaggaggactacgacaagtacggcatcagaatcagagtgaagttcagaagcagcacccagctgcacgagctgaccccccaccaccagagcggcggcgagagaagcgtgagcaccatgctgtacctgatggccctgcaggagctgaacagatgccccttcagagtggtggacgagatcaaccagggcatggaccccatcaacgagagaagagtgttcgagatggtggtgaacaccgcctgcaaggagaacaccagccagtacttcttcatcacccccaagctgctgcagaacctgccctacagcgagaagatgaccgtgctgttcgtgtacaacggcccccacatgctggagcccaacacctggaacctgaaggccttccagagaagaagaagaagaatcaccttcacccagcccagctag

SEQ ID NO: 101090 - DNA, 3276 bp, Artificial Sequence
  Description of Artificial Sequence: Synthetic coding sequence
atggccaagagaaaggaggagaacttcagcagccccaagaacgccaagagacccagacaggaggagctggaggacttcgacaaggacggcgacgaggacgagtgcaagggcaccaccctgaccgccgccgaggtgggcatcatcgagagcatccacctgaagaacttcatgtgccacagcatgctgggccccttcaagttcggcagcaacgtgaacttcgtggtgggcaacaacggcagcggcaagagcgccgtgctgaccgccctgatcgtgggcctgggcggcagagccgtggccaccaacagaggcagcagcctgaagggcttcgtgaaggacggccagaacagcgccgacatcagcatcaccctgagaaacagaggcgacgacgccttcaaggccagcgtgtacggcaacagcatcctgatccagcagcacatcagcatcgacggcagcagaagctacaagctgaagagcgccaccggcagcgtggtgagcaccagaaaggaggagctgatcgccatcctggaccacttcaacatccaggtggacaaccccgtgagcgtgctgacccaggagatgagcaagcagttcctgcagagcaagaacgagggcgacaagtacaagttcttcatgaaggccacccagctggagcagatgaaggaggactacagctacatcatggagaccaaggagagaaccaaggagcagatccaccagggcgaggagagactgaccgagctgaagagacagtgcgtggagaaggaggagagattccagagcatcgccggcctgagcaccatgaagaccaacctggagagcctgaagcacgagatggcctgggccgtggtgaacgagatcgagaagcagctgaacgccatcagagacaacatcaagatcggcgaggacagagccgccagactggacagaaagatggaggagcagcaggtgagactgaacgaggccgagcagaagtacaaggacatccaggacaagctggagaagatcagcgaggagaccaacgccagagcccccgagtgcatggccctgaaggccgacgtggtggccaagaagagagcctacaacgaggccgaggtgctgtacaacagaagcctgaacgagtacaaggccctgaagaaggacgacgagcagctgtgcaagagaatcgaggagctgaagaagagcaccgaccagagcctggagcccgagagactggagagacagaagaagatcagctggctgaaggagagagtgaaggccttccagaaccaggagaacagcgtgaaccaggagatcgagcagttccagcaggccatcgagaaggacaaggaggagcacggcaagatcaagagagaggagctggacgtgaagcacgccctgagctacaaccagagacagctgaaggagctgaaggacagcaagaccgacagactgaagagattcggccccaacgtgcccgccctgctggaggccatcgacgacgcctacagacagggccacttcacctacaagcccgtgggccccctgggcgcctgcatccacctgagagaccccgagctggccctggccatcgagagctgcctgaagggcctgctgcaggcctactgctgccacaaccacgccgacgagagagtgctgcaggccctgatgaagagattctacctgcccggcaccagcagaccccccatcatcgtgagcgagttcagaaacgagatctacgacgtgagacacagagccgcctaccaccccgacttccccaccgtgctgaccgccctggagatcgacaacgccgtggtggccaacagcctgatcgacatgagaggcatcgagaccgtgctgctgatcaagaacaacagcgtggccagagccgtgatgcagagccagaagccccccaagaactgcagagaggccttcaccgccgacggcgaccaggtgttcgccggcagatactacagcagcgagaacaccagacccaagttcctgagcagagacgtggacagcgagatcagcgacctggagaacgaggtggagaacaagaccgcccagatcctgaacctgcagcagcacctgagcgccctggagaaggacatcaagcacaacgaggagctgctgaagagatgccagctgcactacaaggagctgaagatgaagatcagaaagaacatcagcgagatcagagagctggagaacatcgaggagcaccagagcgtggacatcgccaccctggaggacgaggcccaggagaacaagagcaagatgaagatggtggaggagcacatggagcagcagaaggagaacatggagcacctgaagagcctgaagatcgaggccgagaacaagtacgacgccatcaagttcaagatcaaccagctgagcgagctggccgaccccctgaaggacgagctgaacctggccgacagcgaggtggacaaccagaagagaggcaagagacactacgaggagaagcagaaggagcacctggacaccctgaacaagaagaagagagagctggacatgaaggagaaggagctggaggagaagatgagccaggccagacagatctgccccgagagaatcgaggtggagaagagcgccagcatcctggacaaggagatcaacagactgagacagaagatccaggccgagcacgccagccacggcgacagagaggagatcatgagacagtaccaggaggccagagagacctacctggacctggacagcaaggtgagaaccctgaagaagttcatcaagctgctgggcgagatcatggagcacagattcaagacctaccagcagttcagaagatgcctgaccctgagatgcaagctgtacttcgacaacctgctgagccagagagcctactgcggcaagatgaacttcgaccacaagaacgagaccctgagcatcagcgtgcagcccggcgagggcaacaaggccgccttcaacgacatgagagccctgagcggcggcgagagaagcttcagcaccgtgtgcttcatcctgagcctgtggagcatcgccgagagccccttcagatgcctggacgagttcgacgtgtacatggacatggtgaacagaagaatcgccatggacctgatcctgaagatggccgacagccagagattcagacagttcatcctgctgaccccccagagcatgagcagcctgcccagcagcaagctgatcagaatcctgagaatgagcgaccccgagagaggccagaccaccctgcccttcagacccgtgacccaggaggaggacgacgaccagagatag

SEQ ID NO: 101091 - DNA, 3354 bp, Artificial Sequence
  Description of Artificial Sequence: Synthetic coding sequence
atggccaagagaaaggaggagaacttcagcagccccaagaacgccaagagacccagacaggaggagctggaggacttcgacaaggacggcgacgaggacgagtgcaagggcaccaccctgaccgccgccgaggtgggcatcatcgagagcatccacctgaagaacttcatgtgccacagcatgctgggccccttcaagttcggcagcaacgtgaacttcgtggtgggcaacaacggcagctggagcgccgtggtgagaagcagactgaacgccaccagcgccagccaggtgcaggccatcctgctgttccagccctgcggcaagagcgccgtgctgaccgccctgatcgtgggcctgggcggcagagccgtggccaccaacagaggcagcagcctgaagggcttcgtgaaggacggccagaacagcgccgacatcagcatcaccctgagaaacagaggcgacgacgccttcaaggccagcgtgtacggcaacagcatcctgatccagcagcacatcagcatcgacggcagcagaagctacaagctgaagagcgccaccggcagcgtggtgagcaccagaaaggaggagctgatcgccatcctggaccacttcaacatccaggtggacaaccccgtgagcgtgctgacccaggagatgagcaagcagttcctgcagagcaagaacgagggcgacaagtacaagttcttcatgaaggccacccagctggagcagatgaaggaggactacagctacatcatggagaccaaggagagaaccaaggagcagatccaccagggcgaggagagactgaccgagctgaagagacagtgcgtggagaaggaggagagattccagagcatcgccggcctgagcaccatgaagaccaacctggagagcctgaagcacgagatggcctgggccgtggtgaacgagatcgagaagcagctgaacgccatcagagacaacatcaagatcggcgaggacagagccgccagactggacagaaagatggaggagcagcaggtgagactgaacgaggccgagcagaagtacaaggacatccaggacaagctggagaagatcagcgaggagaccaacgccagagcccccgagtgcatggccctgaaggccgacgtggtggccaagaagagagcctacaacgaggccgaggtgctgtacaacagaagcctgaacgagtacaaggccctgaagaaggacgacgagcagctgtgcaagagaatcgaggagctgaagaagagcaccgaccagagcctggagcccgagagactggagagacagaagaagatcagctggctgaaggagagagtgaaggccttccagaaccaggagaacagcgtgaaccaggagatcgagcagttccagcaggccatcgagaaggacaaggaggagcacggcaagatcaagagagaggagctggacgtgaagcacgccctgagctacaaccagagacagctgaaggagctgaaggacagcaagaccgacagactgaagagattcggccccaacgtgcccgccctgctggaggccatcgacgacgcctacagacagggccacttcacctacaagcccgtgggccccctgggcgcctgcatccacctgagagaccccgagctggccctggccatcgagagctgcctgaagggcctgctgcaggcctactgctgccacaaccacgccgacgagagagtgctgcaggccctgatgaagagattctacctgcccggcaccagcagaccccccatcatcgtgagcgagttcagaaacgagatctacgacgtgagacacagagccgcctaccaccccgacttccccaccgtgctgaccgccctggagatcgacaacgccgtggtggccaacagcctgatcgacatgagaggcatcgagaccgtgctgctgatcaagaacaacagcgtggccagagccgtgatgcagagccagaagccccccaagaactgcagagaggccttcaccgccgacggcgaccaggtgttcgccggcagatactacagcagcgagaacaccagacccaagttcctgagcagagacgtggacagcgagatcagcgacctggagaacgaggtggagaacaagaccgcccagatcctgaacctgcagcagcacctgagcgccctggagaaggacatcaagcacaacgaggagctgctgaagagatgccagctgcactacaaggagctgaagatgaagatcagaaagaacatcagcgagatcagagagctggagaacatcgaggagcaccagagcgtggacatcgccaccctggaggacgaggcccaggagaacaagagcaagatgaagatggtggaggagcacatggagcagcagaaggagaacatggagcacctgaagagcctgaagatcgaggccgagaacaagtacgacgccatcaagttcaagatcaaccagctgagcgagctggccgaccccctgaaggacgagctgaacctggccgacagcgaggtggacaaccagaagagaggcaagagacactacgaggagaagcagaaggagcacctggacaccctgaacaagaagaagagagagctggacatgaaggagaaggagctggaggagaagatgagccaggccagacagatctgccccgagagaatcgaggtggagaagagcgccagcatcctggacaaggagatcaacagactgagacagaagatccaggccgagcacgccagccacggcgacagagaggagatcatgagacagtaccaggaggccagagagacctacctggacctggacagcaaggtgagaaccctgaagaagttcatcaagctgctgggcgagatcatggagcacagattcaagacctaccagcagttcagaagatgcctgaccctgagatgcaagctgtacttcgacaacctgctgagccagagagcctactgcggcaagatgaacttcgaccacaagaacgagaccctgagcatcagcgtgcagcccggcgagggcaacaaggccgccttcaacgacatgagagccctgagcggcggcgagagaagcttcagcaccgtgtgcttcatcctgagcctgtggagcatcgccgagagccccttcagatgcctggacgagttcgacgtgtacatggacatggtgaacagaagaatcgccatggacctgatcctgaagatggccgacagccagagattcagacagttcatcctgctgaccccccagagcatgagcagcctgcccagcagcaagctgatcagaatcctgagaatgagcgaccccgagagaggccagaccaccctgcccttcagacccgtgacccaggaggaggacgacgaccagagatag

SEQ ID NO: 101092 - DNA, 3276 bp, Artificial Sequence; identical to SEQ ID NO: 101090
  Description of Artificial Sequence: Synthetic coding sequence

SEQ ID NO: 101093 - DNA, 174 bp, Artificial Sequence
  Description of Artificial Sequence: Synthetic coding sequence
atggccaagagaaaggaggagaacttcagcagccccaagaacgccaagagacccagacaggaggagctggaggacttcgacaaggacggcgacgaggacgagtgcaagggcaccaccctgaccgccgccgaggtgggcatcatcgagagcatccacctgaagaacttcatgtag

SEQ ID NO: 101094 - DNA, 3276 bp, Artificial Sequence; identical to SEQ ID NO: 101090
  Description of Artificial Sequence: Synthetic coding sequence

SEQ ID NO: 101095 - DNA, 2130 bp, Artificial Sequence
  Description of Artificial Sequence: Synthetic coding sequence
atggccgagaccctggagttcaacgacgtgtaccaggaggtgaagggcagcatgaacgacggcagactgagactgagcagacagggcatcatcttcaagaacagcaagaccggcaaggtggacaacatccaggccggcgagctgaccgagggcatctggagaagagtggccctgggccacggcctgaagctgctgaccaagaacggccacgtgtacaagtacgacggcttcagagagagcgagttcgagaagctgagcgacttcttcaagacccactacagactggagctgatggagaaggacctgtgcgtgaagggctggaactggggcaccgtgaagttcggcggccagctgctgagcttcgacatcggcgaccagcccgtgttcgagatccccctgagcaacgtgagccagtgcaccaccggcaagaacgaggtgaccctggagttccaccagaacgacgacgccgaggtgagcctgatggaggtgagattctacgtgccccccacccaggaggacggcgtggaccccgtggaggccttcgcccagaacgtgctgagcaaggccgacgtgatccaggccaccggcgacgccatctgcatcttcagagagctgcagtgcctgacccccagaggcagatacgacatcagaatctaccccaccttcctgcacctgcacggcaagaccttcgactacaagatcccctacaccaccgtgctgagactgttcctgctgccccacaaggaccagagacagatgttcttcgtgatcagcctggacccccccatcaagcagggccagaccagataccacttcctgatcctgctgttcagcaaggacgaggacatcagcctgaccctgaacatgaacgaggaggaggtggagaagagattcgagggcagactgaccaagaacatgagcggcagcctgtacgagatggtgagcagagtgatgaaggccctggtgaacagaaagatcaccgtgcccggcaacttccagggccacagcggcgcccagtgcatcacctgcagctacaaggccagcagcggcctgctgtaccccctggagagaggcttcatctacgtgcacaagccccccgtgcacatcagattcgacgagatcagcttcgtgaacttcgccagaggcaccaccaccaccagaagcttcgacttcgagatcgagaccaagcagggcacccagtacaccttcagcagcatcgagagagaggagtacggcaagctgttcgacttcgtgaacgccaagaagctgaacatcaagaacagaggcctgaaggagggcatgaaccccagctacgacgagtacgccgacagcgacgaggaccagcacgacgcctacctggagagaatgaaggaggagggcaagatcagagaggagaacgccaacgacagcagcgacgacagcggcgaggagaccgacgagagcttcaaccccggcgaggaggaggaggacgtggccgaggagttcgacagcaacgccagcgccagcagcagcagcaacgagggcgacagcgacagagacgagaagaagagaaagcagctgaagaaggccaagatggccaaggacagaaagagcagaaagaagcccgtggaggtgaagaagggcaaggaccccaacgcccccaagagacccatgagcgcctacatgctgtggctgaacgccagcagagagaagatcaagagcgaccaccccggcatcagcatcaccgacctgagcaagaaggccggcgagatctggaagggcatgagcaaggagaagaaggaggagtgggacagaaaggccgaggacgccagaagagactacgagaaggccatgaaggagtacgagggcggcagaggcgagagcagcaagagagacaagagcaagaagaagaagaaggtgaaggtgaagatggagaagaagagcacccccagcagaggcagcagcagcaagagcagcagcagacagctgagcgagagcttcaagagcaaggagttcgtgagcagcgacgagagcagcagcggcgagaacaagagcaagaagaagagaagaagaagcgaggacagcgaggaggaggagctggccagcaccccccccagcagcgaggacagcgccagcggcagcgacgagtag

SEQ ID NO: 101096 - DNA, 240 bp, Artificial Sequence
  Description of Artificial Sequence: Synthetic coding sequence
atgaagagcctgacctggatcctgggcctgtgggccctggccgcctgcttcacccccggcgagagccagagaggccccagaggcccctacccccccggccccctggcccccccccagcccttcggccccggcttcgtgccccccccccccccccccccctacggccccggcagaatccccccccccccccccgccccctacggccccggcatcttcccccccccccccccccagccctag

SEQ ID NO: 101097 - DNA, 324 bp, Artificial Sequence
  Description of Artificial Sequence: Synthetic coding sequence
atgaagagcctgacctggatcctgggcctgtgggccctggccgcctgcttcacccccggcgagagccagagaggccccagaggcccctacccccccggccccctggcccccccccagcccttcggccccggcttcgtgccccccccccccccccccccctacggccccggcagaatccccccccccccctacagctgcacccccaacatgaacaactgcagcagatgccaccaccaccacaagagacaccactacccctgcaactactgcttctactaccccaagtacgagttccagcactgcttccaggagaccttcacctag

SEQ ID NO: 101098 - DNA, 240 bp, Artificial Sequence; identical to SEQ ID NO: 101096
  Description of Artificial Sequence: Synthetic coding sequence

SEQ ID NO: 101099 - DNA, 348 bp, Artificial Sequence
  Description of Artificial Sequence: Synthetic coding sequence
atgagcagacacagcagactgcagagacaggtgctgagcctgtacagagacctgctgagagccggcagaggcaagcccggcgccgaggccagagtgagagccgagttcagacagcacgccggcctgcccagaagcgacgtgctgagaatcgagtacctgtacagaagaggcagaagacagctgcagctgctgagaagcggccacgccaccgccatgggcgccttcgtgagacccagagcccccaccggcgagcccggcggcgtgggctgccagcccgacgacggcgacagccccagaaacccccacgacagcaccggcgcccccgagaccagacccgacggcagatag

SEQ ID NO: 101100 - DNA, 501 bp, Artificial Sequence
  Description of Artificial Sequence: Synthetic coding sequence
atggccgtgagcaccgtgttcagcaccagcagcctgatgctggccctgagcagacacagcctgctgagccccctgctgagcgtgaccagcttcagaagattctacagaggcgacagccccaccgacagccagaaggacatgatcgagatccccctgcccccctggcaggagagaaccgacgagagcatcgagaccaagagagccagactgctgtacgagagcagaaagagaggcatgctggagaactgcatcctgctgagcctgttcgccaaggagcacctgcagcacatgaccgagaagcagctgaacctgtacgacagactgatcaacgagcccagcaacgactgggacatctactactgggccaccgaggccaagcccgcccccgagatcttcgagaacgaggtgatggccctgctgagagacttcgccaagaacaagaacaaggagcagagactgagagcccccgacctggagtacctgttcgagaagcccagatag

SEQ ID NO: 101101 - DNA, 843 bp, Artificial Sequence
  Description of Artificial Sequence: Synthetic coding sequence
atggccgccgtggtggccctgagcctgagaagaagactgcccgccaccaccctgggcggcgcctgcctgcaggccagcagaggcgcccagaccgccgccgccaccgcccccagaatcaagaagttcgccatctacagatgggaccccgacaaggccggcgacaagccccacatgcagacctacgaggtggacctgaacaagtgcggccccatggtgctggacgccctgatcaagatcaagaacgaggtggacagcaccctgaccttcagaagaagctgcagagagggcatctgcggcagctgcgccatgaacatcaacggcggcaacaccctggcctgcaccagaagaatcgacaccaacctgaacaaggtgagcaagatctaccccctgccccacatgtacgtgatcaaggacctggtgcccgacctgagcaacttctacgcccagtacaagagcatcgagccctacctgaagaagaaggacgagagccaggagggcaagcagcagtacctgcagagcatcgaggagagagagaagctggacggcctgtacgagtgcatcctgtgcgcctgctgcagcaccagctgccccagctactggtggaacggcgacaagtacctgggccccgccgtgctgatgcaggcctacagatggatgatcgacagcagagacgacttcaccgaggagagactggccaagctgcaggaccccttcagcctgtacagatgccacaccatcatgaactgcaccagaacctgccccaagggcctgaaccccggcaaggccatcgccgagatcaagaagatgatggccacctacaaggagaagaaggccagcgtgtag

SEQ ID NO: 101102 - DNA, 453 bp, Artificial Sequence
  Description of Artificial Sequence: Synthetic coding sequence
atggccgccctgctgctgagacacgtgggcagacactgcctgagagcccacttcagcccccagctgtgcatcagaaacgccgtgcccctgggcaccaccgccaaggaggagatggagagattctggaacaagaacatcggcagcaacagacccctgagcccccacatcaccatctacagctggagcctgcccatggccatgagcatctgccacagaggcaccggcatcgccctgagcgccgacgtgggccccagaaagagacccgaggacagccccgccatccccgtgtggagcggctgccccggcagctactgcgtggtgctgtacggcgccggcagccacgtgaagaagggcggcagccagcaccacctgcccacccactactacatccaccccagcttctgcctgagcttcctgagccccgcctgggagaagttcagcctgttcgtgtag

SEQ ID NO: 101103 - DNA, 510 bp, Artificial Sequence
  Description of Artificial Sequence: Synthetic coding sequence
atggccgccctgctgctgagacacgtgggcagacactgcctgagagcccacttcagcccccagctgtgcatcagaaacgccgtgcccctgggcaccaccgccaaggaggagatggagagattctggaacaagaacatcggcagcaacagacccctgagcccccacatcaccatctacagctggagcctgcccatggccatgagcatctgccacagaggcaccggcatcgccctgagcgccggcgtgagcctgttcggcatgagcgccctgctgctgcccggcaacttcgagagctacctggagctggtgaagagcctgtgcctgggccccgccctgatccacaccgccaagttcgccctggtgttccccctgatgtaccacacctggaacggcatcagacacctgatgtgggacctgggcaagggcctgaagatcccccagctgtaccagagcggcgtggtggtgctggtgctgaccgtgctgagcagcatgggcctggccgccatgtag

SEQ ID NO: 101104 - DNA, 351 bp, Artificial Sequence
  Description of Artificial Sequence: Synthetic coding sequence
atggccgccctgctgctgagctggagcctgcccatggccatgagcatctgccacagaggcaccggcatcgccctgagcgccggcgtgagcctgttcggcatgagcgccctgctgctgcccggcaacttcgagagctacctggagctggtgaagagcctgtgcctgggccccgccctgatccacaccgccaagttcgccctggtgttccccctgatgtaccacacctggaacggcatcagacacctgatgtgggacctgggcaagggcctgaagatcccccagctgtaccagagcggcgtggtggtgctggtgctgaccgtgctgagcagcatgggcctggccgccatgtag

SEQ ID NO: 101105 - DNA, 408 bp, Artificial Sequence
  Description of Artificial Sequence: Synthetic coding sequence
atggccgccctgctgctgagacacgtgggcagacactgcctgagagcccacttcagcccccagctgtgcatcagaaactggagcctgcccatggccatgagcatctgccacagaggcaccggcatcgccctgagcgccggcgtgagcctgttcggcatgagcgccctgctgctgcccggcaacttcgagagctacctggagctggtgaagagcctgtgcctgggccccgccctgatccacaccgccaagttcgccctggtgttccccctgatgtaccacacctggaacggcatcagacacctgatgtgggacctgggcaagggcctgaagatcccccagctgtaccagagcggcgtggtggtgctggtgctgaccgtgctgagcagcatgggcctggccgccatgtag

SEQ ID NO: 101106 - DNA, 480 bp, Artificial Sequence
  Description of Artificial Sequence: Synthetic coding sequence
atggccgtgctgtggagactgagcgccgtgtgcggcgccctgggcggcagagccctgctgctgagaacccccgtggtgagacccgcccacatcagcgccttcctgcaggacagacccatccccgagtggtgcggcgtgcagcacatccacctgagccccagccaccacagcggcagcaaggccgccagcctgcactggaccagcgagagagtggtgagcgtgctgctgctgggcctgctgcccgccgcctacctgaacccctgcagcgccatggactacagcctggccgccgccctgaccctgcacggccactggggcctgggccaggtggtgaccgactacgtgcacggcgacgccctgcagaaggccgccaaggccggcctgctggccctgagcgccctgaccttcgccggcctgtgctacttcaactaccacgacgtgggcatctgcaaggccgtggccatgctgtggaagctgtag

SEQ ID NO: 101107 - DNA, 465 bp, Artificial Sequence
  Description of Artificial Sequence: Synthetic coding sequence
atggccgccagcatgttctacggcagactggtggccgtggccaccctgagaaaccacagacccagaaccgcccagagagccgccgcccagggccccgtgctgatcggcagcagccacggcggcgtgaacatcgaggacgtggccgccgagagccccgaggccatcatcaaggagcccatcgacatcgaggagggcatcaagaaggagcaggccctgcagctggcccagaagatgggcttcccccccaacatcgtggagagcgccgccgagaacatggtgaagctgtacagcctgttcctgaagtacgacgccaccatgatcgagatcaaccccatggtggaggacagcgacggcgccgtgctgtgcatggacgccaagatcaacttcgacagcaacagcgcctacagacagaagaagatcttcgacctgcaggactggacccaggaggacgagagagacaagtag

SEQ ID NO: 101108 - DNA, 897 bp, Artificial Sequence
  Description of Artificial Sequence: Synthetic coding sequence
agcggcagaggccaccccagcgagccccccgccagcgacggccccgccggctgctgcagcggcagcaaggacgtggtgatcaaggcccaggtgctggccggcggcagaggcaagggcaccttcgagagcggcctgaagggcggcgtgaagatcgtgttcagccccgaggaggccaaggccgtgagcagccagatgatcggcaagaagctgttcaccaagcagaccggcgagaagggcagaatctgcaaccaggtgctggtgtgcgagagaaagtaccccagaagagagtactacttcgccatcaccatggagagaagcttccagggccccgtgctgatcggcagcagccacggcggcgtgaacatcgaggacgtggccgccgagagccccgaggccatcatcaaggagcccatcgacatcgaggagggcatcaagaaggagcaggccctgcagctggcccagaagatgggcttcccccccaacatcgtggagagcgccgccgagaacatggtgaagctgtacagcctgttcctgaagtacgacgccaccatgatcgagatcaaccccatggtggaggacagcgacggcgccgtgctgtgcatggacgccaagatcaacttcgacagcaacagcgcctacagacagaagaagatcttcgacctgcaggactggacccaggaggacgagagagacaaggacgccgccaaggccaacctgaactacatcggcctggacggcaacatcggctgcctggtgaacggcgccggcctggccatggccaccatggacatcatcaagctgcacggcggcacccccgccaacttcctggacgtgggcggcggcgccaccgtgcaccaggtgaccgaggccttcaagctgatcaccagcgacaagtag

SEQ ID NO: 101109 - DNA, 1326 bp, Artificial Sequence
  Description of Artificial Sequence: Synthetic coding sequence
atggccgccagcatgttctacggcagactggtggccgtggccaccctgagaaaccacagacccagaaccgcccagcagcagcagagaaacctgagcctgcacgagtacatgagcatggagctgctgcaggaggccggcgtgagcgtgcccaagggctacgtggccaagagccccgacgaggcctacgccatcgccaagaagctgggcagcaaggacgtggtgatcaaggcccaggtgctggccggcggcagaggcaagggcaccttcgagagcggcctgaagggcggcgtgaagatcgtgttcagccccgaggaggccaaggccgtgagcagccagatgatcggcaagaagctgttcaccaagcagaccggcgagaagggcagaatctgcaaccaggtgctggtgtgcgagagaaagtaccccagaagagagtactacttcgccatcaccatggagagaagcttccagggccccgtgctgatcggcagcagccacggcggcgtgaacatcgaggacgtggccgccgagagccccgaggccatcatcaaggagcccatcgacatcgaggagggcatcaagaaggagcaggccctgcagctggcccagaagatgggcttcccccccaacatcgtggagagcgccgccgagaacatggtgaagctgtacagcctgttcctgaagtacgacgccaccatgatcgagatcaaccccatggtggaggacagcgacggcgccgtgctgtgcatggacgccaagatcaacttcgacagcaacagcgcctacagacagaagaagatcttcgacctgcaggactggacccaggaggacgagagagacaaggacgccgccaaggccaacctgaactacatcggcctggacggcaacatcggctgcctggtgaacggcgccggcctggccatggccaccatggacatcatcaagctgcacggcggcacccccgccaacttcctggacgtgggcggcggcgccaccgtgcaccaggtgaccgaggccttcaagctgatcaccagcgacaagaaggtgctggccatcctggtgaacatcttcggcggcatcatgagatgcgacgtgatcgcccagggcatcgtgatggccgtgaaggacctggagatcaagatccccgtggtggtgagactgcagggcaccagagtggacgacgccaaggccctgatcgccgacagcggcctgaagatcctggcctgcgacgacctggacgaggccgccagaatggtggtgaagctgagcgagatcgtgaccctggccaagcaggcccacgtggacgtgaagttccagctgcccatctag

SEQ ID NO: 101110 - DNA, 1392 bp, Artificial Sequence
  Description of Artificial Sequence: Synthetic coding sequence
atggccgccagcatgttctacggcagactggtggccgtggccaccctgagaaaccacagacccagaaccgcccagagagccgccgcccaggtgctgggcagcagcggcctgttcaacaaccacggcctgcaggtgcagcagcagcagcagagaaacctgagcctgcacgagtacatgagcatggagctgctgcaggaggccggcgtgagcgtgcccaagggctacgtggccaagagccccgacgaggcctacgccatcgccaagaagctgggcagcaaggacgtggtgatcaaggcccaggtgctggccggcggcagaggcaagggcaccttcgagagcggcctgaagggcggcgtgaagatcgtgttcagccccgaggaggccaaggccgtgagcagccagatgatcggcaagaagctgttcaccaagcagaccggcgagaagggcagaatctgcaaccaggtgctggtgtgcgagagaaagtaccccagaagagagtactacttcgccatcaccatggagagaagcttccagggccccgtgctgatcggcagcagccacggcggcgtgaacatcgaggacgtggccgccgagagccccgaggccatcatcaaggagcccatcgacatcgaggagggcatcaagaaggagcaggccctgcagctggcccagaagatgggcttcccccccaacatcgtggagagcgccgccgagaacatggtgaagctgtacagcctgttcctgaagtacgacgccaccatgatcgagatcaaccccatggtggaggacagcgacggcgccgtgctgtgcatggacgccaagatcaacttcgacagcaacagcgcctacagacagaagaagatcttcgacctgcaggactggacccaggaggacgagagagacaaggacgccgccaaggccaacctgaactacatcggcctggacggcaacatcggctgcctggtgaacggcgccggcctggccatggccaccatggacatcatcaagctgcacggcggcacccccgccaacttcctggacgtgggcggcggcgccaccgtgcaccaggtgaccgaggccttcaagctgatcaccagcgacaagaaggtgctggccatcctggtgaacatcttcggcggcatcatgagatgcgacgtgatcgcccagggcatcgtgatggccgtgaaggacctggagatcaagatccccgtggtggtgagactgcagggcaccagagtggacgacgccaaggccctgatcgccgacagcggcctgaagatcctggcctgcgacgacctggacgaggccgccagaatggtggtgaagctgagcgagatcgtgaccctggccaagcaggcccacgtggacgtgaagttccagctgcccatctag

SEQ ID NO: 101111 - DNA, 1218 bp, Artificial Sequence
  Description of Artificial Sequence: Synthetic coding sequence
atgagcatggagctgctgcaggaggccggcgtgagcgtgcccaagggctacgtggccaagagccccgacgaggcctacgccatcgccaagaagctgggcagcaaggacgtggtgatcaaggcccaggtgctggccggcggcagaggcaagggcaccttcgagagcggcctgaagggcggcgtgaagatcgtgttcagccccgaggaggccaaggccgtgagcagccagatgatcggcaagaagctgttcaccaagcagaccggcgagaagggcagaatctgcaaccaggtgctggtgtgcgagagaaagtaccccagaagagagtactacttcgccatcaccatggagagaagcttccagggccccgtgctgatcggcagcagccacggcggcgtgaacatcgaggacgtggccgccgagagccccgaggccatcatcaaggagcccatcgacatcgaggagggcatcaagaaggagcaggccctgcagctggcccagaagatgggcttcccccccaacatcgtggagagcgccgccgagaacatggtgaagctgtacagcctgttcctgaagtacgacgccaccatgatcgagatcaaccccatggtggaggacagcgacggcgccgtgctgtgcatggacgccaagatcaacttcgacagcaacagcgcctacagacagaagaagatcttcgacctgcaggactggacccaggaggacgagagagacaaggacgccgccaaggccaacctgaactacatcggcctggacggcaacatcggctgcctggtgaacggcgccggcctggccatggccaccatggacatcatcaagctgcacggcggcacccccgccaacttcctggacgtgggcggcggcgccaccgtgcaccaggtgaccgaggccttcaagctgatcaccagcgacaagaaggtgctggccatcctggtgaacatcttcggcggcatcatgagatgcgacgtgatcgcccagggcatcgtgatggccgtgaaggacctggagatcaagatccccgtggtggtgagactgcagggcaccagagtggacgacgccaaggccctgatcgccgacagcggcctgaagatcctggcctgcgacgacctggacgaggccgccagaatggtggtgaagctgagcgagatcgtgaccctggccaagcaggcccacgtggacgtgaagttccagctgcccatctag

SEQ ID NO: 101112 - DNA, 876 bp, Artificial Sequence
  Description of Artificial Sequence: Synthetic coding sequence
atggagagaagcttccagggccccgtgctgatcggcagcagccacggcggcgtgaacatcgaggacgtggccgccgagagccccgaggccatcatcaaggagcccatcgacatcgaggagggcatcaagaaggagcaggccctgcagctggcccagaagatgggcttcccccccaacatcgtggagagcgccgccgagaacatggtgaagctgtacagcctgttcctgaagtacgacgccaccatgatcgagatcaaccccatggtggaggacagcgacggcgccgtgctgtgcatggacgccaagatcaacttcgacagcaacagcgcctacagacagaagaagatcttcgacctgcaggactggacccaggaggacgagagagacaaggacgccgccaaggccaacctgaactacatcggcctggacggcaacatcggctgcctggtgaacggcgccggcctggccatggccaccatggacatcatcaagctgcacggcggcacccccgccaacttcctggacgtgggcggcggcgccaccgtgcaccaggtgaccgaggccttcaagctgatcaccagcgacaagaaggtgctggccatcctggtgaacatcttcggcggcatcatgagatgcgacgtgatcgcccagggcatcgtgatggccgtgaaggacctggagatcaagatccccgtggtggtgagactgcagggcaccagagtggacgacgccaaggccctgatcgccgacagcggcctgaagatcctggcctgcgacgacctggacgaggccgccagaatggtggtgaagctgagcgagatcgtgaccctggccaagcaggcccacgtggacgtgaagttccagctgcccatctag

SEQ ID NO: 101113 - DNA, 1218 bp, Artificial Sequence; identical to SEQ ID NO: 101111
  Description of Artificial Sequence: Synthetic coding sequence

SEQ ID NO: 101114 - DNA, 990 bp, Artificial Sequence
  Description of Artificial Sequence: Synthetic coding sequence
atgatcggcaagaagctgttcaccaagcagaccggcgagaagggcagaatctgcaaccaggtgctggtgtgcgagagaaagtaccccagaagagagtactacttcgccatcaccatggagagaagcttccagggccccgtgctgatcggcagcagccacggcggcgtgaacatcgaggacgtggccgccgagagccccgaggccatcatcaaggagcccatcgacatcgaggagggcatcaagaaggagcaggccctgcagctggcccagaagatgggcttcccccccaacatcgtggagagcgccgccgagaacatggtgaagctgtacagcctgttcctgaagtacgacgccaccatgatcgagatcaaccccatggtggaggacagcgacggcgccgtgctgtgcatggacgccaagatcaacttcgacagcaacagcgcctacagacagaagaagatcttcgacctgcaggactggacccaggaggacgagagagacaaggacgccgccaaggccaacctgaactacatcggcctggacggcaacatcggctgcctggtgaacggcgccggcctggccatggccaccatggacatcatcaagctgcacggcggcacccccgccaacttcctggacgtgggcggcggcgccaccgtgcaccaggtgaccgaggccttcaagctgatcaccagcgacaagaaggtgctggccatcctggtgaacatcttcggcggcatcatgagatgcgacgtgatcgcccagggcatcgtgatggccgtgaaggacctggagatcaagatccccgtggtggtgagactgcagggcaccagagtggacgacgccaaggccctgatcgccgacagcggcctgaagatcctggcctgcgacgacctggacgaggccgccagaatggtggtgaagctgagcgagatcgtgaccctggccaagcaggcccacgtggacgtgaagttccagctgcccatctag

SEQ ID NO: 101115 - DNA, 1041 bp, Artificial Sequence
  Description of Artificial Sequence: Synthetic coding sequence
atgaccgccaccctggccgccgccgccgacatcgccaccatggtgagcggcagcagcggcctggccgccgccagactgctgagcagaagcttcctgctgccccagaacggcatcagacactgcagctacaccgccagcagacagcacctgtacgtggacaagaacaccaagatcatctgccagggcttcaccggcaagcagggcaccttccacagccagcaggccctggagtacggcaccaagctggtgggcggcaccacccccggcaagggcggccagacccacctgggcctgcccgtgttcaacaccgtgaaggaggccaaggagcagaccggcgccaccgccagcgtgatctacgtgcccccccccttcgccgccgccgccatcaacgaggccatcgaggccgagatccccctggtggtgtgcatcaccgagggcatcccccagcaggacatggtgagagtgaagcacaagctgctgagacaggagaagaccagactgatcggccccaactgccccggcgtgatcaaccccggcgagtgcaagatcggcatcatgcccggccacatccacaagaagggcagaatcggcatcgtgagcagaagcggcaccctgacctacgaggccgtgcaccagaccacccaggtgggcctgggccagagcctgtgcgtgggcatcggcggcgaccccttcaacggcaccgacttcatcgactgcctggagatcttcctgaacgacagcgccaccgagggcatcatcctgatcggcgagatcggcggcaacgccgaggagaacgccgccgagttcctgaagcagcacaacagcggccccaacagcaagcccgtggtgagcttcatcgccggcctgaccgccccccccggcagaagaatgggccacgccggcgccatcatcgccggcggcaagggcggcgccaaggagaagatcagcgccctgcagagcgccggcgtggtggtgagcatgagccccgcccagctgggcaccaccatctacaaggagttcgagaagagaaagatgctgtag

SEQ ID NO: 101116 - DNA, 5484 bp, Artificial Sequence
  Description of Artificial Sequence: Synthetic coding sequence
atggccagaaagaagttcagcggcctggagatcagcctgatcgtgctgttcgtgatcgtgaccatcatcgccatcgccctgatcgtggtgctggccaccaagacccccgccgtggacgagatcagcgacagcaccagcacccccgccaccaccagagtgaccaccaaccccagcgacagcggcaagtgccccaacgtgctgaacgaccccgtgaacgtgagaatcaactgcatccccgagcagttccccaccgagggcatctgcgcccagagaggctgctgctggagaccctggaacgacagcctgatcccctggtgcttcttcgtggacaaccacggctacaacgtgcaggacatgaccaccaccagcatcggcgtggaggccaagctgaacagaatccccagccccaccctgttcggcaacgacatcaacagcgtgctgttcaccacccagaaccagacccccaacagattcagattcaagatcaccgaccccaacaacagaagatacgaggtgccccaccagtacgtgaaggagttcaccggccccaccgtgagcgacaccctgtacgacgtgaaggtggcccagaaccccttcagcatccaggtgatcagaaagagcaacggcaagaccctgttcgacaccagcatcggccccctggtgtacagcgaccagtacctgcagatcagcaccagactgcccagcgactacatctacggcatcggcgagcaggtgcacaagagattcagacacgacctgagctggaagacctggcccatcttcaccagagaccagctgcccggcgacaacaacaacaacctgtacggccaccagaccttcttcatgtgcatcgaggacaccagcggcaagagcttcggcgtgttcctgatgaacagcaacgccatggagatcttcatccagcccacccccatcgtgacctacagagtgaccggcggcatcctggacttctacatcctgctgggcgacacccccgagcaggtggtgcagcagtaccagcagctggtgggcctgcccgccatgcccgcctactggaacctgggcttccagctgagcagatggaactacaagagcctggacgtggtgaaggaggtggtgagaagaaacagagaggccggcatccccttcgacacccaggtgaccgacatcgactacatggaggacaagaaggacttcacctacgaccaggtggccttcaacggcctgccccagttcgtgcaggacctgcacgaccacggccagaagtacgtgatcatcctggaccccgccatcagcatcggcagaagagccaacggcaccacctacgccacctacgagagaggcaacacccagcacgtgtggatcaacgagagcgacggcagcacccccatcatcggcgaggtgtggcccggcctgaccgtgtaccccgacttcaccaaccccaactgcatcgactggtgggccaacgagtgcagcatcttccaccaggaggtgcagtacgacggcctgtggatcgacatgaacgaggtgagcagcttcatccagggcagcaccaagggctgcaacgtgaacaagctgaactacccccccttcacccccgacatcctggacaagctgatgtacagcaagaccatctgcatggacgccgtgcagaactggggcaagcagtacgacgtgcacagcctgtacggctacagcatggccatcgccaccgagcaggccgtgcagaaggtgttccccaacaagagaagcttcatcctgaccagaagcaccttcgccggcagcggcagacacgccgcccactggctgggcgacaacaccgccagctgggagcagatggagtggagcatcaccggcatgctggagttcagcctgttcggcatccccctggtgggcgccgacatctgcggcttcgtggccgagaccaccgaggagctgtgcagaagatggatgcagctgggcgccttctaccccttcagcagaaaccacaacagcgacggctacgagcaccaggaccccgccttcttcggccagaacagcctgctggtgaagagcagcagacagtacctgaccatcagatacaccctgctgcccttcctgtacaccctgttctacaaggcccacgtgttcggcgagaccgtggccagacccgtgctgcacgagttctacgaggacaccaacagctggatcgaggacaccgagttcctgtggggccccgccctgctgatcacccccgtgctgaagcagggcgccgacaccgtgagcgcctacatccccgacgccatctggtacgactacgagagcggcgccaagagaccctggagaaagcagagagtggacatgtacctgcccgccgacaagatcggcctgcacctgagaggcggctacatcatccccatccaggagcccgacgtgaccaccaccgccagcagaaagaaccccctgggcctgatcgtggccctgggcgagaacaacaccgccaagggcgacttcttctgggacgacggcgagaccaaggacaccatccagaacggcaactacatcctgtacaccttcagcgtgagcaacaacaccctggacatcgtgtgcacccacagcagctaccaggagggcaccaccctggccttccagaccgtgaagatcctgggcctgaccgacagcgtgaccgaggtgagagtggccgagaacaaccagcccatgaacgcccacagcaacttcacctacgacgccagcaaccaggtgctgctgatcgccgacctgaagctgaacctgggcagaaacttcagcgtgcagtggaaccagatcttcagcgagaacgagagattcaactgctaccccgacgccgacctggccaccgagcagaagtgcacccagagaggctgcgtgtggagaaccggcagcagcctgagcaaggcccccgagtgctacttccccagacaggacaacagctacagcgtgaacagcgccagatacagcagcatgggcatcaccgccgacctgcagctgaacaccgccaacgccagaatcaagctgcccagcgaccccatcagcaccctgagagtggaggtgaagtaccacaagaacgacatgctgcagttcaagatctacgacccccagaagaagagatacgaggtgcccgtgcccctgaacatccccaccacccccatcagcacctacgaggacagactgtacgacgtggagatcaaggagaaccccttcggcatccagatcagaagaagaagcagcggcagagtgatctgggacagctggctgcccggcttcgccttcaacgaccagttcatccagatcagcaccagactgcccagcgagtacatctacggcttcggcgaggtggagcacaccgccttcaagagagacctgaactggaacacctggggcatgttcaccagagaccagccccccggctacaagctgaacagctacggcttccacccctactacatggccctggaggaggagggcaacgcccacggcgtgttcctgctgaacagcaacgccatggacgtgaccttccagcccacccccgccctgacctacagaaccgtgggcggcatcctggacttctacatgttcctgggccccacccccgaggtggccaccaagcagtaccacgaggtgatcggccaccccgtgatgcccgcctactgggccctgggcttccagctgtgcagatacggctacgccaacaccagcgaggtgagagagctgtacgacgccatggtggccgccaacatcccctacgacgtgcagtacaccgacatcgactacatggagagacagctggacttcaccatcggcgaggccttccaggacctgccccagttcgtggacaagatcagaggcgagggcatgagatacatcatcatcctggaccccgccatcagcggcaacgagaccaagacctaccccgccttcgagagaggccagcagaacgacgtgttcgtgaagtggcccaacaccaacgacatctgctgggccaaggtgtggcccgacctgcccaacatcaccatcgacaagaccctgaccgaggacgaggccgtgaacgccagcagagcccacgtggccttccccgacttcttcagaaccagcaccgccgagtggtgggccagagagatcgtggacttctacaacgagaagatgaagttcgacggcctgtggatcgacatgaacgagcccagcagcttcgtgaacggcaccaccaccaaccagtgcagaaacgacgagctgaactaccccccctacttccccgagctgaccaagagaaccgacggcctgcacttcagaaccatctgcatggaggccgagcagatcctgagcgacggcaccagcgtgctgcactacgacgtgcacaacctgtacggctggagccagatgaagcccacccacgacgccctgcagaagaccaccggcaagagaggcatcgtgatcagcagaagcacctaccccaccagcggcagatggggcggccactggctgggcgacaactacgccagatgggacaacatggacaagagcatcatcggcatgatggagttcagcctgttcggcatgagctacaccggcgccgacatctgcggcttcttcaacaacagcgagtaccacctgtgcaccagatggatgcagctgggcgccttctacccctacagcagaaaccacaacatcgccaacaccagaagacaggaccccgccagctggaacgagaccttcgccgagatgagcagaaacatcctgaacatcagatacaccctgctgccctacttctacacccagatgcacgagatccacgccaacggcggcaccgtgatcagacccctgctgcacgagttcttcgacgagaagcccacctgggacatcttcaagcagttcctgtggggccccgccttcatggtgacccccgtgctggagccctacgtgcagaccgtgaacgcctacgtgcccaacgccagatggttcgactaccacaccggcaaggacatcggcgtgagaggccagttccagaccttcaacgccagctacgacaccatcaacctgcacgtgagaggcggccacatcctgccctgccaggagcccgcccagaacaccttctacagcagacagaagcacatgaagctgatcgtggccgccgacgacaaccagatggcccagggcagcctgttctgggacgacggcgagagcatcgacacctacgagagagacctgtacctgagcgtgcagttcaacctgaaccagaccaccctgaccagcaccatcctgaagagaggctacatcaacaagagcgagaccagactgggcagcctgcacgtgtggggcaagggcaccacccccgtgaacgccgtgaccctgacctacaacggcaacaagaacagcctgcccttcaacgaggacaccaccaacatgatcctgagaatcgacctgaccacccacaacgtgaccctggaggagcccatcgagatcaactggagctag

SEQ ID NO: 101117 - DNA, 2616 bp, Artificial Sequence
  Description of Artificial Sequence: Synthetic coding sequence
atgaagtacagctgctgcgccctggtgctggccgtgctgggcaccgagctgctgggcagcctgtgcagcaccgtgagaagccccagattcagaggcagaatccagcaggagagaaagaacatcagacccaacatcatcctggtgctgaccgacgaccaggacgtggagctgggcagcctgcaggtgatgaacaagaccagaaagatcatggagcacggcggcgccaccttcatcaacgccttcgtgaccacccccatgtgctgccccagcagaagcagcatgctgaccggcaagtacgtgcacaaccacaacgtgtacaccaacaacgagaactgcagcagccccagctggcaggccatgcacgagcccagaaccttcgccgtgtacctgaacaacaccggctacagaaccgccttcttcggcaagtacctgaacgagtacaacggcagctacatcccccccggctggagagagtggctgggcctgatcaagaacagcagattctacaactacaccgtgtgcagaaacggcatcaaggagaagcacggcttcgactacgccaaggactacttcaccgacctgatcaccaacgagagcatcaactacttcaagatgagcaagagaatgtacccccacagacccgtgatgatggtgatcagccacgccgccccccacggccccgaggacagcgccccccagttcagcaagctgtaccccaacgccagccagcacatcacccccagctacaactacgcccccaacatggacaagcactggatcatgcagtacaccggccccatgctgcccatccacatggagttcaccaacatcctgcagagaaagagactgcagaccctgatgagcgtggacgacagcgtggagagactgtacaacatgctggtggagaccggcgagctggagaacacctacatcatctacaccgccgaccacggctaccacatcggccagttcggcctggtgaagggcaagagcatgccctacgacttcgacatcagagtgcccttcttcatcagaggccccagcgtggagcccggcagcatcgtgccccagatcgtgctgaacatcgacctggcccccaccatcctggacatcgccggcctggacaccccccccgacgtggacggcaagagcgtgctgaagctgctggaccccgagaagcccggcaacagattcagaaccaacaagaaggccaagatctggagagacaccttcctggtggagagaggcaagttcctgagaaagaaggaggagagcagcaagaacatccagcagagcaaccacctgcccaagtacgagagagtgaaggagctgtgccagcaggccagataccagaccgcctgcgagcagcccggccagaagtggcagtgcatcgaggacaccagcggcaagctgagaatccacaagtgcaagggccccagcgacctgctgaccgtgagacagagcaccagaaacctgtacgccagaggcttccacgacaaggacaaggagtgcagctgcagagagagcggctacagagccagcagaagccagagaaagagccagagacagttcctgagaaaccagggcacccccaagtacaagcccagattcgtgcacaccagacagaccagaagcctgagcgtggagttcgagggcgagatctacgacatcaacctggaggaggaggaggagctgcaggtgctgcagcccagaaacatcgccaagagacacgacgagggccacaagggccccagagacctgcaggccagcagcggcggcaacagaggcagaatgctggccgacagcagcaacgccgtgggcccccccaccaccgtgagagtgacccacaagtgcttcatcctgcccaacgacagcatccactgcgagagagagctgtaccagagcgccagagcctggaaggaccacaaggcctacatcgacaaggagatcgaggccctgcaggacaagatcaagaacctgagagaggtgagaggccacctgaagagaagaaagcccgaggagtgcagctgcagcaagcagagctactacaacaaggagaagggcgtgaagaagcaggagaagctgaagagccacctgcaccccttcaaggaggccgcccaggaggtggacagcaagctgcagctgttcaaggagaacaacagaagaagaaagaaggagagaaaggagaagagaagacagagaaagggcgaggagtgcagcctgcccggcctgacctgcttcacccacgacaacaaccactggcagaccgcccccttctggaacctgggcagcttctgcgcctgcaccagcagcaacaacaacacctactggtgcctgagaaccgtgaacgagacccacaacttcctgttctgcgagttcgccaccggcttcctggagtacttcgacatgaacaccgacccctaccagctgaccaacaccgtgcacaccgtggagagaggcatcctgaaccagctgcacgtgcagctgatggagctgagaagctgccagggctacaagcagtgcaaccccagacccaagaacctggacgtgggcaacaaggacggcggcagctacgacctgcacagaggccagctgtgggacggctgggagggctag

SEQ ID NO: 101118 - DNA, 2616 bp, Artificial Sequence; identical to SEQ ID NO: 101117
  Description of Artificial Sequence: Synthetic coding sequence

SEQ ID NO: 101119 - DNA, 2616 bp, Artificial Sequence; identical to SEQ ID NO: 101117
  Description of Artificial Sequence: Synthetic coding sequence

SEQ ID NO: 101120 - DNA, 2616 bp, Artificial Sequence; identical to SEQ ID NO: 101117
  Description of Artificial Sequence: Synthetic coding sequence

SEQ ID NO: 101121 - DNA, 90 bp, Artificial Sequence
  Description of Artificial Sequence: Synthetic coding sequence
atgaagtacagctgctgcgccctggtgctggccgtgctgggcaccgagctgctgggcagcctgtgcagcaccgtgagaagccccagatag

SEQ ID NO: 101122 - DNA, 519 bp, Artificial Sequence
  Description of Artificial Sequence: Synthetic coding sequence
atgaagtacagctgctgcgccctggtgctggccgtgctgggcaccgagctgctgggcagcctgtgcagcaccgtgagaagccccagattcagaggcagaatccagcaggagagaaagaacatcagacccaacatcatcctggtgctgaccgacgaccaggacgtggagctgggcagcctgcaggtgatgaacaagaccagaaagatcatggagcacggcggcgccaccttcatcaacgccttcgtgaccacccccatgtgctgccccagcagaagcagcatgctgaccggcaagtacgtgcacaaccacaacgtgtacaccaacaacgagaactgcagcagccccagctggcaggccatgcacgagcccagaaccttcgccgtgtacctgaacaacaccggctacagaaccgccttcttcggcaagtacctgaacgagtacaacggcagctacatcccccccggctggagagagtggctgggcctgatcaagaacagcagattctacaactacacctag

SEQ ID NO: 101123 - DNA, 231 bp, Artificial Sequence
  Description of Artificial Sequence: Synthetic coding sequence
atgaagtacagctgctgcgccctggtgctggccgtgctgggcaccgagctgctgggcagcctgtgcagcaccgtgagaagccccagattcagaggcagaatccagcaggagagaaagaacatcagacccaacatcatcctggtgctgaccgacgaccaggacgtggagctgggcagcctgcaggtgatgaacaagaccagaaagatcatggagcacggcggcgccacctag

SEQ ID NO: 101124 - DNA, 258 bp, Artificial Sequence
  Description of Artificial Sequence: Synthetic coding sequence
atgaagtacagctgctgcgccctggtgctggccgtgctgggcaccgagctgctgggcagcctgtgcagcaccgtgagaagccccagattcagaggcagaatccagcaggagagaaagaacatcagacccaacatcatcctggtgctgaccgacgaccaggacgtggagctgggcagcctgcaggtgatgaacaagaccagaaagatcatggagcacggcggcgccaccttcatcaacgccttcgtgaccaccccctag

SEQ ID NO: 101125 - DNA, 171 bp, Artificial Sequence
  Description of Artificial Sequence: Synthetic coding sequence
atgaagtacagctgctgcgccctggtgctggccgtgctgggcaccgagctgctgggcagcctgtgcagcaccgtgagaagccccagattcagaggcagaatccagcaggagagaaagaacatcagacccaacatcatcctggtgctgaccgacgaccaggacgtggagtag

SEQ ID NO: 101126 - DNA, 2613 bp, Artificial Sequence
  Description of Artificial Sequence: Synthetic coding sequence
atgggcccccccagcctggtgctgtgcctgctgagcgccaccgtgttcagcctgctgggcggcagcagcgccttcctgagccaccacagactgaagggcagattccagagagacagaagaaacatcagacccaacatcatcctggtgctgaccgacgaccaggacgtggagctgggcagcatgcaggtgatgaacaagaccagaagaatcatggagcagggcggcgcccacttcatcaacgccttcgtgaccacccccatgtgctgccccagcagaagcagcatcctgaccggcaagtacgtgcacaaccacaacacctacaccaacaacgagaactgcagcagccccagctggcaggcccagcacgagagcagaaccttcgccgtgtacctgaacagcaccggctacagaaccgccttcttcggcaagtacctgaacgagtacaacggcagctacgtgccccccggctggaaggagtgggtgggcctgctgaagaacagcagattctacaactacaccctgtgcagaaacggcgtgaaggagaagcacggcagcgactacagcaaggactacctgaccgacctgatcaccaacgacagcgtgagcttcttcagaaccagcaagaagatgtacccccacagacccgtgctgatggtgatcagccacgccgccccccacggccccgaggacagcgccccccagtacagcagactgttccccaacgccagccagcacatcacccccagctacaactacgcccccaaccccgacaagcactggatcatgagatacaccggccccatgaagcccatccacatggagttcaccaacatgctgcagagaaagagactgcagaccctgatgagcgtggacgacagcatggagaccatctacaacatgctggtggagaccggcgagctggacaacacctacatcgtgtacaccgccgaccacggctaccacatcggccagttcggcctggtgaagggcaagagcatgccctacgagttcgacatcagagtgcccttctacgtgagaggccccaacgtggaggccggctgcctgaacccccacatcgtgctgaacatcgacctggcccccaccatcctggacatcgccggcctggacatccccgccgacatggacggcaagagcatcctgaagctgctggacaccgagagacccgtgaacagattccacctgaagaagaagatgagagtgtggagagacagcttcctggtggagagaggcaagctgctgcacaagagagacaacgacaaggtggacgcccaggaggagaacttcctgcccaagtaccagagagtgaaggacctgtgccagagagccgagtaccagaccgcctgcgagcagctgggccagaagtggcagtgcgtggaggacgccaccggcaagctgaagctgcacaagtgcaagggccccatgagactgggcggcagcagagccctgagcaacctggtgcccaagtactacggccagggcagcgaggcctgcacctgcgacagcggcgactacaagctgagcctggccggcagaagaaagaagctgttcaagaagaagtacaaggccagctacgtgagaagcagaagcatcagaagcgtggccatcgaggtggacggcagagtgtaccacgtgggcctgggcgacgccgcccagcccagaaacctgaccaagagacactggcccggcgcccccgaggaccaggacgacaaggacggcggcgacttcagcggcaccggcggcctgcccgactacagcgccgccaaccccatcaaggtgacccacagatgctacatcctggagaacgacaccgtgcagtgcgacctggacctgtacaagagcctgcaggcctggaaggaccacaagctgcacatcgaccacgagatcgagaccctgcagaacaagatcaagaacctgagagaggtgagaggccacctgaagaagaagagacccgaggagtgcgactgccacaagatcagctaccacacccagcacaagggcagactgaagcacagaggcagcagcctgcaccccttcagaaagggcctgcaggagaaggacaaggtgtggctgctgagagagcagaagagaaagaagaagctgagaaagctgctgaagagactgcagaacaacgacacctgcagcatgcccggcctgacctgcttcacccacgacaaccagcactggcagaccgcccccttctggaccctgggccccttctgcgcctgcaccagcgccaacaacaacacctactggtgcatgagaaccatcaacgagacccacaacttcctgttctgcgagttcgccaccggcttcctggagtacttcgacctgaacaccgacccctaccagctgatgaacgccgtgaacaccctggacagagacgtgctgaaccagctgcacgtgcagctgatggagctgagaagctgcaagggctacaagcagtgcaaccccagaaccagaaacatggacctgggcctgaaggacggcggcagctacgagcagtacagacagttccagagaagaaagtggcccgagatgaagagacccagcagcaagagcctgggccagctgtgggagggctgggagggctag

SEQ ID NO: 101127 - DNA, 2559 bp, Artificial Sequence
  Description of Artificial Sequence: Synthetic coding sequence
atgggcccccccagcctggtgctgtgcctgctgagcgccaccgtgttcagcctgctgggcggcagcagcgccttcctgagccaccacagactgaagggcagattccagagagacagaagaaacatcagacccaacatcatcctggtgctgaccgacgaccaggacgtggagctgggcagcatgcaggtgatgaacaagaccagaagaatcatggagcagggcggcgcccacttcatcaacgccttcgtgaccacccccatgtgctgccccagcagaagcagcatcctgaccggcaagtacgtgcacaaccacaacacctacaccaacaacgagaactgcagcagccccagctggcaggcccagcacgagagcagaaccttcgccgtgtacctgaacagcaccggctacagaaccgccttcttcggcaagtacctgaacgagtacaacggcagctacgtgccccccggctggaaggagtgggtgggcctgctgaagaacagcagattctacaactacaccctgtgcagaaacggcgtgaaggagaagcacggcagcgactacagcaaggactacctgaccgacctgatcaccaacgacagcgtgagcttcttcagaaccagcaagaagatgtacccccacagacccgtgctgatggtgatcagccacgccgccccccacggccccgaggacagcgccccccagtacagcagactgttccccaacgccagccagcacatcacccccagctacaactacgcccccaaccccgacaagcactggatcatgagatacaccggccccatgaagcccatccacatggagttcaccaacatgctgcagagaaagagactgcagaccctgatgagcgtggacgacagcatggagaccatctacaacatgctggtggagaccggcgagctggacaacacctacatcgtgtacaccgccgaccacggctaccacatcggccagttcggcctggtgaagggcaagagcatgccctacgagttcgacatcagagtgcccttctacgtgagaggccccaacgtggaggccggctgcctgaacccccacatcgtgctgaacatcgacctggcccccaccatcctggacatcgccggcctggacatccccgccgacatggacggcaagagcatcctgaagctgctggacaccgagagacccgtgaacagattccacctgaagaagaagatgagagtgtggagagacagcttcctggtggagagaggcaagctgctgcacaagagagacaacgacaaggtggacgcccaggaggagaacttcctgcccaagtaccagagagtgaaggacctgtgccagagagccgagtaccagaccgcctgcgagcagctgggccagaagtggcagtgcgtggaggacgccaccggcaagctgaagctgcacaagtgcaagggccccatgagactgggcggcagcagagccctgagcaacctggtgcccaagtactacggccagggcagcgaggcctgcacctgcgacagcggcgactacaagctgagcctggccggcagaagaaagaagctgttcaagaagaagtacaaggccagctacgtgagaagcagaagcatcagaagcgtggccatcgaggtggacggcagagtgtaccacgtgggcctgggcgacgccgcccagcccagaaacctgaccaagagacactggcccggcgcccccgaggaccaggacgacaaggacggcggcgacttcagcggcaccggcggcctgcccgactacagcgccgccaaccccatcaaggtgacccacagatgctacatcctggagaacgacaccgtgcagtgcgacctggacctgtacaagagcctgcaggcctggaaggaccacaagctgcacatcgaccacgagatcgagaccctgcagaacaagatcaagaacctgagagaggtgagaggccacctgaagaagaagagacccgaggagtgcgactgccacaagatcagctaccacacccagcacaagggcagactgaagcacagaggcagcagcctgcaccccttcagaaagggcctgcaggagaaggacaaggtgtggctgctgagagagcagaagagaaagaagaagctgagaaagctgctgaagagactgcagaacaacgacacctgcagcatgcccggcctgacctgcttcacccacgacaaccagcactggcagaccgcccccttctggaccctgggccccttctgcgcctgcaccagcgccaacaacaacacctactggtgcatgagaaccatcaacgagacccacaacttcctgttctgcgagttcgccaccggcttcctggagtacttcgacctgaacaccgacccctaccagctgatgaacgccgtgaacaccctggacagagacgtgctgaaccagctgcacgtgcagctgatggagctgagaagctgcaagggctacaagcagtgcaaccccagaaccagaaacatggacctgggcctgaaggacggcggcagctacgagcagtacagaggccagctgtgggagggctgggagggctag

SEQ ID NO: 101128 - DNA, 870 bp, Artificial Sequence
  Description of Artificial Sequence: Synthetic coding sequence
ttcagcggcaccggcggcctgcccgactacagcgccgccaaccccatcaaggtgacccacagatgctacatcctggagaacgacaccgtgcagtgcgacctggacctgtacaagagcctgcaggcctggaaggaccacaagctgcacatcgaccacgagatcgagaccctgcagaacaagatcaagaacctgagagaggtgagaggccacctgaagaagaagagacccgaggagtgcgactgccacaagatcagctaccacacccagcacaagggcagactgaagcacagaggcagcagcctgcaccccttcagaaagggcctgcaggagaaggacaaggtgtggctgctgagagagcagaagagaaagaagaagctgagaaagctgctgaagagactgcagaacaacgacacctgcagcatgcccggcctgacctgcttcacccacgacaaccagcactggcagaccgcccccttctggaccctgggccccttctgcgcctgcaccagcgccaacaacaacacctactggtgcatgagaaccatcaacgagacccacaacttcctgttctgcgagttcgccaccggcttcctggagtacttcgacctgaacaccgacccctaccagctgatgaacgccgtgaacaccctggacagagacgtgctgaaccagctgcacgtgcagctgatggagctgagaagctgcaagggctacaagcagtgcaaccccagaaccagaaacatggacctgggcctgaaggacggcggcagctacgagcagtacagacagttccagagaagaaagtggcccgagatgaagagacccagcagcaagagcctgggccagctgtgggagggctgggagggctag

SEQ ID NO: 101129 - DNA, 2604 bp, Artificial Sequence
  Description of Artificial Sequence: Synthetic coding sequence
atgggcccccccagcctggtgctgtgcctgctgagcgccaccgtgttcagcctgctgggcggcagcagcgccttcctgagccaccacagactgaagggcagattccagagagacagaagaaacatcagacccaacatcatcctggtgctgaccgacgaccaggacgtggagctgggcagcatgcaggtgatgaacaagaccagaagaatcatggagcagggcggcgcccacttcatcaacgccttcgtgaccacccccatgtgctgccccagcagaagcagcatcctgaccggcaagtacgtgcacaaccacaacacctacaccaacaacgagaactgcagcagccccagctggcaggcccagcacgagagcagaaccttcgccgtgtacctgaacagcaccggctacagaaccgccttcttcggcaagtacctgaacgagtacaacggcagctacgtgccccccggctggaaggagtgggtgggcctgctgaagaacagcagattctacaactacaccctgtgcagaaacggcgtgaaggagaagcacggcagcgactacagcaaggactacctgaccgacctgatcaccaacgacagcgtgagcttcttcagaaccagcaagaagatgtacccccacagacccgtgctgatggtgatcagccacgccgccccccacggccccgaggacagcgccccccagtacagcagactgttccccaacgccagccagcacatcacccccagctacaactacgcccccaaccccgacaagcactggatcatgagatacaccggccccatgaagcccatccacatggagttcaccaacatgctgcagagaaagagactgcagaccctgatgagcgtggacgacagcatggagaccatctacaacatgctggtggagaccggcgagctggacaacacctacatcgtgtacaccgccgaccacggctaccacatcggccagttcggcctggtgaagggcaagagcatgccctacgagttcgacatcagagtgcccttctacgtgagaggccccaacgtggaggccggctgcctgaacccccacatcgtgctgaacatcgacctggcccccaccatcctggacatcgccggcctggacatccccgccgacatggacggcaagagcatcctgaagctgctggacaccgagagacccgtgaacagattccacctgaagaagaagatgagagtgtggagagacagcttcctggtggagagaggcaagctgctgcacaagagagacaacgacaaggtggacgcccaggaggagaacttcctgcccaagtaccagagagtgaaggacctgtgccagagagccgagtaccagaccgcctgcgagcagctgggccagaagtggcagtgcgtggaggacgccaccggcaagctgaagctgcacaagtgcaagggccccatgagactgggcggcagcagagccctgagcaacctggtgcccaagtactacggccagggcagcgaggcctgcacctgcgacagcggcgactacaagctgagcctggccggcagaagaaagaagctgttcaagaagaagtacaaggccagctacgtgagaagcagaagcatcagaagcgtggccatcgaggtggacggcagagtgtaccacgtgggcctgggcgacgccgcccagcccagaaacctgaccaagagacactggcccggcgcccccgaggaccaggacgacaaggacggcggcgacttcagcggcaccggcggcctgcccgactacagcgccgccaaccccatcaaggtgacccacagatgctacatcctggagaacgacaccgtgcagtgcgacctggacctgtacaagagcctgcaggcctggaaggaccacaagctgcacatcgaccacgagatcgagaccctgcagaacaagatcaagaacctgagagaggtgagaggccacctgaagaagaagagacccgaggagtgcgactgccacaagatcagctaccacacccagcacaagggcagactgaagcacagaggcagcagcctgcaccccttcagaaagggcctgcaggagaaggacaaggtgtggctgctgagagagcagaagagaaagaagaagctgagaaagctgctgaagagactgcagaacaacgacacctgcagcatgcccggcctgacctgcttcacccacgacaaccagcactggcagaccgcccccttctggaccctgggccccttctgcgcctgcaccagcgccaacaacaacacctactggtgcatgagaaccatcaacgagacccacaacttcctgttctgcgagttcgccaccggcttcctggagtacttcgacctgaacaccgacccctaccagctgatgaacgccgtgaacaccctggacagagacgtgctgaaccagctgcacgtgcagctgatggagctgagaagctgcaagggctacaagcagtgcaaccccagaaccagaaacatggacctggacggcggcagctacgagcagtacagacagttccagagaagaaagtggcccgagatgaagagacccagcagcaagagcctgggccagctgtgggagggctgggagggctag

SEQ ID NO: 101130 - DNA, 2613 bp, Artificial Sequence; identical to SEQ ID NO: 101126
  Description of Artificial Sequence: Synthetic coding sequence

SEQ ID NO: 101131 - DNA, 1125 bp, Artificial Sequence
  Description of Artificial Sequence: Synthetic coding sequence
atggccgcccccgccctgggcctggtgtgcggcagatgccccgagctgggcctggtgctgctgctgctgctgctgagcctgctgtgcggcgccgccggcagccaggaggccggcaccggcgccggcgccggcagcctggccggcagctgcggctgcggcaccccccagagacccggcgcccacggcagcagcgccgccgcccacagatacagcagagaggccaacgcccccggccccgtgcccggcgagagacagctggcccacagcaagatggtgcccatccccgccggcgtgttcaccatgggcaccgacgacccccagatcaagcaggacggcgaggcccccgccagaagagtgaccatcgacgccttctacatggacgcctacgaggtgagcaacaccgagttcgagaagttcgtgaacagcaccggctacctgaccgaggccgagaagttcggcgacagcttcgtgttcgagggcatgctgagcgagcaggtgaagaccaacatccagcaggccgtggccgccgccccctggtggctgcccgtgaagggcgccaactggagacaccccgagggccccgacagcaccatcctgcacagacccgaccaccccgtgctgcacgtgagctggaacgacgccgtggcctactgcacctgggccggcaagagactgcccaccgaggccgagtgggagtacagctgcagaggcggcctgcacaacagactgttcccctggggcaacaagctgcagcccaagggccagcactacgccaacatctggcagggcgagttccccgtgaccaacaccggcgaggacggcttccagggcaccgcccccgtggacgccttcccccccaacggctacggcctgtacaacatcgtgggcaacgcctgggagtggaccagcgactggtggaccgtgcaccacagcgtggaggagaccctgaaccccaagggcccccccagcggcaaggacagagtgaagaagggcggcagctacatgtgccacagaagctactgctacagatacagatgcgccgccagaagccagaacacccccgacagcagcgccagcaacctgggcttcagatgcgccgccgacagactgcccaccatggactag

SEQ ID NO: 101132 - DNA, 1281 bp, Artificial Sequence
  Description of Artificial Sequence: Synthetic coding sequence
atggccgcccccgccctgggcctggtgtgcggcagatgccccgagctgggcctggtgctgctgctgctgctgctgagcctgctgtgcggcgccgccggcagccaggaggccggcaccggcgccggcgccggcagcctggccggcagctgcggctgcggcaccccccagagacccggcgcccacggcagcagcgccgccgcccacagatacagcagagaggccaacgcccccggccccgtgcccggcgagagacagctggcccacagcaagatggtgcccatccccgccggcgtgttcaccatgggcaccgacgacccccagatcaagcaggacggcgaggcccccgccagaagagtgaccatcgacgccttctacatggacgcctacgaggtgagcaacaccgagttcgagaagttcgtgaacagcaccggctacctgaccgaggccgagaagttcggcgacagcttcgtgttcgagggcatgctgagcgagcaggtgaagaccaacatccagcaggccgtggccgccgccccctggtggctgcccgtgaagggcgccaactggagacaccccgagggccccgacagcaccatcctgcacagacccgaccaccccgtgctgcacgtgagctggaacgacgccgtggcctactgcacctgggccggcaagagactgcccaccgaggccgagtgggagtacagctgcagaggcggcctgcacaacagactgttcccctggggcaacaagctgcagcccaagggccagcactacgccaacatctggcagggcgagttccccgtgaccaacaccggcgaggacggcttccagggcaccgcccccgtggacgccttcccccccaacggctacggcctgtacaacatcgtgggcaacgcctgggagtggaccagcgactggtggaccgtgcaccacagcgtggaggagaccctgaaccccaagggcccccccagcggcaaggacagagtgaagaagggcggcagctacatgtgccacagaagccaggagtactacgacccctacttccaggacgtggccagcgagatgctgagaagacacaccgccagcagatggaaggccttcagcagcctggagccctgctgcagcatcagaagacaccagcagtacgccgccatcgagagactgacctgcggcaagttcgagctgagatgcgccagcctgagaaagatcgactgcctgaacaccaacatcgcctgcagctacagcatgagacaggacggccccagactgcactgcgtggactag

SEQ ID NO: 101133 - DNA, 1287 bp, Artificial Sequence
  Description of Artificial Sequence: Synthetic coding sequence
atggccgcccccgccctgggcctggtgtgcggcagatgccccgagctgggcctggtgctgctgctgctgctgctgagcctgctgtgcggcgccgccggcagccaggaggccggcaccggcgccggcgccggcagcctggccggcagctgcggctgcggcaccccccagagacccggcgcccacggcagcagcgccgccgcccacagatacagcagagaggccaacgcccccggccccgtgcccggcgagagacagctggcccacagcaagatggtgcccatccccgccggcgtgttcaccatgggcaccgacgacccccagatcaagcaggacggcgaggcccccgccagaagagtgaccatcgacgccttctacatggacgcctacgaggtgagcaacaccgagttcgagaagttcgtgaacagcaccggctacctgaccgaggccgagaagttcggcgacagcttcgtgttcgagggcatgctgagcgagcaggtgaagaccaacatccagcaggccgtggccgccgccccctggtggctgcccgtgaagggcgccaactggagacaccccgagggccccgacagcaccatcctgcacagacccgaccaccccgtgctgcacgtgagctggaacgacgccgtggcctactgcacctgggccggcaagagactgcccaccgaggccgagtgggagtacagctgcagaggcggcctgcacaacagactgttcccctggggcaacaagctgcagcccaagggccagcactacgccaacatctggcagggcgagttccccgtgaccaacaccggcgaggacggcttccagggcaccgcccccgtggacgccttcccccccaacggctacggcctgtacaacatcgtgggcaacgcctgggagtggaccagcgactggtggaccgtgcaccacagcgtggaggagaccctgaaccccaagggcccccccagcggcaaggacagagtgaagaagggcggcctgagcaaggcccaccagagaatcagccaggagtactacgacccctacttccaggacgtggccagcgagatgctgagaagacacaccgccagcagatggaaggccttcagcagcctggagccctgctgcagcatcagaagacaccagcagtacgccgccatcgagagactgacctgcggcaagttcgagctgagatgcgccagcctgagaaagatcgactgcctgaacaccaacatcgcctgcagctacagcatgagacaggacggccccagactgcactgcgtggactag

SEQ ID NO: 101134 - DNA, 1050 bp, Artificial Sequence
  Description of Artificial Sequence: Synthetic coding sequence
atggccgcccccgccctgggcctggtgtgcggcagatgccccgagctgggcctggtgctgctgctgctgctgctgagcctgctgtgcggcgccgccggcagccaggaggccggcaccggcgccggcgccggcagcctggccggcagctgcggctgcggcaccccccagagacccggcgcccacggcagcagcgccgccgcccacagatacagcagagaggccaacgcccccggccccgtgcccggcgagagacagctggcccacagcaagatggtgcccatccccgccggcgtgttcaccatgggcaccgacgacccccagatcaagcaggacggcgaggcccccgccagaagagtgaccatcgacgccttctacatggacgcctacgaggtgagcaacaccgagttcgagaagttcgtgaacagcaccggctacctgaccgaggtggccgccgccccctggtggctgcccgtgaagggcgccaactggagacaccccgagggccccgacagcaccatcctgcacagacccgaccaccccgtgctgcacgtgagctggaacgacgccgtggcctactgcacctgggccggcaagagactgcccaccgaggccgagtgggagtacagctgcagaggcggcctgcacaacagactgttcccctggggcaacaagctgcagcccaagggccagcactacgccaacatctggcagggcgagttccccgtgaccaacaccggcgaggacggcttccagggcaccgcccccgtggacgccttcccccccaacggctacggcctgtacaacatcgtgggcaacgcctgggagtggaccagcgactggtggaccgtgcaccacagcgtggaggagaccctgaaccccaagggcccccccagcggcaaggacagagtgaagaagggcggcagctacatgtgccacagaagctactgctacagatacagatgcgccgccagaagccagaacacccccgacagcagcgccagcaacctgggcttcagatgcgccgccgacagactgcccaccatggactag

SEQ ID NO: 101135 - DNA, 1065 bp, Artificial Sequence
  Description of Artificial Sequence: Synthetic coding sequence
atggccgcccccgccctgggcctggtgtgcggcagatgccccgagctgggcctggtgctgctgctgctgctgctgagcctgctgtgcggcgccgccggcagccaggaggccggcaccggcgccggcgccggcagcctggccggcagctgcggctgcggcaccccccagagacccggcgcccacggcagcagcgccgccgcccacagatacagcagagaggccaacgcccccggccccgtgcccggcgagagacagctggcccacagcaagatggtgcccatccccgccggcgtgttcaccatgggcaccgacgacccccagatcaagcaggacggcgaggcccccgccagaagagtgaccatcgacgccttctacatggacgcctacgaggtgagcaacaccgagttcgagaagttcgtgaacagcaccggctacctgaccgaggccgagaagttcggcgacagcttcgtgttcgagggcatgctgagcgagcaggtgaagaccaacatccagcaggccgtggccgccgccccctggtggctgcccgtgaagggcgccaactggagacaccccgagggccccgacagcaccatcctgcacagacccgaccaccccgtgctgcacgtgagctggaacgacgccgtggcctactgcacctgggccggcaagagactgcccaccgaggccgagtgggagtacagctgcagaggcggcctgcacaacagactgttcccctggggcaacaagctgcagcccaagggccagcactacgccaacatctggcagggcgagttccccgtgaccaacaccggcgaggacggcttccagggcaccgcccccgtggacgccttcccccccaacggctacggcctgtacaacatcgtgggcaacgcctgggagtggaccagcgactggtggaccgtgcaccacagcgtggaggagaccctgaaccccagctactgctacagatacagatgcgccgccagaagccagaacacccccgacagcagcgccagcaacctgggcttcagatgcgccgccgacagactgcccaccatggactag

SEQ ID NO: 101136 - DNA, 1638 bp, Artificial Sequence
  Description of Artificial Sequence: Synthetic coding sequence
atgctgctgctgcacagagccgtggtgctgagactgcagcaggcctgcagactgaagagcatccccagcagaatctgcatccaggcctgcagcaccaacgacagcttccagccccagagacccagcctgaccttcagcggcgacaacagcagcacccagggctggagagtgatgggcaccctgctgggcctgggcgccgtgctggcctaccaggaccacagatgcagagccgcccaggagagcacccacatctacaccaaggaggaggtgagcagccacaccagccccgagaccggcatctgggtgaccctgggcagcgaggtgttcgacgtgaccgagttcgtggacctgcaccccggcggccccagcaagctgatgctggccgccggcggccccctggagcccttctgggccctgtacgccgtgcacaaccagagccacgtgagagagctgctggcccagtacaagatcggcgagctgaaccccgaggacaaggtggcccccaccgtggagaccagcgacccctacgccgacgaccccgtgagacaccccgccctgaaggtgaacagccagagacccttcaacgccgagcccccccccgagctgctgaccgagaactacatcacccccaaccccatcttcttcaccagaaaccacctgcccgtgcccaacctggaccccgacacctacagactgcacgtggtgggcgcccccggcggccagagcctgagcctgagcctggacgacctgcacaacttccccagatacgagatcaccgtgaccctgcagtgcgccggcaacagaagaagcgagatgacccaggtgaaggaggtgaagggcctggagtggagaaccggcgccatcagcaccgccagatgggccggcgccagactgtgcgacgtgctggcccaggccggccaccagctgtgcgagaccgaggcccacgtgtgcttcgagggcctggacagcgaccccaccggcaccgcctacggcgccagcatccccctggccagagccatggaccccgaggccgaggtgctgctggcctacgagatgaacggccagcccctgcccagagaccacggcttccccgtgagagtggtggtgcccggcgtggtgggcgccagacacgtgaagtggctgggcagagtgagcgtgcagcccgaggagagctacagccactggcagagaagagactacaagggcttcagccccagcgtggactgggagaccgtggacttcgacagcgcccccagcatccaggagctgcccgtgcagagcgccatcaccgagcccagagacggcgagaccgtggagagcggcgaggtgaccatcaagggctacgcctggagcggcggcggcagagccgtgatcagagtggacgtgagcctggacggcggcctgacctggcaggtggccaagctggacggcgaggagcagagacccagaaaggcctgggcctggagactgtggcagctgaaggcccccgtgcccgccggccagaaggagctgaacatcgtgtgcaaggccgtggacgacggctacaacgtgcagcccgacaccgtggcccccatctggaacctgagaggcgtgctgagcaacgcctggcacagagtgcacgtgtacgtgagcccctag

SEQ ID NO: 101137 - DNA, 1638 bp, Artificial Sequence; identical to SEQ ID NO: 101136
  Description of Artificial Sequence: Synthetic coding sequence

SEQ ID NO: 101138 - DNA, 1638 bp, Artificial Sequence; identical to SEQ ID NO: 101136
  Description of Artificial Sequence: Synthetic coding sequence

SEQ ID NO: 101139 - DNA, 1638 bp, Artificial Sequence; identical to SEQ ID NO: 101136
  Description of Artificial Sequence: Synthetic coding sequence

SEQ ID NO: 101140 - DNA, 489 bp, Artificial Sequence
  Description of Artificial Sequence: Synthetic coding sequence
atgctgctgctgcacagagccgtggtgctgagactgcagcaggcctgcagactgaagagcatccccagcagaatctgcatccaggcctgcagcaccaacgacagcttccagccccagagacccagcctgaccttcagcggcgacaacagcagcacccagggctggagagtgatgggcaccctgctgggcctgggcgccgtgctggcctaccaggaccacagatgcagagccgcccaggagagcacccacatctacaccaaggaggaggtgagcagccacaccagccccgagaccggcatctgggtgaccctgggcagcgaggtgttcgacgtgaccgagttcgtggacctgcaccccggcggccccagcaagctgatgctggccgccggcggccccctggagcccttctgggccctgtacgccgtgcacaaccagagccacgtgagagagctgctggcccagtacaagatcggcgagctgaacccctag

SEQ ID NO: 101141 - DNA, 132 bp, Artificial Sequence
  Description of Artificial Sequence: Synthetic coding sequence
atgctgctgctgcacagagccgtggtgctgagactgcagcaggcctgcagactgaagagcatccccagcagaatctgcatccaggcctgcagcaccaacgacagcttccagccccagagacccagcctgtag

SEQ ID NO: 101142 - DNA, 1638 bp, Artificial Sequence; identical to SEQ ID NO: 101136
  Description of Artificial Sequence: Synthetic coding sequence

SEQ ID NO: 101143 - DNA, 1638 bp, Artificial Sequence; identical to SEQ ID NO: 101136
  Description of Artificial Sequence: Synthetic coding sequence

SEQ ID NO: 101144 - DNA, 366 bp, Artificial Sequence
  Description of Artificial Sequence: Synthetic coding sequence
atgctgctgctgcacagagccgtggtgctgagactgcagcaggcctgcagactgaagagcatccccagcagaatctgcatccaggcctgcagcaccaacgacagcttccagccccagagacccagcctgaccttcagcggcgacaacagcagcacccagggctggagagtgatgggcaccctgctgggcctgggcgccgtgctggcctaccaggaccacagatgcagagccgcccaggagagcacccacatctacaccaaggaggaggtgagcagccacaccagccccgagaccggcatctgggtgaccctgggcagcgaggtgttcgacgtgaccgagttcgtggacctgcaccccggcggctag

SEQ ID NO: 101145 - DNA, 783 bp, Artificial Sequence
  Description of Artificial Sequence: Synthetic coding sequence
atggccgagagcgaggccgagacccccagcacccccggcgagttcgagagcaagtacttcgagttccacggcgtgagactgccccccttctgcagaggcaagatggaggagatcgccaacttccccgtgagacccagcgacgtgtggatcgtgacctaccccaagagcggcaccagcctgctgcaggaggtggtgtacctggtgagccagggcgccgaccccgacgagatcggcctgatgaacatcgacgagcagctgcccgtgctggagtacccccagcccggcctggacatcatcaaggagctgaccagccccagactgatcaagagccacctgccctacagattcctgcccagcgacctgcacaacggcgacagcaaggtgatctacatggccagaaaccccaaggacctggtggtgagctactaccagttccacagaagcctgagaaccatgagctacagaggcaccttccaggagttctgcagaagattcatgaacgacaagctgggctacggcagctggttcgagcacgtgcaggagttctgggagcacagaatggacagcaacgtgctgttcctgaagtacgaggacatgcacagagacctggtgaccatggtggagcagctggccagattcctgggcgtgagctgcgacaaggcccagctggaggccctgaccgagcactgccaccagctggtggaccagtgctgcaacgccgaggccctgcccgtgggcagagcccactgcgtgttcgccagaaagatcttcctgagctggtag

SEQ ID NO: 101146 - DNA, 855 bp, Artificial Sequence
  Description of Artificial Sequence: Synthetic coding sequence
atggccgagagcgaggccgagacccccagcacccccggcgagttcgagagcaagtacttcgagttccacggcgtgagactgccccccttctgcagaggcaagatggaggagatcgccaacttccccgtgagacccagcgacgtgtggatcgtgacctaccccaagagcggcaccagcctgctgcaggaggtggtgtacctggtgagccagggcgccgaccccgacgagatcggcctgatgaacatcgacgagcagctgcccgtgctggagtacccccagcccggcctggacatcatcaaggagctgaccagccccagactgatcaagagccacctgccctacagattcctgcccagcgacctgcacaacggcgacagcaaggtgatctacatggccagaaaccccaaggacctggtggtgagctactaccagttccacagaagcctgagaaccatgagctacagaggcaccttccaggagttctgcagaagattcatgaacgacaagctgggctacggcagctggttcgagcacgtgcaggagttctgggagcacagaatggacagcaacgtgctgttcctgaagtacgaggacatgcacagagacctggtgaccatggtggagcagctggccagattcctgggcgtgagctgcgacaaggcccagctggaggccctgaccgagcactgccaccagctggtggaccagtgctgcaacgccgaggccctgcccgtgggcagaggcagagtgggcctgtggaaggacatcttcaccgtgagcatgaacgagaagttcgacctggtgtacaagcagaagatgggcaagtgcgacctgaccttcgacttctacctgtag

SEQ ID NO: 101147 - DNA, 516 bp, Artificial Sequence
  Description of Artificial Sequence: Synthetic coding sequence
atggccgagagcgaggccgagacccccagcacccccggcgagttcgagagcaagtacttcgagttccacggcgtgagactgccccccttctgcagaggcaagatggaggagatcgccaacttccccgtgagacccagcgacgtgtggatcgtgacctaccccaagagcgtgggctacggcagctggttcgagcacgtgcaggagttctgggagcacagaatggacagcaacgtgctgttcctgaagtacgaggacatgcacagagacctggtgaccatggtggagcagctggccagattcctgggcgtgagctgcgacaaggcccagctggaggccctgaccgagcactgccaccagctggtggaccagtgctgcaacgccgaggccctgcccgtgggcagaggcagagtgggcctgtggaaggacatcttcaccgtgagcatgaacgagaagttcgacctggtgtacaagcagaagatgggcaagtgcgacctgaccttcgacttctacctgtag

SEQ ID NO: 101148 - DNA, 171 bp, Artificial Sequence
  Description of Artificial Sequence: Synthetic coding sequence
atgctggccaagctgctgtgcgaccaggtggtgggcgcccccatcgccgtgagcgccttctacgccggcatgagcatcctgcagggcaaggacgacatcttcctggacctgaagcagaagttctggaacacctacatgcagacccagagctggctgtggagaagcctgtag

SEQ ID NO: 101149 - DNA, 888 bp, Artificial Sequence
  Description of Artificial Sequence: Synthetic coding sequence
atggagctgatccaggacaccagcagaccccccctggagtacgtgaagggcgtgcccctgatcaagtacttcgccgaggccctgggccccctgcagagcttccaggccagacccgacgacctgctgatcagcacctaccccaagagcggcaccacctgggtgagccagatcctggacatgatctaccagggcggcgacctggagaagtgccacagagcccccatcttcatgagagtgcccttcctggagttcaaggcccccggcatccccagcggcatggagaccctgaaggacacccccgcccccagactgctgaagacccacctgcccctggccctgctgccccagaccctgctggaccagaaggtgaaggtggtgtacgtggccagaaacgccaaggacgtggccgtgagctactaccacttctaccacatggccaaggtgcaccccgagcccggcacctgggacagcttcctggagaagttcatggtgggcgaggtgagctacggcagctggtaccagcacgtgcaggagtggtgggagctgagcagaacccaccccgtgctgtacctgttctacgaggacatgaaggagaaccccaagagagagatccagaagatcctggagttcgtgggcagaagcctgcccgaggagaccgtggacttcgtggtgcagcacaccagcttcaaggagatgaagaagaaccccatgaccaactacaccaccgtgccccaggagttcatggaccacagcatcagccccttcatgagaaagggcatggccggcgactggaagaccaccttcaccgtggcccagaacgagagattcgacgccgactacgccgagaagatggccggctgcagcctgagcttcagaagcgagctgtag

SEQ ID NO: 101150 - DNA, 888 bp, Artificial Sequence; identical to SEQ ID NO: 101149
  Description of Artificial Sequence: Synthetic coding sequence

SEQ ID NO: 101151 - DNA, 654 bp, Artificial Sequence
  Description of Artificial Sequence: Synthetic coding sequence
atgctggccaagctgctgtgcgaccaggtggtgggcgcccccatcgccgtgagcgccttctacgccggcatgagcatcctgcagggcaaggacgacatcttcctggacctgaagcagaagttctggaacacctacatggtggtgtacgtggccagaaacgccaaggacgtggccgtgagctactaccacttctaccacatggccaaggtgcaccccgagcccggcacctgggacagcttcctggagaagttcatggtgggcgaggtgagctacggcagctggtaccagcacgtgcaggagtggtgggagctgagcagaacccaccccgtgctgtacctgttctacgaggacatgaaggagaaccccaagagagagatccagaagatcctggagttcgtgggcagaagcctgcccgaggagaccgtggacttcgtggtgcagcacaccagcttcaaggagatgaagaagaaccccatgaccaactacaccaccgtgccccaggagttcatggaccacagcatcagccccttcatgagaaagggcatggccggcgactggaagaccaccttcaccgtggcccagaacgagagattcgacgccgactacgccgagaagatggccggctgcagcctgagcttcagaagcgagctgtag

SEQ ID NO: 101152 - DNA, 888 bp, Artificial Sequence; identical to SEQ ID NO: 101149
  Description of Artificial Sequence: Synthetic coding sequence

SEQ ID NO: 101153 - DNA, 888 bp, Artificial Sequence; identical to SEQ ID NO: 101149
  Description of Artificial Sequence: Synthetic coding sequence

SEQ ID NO: 101154 - DNA, 888 bp, Artificial Sequence
  Description of Artificial Sequence: Synthetic coding sequence
atggagctgatccaggacatcagcagaccccccctggagtacgtgaagggcgtgcccctgatcaagtacttcgccgaggccctgggccccctgcagagcttccaggccagacccgacgacctgctgatcagcacctaccccaagagcggcaccacctgggtgagccagatcctggacatgatctaccagggcggcgacctggagaagtgccacagagcccccatcttcatgagagtgcccttcctggagttcaaggtgcccggcatccccagcggcatggagaccctgaagaacacccccgcccccagactgctgaagacccacctgcccctggccctgctgccccagaccctgctggaccagaaggtgaaggtggtgtacgtggccagaaacgccaaggacgtggccgtgagctactaccacttctaccacatggccaaggtgtacccccaccccggcacctgggagagcttcctggagaagttcatggccggcgaggtgagctacggcagctggtaccagcacgtgcaggagtggtgggagctgagcagaacccaccccgtgctgtacctgttctacgaggacatgaaggagaaccccaagagagagatccagaagatcctggagttcgtgggcagaagcctgcccgaggagaccgtggacctgatggtggagcacaccagcttcaaggagatgaagaagaaccccatgaccaactacaccaccgtgagaagagagttcatggaccacagcatcagccccttcatgagaaagggcatggccggcgactggaagaccaccttcaccgtggcccagaacgagagattcgacgccgactacgccaagaagatggccggctgcagcctgagcttcagaagcgagctgtag

SEQ ID NO: 101155 - DNA, 888 bp, Artificial Sequence; identical to SEQ ID NO: 101154
  Description of Artificial Sequence: Synthetic coding sequence

SEQ ID NO: 101156 - DNA, 579 bp, Artificial Sequence
  Description of Artificial Sequence: Synthetic coding sequence
atggagctgatccaggacatcagcagaccccccctggagtacgtgaagggcgtgcccctgatcaagtacttcgccgaggccctgggccccctgcagagcttccaggccagacccgacgacctgctgatcagcacctaccccaagagcggcaccacctgggtgagccagatcctggacatgatctaccagggcggcgacctggagaagtgccacagagcccccatcttcatgagagtgcccttcctggagttcaaggtgcccggcatccccagcggcatggagaccctgaagaacacccccgcccccagactgctgaagacccacctgcccctggccctgctgccccagaccctgctggaccagaaggtgaaggtggtgtacgtggccagaaacgccaaggacgtggccgtgagctactaccacttctaccacatggccaaggtgtacccccaccccggcacctgggagagcttcctggagaagttcatggccggcgaggtgagctacggcagctggtaccagcacgtgcaggagtggtgggagctgagcagaacccaccccgtgctgtacctgttctag

SEQ ID NO: 101157 - DNA, 891 bp, Artificial Sequence
  Description of Artificial Sequence: Synthetic coding sequence
atggccctgaccagcgacctgggcaagcagatcaagctgaaggaggtggagggcaccctgctgcagcccgccaccgtggacaactggagccagatccagagcttcgaggccaagcccgacgacctgctgatctgcacctaccccaaggccggcaccacctggatccaggagatcgtggacatgatcgagcagaacggcgacgtggagaagtgccagagagccatcatccagcacagacaccccttcatcgagtgggccagacccccccagcccagcggcgtggagaaggccaaggccatgcccagccccagaatcctgaagacccacctgagcacccagctgctgccccccagcttctgggagaacaactgcaagttcctgtacgtggccagaaacgccaaggactgcatggtgagctactaccacttccagagaatgaaccacatgctgcccgaccccggcacctgggaggagtacttcgagaccttcatcaacggcaaggtggtgtggggcagctggttcgaccacgtgaagggctggtgggagatgaaggacagacaccagatcctgttcctgttctacgaggacatcaagagagaccccaagcacgagatcagaaaggtgatgcagttcatgggcaagaaggtggacgagaccgtgctggacaagatcgtgcaggagaccagcttcgagaagatgaaggagaaccccatgaccaacagaagcaccgtgagcaagagcatcctggaccagagcatcagcagcttcatgagaaagggcaccgtgggcgactggaagaaccacttcaccgtggcccagaacgagagattcgacgagatctacagaagaaagatggagggcaccagcatcaacttctgcatggagctgtag

SEQ ID NO: 101158 - DNA, 924 bp, Artificial Sequence
  Description of Artificial Sequence: Synthetic coding sequence
atggccctgaccagcgacctgggcaagcagatcaagctgaaggaggtggagggcaccctgctgcagcccgccaccgtggacaactggagccagatccagagcttcgaggccaagcccgacgacctgctgatctgcacctaccccaaggccggcaccacctggatccaggagatcgtggacatgatcgagcagaacggcgacgtggagaagtgccagagagccatcatccagcacagacaccccttcatcgagtgggccagacccccccagcccagcgagaccggcttccaccacgtggcccaggccggcctgaagctgctgagcagcagcaacccccccgccagcaccagccagagcgccaagatcaccgacctgctgccccccagcttctgggagaacaactgcaagttcctgtacgtggccagaaacgccaaggactgcatggtgagctactaccacttccagagaatgaaccacatgctgcccgaccccggcacctgggaggagtacttcgagaccttcatcaacggcaaggtggtgtggggcagctggttcgaccacgtgaagggctggtgggagatgaaggacagacaccagatcctgttcctgttctacgaggacatcaagagagaccccaagcacgagatcagaaaggtgatgcagttcatgggcaagaaggtggacgagaccgtgctggacaagatcgtgcaggagaccagcttcgagaagatgaaggagaaccccatgaccaacagaagcaccgtgagcaagagcatcctggaccagagcatcagcagcttcatgagaaagggcaccgtgggcgactggaagaaccacttcaccgtggcccagaacgagagattcgacgagatctacagaagaaagatggagggcaccagcatcaacttctgcatggagctgtag

SEQ ID NO: 101159 - DNA, 933 bp, Artificial Sequence
  Description of Artificial Sequence: Synthetic coding sequence
atggccctgaccagcgacctgggcaagcagatcaagctgaaggaggtggagggcaccctgctgcagcccgccaccgtggacaactggagccagatccagagcttcgaggccaagcccgacgacctgctgatctgcacctaccccaaggccggcaccacctggatccaggagatcgtggacatgatcgagcagaacggcgacgtggagaagtgccagagagccatcatccagcacagacaccccttcatcgagtgggccagacccccccagcccagcgtgctggtgctgagaagatgcttcctgctgagctacttcaagggcgtggagaaggccaaggccatgcccagccccagaatcctgaagacccacctgagcacccagctgctgccccccagcttctgggagaacaactgcaagttcctgtacgtggccagaaacgccaaggactgcatggtgagctactaccacttccagagaatgaaccacatgctgcccgaccccggcacctgggaggagtacttcgagaccttcatcaacggcaaggtggtgtggggcagctggttcgaccacgtgaagggctggtgggagatgaaggacagacaccagatcctgttcctgttctacgaggacatcaagagagaccccaagcacgagatcagaaaggtgatgcagttcatgggcaagaaggtggacgagaccgtgctggacaagatcgtgcaggagaccagcttcgagaagatgaaggagaaccccatgaccaacagaagcaccgtgagcaagagcatcctggaccagagcatcagcagcttcatgagaaagggcaccgtgggcgactggaagaaccacttcaccgtggcccagaacgagagattcgacgagatctacagaagaaagatggagggcaccagcatcaacttctgcatggagctgtag

SEQ ID NO: 101160 - DNA, 639 bp, Artificial Sequence
  Description of Artificial Sequence: Synthetic coding sequence
atgggcccccccagcgccagcccccacagagagtgcatcccctggcagggcctgctgctgaccgccagcctgctgaacttctggaacccccccaccaccgccaagctgaccatcgagagcatgcccctgagcgtggccgagggcaaggaggtgctgctgctggtgcacaacctgccccagcacctgttcggctacagctggtacaagggcgagagagtggacggcaacagcctgatcgtgggctacgtgatcggcacccagcaggccacccccggcgccgcctacagcggcagagagaccatctacaccaacgccagcctgctgatccagaacgtgacccagaacgacatcggcttctacaccctgcaggtgatcaagagcgacctggtgaacgaggaggccaccggccagttccacgtgtaccaggagaacgcccccggcctgcccgtgggcgccgtggccggcatcgtgaccggcgtgctggtgggcgtggccctggtggccgccctggtgtgcttcctgctgctggccaagaccggcagaccctggagcctgccccagctgtgcctgctggacgtgcccagcctgcactgccccggcccccccacccagccccaggacagcagcttccacctgtag

SEQ ID NO: 101161 - DNA, 1098 bp, Artificial Sequence
  Description of Artificial Sequence: Synthetic coding sequence
atggacggccccgccgagccccagatccccggcctgtgggacacctacgaggacgacatcagcgagatcagccagaagctgcccggcgagtacttcagatacaagggcgtgcccttccccgtgggcctgtacagcctggagagcatcagcctggccgagaacacccaggacgtgagagacgacgacatcttcatcatcacctaccccaagagcggcaccacctggatgatcgagatcatctgcctgatcctgaaggagggcgaccccagctggatcagaagcgtgcccatctgggagagagccccctggtgcgagaccatcgtgggcgccttcagcctgcccgaccagtacagccccagactgatgagcagccacctgcccatccagatcttcaccaaggccttcttcagcagcaaggccaaggtgatctacatgggcagaaaccccagagacgtggtggtgagcctgtaccactacagcaagatcgccggccagctgaaggaccccggcacccccgaccagttcctgagagacttcctgaagggcgaggtgcagttcggcagctggttcgaccacatcaagggctggctgagaatgaagggcaaggacaacttcctgttcatcacctacgaggagctgcagcaggacctgcagggcagcgtggagagaatctgcggcttcctgggcagacccctgggcaaggaggccctgggcagcgtggtggcccacagcaccttcagcgccatgaaggccaacaccatgagcaactacaccctgctgccccccagcctgctggaccacagaagaggcgccttcctgagaaagggcgtgtgcggcgactggaagaaccacttcaccgtggcccagagcgaggccttcgacagagcctacagaaagcagatgagaggcatgcccaccttcccctgggacgaggaccccgaggaggacggcagccccgaccccgagcccagccccgagcccgagcccaagcccagcctggagcccaacaccagcctggagagagagcccagacccaacagcagccccagccccagccccggccaggccagcgagaccccccaccccagacccagctag

SEQ ID NO: 101162 - DNA, 1053 bp, Artificial Sequence
  Description of Artificial Sequence: Synthetic coding sequence
atggccagccccccccccttccacagccagaagctgcccggcgagtacttcagatacaagggcgtgcccttccccgtgggcctgtacagcctggagagcatcagcctggccgagaacacccaggacgtgagagacgacgacatcttcatcatcacctaccccaagagcggcaccacctggatgatcgagatcatctgcctgatcctgaaggagggcgaccccagctggatcagaagcgtgcccatctgggagagagccccctggtgcgagaccatcgtgggcgccttcagcctgcccgaccagtacagccccagactgatgagcagccacctgcccatccagatcttcaccaaggccttcttcagcagcaaggccaaggtgatctacatgggcagaaaccccagagacgtggtggtgagcctgtaccactacagcaagatcgccggccagctgaaggaccccggcacccccgaccagttcctgagagacttcctgaagggcgaggtgcagttcggcagctggttcgaccacatcaagggctggctgagaatgaagggcaaggacaacttcctgttcatcacctacgaggagctgcagcaggacctgcagggcagcgtggagagaatctgcggcttcctgggcagacccctgggcaaggaggccctgggcagcgtggtggcccacagcaccttcagcgccatgaaggccaacaccatgagcaactacaccctgctgccccccagcctgctggaccacagaagaggcgccttcctgagaaagggcgtgtgcggcgactggaagaaccacttcaccgtggcccagagcgaggccttcgacagagcctacagaaagcagatgagaggcatgcccaccttcccctgggacgaggaccccgaggaggacggcagccccgaccccgagcccagccccgagcccgagcccaagcccagcctggagcccaacaccagcctggagagagagcccagacccaacagcagccccagccccagccccggccaggccagcgagaccccccaccccagacccagctag

SEQ ID NO: 101163 - DNA, 1041 bp, Artificial Sequence
  Description of Artificial Sequence: Synthetic coding sequence
atggtggagaaggaggaggccggcggcggcatcagcgaggaggaggccgcccagtacgacagacagatcagactgtggggcctggaggcccagaagagactgagagccagcagagtgctgctggtgggcctgaagggcctgggcgccgagatcgccaagaacctgatcctggccggcgtgaagggcctgaccatgctggaccacgagcaggtgacccccgaggaccccggcgcccagttcctgatcagaaccggcagcgtgggcagaaacagagccgaggccagcctggagagagcccagaacctgaaccccatggtggacgtgaaggtggacaccgaggacatcgagaagaagcccgagagcttcttcacccagttcgacgccgtgtgcctgacctgctgcagcagagacgtgatcgtgaaggtggaccagatctgccacaagaacagcatcaagttcttcaccggcgacgtgttcggctaccacggctacaccttcgccaacctgggcgagcacgagttcgtggaggagaagaccaaggtggccaaggtgagccagggcgtggaggacggccccgacaccaagagagccaagctggacagcagcgagaccaccatggtgaagaagaaggtggtgttctgccccgtgaaggaggccctggaggtggactggagcagcgagaaggccaaggccgccctgaagagaaccaccagcgactacttcctgctgcaggtgctgctgaagttcagaaccgacaagggcagagaccccagcagcgacacctacgaggaggacagcgagctgctgctgcagatcagaaacgacgtgctggacagcctgggcatcagccccgacctgctgcccgaggacttcgtgagatactgcttcagcgagatggcccccgtgtgcgccgtggtgggcggcatcctggcccaggagatcgtgaaggccctgagccagagagaccccccccacaacaacttcttcttcttcgacggcatgaagggcaacggcatcgtggagtgcctgggccccaagtag

SEQ ID NO: 101164 - DNA, 801 bp, Artificial Sequence
  Description of Artificial Sequence: Synthetic coding sequence
atggtggagaaggaggaggccggcggcggcatcagcgaggaggaggccgcccagtacgacagacagatcagactgtggggcctggaggcccagaagagactgagagccagcagagtgctgctggtgggcctgaagggcctgggcgccgagatcgccaagaacctgatcctggccggcgtgaagggcctgaccatgctggaccacgagcaggtgacccccgaggaccccggcgcccagttcctgatcagaaccggcagcgtgggcagaaacagagccgaggccagcctggagagagcccagaacctgaaccccatggtggacgtgaaggtggacaccgaggacatcgagaagaagcccgagagcttcttcacccagttcgacgccgtgtgcctgacctgctgcagcagagacgtgatcgtgaaggtggaccagatctgccacaagaacagcatcaagttcttcaccggcgacgtgttcggctaccacggctacaccttcgccaacctgggcgagcacgagttcgtggaggagaagaccaaggtggccaaggtgagccagggcgtggaggacggccccgacaccaagagagccaagctggacagcagcgagaccaccatggtgaagaagaaggtggtgttctgccccgtgaaggaggccctggaggtggactggagcagcgagaaggccaaggccgccctgaagagaaccaccagcgactacttcctgctgcagggcaccgccagccccagatggccccagtgcgtgagatggctggagggcttctggcacagaaagctgtag

SEQ ID NO: 101165 - DNA, 900 bp, Artificial Sequence
  Description of Artificial Sequence: Synthetic coding sequence
atggtggagaaggaggaggccggcggcggcatcagcgaggaggaggccgcccagtacgacagacagatcagactgtggggcctggaggcccagaagagactgagagccagcagagtgctgctggtgggcctgaagggcctgggcgccgagatcgccaagaacctgatcctggccggcgtgaagggcctgaccatgctggaccacgagcaggtgacccccgaggaccccggcgcccagttcctgatcagaaccggcagcgtgggcagaaacagagccgaggccagcctggagagagcccagaacctgaaccccatggtggacgtgaaggtggacaccgaggacatcgagaagaagcccgagagcttcttcacccagttcgacgccgtgtgcctgacctgctgcagcagagacgtgatcgtgaaggtggaccagatctgccacaagaacagcatcaagttcttcaccggcgacgtgttcggctaccacggctacaccttcgccaacctgggcgagcacgagttcgtggaggagaagaccaaggtggccaaggtgagccagggcgtggaggacggccccgacaccaagagagccaagctggacagcagcgagaccaccatggtgaagaagaaggtggtgttctgccccgtgaaggaggccctggaggtggactggagcagcgagaaggccaaggccgccctgaagagaaccaccagcgactacttcctgctgcagggccccgtgagcgccggccccagcagccagcagctgctgctgctgagatggcacgagggcgagtgggactgcggcgtgccctggccccaggtgaacagcagattcggcagccccagagacgccaactgcagcatgcccacctgcatcccctgccccctgcccagctag

SEQ ID NO: 101166 - DNA, 900 bp, Artificial Sequence
  Description of Artificial Sequence: Synthetic coding sequence
atggtggagaaggaggaggccggcggcggcatcagcgaggaggaggccgcccagtacgacagacagatcagactgtggggcctggaggcccagaagagactgagagccagcagagtgctgctggtgggcctgaagggcctgggcgccgagatcgccaagaacctgatcctggccggcgtgaagggcctgaccatgctggaccacgagcaggtgacccccgaggaccccggcgcccagttcctgatcagaaccggcagcgtgggcagaaacagagccgaggccagcctggagagagcccagaacctgaaccccatggtggacgtgaaggtggacaccgaggacatcgagaagaagcccgagagcttcttcacccagttcgacgccgtgtgcctgacctgctgcagcagagacgtgatcgtgaaggtggaccagatctgccacaagaacagcatcaagttcttcaccggcgacgtgttcggctaccacggctacaccttcgccaacctgggcgagcacgagttcgtggaggagaagaccaaggtggccaaggtgagccagggcgtggaggacggccccgacaccaagagagccaagctggacagcagcgagaccaccatggtgaagaagaaggtggtgttctgccccgtgaaggaggccctggaggtggactggagcagcgagaaggccaaggccgccctgaagagaaccaccagcgactacttcctgctgcaggagctgttccccagaatcgtggagagagtgtacgcccagagacaccccagaagcaccgagagaacccacgccaagatgctgatccccttcctgaccaaggagaagcccggcttcctgggcgagatggccgtgagcagaagcggcgtgggcaagctgcagtgcagctag

SEQ ID NO: 101167 - DNA, 519 bp, Artificial Sequence
  Description of Artificial Sequence: Synthetic coding sequence
atgctggagaagaccaaggtggccaaggtgagccagggcgtggaggacggccccgacaccaagagagccaagctggacagcagcgagaccaccatggtgaagaagaaggtggtgttctgccccgtgaaggaggccctggaggtggactggagcagcgagaaggccaaggccgccctgaagagaaccaccagcgactacttcctgctgcaggtgctgctgaagttcagaaccgacaagggcagagaccccagcagcgacacctacgaggaggacagcgagctgctgctgcagatcagaaacgacgtgctggacagcctgggcatcagccccgacctgctgcccgaggacttcgtgagatactgcttcagcgagatggcccccgtgtgcgccgtggtgggcggcatcctggcccaggagatcgtgaaggccctgagccagagagaccccccccacaacaacttcttcttcttcgacggcatgaagggcaacggcatcgtggagtgcctgggccccaagtag

SEQ ID NO: 101168 - DNA, 1935 bp, Artificial Sequence
  Description of Artificial Sequence: Synthetic coding sequence
atggacgacatcgccgacagaatgagaatggacgccggcgaggtgaccctggtgaaccacaacagcgtgttcaagacccacctgctgccccagaccggcttccccgaggaccagctgagcctgagcgaccagcagatcctgagcagcagacagggccacctggacagaagcttcacctgcagcaccagaagcgccgcctacaaccccagctactacagcgacaaccccagcagcgacagcttcctgggcagcggcgacctgagaaccttcggccagagcgccaacggccagtggagaaacagcacccccagcagcagcagcagcctgcagaagagcagaaacagcagaagcctgtacctggagaccagaaagaccagcagcggcctgagcaacagcttcgccggcaagagcaaccaccactgccacgtgagcgcctacgagaagagcttccccatcaagcccgtgcccagccccagctggagcggcagctgcagaagaagcctgctgagccccaagaagacccagagaagacacgtgagcaccgccgaggagaccgtgcaggaggaggagagagagatctacagacagctgctgcagatggtgaccggcaagcagttcaccatcgccaagcccaccacccacttccccctgcacctgagcagatgcctgagcagcagcaagaacaccctgaaggacagcctgttcaagaacggcaacagctgcgccagccagatcatcggcagcgacaccagcagcagcggcagcgccagcatcctgaccaaccaggagcagctgagccacagcgtgtacagcctgagcagctacacccccgacgtggccttcggcagcaaggacagcggcaccctgcaccacccccaccaccaccacagcgtgccccaccagcccgacaacctggccgccagcaacacccagagcgagggcagcgacagcgtgatcctgctgaaggtgaaggacagccagacccccacccccagcagcaccttcttccaggccgagctgtggatcaaggagctgaccagcgtgtacgacagcagagccagagagagactgagacagatcgaggagcagaaggccctggccctgcagctgcagaaccagagactgcaggagagagagcacagcgtgcacgacagcgtggagctgcacctgagagtgcccctggagaaggagatccccgtgaccgtggtgcaggagacccagaagaagggccacaagctgaccgacagcgaggacgagttccccgagatcaccgaggagatggagaaggagatcaagaacgtgttcagaaacggcaaccaggacgaggtgctgagcgaggccttcagactgaccatcaccagaaaggacatccagaccctgaaccacctgaactggctgaacgacgagatcatcaacttctacatgaacatgctgatggagagaagcaaggagaagggcctgcccagcgtgcacgccttcaacaccttcttcttcaccaagctgaagaccgccggctaccaggccgtgaagagatggaccaagaaggtggacgtgttcagcgtggacatcctgctggtgcccatccacctgggcgtgcactggtgcctggccgtggtggacttcagaaagaagaacatcacctactacgacagcatgggcggcatcaacaacgaggcctgcagaatcctgctgcagtacctgaagcaggagagcatcgacaagaagagaaaggagttcgacaccaacggctggcagctgttcagcaagaagagccaggagatcccccagcagatgaacggcagcgactgcggcatgttcgcctgcaagtacgccgactgcatcaccaaggacagacccatcaacttcacccagcagcacatgccctacttcagaaagagaatggtgtgggagatcctgcacagaaagctgctgtag

SEQ ID NO: 101169 - DNA, 489 bp, Artificial Sequence
  Description of Artificial Sequence: Synthetic coding sequence
atgaagatccccctgaccgccaccatctgcctgcccggcagcagcccccccggcctgtgcatcttcgccaaggtgagcgacgtgaagagactggagatggacgacatcgccgacagaatgagaatggacgccggcgaggtgaccctggtgaaccacaacagcgtgttcaagacccacctgctgccccagaccggcttccccgaggaccagctgagcctgagcgaccagcagatcctgagcagcagacagggccacctggacagaagcttcacctgcagcaccagaagcgccgcctacaaccccagctactacagcggccccggcctgggcgtgctggccagatacagctggggcaagatgctgaccttcggcggccaccacggcgtgaccctgatgcagatcagacacatggccgtggccggcttcagcagcttcatcaacttccagatcatcctgccccagaccgtgttcctggcccaggccatctag

SEQ ID NO: 101170 - DNA, 1932 bp, Artificial Sequence
  Description of Artificial Sequence: Synthetic coding sequence
atggacgacatcgccgacagaatgagaatggacgccggcgaggtgaccctggtgaaccacaacagcgtgttcaagacccacctgctgccccagaccggcttccccgaggaccagctgagcctgagcgaccagcagatcctgagcagcagacagggccacctggacagaagcttcacctgcagcaccagaagcgccgcctacaaccccagctactacagcgacaaccccagcagcgacagcttcctgggcagcggcgacctgagaaccttcggccagagcgccaacggccagtggagaaacagcacccccagcagcagcagcagcctgcagaagagcagaaacagcagaagcctgtacctggagaccagaaagaccagcagcggcctgagcaacagcttcgccggcaagagcaaccaccactgccacgtgagcgcctacgagaagagcttccccatcaagcccgtgcccagccccagctggagcggcagctgcagaagaagcctgctgagccccaagaagacccagagaagacacgtgagcaccgccgaggagaccgtgcaggaggaggagagagagatctacagacagctgctgcagatggtgaccggcaagcagttcaccatcgccaagcccaccacccacttccccctgcacctgagcagatgcctgagcagcagcaagaacaccctgaaggacagcctgttcaagaacggcaacagctgcgccagccagatcatcggcagcgacaccagcagcagcggcagcgccagcatcctgaccaaccaggagcagctgagccacagcgtgtacagcctgagcagctacacccccgacgtggccttcggcagcaaggacagcggcaccctgcaccacccccaccaccaccacagcgtgccccaccagcccgacaacctggccgccagcaacacccagagcgagggcagcgacagcgtgatcctgctgaaggtgaaggacagccagacccccacccccagcagcaccttcttccaggccgagctgtggatcaaggagctgaccagcgtgtacgacagcagagccagagagagactgagacagatcgaggagcagaaggccctggccctgcagctgcagaaccagagactgcaggagagagagcacagcgtgcacgacagcgtggagctgcacctgagagtgcccctggagaaggagatccccgtgaccgtggtgcaggagacccagaagaagggccacaagctgaccgacagcgaggacgagttccccgagatcaccgaggagatggagaaggagatcaagaacgtgttcagaaacggcaaccaggacgaggtgctgagcgaggccttcagactgaccatcaccagaaaggacatccagaccctgaaccacctgaactggctgaacgacgagatcatcaacttctacatgaacatgctgatggagagaagcaaggagaagggcctgcccagcgtgcacgccttcaacaccttcttcttcaccaagctgaagaccgccggctaccaggccgtgaagagatggaccaagaaggtggacgtgttcagcgtggacatcctgctggtgcccatccacctgggcgtgcactggtgcctggccgtggtggacttcagaaagaagaacatcacctactacgacagcatgggcggcatcaacaacgaggcctgcagaatcctgctgcagtacctgaagcaggagagcatcgacaagaagagaaaggagttcgacaccaacggctggcagctgttcagcaagaagagccagatcccccagcagatgaacggcagcgactgcggcatgttcgcctgcaagtacgccgactgcatcaccaaggacagacccatcaacttcacccagcagcacatgccctacttcagaaagagaatggtgtgggagatcctgcacagaaagctgctgtag

SEQ ID NO: 101171 - DNA, 1935 bp, Artificial Sequence; identical to SEQ ID NO: 101168
  Description of Artificial Sequence: Synthetic coding sequence

SEQ ID NO: 101172 - DNA, 1932 bp, Artificial Sequence; identical to SEQ ID NO: 101170
  Description of Artificial Sequence: Synthetic coding sequence

SEQ ID NO: 101173 - DNA, 1935 bp, Artificial Sequence; identical to SEQ ID NO: 101168
  Description of Artificial Sequence: Synthetic coding sequence

SEQ ID NO: 101174 - DNA, 2268 bp, Artificial Sequence
  Description of Artificial Sequence: Synthetic coding sequence
atgaagaagcagagaaagatcctgtggagaaagggcatccacctggccttcagcgagaagtggaacaccggcttcggcggcttcaagaagttctacttccaccagcacctgtgcatcctgaaggccaagctgggcagacccgtgacctggaacagacagctgagacacttccagggcagaaagaaggccctgcagatccagaagacctggatcaaggacgagcccctgtgcgccaagaccaagttcaacgtggccacccagaacgtgagcaccctgagcagcaaggtgaagagaaaggacgccaagcacttcatcagcagcagcaagaccctgctgagactgcaggccgagaagctgctgagcagcgccaagaacagcgaccacgagtactgcagagagaagaacctgctgaaggccgtgaccgacttccccagcaacagcgccctgggccaggccaacggccacagacccagaaccgacccccagcccagcgacttccccatgaagttcaacggcgagagccagagccccggcgagagcggcaccatcgtggtgaccctgaacaaccacaagagaaagggcttctgctacggctgctgccagggccccgagcaccacagaaacggcggccccctgatccccaagaagttccagctgaaccagcacagaagaatcaagctgagccccctgatgatgtacgagaagctgagcatgatcagattcagatacagaatcctgagaagccagcacttcagaaccaagagcaaggtgtgcaagctgagaaaggcccagagaagctgggtgcagaaggtgaccggcgaccaccaggagaccagaagagagaacggcgagggcggcagctgcagccccttccccagccccgagcccaaggaccccagctgcagacaccagccctacttccccgacatggacagcagcgccgtggtgaagggcaccaacagccacgtgcccgactgccacaccaagggcagcagcttcctgggcaaggagctgagcctggacgaggccttccccgaccagcagaacggcagcgccaccaacgcctgggaccagagcagctgcagcagccccaagtgggagtgcaccgagctgatccacgacatccccctgcccgagcacagaagcaacaccatgttcatcagcgagaccgagagagagatcatgaccctgggccaggagaaccagaccagcagcgtgagcgacgacagagtgaagctgagcgtgagcggcgccgacaccagcgtgagcagcgtggacggccccgtgagccagaaggccgtgcagaacgagaacagctaccagatggaggaggacggcagcctgaagcagagcatcctgagcagcgagctgctggaccacccctactgcaagagccccctggaggcccccctggtgtgcagcggcctgaagctggagaaccaggtgggcggcggcaagaacagccagaaggccagccccgtggacgacgagcagctgagcgtgtgcctgagcggcttcctggacgaggtgatgaagaagtacggcagcctggtgcccctgagcgagaaggaggtgctgggcagactgaaggacgtgttcaacgaggacttcagcaacagaaagcccttcatcaacagagagatcaccaactacagagccagacaccagaagtgcaacttcagaatcttctacaacaagcacatgctggacatggacgacctggccaccctggacggccagaactggctgaacgaccaggtgatcaacatgtacggcgagctgatcatggacgccgtgcccgacaaggtgcacttcttcaacagcttcttccacagacagctggtgaccaagggctacaacggcgtgaagagatggaccaagaaggtggacctgttcaagaagagcctgctgctgatccccatccacctggaggtgcactggagcctgatcaccgtgaccctgagcaacagaatcatcagcttctacgacagccagggcatccacttcaagttctgcgtggagaacatcagaaagtacctgctgaccgaggccagagagaagaacagacccgagttcctgcagggctggcagaccgccgtgaccaagtgcatcccccagcagaagaacgacagcgactgcggcgtgttcgtgctgcagtactgcaagtgcctggccctggagcagcccttccagttcagccaggaggacatgcccagagtgagaaagagaatctacaaggagctgtgcgagtgcagactgatggactag

SEQ ID NO: 101175 - DNA, 3318 bp, Artificial Sequence
  Description of Artificial Sequence: Synthetic coding sequence
atggccgccggcaagagcggcggcagcgccggcgagatcaccttcctggaggccctggccagaagcgagagcaagagagacggcggcttcaagaacaactggagcttcgaccacgaggaggagagcgagggcgacaccgacaaggacggcaccaacctgctgagcgtggacgaggacgaggacagcgagaccagcaagggcaagaagctgaacagaagaagcgagatcgtggccaacagcagcggcgagttcatcctgaagacctacgtgagaagaaacaagagcgagagcttcaagaccctgaagggcaaccccatcggcctgaacatgctgagcaacaacaagaagctgagcgagaacacccagaacaccagcctgtgcagcggcaccgtggtgcacggcagaagattccaccacgcccacgcccagatccccgtggtgaagaccgccgcccagagaaaggagtaccccccccacgtgcagaaggtggagatcaaccccgtgagactgagcagactgcagggcgtggagagaatcatgaagaagaccgaggagagcgagagccaggtggagcccgagatcaagagaaaggtgcagcagaagagacactgcagcacctaccagcccaccccccccctgagccccgccagcaagaagtgcctgacccacctggaggacctgcagagaaactgcagacaggccatcaccctgaacgagagcaccggccccctgctgagaaccagcatccaccagaacagcggcggccagaagagccagaacaccggcctgaccaccaagaagttctacggcaacaacgtggagaaggtgcccatcgacatcatcgtgaactgcgacgacagcaagcacacctacctgcagaccaacggcaaggtgatcctgcccggcgccaagatccccaagatcaccaacctgaaggagagaaagaccagcctgagcgacctgaacgaccccatcatcctgagcagcgacgacgacgacgacaacgacagaaccaacagaagagagagcatcagcccccagcccgccgacagcgcctgcagcagccccgcccccagcaccggcaaggtggaggccgccctgaacgagaacacctgcagagccgagagagagctgagaagcatccccgaggacagcgagctgaacaccgtgaccctgcccagaaaggccagaatgaaggaccagttcggcaacagcatcatcaacacccccctgaagagaagaaaggtgttcagccaggagccccccgacgccctggccctgagctgccagagcagcttcgacagcgtgatcctgaactgcagaagcatcagagtgggcaccctgttcagactgctgatcgagcccgtgatcttctgcctggacttcatcaagatccagctggacgagcccgaccacgaccccgtggagatcatcctgaacaccagcgacctgaccaagtgcgagtggtgcaacgtgagaaagctgcccgtggtgttcctgcaggccatccccgccgtgtaccagaagctgagcatccagctgcagatgaacaaggaggacaaggtgtggaacgactgcaagggcgtgaacaagctgaccaacctggaggagcagtacatcatcctgatcttccagaacggcctggacccccccgccaacatggtgttcgagagcatcatcaacgagatcggcatcaagaacaacatcagcaacttcttcgccaagatccccttcgaggaggccaacggcagactggtggcctgcaccagaacctacgaggagagcatcaagggcagctgcggccagaaggagaacaagatcaagaccgtgagcttcgagagcaagatccagctgagaagcaagcaggagttccagttcttcgacgaggaggaggagaccggcgagaaccacaccatcttcatcggccccgtggagaagctgatcgtgtacccccccccccccgccaagggcggcatcagcgtgaccaacgaggacctgcactgcctgaacgagggcgagttcctgaacgacgtgatcatcgacttctacctgaagtacctggtgctggagaagctgaagaaggaggacgccgacagaatccacatcttcagcagcttcttctacaagagactgaaccagagagagagaagaaaccacgagaccaccaacctgagcatccagcagaagagacacggcagagtgaagacctggaccagacacgtggacatcttcgagaaggacttcatcttcgtgcccctgaacgaggccgcccactggttcctggccgtggtgtgcttccccggcctggagaagcccaagtacgagcccaacccccactaccacgagaacgccgtgatccagaagtgcagcaccgtggaggacagctgcatcagcagcagcgccagcgagatggagagctgcagccagaacagcagcgccaagcccgtgatcaagaagatgctgaacaagaagcactgcatcgccgtgatcgacagcaaccccggccaggaggagagcgaccccagatacaagagaaacatctgcagcgtgaagtacagcgtgaagaagatcaaccacaccgccagcgagaacgaggagttcaacaagggcgagagcaccagccagaaggtggccgacagaaccaagagcgagaacggcctgcagaacgagagcctgagcagcacccaccacaccgacggcctgagcaagatcagactgaactacagcgacgagagccccgaggccggcaagatgctggaggacgagctggtggacttcagcgaggaccaggacaaccaggacgacagcagcgacgacggcttcctggccgacgacaactgcagcagcgagatcggccagtggcacctgaagcccaccatctgcaagcagccctgcatcctgctgatggacagcctgagaggccccagcagaagcaacgtggtgaagatcctgagagagtacctggaggtggagtgggaggtgaagaagggcagcaagagaagcttcagcaaggacgtgatgaagggcagcaaccccaaggtgccccagcagaacaacttcagcgactgcggcgtgtacgtgctgcagtacgtggagagcttcttcgagaaccccatcctgagcttcgagctgcccatgaacctggccaactggttccccccccccagaatgagaaccaagagagaggagatcagaaacatcatcctgaagctgcaggaggaccagagcaaggagaagagaaagcacaaggacacctacagcaccgaggcccccctgggcgagggcaccgagcagtacgtgaacagcatcagcgactag

SEQ ID NO: 101176 - DNA, 3339 bp, Artificial Sequence
  Description of Artificial Sequence: Synthetic coding sequence
atggccgccggcaagagcggcggcagcgccggcgagatcaccttcctggaggccctggccagaagcgagagcaagagagacggcggcttcaagaacaactggagcttcgaccacgaggaggagagcgagggcgacaccgacaaggacggcaccaacctgctgagcgtggacgaggacgaggacagcgagaccagcaagggcaagaagctgaacagaagaagcgagatcgtggccaacagcagcggcgagttcatcctgaagacctacgtgagaagaaacaagagcgagagcttcaagaccctgaagggcaaccccatcggcctgaacatgctgagcaacaacaagaagctgagcgagaacacccagaacaccagcctgtgcagcggcaccgtggtgcacggcagaagattccaccacgcccacgcccagatccccgtggtgaagaccgccgcccagagactgctgagcaaccagatcctgaaggagtaccccccccacgtgcagaaggtggagatcaaccccgtgagactgagcagactgcagggcgtggagagaatcatgaagaagaccgaggagagcgagagccaggtggagcccgagatcaagagaaaggtgcagcagaagagacactgcagcacctaccagcccaccccccccctgagccccgccagcaagaagtgcctgacccacctggaggacctgcagagaaactgcagacaggccatcaccctgaacgagagcaccggccccctgctgagaaccagcatccaccagaacagcggcggccagaagagccagaacaccggcctgaccaccaagaagttctacggcaacaacgtggagaaggtgcccatcgacatcatcgtgaactgcgacgacagcaagcacacctacctgcagaccaacggcaaggtgatcctgcccggcgccaagatccccaagatcaccaacctgaaggagagaaagaccagcctgagcgacctgaacgaccccatcatcctgagcagcgacgacgacgacgacaacgacagaaccaacagaagagagagcatcagcccccagcccgccgacagcgcctgcagcagccccgcccccagcaccggcaaggtggaggccgccctgaacgagaacacctgcagagccgagagagagctgagaagcatccccgaggacagcgagctgaacaccgtgaccctgcccagaaaggccagaatgaaggaccagttcggcaacagcatcatcaacacccccctgaagagaagaaaggtgttcagccaggagccccccgacgccctggccctgagctgccagagcagcttcgacagcgtgatcctgaactgcagaagcatcagagtgggcaccctgttcagactgctgatcgagcccgtgatcttctgcctggacttcatcaagatccagctggacgagcccgaccacgaccccgtggagatcatcctgaacaccagcgacctgaccaagtgcgagtggtgcaacgtgagaaagctgcccgtggtgttcctgcaggccatccccgccgtgtaccagaagctgagcatccagctgcagatgaacaaggaggacaaggtgtggaacgactgcaagggcgtgaacaagctgaccaacctggaggagcagtacatcatcctgatcttccagaacggcctggacccccccgccaacatggtgttcgagagcatcatcaacgagatcggcatcaagaacaacatcagcaacttcttcgccaagatccccttcgaggaggccaacggcagactggtggcctgcaccagaacctacgaggagagcatcaagggcagctgcggccagaaggagaacaagatcaagaccgtgagcttcgagagcaagatccagctgagaagcaagcaggagttccagttcttcgacgaggaggaggagaccggcgagaaccacaccatcttcatcggccccgtggagaagctgatcgtgtacccccccccccccgccaagggcggcatcagcgtgaccaacgaggacctgcactgcctgaacgagggcgagttcctgaacgacgtgatcatcgacttctacctgaagtacctggtgctggagaagctgaagaaggaggacgccgacagaatccacatcttcagcagcttcttctacaagagactgaaccagagagagagaagaaaccacgagaccaccaacctgagcatccagcagaagagacacggcagagtgaagacctggaccagacacgtggacatcttcgagaaggacttcatcttcgtgcccctgaacgaggccgcccactggttcctggccgtggtgtgcttccccggcctggagaagcccaagtacgagcccaacccccactaccacgagaacgccgtgatccagaagtgcagcaccgtggaggacagctgcatcagcagcagcgccagcgagatggagagctgcagccagaacagcagcgccaagcccgtgatcaagaagatgctgaacaagaagcactgcatcgccgtgatcgacagcaaccccggccaggaggagagcgaccccagatacaagagaaacatctgcagcgtgaagtacagcgtgaagaagatcaaccacaccgccagcgagaacgaggagttcaacaagggcgagagcaccagccagaaggtggccgacagaaccaagagcgagaacggcctgcagaacgagagcctgagcagcacccaccacaccgacggcctgagcaagatcagactgaactacagcgacgagagccccgaggccggcaagatgctggaggacgagctggtggacttcagcgaggaccaggacaaccaggacgacagcagcgacgacggcttcctggccgacgacaactgcagcagcgagatcggccagtggcacctgaagcccaccatctgcaagcagccctgcatcctgctgatggacagcctgagaggccccagcagaagcaacgtggtgaagatcctgagagagtacctggaggtggagtgggaggtgaagaagggcagcaagagaagcttcagcaaggacgtgatgaagggcagcaaccccaaggtgccccagcagaacaacttcagcgactgcggcgtgtacgtgctgcagtacgtggagagcttcttcgagaaccccatcctgagcttcgagctgcccatgaacctggccaactggttccccccccccagaatgagaaccaagagagaggagatcagaaacatcatcctgaagctgcaggaggaccagagcaaggagaagagaaagcacaaggacacctacagcaccgaggcccccctgggcgagggcaccgagcagtacgtgaacagcatcagcgactag

SEQ ID NO: 101177 - DNA, 3339 bp, Artificial Sequence
  Description of Artificial Sequence: Synthetic coding sequence
atggccgccggcaagagcggcggcagcgccggcgagatcaccttcctggaggccctggccagaagcgagagcaagagagacggcggcttcaagaacaactggagcttcgaccacgaggaggagagcgagggcgacaccgacaaggacggcaccaacctgctgagcgtggacgaggacgaggacagcgagaccagcaagggcaagaagctgaacagaagaagcgagatcgtggccaacagcagcggcgagttcatcctgaagacctacgtgagaagaaacaagagcgagagcttcaagaccctgaagggcaaccccatcggcctgaacatgctgagcaacaacaagaagctgagcgagaacacccagaacaccagcctgtgcagcggcaccgtggtgcacggcagaagattccaccacgcccacgcccagatccccgtggtgaagaccgccgcccagagcagcctggacagaaaggagagaaaggagtaccccccccacgtgcagaaggtggagatcaaccccgtgagactgagcagactgcagggcgtggagagaatcatgaagaagaccgaggagagcgagagccaggtggagcccgagatcaagagaaaggtgcagcagaagagacactgcagcacctaccagcccaccccccccctgagccccgccagcaagaagtgcctgacccacctggaggacctgcagagaaactgcagacaggccatcaccctgaacgagagcaccggccccctgctgagaaccagcatccaccagaacagcggcggccagaagagccagaacaccggcctgaccaccaagaagttctacggcaacaacgtggagaaggtgcccatcgacatcatcgtgaactgcgacgacagcaagcacacctacctgcagaccaacggcaaggtgatcctgcccggcgccaagatccccaagatcaccaacctgaaggagagaaagaccagcctgagcgacctgaacgaccccatcatcctgagcagcgacgacgacgacgacaacgacagaaccaacagaagagagagcatcagcccccagcccgccgacagcgcctgcagcagccccgcccccagcaccggcaaggtggaggccgccctgaacgagaacacctgcagagccgagagagagctgagaagcatccccgaggacagcgagctgaacaccgtgaccctgcccagaaaggccagaatgaaggaccagttcggcaacagcatcatcaacacccccctgaagagaagaaaggtgttcagccaggagccccccgacgccctggccctgagctgccagagcagcttcgacagcgtgatcctgaactgcagaagcatcagagtgggcaccctgttcagactgctgatcgagcccgtgatcttctgcctggacttcatcaagatccagctggacgagcccgaccacgaccccgtggagatcatcctgaacaccagcgacctgaccaagtgcgagtggtgcaacgtgagaaagctgcccgtggtgttcctgcaggccatccccgccgtgtaccagaagctgagcatccagctgcagatgaacaaggaggacaaggtgtggaacgactgcaagggcgtgaacaagctgaccaacctggaggagcagtacatcatcctgatcttccagaacggcctggacccccccgccaacatggtgttcgagagcatcatcaacgagatcggcatcaagaacaacatcagcaacttcttcgccaagatccccttcgaggaggccaacggcagactggtggcctgcaccagaacctacgaggagagcatcaagggcagctgcggccagaaggagaacaagatcaagaccgtgagcttcgagagcaagatccagctgagaagcaagcaggagttccagttcttcgacgaggaggaggagaccggcgagaaccacaccatcttcatcggccccgtggagaagctgatcgtgtacccccccccccccgccaagggcggcatcagcgtgaccaacgaggacctgcactgcctgaacgagggcgagttcctgaacgacgtgatcatcgacttctacctgaagtacctggtgctggagaagctgaagaaggaggacgccgacagaatccacatcttcagcagcttcttctacaagagactgaaccagagagagagaagaaaccacgagaccaccaacctgagcatccagcagaagagacacggcagagtgaagacctggaccagacacgtggacatcttcgagaaggacttcatcttcgtgcccctgaacgaggccgcccactggttcctggccgtggtgtgcttccccggcctggagaagcccaagtacgagcccaacccccactaccacgagaacgccgtgatccagaagtgcagcaccgtggaggacagctgcatcagcagcagcgccagcgagatggagagctgcagccagaacagcagcgccaagcccgtgatcaagaagatgctgaacaagaagcactgcatcgccgtgatcgacagcaaccccggccaggaggagagcgaccccagatacaagagaaacatctgcagcgtgaagtacagcgtgaagaagatcaaccacaccgccagcgagaacgaggagttcaacaagggcgagagcaccagccagaaggtggccgacagaaccaagagcgagaacggcctgcagaacgagagcctgagcagcacccaccacaccgacggcctgagcaagatcagactgaactacagcgacgagagccccgaggccggcaagatgctggaggacgagctggtggacttcagcgaggaccaggacaaccaggacgacagcagcgacgacggcttcctggccgacgacaactgcagcagcgagatcggccagtggcacctgaagcccaccatctgcaagcagccctgcatcctgctgatggacagcctgagaggccccagcagaagcaacgtggtgaagatcctgagagagtacctggaggtggagtgggaggtgaagaagggcagcaagagaagcttcagcaaggacgtgatgaagggcagcaaccccaaggtgccccagcagaacaacttcagcgactgcggcgtgtacgtgctgcagtacgtggagagcttcttcgagaaccccatcctgagcttcgagctgcccatgaacctggccaactggttccccccccccagaatgagaaccaagagagaggagatcagaaacatcatcctgaagctgcaggaggaccagagcaaggagaagagaaagcacaaggacacctacagcaccgaggcccccctgggcgagggcaccgagcagtacgtgaacagcatcagcgactag

SEQ ID NO: 101178 - DNA, 1074 bp, Artificial Sequence
  Description of Artificial Sequence: Synthetic coding sequence
atggccgccggcaagagcggcggcagcgccggcgagatcaccttcctggaggccctggccagaagcgagagcaagagagacggcggcttcaagaacaactggagcttcgaccacgaggaggagagcgagggcgacaccgacaaggacggcaccaacctgctgagcgtggacgaggacgaggacagcgagaccagcaagggcaagaagctgaacagaagaagcgagatcgtggccaacagcagcggcgagttcatcctgaagacctacgtgagaagaaacaagagcgagagcttcaagaccctgaagggcaaccccatcggcctgaacatgctgagcaacaacaagaagctgagcgagaacacccagaacaccagcctgtgcagcggcaccgtggtgcacggcagaagattccaccacgcccacgcccagatccccgtggtgaagaccgccgcccagagcaaccagatcctgaaggagtaccccccccacgtgcagaaggtggagatcaaccccgtgagactgagcagactgcagggcgtggtgatcctgagcagcgacgacgacgacgacaacgacagaaccaacagaagagagagcatcagcccccagcccgccgacagcgcctgcagcagccccgcccccagcaccggcaaggtggaggccgccctgaacgagaacacctgcagagccgagagagagctgagaagcatccccgaggacagcgagctgaacaccgtgaccctgcccagaaaggccagaatgaaggaccagttcggcaacagcatcatcaacacccccctgaagagaagaaaggtgttcagccaggagccccccgacgccctggccctgagctgccagagcagcttcgacagcgtgatcctgaactgcagaagcatcagagtgggcaccctgttcagactgctgatcgagcccgtgatcgtgatcatcaagatcttcttcatcacccacaagaagcccgaccacgaccccgtggagatcatcctgaacaccagcgacctgaccaagtgcgagtggtgcaacgtgagaaagctgcccgtggtgttcctgcagtag

SEQ ID NO: 101179 - DNA, 1107 bp, Artificial Sequence
  Description of Artificial Sequence: Synthetic coding sequence
atgaaggaccagttcggcaacagcatcatcaacacccccctgaagagaagaaaggtgttcagccaggagccccccgacgccctggccctgagctgccagagcagcttcgacagcgtgatcctgaactgcagaagcatcagagtgggcaccctgttcagactgctgatcgagcccgtgatcttctgcctggacttcatcaagatccagctggacgagcccgaccacgaccccgtggagatcatcctgaacaccagcgacctgaccaagtgcgagtggtgcaacgtgagaaagctgcccgtggtgttcctgcaggccatccccgccgtgtaccagaagctgagcatccagctgcagatgaacaaggaggacaaggtgtggaacgactgcaagggcgtgaacaagctgaccaacctggaggagcagtacatcatcctgatcttccagaacggcctggacccccccgccaacatggtgttcgagagcatcatcaacgagatcggcatcaagaacaacatcagcaacttcttcgccaagatccccttcgaggaggccaacggcagactggtggcctgcaccagaacctacgaggagagcatcaagggcagctgcggccagaaggagaacaagatcaagaccgtgagcttcgagagcaagatccagctgagaagcaagcaggagttccagttcttcgacgaggaggaggagaccggcgagaaccacaccatcttcatcggccccgtggagaagctgatcgtgtacccccccccccccgccaagggcggcatcagcgtgaccaacgaggacctgcactgcctgaacgagggcgagttcctgaacgacgtgatcatcgacttctacctgaagtacctggtgctggagaagctgaagaaggaggacgccgacagaatccacatcttcagcagcttcttctacaagagactgaaccagagagagagaagaaaccacgagaccaccaacctgagcatccagcagaagagacacggcagagtgaagacctggaccagacacgtggacatcttcgagaaggacttcatcttcgtgcccctgaacgaggcctggctgaagcagaaccagaccaagctgtag

SEQ ID NO: 101180 - DNA, 2955 bp, Artificial Sequence
  Description of Artificial Sequence: Synthetic coding sequence
atggacaagagaaagctgggcagaagacccagcagcagcgagatcatcaccgagggcaagagaaagaagagcagcagcgacctgagcgagatcagaaagatgctgaacgccaagcccgaggacgtgcacgtgcagagccccctgagcaagttcagaagcagcgagagatggaccctgcccctgcagtgggagagaagcctgagaaacaaggtgatcagcctggaccacaagaacaagaagcacatcagaggctgccccgtgaccagcaagagcagccccgagagaatccccagagtgatcctgaccaacgtgctgggcaccgagctgggcagaaagtacatcagaaccccccccgtgaccgagggcagcctgagcgacaccgacaacctgcagagcgagcagctgagcagcagcagcgacggcagcctggagagctaccagaacctgaacccccacaagagctgctacctgagcgagagaggcagccagagaagcaagaccgtggacgacaacagcgccaagcagaccgcccacaacaaggagaagagaagaaaggacgacggcatcagcctgctgatcagcgacacccagcccgaggacctgaacagcggcagcagaggctgcgaccacctggagcaggagagcagaaacaaggacgtgaagtacagcgacagcaaggtggagctgaccctgatcagcagaaagaccaagagaagactgagaaacaacctgcccgacagccagtactgcaccagcctggacaagagcaccgagcagaccaagaagcaggaggacgacagcaccatcagcaccgagttcgagaagcccagcgagaactaccaccaggaccccaagctgcccgaggagatcaccaccaagcccaccaagagcgacttcaccaagctgagcagcctgaacagccaggagctgaccctgagcaacgccaccaagagcgccagcgccggcagcaccaccgagaccgtggagaacagcaacagcatcgacatcgtgggcatcagcagcctggtggagaaggacgagaacgagctgaacaccatcgagaagcccatcctgagaggccacaacgagggcaaccagagcctgatcagcgccgagcccatcgtggtgagcagcgacgaggagggccccgtggagcacaagagcagcgagatcctgaagctgcagagcaagcaggacagagagaccaccaacgagaacgagagcaccagcgagagcgccctgctggagctgcccctgatcacctgcgagagcgtgcagatgagcagcgagctgtgcccctacaaccccgtgatggagaacatcagcagcatcatgcccagcaacgagatggacctgcagctggacttcatcttcaccagcgtgtacatcggcaagatcaagggcgccagcaagggctgcgtgaccatcaccaagaagtacatcaagatccccttccaggtgagcctgaacgagatcagcctgctggtggacaccacccacctgaagagattcggcctgtggaagagcaaggacgacaaccacagcaagagaagccacgccatcctgttcttctgggtgagcagcgactacctgcaggagatccagacccagctggagcacagcgtgctgagccagcagagcaagagcagcgagttcatcttcctggagctgcacaaccccgtgagccagagagaggagctgaagctgaaggacatcatgaccgagatcagcatcatcagcggcgagctggagctgagctaccccctgagctgggtgcaggccttccccctgttccagaacctgagcagcaaggagagcagcttcatccactactactgcgtgagcacctgcagcttccccgccggcgtggccgtggccgaggagatgaagctgaagagcgtgagccagcccagcaacaccgacgccgccaagcccacctacaccttcctgcagaagcagagcagcggctgctacagcctgagcatcaccagcaaccccgacgaggagtggagagaggtgagacacaccggcctggtgcagaagctgatcgtgtacccccccccccccaccaagggcggcctgggcgtgaccaacgaggacctggagtgcctggaggagggcgagttcctgaacgacgtgatcatcgacttctacctgaagtacctgatcctggagaaggccagcgacgagctggtggagagaagccacatcttcagcagcttcttctacaagtgcctgaccagaaaggagaacaacctgaccgaggacaaccccaacctgagcatggcccagagaagacacaagagagtgagaacctggaccagacacatcaacatcttcaacaaggactacatcttcgtgcccgtgaacgagagcagccactggtacctggccgtgatctgcttcccctggctggaggaggccgtgtacgaggacttcccccagaccgtgagccagcagagccaggcccagcagagccagaacgacaacaagaccatcgacaacgacctgagaaccaccagcaccctgagcctgagcgccgaggacagccagagcaccgagagcaacatgagcgtgcccaagaagatgtgcaagagaccctgcatcctgatcctggacagcctgaaggccgccagcgtgcagaacaccgtgcagaacctgagagagtacctggaggtggagtgggaggtgaagctgaagacccacagacagttcagcaagaccaacatggtggacctgtgccccaaggtgcccaagcaggacaacagcagcgactgcggcgtgtacctgctgcagtacgtggagagcttcttcaaggaccccatcgtgaacttcgagctgcccatccacctggagaagtggttccccagacacgtgatcaagaccaagagagaggacatcagagagctgatcctgaagctgcacctgcagcagcagaagggcagcagcagctag

SEQ ID NO: 101181 - DNA, 3054 bp, Artificial Sequence
  Description of Artificial Sequence: Synthetic coding sequence
atgctgaacgccaagcccgaggacgtgcacgtgcagagccccctgagcaagttcagaagcagcgagagatggaccctgcccctgcagtgggagagaagcctgagaaacaaggtgatcagcctggaccacaagaacaagaagcacatcagaggctgccccgtgaccagcaagagcagccccgagagacagctgaaggtgatgctgaccaacgtgctgtggaccgacctgggcagaaagttcagaaagaccctgcccagaaacgacgccaacctgtgcgacgccaacaaggtgcagagcgacagcctgcccagcaccagcgtggacagcctggagacctgccagaagctggagcccctgagacagagcctgaacctgagcgagagaatccccagagtgatcctgaccaacgtgctgggcaccgagctgggcagaaagtacatcagaaccccccccgtgaccgagggcagcctgagcgacaccgacaacctgcagagcgagcagctgagcagcagcagcgacggcagcctggagagctaccagaacctgaacccccacaagagctgctacctgagcgagagaggcagccagagaagcaagaccgtggacgacaacagcgccaagcagaccgcccacaacaaggagaagagaagaaaggacgacggcatcagcctgctgatcagcgacacccagcccgaggacctgaacagcggcagcagaggctgcgaccacctggagcaggagagcagaaacaaggacgtgaagtacagcgacagcaaggtggagctgaccctgatcagcagaaagaccaagagaagactgagaaacaacctgcccgacagccagtactgcaccagcctggacaagagcaccgagcagaccaagaagcaggaggacgacagcaccatcagcaccgagttcgagaagcccagcgagaactaccaccaggaccccaagctgcccgaggagatcaccaccaagcccaccaagagcgacttcaccaagctgagcagcctgaacagccaggagctgaccctgagcaacgccaccaagagcgccagcgccggcagcaccaccgagaccgtggagaacagcaacagcatcgacatcgtgggcatcagcagcctggtggagaaggacgagaacgagctgaacaccatcgagaagcccatcctgagaggccacaacgagggcaaccagagcctgatcagcgccgagcccatcgtggtgagcagcgacgaggagggccccgtggagcacaagagcagcgagatcctgaagctgcagagcaagcaggacagagagaccaccaacgagaacgagagcaccagcgagagcgccctgctggagctgcccctgatcacctgcgagagcgtgcagatgagcagcgagctgtgcccctacaaccccgtgatggagaacatcagcagcatcatgcccagcaacgagatggacctgcagctggacttcatcttcaccagcgtgtacatcggcaagatcaagggcgccagcaagggctgcgtgaccatcaccaagaagtacatcaagatccccttccaggtgagcctgaacgagatcagcctgctggtggacaccacccacctgaagagattcggcctgtggaagagcaaggacgacaaccacagcaagagaagccacgccatcctgttcttctgggtgagcagcgactacctgcaggagatccagacccagctggagcacagcgtgctgagccagcagagcaagagcagcgagttcatcttcctggagctgcacaaccccgtgagccagagagaggagctgaagctgaaggacatcatgaccgagatcagcatcatcagcggcgagctggagctgagctaccccctgagctgggtgcaggccttccccctgttccagaacctgagcagcaaggagagcagcttcatccactactactgcgtgagcacctgcagcttccccgccggcgtggccgtggccgaggagatgaagctgaagagcgtgagccagcccagcaacaccgacgccgccaagcccacctacaccttcctgcagaagcagagcagcggctgctacagcctgagcatcaccagcaaccccgacgaggagtggagagaggtgagacacaccggcctggtgcagaagctgatcgtgtacccccccccccccaccaagggcggcctgggcgtgaccaacgaggacctggagtgcctggaggagggcgagttcctgaacgacgtgatcatcgacttctacctgaagtacctgatcctggagaaggccagcgacgagctggtggagagaagccacatcttcagcagcttcttctacaagtgcctgaccagaaaggagaacaacctgaccgaggacaaccccaacctgagcatggcccagagaagacacaagagagtgagaacctggaccagacacatcaacatcttcaacaaggactacatcttcgtgcccgtgaacgagagcagccactggtacctggccgtgatctgcttcccctggctggaggaggccgtgtacgaggacttcccccagaccgtgagccagcagagccaggcccagcagagccagaacgacaacaagaccatcgacaacgacctgagaaccaccagcaccctgagcctgagcgccgaggacagccagagcaccgagagcaacatgagcgtgcccaagaagatgtgcaagagaccctgcatcctgatcctggacagcctgaaggccgccagcgtgcagaacaccgtgcagaacctgagagagtacctggaggtggagtgggaggtgaagctgaagacccacagacagttcagcaagaccaacatggtggacctgtgccccaaggtgcccaagcaggacaacagcagcgactgcggcgtgtacctgctgcagtacgtggagagcttcttcaaggaccccatcgtgaacttcgagctgcccatccacctggagaagtggttccccagacacgtgatcaagaccaagagagaggacatcagagagctgatcctgaagctgcacctgcagcagcagaagggcagcagcagctag

SEQ ID NO: 101182 - DNA, 2661 bp, Artificial Sequence
  Description of Artificial Sequence: Synthetic coding sequence
atgctgaacgccaagcccgaggacgtgcacgtgcagagccccctgagcaagttcagaagcagcgagagatggaccctgcccctgcagtgggagagaagcctgagaaacaaggtgatcagcctggaccacaagaacaagaagcacatcagaggctgccccgtgaccagcaagagcagccccgagagaggcagccagagaagcaagaccgtggacgacaacagcgccaagcagaccgcccacaacaaggagaagagaagaaaggacgacggcatcagcctgctgatcagcgacacccagcccgaggacctgaacagcggcagcagaggctgcgaccacctggagcaggagagcagaaacaaggacgtgaagtacagcgacagcaaggtggagctgaccctgatcagcagaaagaccaagagaagactgagaaacaacctgcccgacagccagtactgcaccagcctggacaagagcaccgagcagaccaagaagcaggaggacgacagcaccatcagcaccgagttcgagaagcccagcgagaactaccaccaggaccccaagctgcccgaggagatcaccaccaagcccaccaagagcgacttcaccaagctgagcagcctgaacagccaggagctgaccctgagcaacgccaccaagagcgccagcgccggcagcaccaccgagaccgtggagaacagcaacagcatcgacatcgtgggcatcagcagcctggtggagaaggacgagaacgagctgaacaccatcgagaagcccatcctgagaggccacaacgagggcaaccagagcctgatcagcgccgagcccatcgtggtgagcagcgacgaggagggccccgtggagcacaagagcagcgagatcctgaagctgcagagcaagcaggacagagagaccaccaacgagaacgagagcaccagcgagagcgccctgctggagctgcccctgatcacctgcgagagcgtgcagatgagcagcgagctgtgcccctacaaccccgtgatggagaacatcagcagcatcatgcccagcaacgagatggacctgcagctggacttcatcttcaccagcgtgtacatcggcaagatcaagggcgccagcaagggctgcgtgaccatcaccaagaagtacatcaagatccccttccaggtgagcctgaacgagatcagcctgctggtggacaccacccacctgaagagattcggcctgtggaagagcaaggacgacaaccacagcaagagaagccacgccatcctgttcttctgggtgagcagcgactacctgcaggagatccagacccagctggagcacagcgtgctgagccagcagagcaagagcagcgagttcatcttcctggagctgcacaaccccgtgagccagagagaggagctgaagctgaaggacatcatgaccgagatcagcatcatcagcggcgagctggagctgagctaccccctgagctgggtgcaggccttccccctgttccagaacctgagcagcaaggagagcagcttcatccactactactgcgtgagcacctgcagcttccccgccggcgtggccgtggccgaggagatgaagctgaagagcgtgagccagcccagcaacaccgacgccgccaagcccacctacaccttcctgcagaagcagagcagcggctgctacagcctgagcatcaccagcaaccccgacgaggagtggagagaggtgagacacaccggcctggtgcagaagctgatcgtgtacccccccccccccaccaagggcggcctgggcgtgaccaacgaggacctggagtgcctggaggagggcgagttcctgaacgacgtgatcatcgacttctacctgaagtacctgatcctggagaaggccagcgacgagctggtggagagaagccacatcttcagcagcttcttctacaagtgcctgaccagaaaggagaacaacctgaccgaggacaaccccaacctgagcatggcccagagaagacacaagagagtgagaacctggaccagacacatcaacatcttcaacaaggactacatcttcgtgcccgtgaacgagagcagccactggtacctggccgtgatctgcttcccctggctggaggaggccgtgtacgaggacttcccccagaccgtgagccagcagagccaggcccagcagagccagaacgacaacaagaccatcgacaacgacctgagaaccaccagcaccctgagcctgagcgccgaggacagccagagcaccgagagcaacatgagcgtgcccaagaagatgtgcaagagaccctgcatcctgatcctggacagcctgaaggccgccagcgtgcagaacaccgtgcagaacctgagagagtacctggaggtggagtgggaggtgaagctgaagacccacagacagttcagcaagaccaacatggtggacctgtgccccaaggtgcccaagcaggacaacagcagcgactgcggcgtgtacctgctgcagtacgtggagagcttcttcaaggaccccatcgtgaacttcgagctgcccatccacctggagaagtggttccccagacacgtgatcaagaccaagagagaggacatcagagagctgatcctgaagctgcacctgcagcagcagaagggcagcagcagctag

SEQ ID NO: 101183 - DNA, 717 bp, Artificial Sequence
  Description of Artificial Sequence: Synthetic coding sequence
atgaagaagttcctgtacatcaagagcgtgttccacaccctgagaatggcccagagaagacacaagagagtgagaacctggaccagacacatcaacatcttcaacaaggactacatcttcgtgcccgtgaacgagagcagccactggtacctggccgtgatctgcttcccctggctggaggaggccgtgtacgaggacttcccccagaccgtgagccagcagagccaggcccagcagagccagaacgacaacaagaccatcgacaacgacctgagaaccaccagcaccctgagcctgagcgccgaggacagccagagcaccgagagcaacatgagcgtgcccaagaagatgtgcaagagaccctgcatcctgatcctggacagcctgaaggccgccagcgtgcagaacaccgtgcagaacctgagagagtacctggaggtggagtgggaggtgaagctgaagacccacagacagttcagcaagaccaacatggtggacctgtgccccaaggtgcccaagcaggacaacagcagcgactgcggcgtgtacctgctgcagtacgtggagagcttcttcaaggaccccatcgtgaacttcgagctgcccatccacctggagaagtggttccccagacacgtgatcaagaccaagagagaggacatcagagagctgatcctgaagctgcacctgcagcagcagaagggcagcagcagctag

SEQ ID NO: 101184 - DNA, 2958 bp, Artificial Sequence
  Description of Artificial Sequence: Synthetic coding sequence
atggacaagagaaagctgggcagaagacccagcagcagcgagatcatcaccgagggcaagagaaagaagagcagcagcgacctgagcgagatcagaaagatgctgaacgccaagcccgaggacgtgcacgtgcagagccccctgagcaagttcagaagcagcgagagatggaccctgcccctgcagtgggagagaagcctgagaaacaaggtgatcagcctggaccacaagaacaagaagcacatcagaggctgccccgtgaccagcaagagcagccccgagagacagctgaaggtgatgctgaccaacgtgctgtggaccgacctgggcagaaagttcagaaagaccctgcccagaaacgacgccaacctgtgcgacgccaacaaggtgcagagcgacagcctgcccagcaccagcgtggacagcctggagacctgccagaagctggagcccctgagacagagcctgaacctgagcgagagaggcagccagagaagcaagaccgtggacgacaacagcgccaagcagaccgcccacaacaaggagaagagaagaaaggacgacggcatcagcctgctgatcagcgacacccagcccgaggacctgaacagcggcagcagaggctgcgaccacctggagcaggagagcagaaacaaggacgtgaagtacagcgacagcaaggtggagctgaccctgatcagcagaaagaccaagagaagactgagaaacaacctgcccgacagccagtactgcaccagcctggacaagagcaccgagcagaccaagaagcaggaggacgacagcaccatcagcaccgagttcgagaagcccagcgagaactaccaccaggaccccaagctgcccgaggagatcaccaccaagcccaccaagagcgacttcaccaagctgagcagcctgaacagccaggagctgaccctgagcaacgccaccaagagcgccagcgccggcagcaccaccgagaccgtggagaacagcaacagcatcgacatcgtgggcatcagcagcctggtggagaaggacgagaacgagctgaacaccatcgagaagcccatcctgagaggccacaacgagggcaaccagagcctgatcagcgccgagcccatcgtggtgagcagcgacgaggagggccccgtggagcacaagagcagcgagatcctgaagctgcagagcaagcaggacagagagaccaccaacgagaacgagagcaccagcgagagcgccctgctggagctgcccctgatcacctgcgagagcgtgcagatgagcagcgagctgtgcccctacaaccccgtgatggagaacatcagcagcatcatgcccagcaacgagatggacctgcagctggacttcatcttcaccagcgtgtacatcggcaagatcaagggcgccagcaagggctgcgtgaccatcaccaagaagtacatcaagatccccttccaggtgagcctgaacgagatcagcctgctggtggacaccacccacctgaagagattcggcctgtggaagagcaaggacgacaaccacagcaagagaagccacgccatcctgttcttctgggtgagcagcgactacctgcaggagatccagacccagctggagcacagcgtgctgagccagcagagcaagagcagcgagttcatcttcctggagctgcacaaccccgtgagccagagagaggagctgaagctgaaggacatcatgaccgagatcagcatcatcagcggcgagctggagctgagctaccccctgagctgggtgcaggccttccccctgttccagaacctgagcagcaaggagagcagcttcatccactactactgcgtgagcacctgcagcttccccgccggcgtggccgtggccgaggagatgaagctgaagagcgtgagccagcccagcaacaccgacgccgccaagcccacctacaccttcctgcagaagcagagcagcggctgctacagcctgagcatcaccagcaaccccgacgaggagtggagagaggtgagacacaccggcctggtgcagaagctgatcgtgtacccccccccccccaccaagggcggcctgggcgtgaccaacgaggacctggagtgcctggaggagggcgagttcctgaacgacgtgatcatcgacttctacctgaagtacctgatcctggagaaggccagcgacgagctggtggagagaagccacatcttcagcagcttcttctacaagtgcctgaccagaaaggagaacaacctgaccgaggacaaccccaacctgagcatggcccagagaagacacaagagagtgagaacctggaccagacacatcaacatcttcaacaaggactacatcttcgtgcccgtgaacgagagcagccactggtacctggccgtgatctgcttcccctggctggaggaggccgtgtacgaggacttcccccagaccgtgagccagcagagccaggcccagcagagccagaacgacaacaagaccatcgacaacgacctgagaaccaccagcaccctgagcctgagcgccgaggacagccagagcaccgagagcaacatgagcgtgcccaagaagatgtgcaagagaccctgcatcctgatcctggacagcctgaaggccgccagcgtgcagaacaccgtgcagaacctgagagagtacctggaggtggagtgggaggtgaagctgaagacccacagacagttcagcaagaccaacatggtggacctgtgccccaaggtgcccaagcaggacaacagcagcgactgcggcgtgtacctgctgcagtacgtggagagcttcttcaaggaccccatcgtgaacttcgagctgcccatccacctggagaagtggttccccagacacgtgatcaagaccaagagagaggacatcagagagctgatcctgaagctgcacctgcagcagcagaagggcagcagcagctag

SEQ ID NO: 101185 - DNA, 3153 bp, Artificial Sequence
  Description of Artificial Sequence: Synthetic coding sequence
atggacaagagaaagctgggcagaagacccagcagcagcgagatcatcaccgagggcaagagaaagaagagcagcagcgacctgagcgagatcagaaagatgctgaacgccaagcccgaggacgtgcacgtgcagagccccctgagcaagttcagaagcagcgagagatggaccctgcccctgcagtgggagagaagcctgagaaacaaggtgatcagcctggaccacaagaacaagaagcacatcagaggctgccccgtgaccagcaagagcagccccgagagacagctgaaggtgatgctgaccaacgtgctgtggaccgacctgggcagaaagttcagaaagaccctgcccagaaacgacgccaacctgtgcgacgccaacaaggtgcagagcgacagcctgcccagcaccagcgtggacagcctggagacctgccagaagctggagcccctgagacagagcctgaacctgagcgagagaatccccagagtgatcctgaccaacgtgctgggcaccgagctgggcagaaagtacatcagaaccccccccgtgaccgagggcagcctgagcgacaccgacaacctgcagagcgagcagctgagcagcagcagcgacggcagcctggagagctaccagaacctgaacccccacaagagctgctacctgagcgagagaggcagccagagaagcaagaccgtggacgacaacagcgccaagcagaccgcccacaacaaggagaagagaagaaaggacgacggcatcagcctgctgatcagcgacacccagcccgaggacctgaacagcggcagcagaggctgcgaccacctggagcaggagagcagaaacaaggacgtgaagtacagcgacagcaaggtggagctgaccctgatcagcagaaagaccaagagaagactgagaaacaacctgcccgacagccagtactgcaccagcctggacaagagcaccgagcagaccaagaagcaggaggacgacagcaccatcagcaccgagttcgagaagcccagcgagaactaccaccaggaccccaagctgcccgaggagatcaccaccaagcccaccaagagcgacttcaccaagctgagcagcctgaacagccaggagctgaccctgagcaacgccaccaagagcgccagcgccggcagcaccaccgagaccgtggagaacagcaacagcatcgacatcgtgggcatcagcagcctggtggagaaggacgagaacgagctgaacaccatcgagaagcccatcctgagaggccacaacgagggcaaccagagcctgatcagcgccgagcccatcgtggtgagcagcgacgaggagggccccgtggagcacaagagcagcgagatcctgaagctgcagagcaagcaggacagagagaccaccaacgagaacgagagcaccagcgagagcgccctgctggagctgcccctgatcacctgcgagagcgtgcagatgagcagcgagctgtgcccctacaaccccgtgatggagaacatcagcagcatcatgcccagcaacgagatggacctgcagctggacttcatcttcaccagcgtgtacatcggcaagatcaagggcgccagcaagggctgcgtgaccatcaccaagaagtacatcaagatccccttccaggtgagcctgaacgagatcagcctgctggtggacaccacccacctgaagagattcggcctgtggaagagcaaggacgacaaccacagcaagagaagccacgccatcctgttcttctgggtgagcagcgactacctgcaggagatccagacccagctggagcacagcgtgctgagccagcagagcaagagcagcgagttcatcttcctggagctgcacaaccccgtgagccagagagaggagctgaagctgaaggacatcatgaccgagatcagcatcatcagcggcgagctggagctgagctaccccctgagctgggtgcaggccttccccctgttccagaacctgagcagcaaggagagcagcttcatccactactactgcgtgagcacctgcagcttccccgccggcgtggccgtggccgaggagatgaagctgaagagcgtgagccagcccagcaacaccgacgccgccaagcccacctacaccttcctgcagaagcagagcagcggctgctacagcctgagcatcaccagcaaccccgacgaggagtggagagaggtgagacacaccggcctggtgcagaagctgatcgtgtacccccccccccccaccaagggcggcctgggcgtgaccaacgaggacctggagtgcctggaggagggcgagttcctgaacgacgtgatcatcgacttctacctgaagtacctgatcctggagaaggccagcgacgagctggtggagagaagccacatcttcagcagcttcttctacaagtgcctgaccagaaaggagaacaacctgaccgaggacaaccccaacctgagcatggcccagagaagacacaagagagtgagaacctggaccagacacatcaacatcttcaacaaggactacatcttcgtgcccgtgaacgagagcagccactggtacctggccgtgatctgcttcccctggctggaggaggccgtgtacgaggacttcccccagaccgtgagccagcagagccaggcccagcagagccagaacgacaacaagaccatcgacaacgacctgagaaccaccagcaccctgagcctgagcgccgaggacagccagagcaccgagagcaacatgagcgtgcccaagaagatgtgcaagagaccctgcatcctgatcctggacagcctgaaggccgccagcgtgcagaacaccgtgcagaacctgagagagtacctggaggtggagtgggaggtgaagctgaagacccacagacagttcagcaagaccaacatggtggacctgtgccccaaggtgcccaagcaggacaacagcagcgactgcggcgtgtacctgctgcagtacgtggagagcttcttcaaggaccccatcgtgaacttcgagctgcccatccacctggagaagtggttccccagacacgtgatcaagaccaagagagaggacatcagagagctgatcctgaagctgcacctgcagcagcagaagggcagcagcagctag

SEQ ID NO: 101186 - DNA, 1770 bp, Artificial Sequence
  Description of Artificial Sequence: Synthetic coding sequence
atgtacagatggctggtgagaatcctgggcaccatcttcagattctgcgacagaagcgtgccccccgccagagccctgctgaagagaagaagaagcgacagcaccctgttcagcaccgtggacaccgacgagatccccgccaagagacccagactggactgcttcatccaccaggtgaagaacagcctgtacaacgccgccagcctgttcggcttccccttccagctgaccaccaagcccatggtgaccagcgcctgcaacggcaccagaaacgtggcccccagcggcgaggtgttcagcaacagcagcagctgcgagctgaccggcagcggcagctggaacaacatgctgaagctgggcaacaagagccccaacggcatcagcgactaccccaagatcagagtgaccgtgaccagagaccagcccagaagagtgctgcccagcttcggcttcaccctgaacagcgagggctgcaacagaagacccggcggcagaagacacagcaagggcaaccccgagagcagcctgatgtggaagccccaggagcaggccgtgaccgagatgatcagcgaggagagcggcaagggcctgagaagaccccactgcaccgtggaggagggcgtgcagaaggaggagagagagaagtacagaaagctgctggagagactgaaggagagcggccacggcaacagcgtgtgccccgtgaccagcaactaccacagcagccagagaagccagatggacaccctgaagaccaagggctggggcgaggagcagaaccacggcgtgaagaccacccagttcgtgcccaagcagtacagactggtggagaccagaggccccctgtgcagcctgagaagcgagaagagatgcagcaagggcaagatcaccgacaccgagaccatggtgggcatcagattcgagaacgagagcagaagaggctaccagctggagcccgacctgagcgaggaggtgagcgccagactgagactgggcagcggcagcaacggcctgctgagaagaaaggtgagcatcatcgagaccaaggagaagaactgcagcggcaaggagagagacagaagaaccgacgacctgctggagctgaccgaggacatggagaaggagatcagcaacgccctgggccacggcccccaggacgagatcctgagcagcgccttcaagctgagaatcaccagaggcgacatccagaccctgaagaactaccactggctgaacgacgaggtgatcaacttctacatgaacctgctggtggagagaaacaagaagcagggctaccccgccctgcacgtgttcagcaccttcttctaccccaagctgaagagcggcggctaccaggccgtgaagagatggaccaagggcgtgaacctgttcgagcaggagatcatcctggtgcccatccacagaaaggtgcactggagcctggtggtgatcgacctgagaaagaagtgcctgaagtacctggacagcatgggccagaagggccacagaatctgcgagatcctgctgcagtacctgcaggacgagagcaagaccaagagaaacagcgacctgaacctgctggagtggacccaccacagcatgaagccccacgagatcccccagcagctgaacggcagcgactgcggcatgttcacctgcaagtacgccgactacatcagcagagacaagcccatcaccttcacccagcaccagatgcccctgttcagaaagaagatggtgtgggagatcctgcaccagcagctgctgtag

SEQ ID NO: 101187 - DNA, 1242 bp, Artificial Sequence
  Description of Artificial Sequence: Synthetic coding sequence
atgtggaagccccaggagcaggccgtgaccgagatgatcagcgaggagagcggcaagggcctgagaagaccccactgcaccgtggaggagggcgtgcagaaggaggagagagagaagtacagaaagctgctggagagactgaaggagagcggccacggcaacagcgtgtgccccgtgaccagcaactaccacagcagccagagaagccagatggacaccctgaagaccaagggctggggcgaggagcagaaccacggcgtgaagaccacccagttcgtgcccaagcagtacagactggtggagaccagaggccccctgtgcagcctgagaagcgagaagagatgcagcaagggcaagatcaccgacaccgagaccatggtgggcatcagattcgagaacgagagcagaagaggctaccagctggagcccgacctgagcgaggaggtgagcgccagactgagactgggcagcggcagcaacggcctgctgagaagaaaggtgagcatcatcgagaccaaggagaagaactgcagcggcaaggagagagacagaagaaccgacgacctgctggagctgaccgaggacatggagaaggagatcagcaacgccctgggccacggcccccaggacgagatcctgagcagcgccttcaagctgagaatcaccagaggcgacatccagaccctgaagaactaccactggctgaacgacgaggtgatcaacttctacatgaacctgctggtggagagaaacaagaagcagggctaccccgccctgcacgtgttcagcaccttcttctaccccaagctgaagagcggcggctaccaggccgtgaagagatggaccaagggcgtgaacctgttcgagcaggagatcatcctggtgcccatccacagaaaggtgcactggagcctggtggtgatcgacctgagaaagaagtgcctgaagtacctggacagcatgggccagaagggccacagaatctgcgagatcctgctgcagtacctgcaggacgagagcaagaccaagagaaacagcgacctgaacctgctggagtggacccaccacagcatgaagccccacgagatcccccagcagctgaacggcagcgactgcggcatgttcacctgcaagtacgccgactacatcagcagagacaagcccatcaccttcacccagcaccagatgcccctgttcagaaagaagatggtgtgggagatcctgcaccagcagctgctgtag

SEQ ID NO: 101188 - DNA, 1383 bp, Artificial Sequence
  Description of Artificial Sequence: Synthetic coding sequence
atgtacagatggctggtgagaatcctgggcaccatcttcagattctgcgacagaagcgtgccccccgccagagccctgctgaagagaagaagaagcgacagcaccctgttcagcaccgtggacaccgacgagatccccgccaagagacccagactggactgcttcatccaccaggtgaagaacagcctgtacaacgccgccagcctgttcggcttccccttccagctgaccaccaagcccatggtgaccagcgcctgcaacggcaccagaaacgtggcccccagcggcgaggtgaacggcaacagcgtgtgccccgtgaccagcaactaccacagcagccagagaagccagatggacaccctgaagaccaagggctggggcgaggagcagaaccacggcgtgaagaccacccagttcgtgcccaagcagtacagactggtggagaccagaggccccctgtgcagcctgagaagcgagaagagatgcagcaagggcaagatcaccgacaccgagaccatggtgggcatcagattcgagaacgagagcagaagaggctaccagctggagcccgacctgagcgaggaggtgagcgccagactgagactgggcagcggcagcaacggcctgctgagaagaaaggtgagcatcatcgagaccaaggagaagaactgcagcggcaaggagagagacagaagaaccgacgacctgctggagctgaccgaggacatggagaaggagatcagcaacgccctgggccacggcccccaggacgagatcctgagcagcgccttcaagctgagaatcaccagaggcgacatccagaccctgaagaactaccactggctgaacgacgaggtgatcaacttctacatgaacctgctggtggagagaaacaagaagcagggctaccccgccctgcacgtgttcagcaccttcttctaccccaagctgaagagcggcggctaccaggccgtgaagagatggaccaagggcgtgaacctgttcgagcaggagatcatcctggtgcccatccacagaaaggtgcactggagcctggtggtgatcgacctgagaaagaagtgcctgaagtacctggacagcatgggccagaagggccacagaatctgcgagatcctgctgcagtacctgcaggacgagagcaagaccaagagaaacagcgacctgaacctgctggagtggacccaccacagcatgaagccccacgagatcccccagcagctgaacggcagcgactgcggcatgttcacctgcaagtacgccgactacatcagcagagacaagcccatcaccttcacccagcaccagatgcccctgttcagaaagaagatggtgtgggagatcctgcaccagcagctgctgtag

SEQ ID NO: 101189 - DNA, 1740 bp, Artificial Sequence
  Description of Artificial Sequence: Synthetic coding sequence
atggacagccacccctgcctgtactgcggcccccaggacagcgagggcaccaactggcagaccagccccagcaccctgttcagcaccgtggacaccgacgagatccccgccaagagacccagactggactgcttcatccaccaggtgaagaacagcctgtacaacgccgccagcctgttcggcttccccttccagctgaccaccaagcccatggtgaccagcgcctgcaacggcaccagaaacgtggcccccagcggcgaggtgttcagcaacagcagcagctgcgagctgaccggcagcggcagctggaacaacatgctgaagctgggcaacaagagccccaacggcatcagcgactaccccaagatcagagtgaccgtgaccagagaccagcccagaagagtgctgcccagcttcggcttcaccctgaacagcgagggctgcaacagaagacccggcggcagaagacacagcaagggcaaccccgagagcagcctgatgtggaagccccaggagcaggccgtgaccgagatgatcagcgaggagagcggcaagggcctgagaagaccccactgcaccgtggaggagggcgtgcagaaggaggagagagagaagtacagaaagctgctggagagactgaaggagagcggccacggcaacagcgtgtgccccgtgaccagcaactaccacagcagccagagaagccagatggacaccctgaagaccaagggctggggcgaggagcagaaccacggcgtgaagaccacccagttcgtgcccaagcagtacagactggtggagaccagaggccccctgtgcagcctgagaagcgagaagagatgcagcaagggcaagatcaccgacaccgagaccatggtgggcatcagattcgagaacgagagcagaagaggctaccagctggagcccgacctgagcgaggaggtgagcgccagactgagactgggcagcggcagcaacggcctgctgagaagaaaggtgagcatcatcgagaccaaggagaagaactgcagcggcaaggagagagacagaagaaccgacgacctgctggagctgaccgaggacatggagaaggagatcagcaacgccctgggccacggcccccaggacgagatcctgagcagcgccttcaagctgagaatcaccagaggcgacatccagaccctgaagaactaccactggctgaacgacgaggtgatcaacttctacatgaacctgctggtggagagaaacaagaagcagggctaccccgccctgcacgtgttcagcaccttcttctaccccaagctgaagagcggcggctaccaggccgtgaagagatggaccaagggcgtgaacctgttcgagcaggagatcatcctggtgcccatccacagaaaggtgcactggagcctggtggtgatcgacctgagaaagaagtgcctgaagtacctggacagcatgggccagaagggccacagaatctgcgagatcctgctgcagtacctgcaggacgagagcaagaccaagagaaacagcgacctgaacctgctggagtggacccaccacagcatgaagccccacgagatcccccagcagctgaacggcagcgactgcggcatgttcacctgcaagtacgccgactacatcagcagagacaagcccatcaccttcacccagcaccagatgcccctgttcagaaagaagatggtgtgggagatcctgcaccagcagctgctgtag

SEQ ID NO: 101190 - DNA, 1722 bp, Artificial Sequence
  Description of Artificial Sequence: Synthetic coding sequence
atgaaggagaccatccagggcaccggcagctggggccccgagccccccggccccggcatcccccccgcctacagcagccccagaagagagagactgagatggccccccccccccaagcccagactgaagagcggcggcggcttcggccccgaccccggcagcggcaccaccgtgcccgccagaagactgcccgtgcccagacccagcttcgacgccagcgccagcgaggaggaggaggaggaggaggaggaggaggacgaggacgaggaggaggaggtggccgcctggagactgccccccagatggagccagctgggcaccagccagagacccagacccagcagacccacccacagaaagacctgcagccagagaagaagaagagccatgagagccttcagaatgctgctgtacagcaagagcaccagcctgaccttccactggaagctgtggggcagacacagaggcagaagaagaggcctggcccaccccaagaaccacctgagcccccagcagggcggcgccaccccccaggtgcccagcccctgctgcagattcgacagccccagaggcccccccccccccagactgggcctgctgggcgccctgatggccgaggacggcgtgagaggcagcccccccgtgcccagcggcccccccatggaggaggacggcctgagatggacccccaagagccccctggaccccgacagcggcctgctgagctgcaccctgcccaacggcttcggcggccagagcggccccgagggcgagagaagcctggccccccccgacgccagcatcctgatcagcaacgtgtgcagcatcggcgaccacgtggcccaggagctgttccagggcagcgacctgggcatggccgaggaggccgagagacccggcgagaaggccggccagcacagccccctgagagaggagcacgtgacctgcgtgcagagcatcctggacgagttcctgcagacctacggcagcctgatccccctgagcaccgacgaggtggtggagaagctggaggacatcttccagcaggagttcagcacccccagcagaaagggcctggtgctgcagctgatccagagctaccagagaatgcccggcaacgccatggtgagaggcttcagagtggcctacaagagacacgtgctgaccatggacgacctgggcaccctgtacggccagaactggctgaacgaccaggtgatgaacatgtacggcgacctggtgatggacaccgtgcccgagaaggtgcacttcttcaacagcttcttctacgacaagctgagaaccggctacgacggcgtgaagagatggaccaagaacgtggacatcttcaacaaggagctgctgctgatccccatccacctggaggtgcactggagcctgatcagcgtggacgtgagaagaagaaccatcacctacttcgacagccagagaaccctgaacagaagatgccccaagcacatcgccaagtacctgcaggccgaggccgtgaagaaggacagactggacttccaccagggctggaagggctacttcaagatgaacgtggccagacagaacaacgacagcgactgcggcgccttcgtgctgcagtactgcaagcacctggccctgagccagcccttcagcttcacccagcaggacatgcccaagctgagaagacagatctacaaggagctgtgccactgcaagctgaccgtgtag

SEQ ID NO: 101191 - DNA, 1725 bp, Artificial Sequence
  Description of Artificial Sequence: Synthetic coding sequence
atgaaggagaccatccagggcaccggcagctggggccccgagccccccggccccggcatcccccccgcctacagcagccccagaagagagagactgagatggccccccccccccaagcccagactgaagagcggcggcggcttcggccccgaccccggcagcggcaccaccgtgcccgccagaagactgcccgtgcccagacccagcttcgacgccagcgccagcgaggaggaggaggaggaggaggaggaggaggacgaggacgaggaggaggaggtggccgcctggagactgccccccagatggagccagctgggcaccagccagagacccagacccagcagacccacccacagaaagacctgcagccagagaagaagaagagccatgagagccttcagaatgctgctgtacagcaagagcaccagcctgaccttccactggaagctgtggggcagacacagaggcagaagaagaggcctggcccaccccaagaaccacctgagcccccagcagggcggcgccaccccccaggtgcccagcccctgctgcagattcgacagccccagaggcccccccccccccagactgggcctgctgggcgccctgatggccgaggacggcgtgagaggcagcccccccgtgcccagcggcccccccatggaggaggacggcctgagatggacccccaagagccccctggaccccgacagcggcctgctgagctgcaccctgcccaacggcttcggcggccagagcggccccgagggcgagagaagcctggccccccccgacgccagcatcctgatcagcaacgtgtgcagcatcggcgaccacgtggcccaggagctgttccagggcagcgacctgggcatggccgaggaggccgagagacccggcgagaaggccggccagcacagccccctgagagaggagcacgtgacctgcgtgcagagcatcctggacgagttcctgcagacctacggcagcctgatccccctgagcaccgacgaggtggtggagaagctggaggacatcttccagcaggagttcagcacccccagcagaaagggcctggtgctgcagctgatccagagctaccagagaatgcccggcaacgccatggtgagaggcttcagagtggcctacaagagacacgtgctgaccatggacgacctgggcaccctgtacggccagaactggctgaacgaccaggtgatgaacatgtacggcgacctggtgatggacaccgtgcccgagaaggtgcacttcttcaacagcttcttctacgacaagctgagaaccaagggctacgacggcgtgaagagatggaccaagaacgtggacatcttcaacaaggagctgctgctgatccccatccacctggaggtgcactggagcctgatcagcgtggacgtgagaagaagaaccatcacctacttcgacagccagagaaccctgaacagaagatgccccaagcacatcgccaagtacctgcaggccgaggccgtgaagaaggacagactggacttccaccagggctggaagggctacttcaagatgaacgtggccagacagaacaacgacagcgactgcggcgccttcgtgctgcagtactgcaagcacctggccctgagccagcccttcagcttcacccagcaggacatgcccaagctgagaagacagatctacaaggagctgtgccactgcaagctgaccgtgtag

SEQ ID NO: 101192 - DNA, 3741 bp, Artificial Sequence
  Description of Artificial Sequence: Synthetic coding sequence
atgatggagaccgagagactggtgctgcccccccccgaccccctggacctgcccctgagagccgtggagctgggctgcaccggccactgggagctgctgaacctgcccggcgcccccgagagcagcctgccccacggcctgcccccctgcgcccccgacctgcagcaggaggccgagcagctgttcctgagcagccccgcctggctgcccctgcacggcgtggagcacagcgccagaaagtggcagagaaagaccgacccctggagcctgctggccgtgctgggcgcccccgtgcccagcgacctgcaggcccagagacaccccaccaccggccagatcctgggctacaaggaggtgctgctggagaacaccaacctgagcgccaccaccagcctgagcctgagaagaccccccggccccgccagccagagcctgtggggcaaccccacccagtaccccttctggcccggcggcatggacgagcccaccatcaccgacctgaacaccagagaggaggccgaggaggagatcgacttcgagaaggacctgctgaccatcccccccggcttcaagaagggcatggacttcgcccccaaggactgccccacccccgcccccggcctgctgagcctgagctgcatgctggagcccctggacctgggcggcggcgacgaggacgagaacgaggccgtgggccagcccggcggccccagaggcgacaccgtgagcgccagcccctgcagcgcccccctggccagagccagcagcctggaggacctggtgctgaaggaggccagcaccgccgtgagcacccccgaggcccccgagccccccagccaggagcagtgggccatccccgtggacgccaccagccccgtgggcgacttctacagactgatcccccagcccgccttccagtgggccttcgagcccgacgtgttccagaagcaggccatcctgcacctggagagacacgacagcgtgttcgtggccgcccacaccagcgccggcaagaccgtggtggccgagtacgccatcgccctggcccagaagcacatgaccagaaccatctacaccagccccatcaaggccctgagcaaccagaagttcagagacttcagaaacaccttcggcgacgtgggcctgctgaccggcgacgtgcagctgcaccccgaggccagctgcctgatcatgaccaccgagatcctgagaagcatgctgtacagcggcagcgacgtgatcagagacctggagtgggtgatcttcgacgaggtgcactacatcaacgacgtggagagaggcgtggtgtgggaggaggtgctgatcatgctgcccgaccacgtgagcatcatcctgctgagcgccaccgtgcccaacgccctggagttcgccgactggatcggcagactgaagagaagacagatctacgtgatcagcaccgtgaccagacccgtgcccctggagcactacctgttcaccggcaacagcagcaagacccagggcgagctgttcctgctgctggacagcagaggcgccttccacaccaagggctactacgccgccgtggaggccaagaaggagagaatgagcaagcacgcccagaccttcggcgccaagcagcccacccaccagggcggccccgcccaggacagaggcgtgtacctgagcctgctggccagcctgagaaccagagcccagctgcccgtggtggtgttcaccttcagcagaggcagatgcgacgagcaggccagcggcctgaccagcctggacctgaccaccagcagcgagaagagcgagatccacctgttcctgcagagatgcctggccagactgagaggcagcgacagacagctgccccaggtgctgcacatgagcgagctgctgaacagaggcctgggcgtgcaccacagcggcatcctgcccatcctgaaggagatcgtggagatgctgttcagcagaggcctggtgaaggtgctgttcgccaccgagaccttcgccatgggcgtgaacatgcccgccagaaccgtggtgttcgacagcatgagaaagcacgacggcagcaccttcagagacctgctgcccggcgagtacgtgcagatggccggcagagccggcagaagaggcctggaccccaccggcaccgtgatcctgctgtgcaagggcagagtgcccgagatggccgacctgcacagaatgatgatgggcaagcccagccagctgcagagccagttcagactgacctacaccatgatcctgaacctgctgagagtggacgccctgagagtggaggacatgatgaagagaagcttcagcgagttccccagcagaaaggacagcaaggcccacgagcaggccctggccgagctgaccaagagactgggcgccctggaggagcccgacatgaccggccagctggtggacctgcccgagtactacagctggggcgaggagctgaccgagacccagcacatgatccagagaagaatcatggagagcgtgaacggcctgaagagcctgagcgccggcagagtggtggtggtgaagaaccaggagcaccacaacgccctgggcgtgatcctgcaggtgagcagcaacagcaccagcagagtgttcaccaccctggtgctgtgcgacaagcccctgagccaggacccccaggacagaggccccgccaccgccgaggtgccctaccccgacgacctggtgggcttcaagctgttcctgcccgagggcccctgcgaccacaccgtggtgaagctgcagcccggcgacatggccgccatcaccaccaaggtgctgagagtgaacggcgagaagatcctggaggacttcagcaagagacagcagcccaagttcaagaaggacccccccctggccgccgtgaccaccgccgtgcaggagctgctgagactggcccaggcccaccccgccggcccccccaccctggaccccgtgaacgacctgcagctgaaggacatgagcgtggtggagggcggcctgagagccagaaagctggaggagctgatccagggcgcccagtgcgtgcacagccccagattccccgcccagtacctgaagctgagagagagaatgcagatccagaaggagatggagagactgagattcctgctgagcgaccagagcctgctgctgctgcccgagtaccaccagagagtggaggtgctgagaaccctgggctacgtggacgaggccggcaccgtgaagctggccggcagagtggcctgcgccatgagcagccacgagctgctgctgaccgagctgatgttcgacaacgccctgagcaccctgagacccgaggagatcgccgccctgctgagcggcctggtgtgccagagccccggcgacgccggcgaccagctgcccaacaccctgaagcagggcatcgagagagtgagagccgtggccaagagaatcggcgaggtgcaggtggcctgcggcctgaaccagaccgtggaggagttcgtgggcgagctgaacttcggcctggtggaggtggtgtacgagtgggccagaggcatgcccttcagcgagctggccggcctgagcggcacccccgagggcctggtggtgagatgcatccagagactggccgagatgtgcagaagcctgagaggcgccgccagactggtgggcgagcccgtgctgggcgccaagatggagaccgccgccaccctgctgagaagagacatcgtgttcgccgccagcctgtacacccagtag

SEQ ID NO: 101193 - DNA, 3741 bp, Artificial Sequence
  Description of Artificial Sequence: Synthetic coding sequence
atgatggagaccgagagactggtgctgcccccccccgaccccctggacctgcccctgagagccgtggagctgggctgcaccggccactgggagctgctgaacctgcccggcgcccccgagagcagcctgccccacggcctgcccccctgcgcccccgacctgcagcaggaggccgagcagctgttcctgagcagccccgcctggctgcccctgcacggcgtggagcacagcgccagaaagtggcagagaaagaccgacccctggagcctgctggccgtgctgggcgcccccgtgcccagcgacctgcaggcccagagacaccccaccaccggccagatcctgggctacaaggaggtgctgctggagaacaccaacctgagcgccaccaccagcctgagcctgagaagaccccccggccccgccagccagagcctgtggggcaaccccacccagtaccccttctggcccggcggcatggacgagcccaccatcaccgacctgaacaccagagaggaggccgaggaggagatcgacttcgagaaggacctgctgaccatcccccccggcttcaagaagggcatggacttcgcccccaaggactgccccacccccgcccccggcctgctgagcctgagctgcctgctggagcccctggacctgggcggcggcgacgaggacgagaacgaggccgtgggccagcccggcggccccagaggcgacaccgtgagcgccagcccctgcagcgcccccctggccagagccagcagcctggaggacctggtgctgaaggaggccagcaccgccgtgagcacccccgaggcccccgagccccccagccaggagcagtgggccatccccgtggacgccaccagccccgtgggcgacttctacagactgatcccccagcccgccttccagtgggccttcgagcccgacgtgttccagaagcaggccatcctgcacctggagagacacgacagcgtgttcgtggccgcccacaccagcgccggcaagaccgtggtggccgagtacgccatcgccctggcccagaagcacatgaccagaaccatctacaccagccccatcaaggccctgagcaaccagaagttcagagacttcagaaacaccttcggcgacgtgggcctgctgaccggcgacgtgcagctgcaccccgaggccagctgcctgatcatgaccaccgagatcctgagaagcatgctgtacagcggcagcgacgtgatcagagacctggagtgggtgatcttcgacgaggtgcactacatcaacgacgtggagagaggcgtggtgtgggaggaggtgctgatcatgctgcccgaccacgtgagcatcatcctgctgagcgccaccgtgcccaacgccctggagttcgccgactggatcggcagactgaagagaagacagatctacgtgatcagcaccgtgaccagacccgtgcccctggagcactacctgttcaccggcaacagcagcaagacccagggcgagctgttcctgctgctggacagcagaggcgccttccacaccaagggctactacgccgccgtggaggccaagaaggagagaatgagcaagcacgcccagaccttcggcgccaagcagcccacccaccagggcggccccgcccaggacagaggcgtgtacctgagcctgctggccagcctgagaaccagagcccagctgcccgtggtggtgttcaccttcagcagaggcagatgcgacgagcaggccagcggcctgaccagcctggacctgaccaccagcagcgagaagagcgagatccacctgttcctgcagagatgcctggccagactgagaggcagcgacagacagctgccccaggtgctgcacatgagcgagctgctgaacagaggcctgggcgtgcaccacagcggcatcctgcccatcctgaaggagatcgtggagatgctgttcagcagaggcctggtgaaggtgctgttcgccaccgagaccttcgccatgggcgtgaacatgcccgccagaaccgtggtgttcgacagcatgagaaagcacgacggcagcaccttcagagacctgctgcccggcgagtacgtgcagatggccggcagagccggcagaagaggcctggaccccaccggcaccgtgatcctgctgtgcaagggcagagtgcccgagatggccgacctgcacagaatgatgatgggcaagcccagccagctgcagagccagttcagactgacctacaccatgatcctgaacctgctgagagtggacgccctgagagtggaggacatgatgaagagaagcttcagcgagttccccagcagaaaggacagcaaggcccacgagcaggccctggccgagctgaccaagagactgggcgccctggaggagcccgacatgaccggccagctggtggacctgcccgagtactacagctggggcgaggagctgaccgagacccagcacatgatccagagaagaatcatggagagcgtgaacggcctgaagagcctgagcgccggcagagtggtggtggtgaagaaccaggagcaccacaacgccctgggcgtgatcctgcaggtgagcagcaacagcaccagcagagtgttcaccaccctggtgctgtgcgacaagcccctgagccaggacccccaggacagaggccccgccaccgccgaggtgccctaccccgacgacctggtgggcttcaagctgttcctgcccgagggcccctgcgaccacaccgtggtgaagctgcagcccggcgacatggccgccatcaccaccaaggtgctgagagtgaacggcgagaagatcctggaggacttcagcaagagacagcagcccaagttcaagaaggacccccccctggccgccgtgaccaccgccgtgcaggagctgctgagactggcccaggcccaccccgccggcccccccaccctggaccccgtgaacgacctgcagctgaaggacatgagcgtggtggagggcggcctgagagccagaaagctggaggagctgatccagggcgcccagtgcgtgcacagccccagattccccgcccagtacctgaagctgagagagagaatgcagatccagaaggagatggagagactgagattcctgctgagcgaccagagcctgctgctgctgcccgagtaccaccagagagtggaggtgctgagaaccctgggctacgtggacgaggccggcaccgtgaagctggccggcagagtggcctgcgccatgagcagccacgagctgctgctgaccgagctgatgttcgacaacgccctgagcaccctgagacccgaggagatcgccgccctgctgagcggcctggtgtgccagagccccggcgacgccggcgaccagctgcccaacaccctgaagcagggcatcgagagagtgagagccgtggccaagagaatcggcgaggtgcaggtggcctgcggcctgaaccagaccgtggaggagttcgtgggcgagctgaacttcggcctggtggaggtggtgtacgagtgggccagaggcatgcccttcagcgagctggccggcctgagcggcacccccgagggcctggtggtgagatgcatccagagactggccgagatgtgcagaagcctgagaggcgccgccagactggtgggcgagcccgtgctgggcgccaagatggagaccgccgccaccctgctgagaagagacatcgtgttcgccgccagcctgtacacccagtag

SEQ ID NO: 101194 - DNA, 3741 bp, Artificial Sequence; identical to SEQ ID NO: 101193
  Description of Artificial Sequence: Synthetic coding sequence

SEQ ID NO: 101195 - DNA, 3741 bp, Artificial Sequence; identical to SEQ ID NO: 101193
  Description of Artificial Sequence: Synthetic coding sequence

SEQ ID NO: 101196 - DNA, 3741 bp, Artificial Sequence; identical to SEQ ID NO: 101193
  Description of Artificial Sequence: Synthetic coding sequence

SEQ ID NO: 101197 - DNA, 3267 bp, Artificial Sequence
  Description of Artificial Sequence: Synthetic coding sequence
atggacgagcccaccatcaccgacctgaacaccagagaggaggccgaggaggagatcgacttcgagaaggacctgctgaccatcccccccggcttcaagaagggcatggacttcgcccccaaggactgccccacccccgcccccggcctgctgagcctgagctgcatgctggagcccctggacctgggcggcggcgacgaggacgagaacgaggccgtgggccagcccggcggccccagaggcgacaccgtgagcgccagcccctgcagcgcccccctggccagagccagcagcctggaggacctggtgctgaaggaggccagcaccgccgtgagcacccccgaggcccccgagccccccagccaggagcagtgggccatccccgtggacgccaccagccccgtgggcgacttctacagactgatcccccagcccgccttccagtgggccttcgagcccgacgtgttccagaagcaggccatcctgcacctggagagacacgacagcgtgttcgtggccgcccacaccagcgccggcaagaccgtggtggccgagtacgccatcgccctggcccagaagcacatgaccagaaccatctacaccagccccatcaaggccctgagcaaccagaagttcagagacttcagaaacaccttcggcgacgtgggcctgctgaccggcgacgtgcagctgcaccccgaggccagctgcctgatcatgaccaccgagatcctgagaagcatgctgtacagcggcagcgacgtgatcagagacctggagtgggtgatcttcgacgaggtgcactacatcaacgacgtggagagaggcgtggtgtgggaggaggtgctgatcatgctgcccgaccacgtgagcatcatcctgctgagcgccaccgtgcccaacgccctggagttcgccgactggatcggcagactgaagagaagacagatctacgtgatcagcaccgtgaccagacccgtgcccctggagcactacctgttcaccggcaacagcagcaagacccagggcgagctgttcctgctgctggacagcagaggcgccttccacaccaagggctactacgccgccgtggaggccaagaaggagagaatgagcaagcacgcccagaccttcggcgccaagcagcccacccaccagggcggccccgcccaggacagaggcgtgtacctgagcctgctggccagcctgagaaccagagcccagctgcccgtggtggtgttcaccttcagcagaggcagatgcgacgagcaggccagcggcctgaccagcctggacctgaccaccagcagcgagaagagcgagatccacctgttcctgcagagatgcctggccagactgagaggcagcgacagacagctgccccaggtgctgcacatgagcgagctgctgaacagaggcctgggcgtgcaccacagcggcatcctgcccatcctgaaggagatcgtggagatgctgttcagcagaggcctggtgaaggtgctgttcgccaccgagaccttcgccatgggcgtgaacatgcccgccagaaccgtggtgttcgacagcatgagaaagcacgacggcagcaccttcagagacctgctgcccggcgagtacgtgcagatggccggcagagccggcagaagaggcctggaccccaccggcaccgtgatcctgctgtgcaagggcagagtgcccgagatggccgacctgcacagaatgatgatgggcaagcccagccagctgcagagccagttcagactgacctacaccatgatcctgaacctgctgagagtggacgccctgagagtggaggacatgatgaagagaagcttcagcgagttccccagcagaaaggacagcaaggcccacgagcaggccctggccgagctgaccaagagactgggcgccctggaggagcccgacatgaccggccagctggtggacctgcccgagtactacagctggggcgaggagctgaccgagacccagcacatgatccagagaagaatcatggagagcgtgaacggcctgaagagcctgagcgccggcagagtggtggtggtgaagaaccaggagcaccacaacgccctgggcgtgatcctgcaggtgagcagcaacagcaccagcagagtgttcaccaccctggtgctgtgcgacaagcccctgagccaggacccccaggacagaggccccgccaccgccgaggtgccctaccccgacgacctggtgggcttcaagctgttcctgcccgagggcccctgcgaccacaccgtggtgaagctgcagcccggcgacatggccgccatcaccaccaaggtgctgagagtgaacggcgagaagatcctggaggacttcagcaagagacagcagcccaagttcaagaaggacccccccctggccgccgtgaccaccgccgtgcaggagctgctgagactggcccaggcccaccccgccggcccccccaccctggaccccgtgaacgacctgcagctgaaggacatgagcgtggtggagggcggcctgagagccagaaagctggaggagctgatccagggcgcccagtgcgtgcacagccccagattccccgcccagtacctgaagctgagagagagaatgcagatccagaaggagatggagagactgagattcctgctgagcgaccagagcctgctgctgctgcccgagtaccaccagagagtggaggtgctgagaaccctgggctacgtggacgaggccggcaccgtgaagctggccggcagagtggcctgcgccatgagcagccacgagctgctgctgaccgagctgatgttcgacaacgccctgagcaccctgagacccgaggagatcgccgccctgctgagcggcctggtgtgccagagccccggcgacgccggcgaccagctgcccaacaccctgaagcagggcatcgagagagtgagagccgtggccaagagaatcggcgaggtgcaggtggcctgcggcctgaaccagaccgtggaggagttcgtgggcgagctgaacttcggcctggtggaggtggtgtacgagtgggccagaggcatgcccttcagcgagctggccggcctgagcggcacccccgagggcctggtggtgagatgcatccagagactggccgagatgtgcagaagcctgagaggcgccgccagactggtgggcgagcccgtgctgggcgccaagatggagaccgccgccaccctgctgagaagagacatcgtgttcgccgccagcctgtacacccagtag

SEQ ID NO: 101198 - DNA, 3741 bp, Artificial Sequence; identical to SEQ ID NO: 101192
  Description of Artificial Sequence: Synthetic coding sequence

SEQ ID NO: 101199 - DNA, 3162 bp, Artificial Sequence
  Description of Artificial Sequence: Synthetic coding sequence
atggacttcgcccccaaggactgccccacccccgcccccggcctgctgagcctgagctgcatgctggagcccctggacctgggcggcggcgacgaggacgagaacgaggccgtgggccagcccggcggccccagaggcgacaccgtgagcgccagcccctgcagcgcccccctggccagagccagcagcctggaggacctggtgctgaaggaggccagcaccgccgtgagcacccccgaggcccccgagccccccagccaggagcagtgggccatccccgtggacgccaccagccccgtgggcgacttctacagactgatcccccagcccgccttccagtgggccttcgagcccgacgtgttccagaagcaggccatcctgcacctggagagacacgacagcgtgttcgtggccgcccacaccagcgccggcaagaccgtggtggccgagtacgccatcgccctggcccagaagcacatgaccagaaccatctacaccagccccatcaaggccctgagcaaccagaagttcagagacttcagaaacaccttcggcgacgtgggcctgctgaccggcgacgtgcagctgcaccccgaggccagctgcctgatcatgaccaccgagatcctgagaagcatgctgtacagcggcagcgacgtgatcagagacctggagtgggtgatcttcgacgaggtgcactacatcaacgacgtggagagaggcgtggtgtgggaggaggtgctgatcatgctgcccgaccacgtgagcatcatcctgctgagcgccaccgtgcccaacgccctggagttcgccgactggatcggcagactgaagagaagacagatctacgtgatcagcaccgtgaccagacccgtgcccctggagcactacctgttcaccggcaacagcagcaagacccagggcgagctgttcctgctgctggacagcagaggcgccttccacaccaagggctactacgccgccgtggaggccaagaaggagagaatgagcaagcacgcccagaccttcggcgccaagcagcccacccaccagggcggccccgcccaggacagaggcgtgtacctgagcctgctggccagcctgagaaccagagcccagctgcccgtggtggtgttcaccttcagcagaggcagatgcgacgagcaggccagcggcctgaccagcctggacctgaccaccagcagcgagaagagcgagatccacctgttcctgcagagatgcctggccagactgagaggcagcgacagacagctgccccaggtgctgcacatgagcgagctgctgaacagaggcctgggcgtgcaccacagcggcatcctgcccatcctgaaggagatcgtggagatgctgttcagcagaggcctggtgaaggtgctgttcgccaccgagaccttcgccatgggcgtgaacatgcccgccagaaccgtggtgttcgacagcatgagaaagcacgacggcagcaccttcagagacctgctgcccggcgagtacgtgcagatggccggcagagccggcagaagaggcctggaccccaccggcaccgtgatcctgctgtgcaagggcagagtgcccgagatggccgacctgcacagaatgatgatgggcaagcccagccagctgcagagccagttcagactgacctacaccatgatcctgaacctgctgagagtggacgccctgagagtggaggacatgatgaagagaagcttcagcgagttccccagcagaaaggacagcaaggcccacgagcaggccctggccgagctgaccaagagactgggcgccctggaggagcccgacatgaccggccagctggtggacctgcccgagtactacagctggggcgaggagctgaccgagacccagcacatgatccagagaagaatcatggagagcgtgaacggcctgaagagcctgagcgccggcagagtggtggtggtgaagaaccaggagcaccacaacgccctgggcgtgatcctgcaggtgagcagcaacagcaccagcagagtgttcaccaccctggtgctgtgcgacaagcccctgagccaggacccccaggacagaggccccgccaccgccgaggtgccctaccccgacgacctggtgggcttcaagctgttcctgcccgagggcccctgcgaccacaccgtggtgaagctgcagcccggcgacatggccgccatcaccaccaaggtgctgagagtgaacggcgagaagatcctggaggacttcagcaagagacagcagcccaagttcaagaaggacccccccctggccgccgtgaccaccgccgtgcaggagctgctgagactggcccaggcccaccccgccggcccccccaccctggaccccgtgaacgacctgcagctgaaggacatgagcgtggtggagggcggcctgagagccagaaagctggaggagctgatccagggcgcccagtgcgtgcacagccccagattccccgcccagtacctgaagctgagagagagaatgcagatccagaaggagatggagagactgagattcctgctgagcgaccagagcctgctgctgctgcccgagtaccaccagagagtggaggtgctgagaaccctgggctacgtggacgaggccggcaccgtgaagctggccggcagagtggcctgcgccatgagcagccacgagctgctgctgaccgagctgatgttcgacaacgccctgagcaccctgagacccgaggagatcgccgccctgctgagcggcctggtgtgccagagccccggcgacgccggcgaccagctgcccaacaccctgaagcagggcatcgagagagtgagagccgtggccaagagaatcggcgaggtgcaggtggcctgcggcctgaaccagaccgtggaggagttcgtgggcgagctgaacttcggcctggtggaggtggtgtacgagtgggccagaggcatgcccttcagcgagctggccggcctgagcggcacccccgagggcctggtggtgagatgcatccagagactggccgagatgtgcagaagcctgagaggcgccgccagactggtgggcgagcccgtgctgggcgccaagatggagaccgccgccaccctgctgagaagagacatcgtgttcgccgccagcctgtacacccagtag

SEQ ID NO: 101200 - DNA, 3162 bp, Artificial Sequence; identical to SEQ ID NO: 101199
  Description of Artificial Sequence: Synthetic coding sequence

SEQ ID NO: 101201 - DNA, 693 bp, Artificial Sequence
  Description of Artificial Sequence: Synthetic coding sequence
atgatggagaccgagagactggtgctgcccccccccgaccccctggacctgcccctgagagccgtggagctgggctgcaccggccactgggagctgctgaacctgcccggcgcccccgagagcagcctgccccacggcctgcccccctgcgcccccgacctgcagcaggaggccgagcagctgttcctgagcagccccgcctggctgcccctgcacggcgtggagcacagcgccagaaagtggcagagaaagaccgacccctggagcctgctggccgtgctgggcgcccccgtgcccagcgacctgcaggcccagagacaccccaccaccggccagatcctgggctacaaggaggtgctgctggagaacaccaacctgagcgccaccaccagcctgagcctgagaagaccccccggccccgccagccagagcctgtggggcaaccccacccagtaccccttctggcccggcggcatggacgagcccaccatcaccgacctgaacaccagagaggaggccgaggaggagatcgacttcgagaaggacctgctgaccatcccccccggcttcaagaagggcatggacttcgcccccaagggcagcgtgcacagctgcatccaccccagaggccccagagccagcatcagcggcgccgtgggccacccctgcggcagacacctgccctgctggtag

SEQ ID NO: 101202 - DNA, 3267 bp, Artificial Sequence
  Description of Artificial Sequence: Synthetic coding sequence
atggacgagcccaccatcaccgacctgaacaccagagaggaggccgaggaggagatcgacttcgagaaggacctgctgaccatcccccccggcttcaagaagggcatggacttcgcccccaaggactgccccacccccgcccccggcctgctgagcctgagctgcctgctggagcccctggacctgggcggcggcgacgaggacgagaacgaggccgtgggccagcccggcggccccagaggcgacaccgtgagcgccagcccctgcagcgcccccctggccagagccagcagcctggaggacctggtgctgaaggaggccagcaccgccgtgagcacccccgaggcccccgagccccccagccaggagcagtgggccatccccgtggacgccaccagccccgtgggcgacttctacagactgatcccccagcccgccttccagtgggccttcgagcccgacgtgttccagaagcaggccatcctgcacctggagagacacgacagcgtgttcgtggccgcccacaccagcgccggcaagaccgtggtggccgagtacgccatcgccctggcccagaagcacatgaccagaaccatctacaccagccccatcaaggccctgagcaaccagaagttcagagacttcagaaacaccttcggcgacgtgggcctgctgaccggcgacgtgcagctgcaccccgaggccagctgcctgatcatgaccaccgagatcctgagaagcatgctgtacagcggcagcgacgtgatcagagacctggagtgggtgatcttcgacgaggtgcactacatcaacgacgtggagagaggcgtggtgtgggaggaggtgctgatcatgctgcccgaccacgtgagcatcatcctgctgagcgccaccgtgcccaacgccctggagttcgccgactggatcggcagactgaagagaagacagatctacgtgatcagcaccgtgaccagacccgtgcccctggagcactacctgttcaccggcaacagcagcaagacccagggcgagctgttcctgctgctggacagcagaggcgccttccacaccaagggctactacgccgccgtggaggccaagaaggagagaatgagcaagcacgcccagaccttcggcgccaagcagcccacccaccagggcggccccgcccaggacagaggcgtgtacctgagcctgctggccagcctgagaaccagagcccagctgcccgtggtggtgttcaccttcagcagaggcagatgcgacgagcaggccagcggcctgaccagcctggacctgaccaccagcagcgagaagagcgagatccacctgttcctgcagagatgcctggccagactgagaggcagcgacagacagctgccccaggtgctgcacatgagcgagctgctgaacagaggcctgggcgtgcaccacagcggcatcctgcccatcctgaaggagatcgtggagatgctgttcagcagaggcctggtgaaggtgctgttcgccaccgagaccttcgccatgggcgtgaacatgcccgccagaaccgtggtgttcgacagcatgagaaagcacgacggcagcaccttcagagacctgctgcccggcgagtacgtgcagatggccggcagagccggcagaagaggcctggaccccaccggcaccgtgatcctgctgtgcaagggcagagtgcccgagatggccgacctgcacagaatgatgatgggcaagcccagccagctgcagagccagttcagactgacctacaccatgatcctgaacctgctgagagtggacgccctgagagtggaggacatgatgaagagaagcttcagcgagttccccagcagaaaggacagcaaggcccacgagcaggccctggccgagctgaccaagagactgggcgccctggaggagcccgacatgaccggccagctggtggacctgcccgagtactacagctggggcgaggagctgaccgagacccagcacatgatccagagaagaatcatggagagcgtgaacggcctgaagagcctgagcgccggcagagtggtggtggtgaagaaccaggagcaccacaacgccctgggcgtgatcctgcaggtgagcagcaacagcaccagcagagtgttcaccaccctggtgctgtgcgacaagcccctgagccaggacccccaggacagaggccccgccaccgccgaggtgccctaccccgacgacctggtgggcttcaagctgttcctgcccgagggcccctgcgaccacaccgtggtgaagctgcagcccggcgacatggccgccatcaccaccaaggtgctgagagtgaacggcgagaagatcctggaggacttcagcaagagacagcagcccaagttcaagaaggacccccccctggccgccgtgaccaccgccgtgcaggagctgctgagactggcccaggcccaccccgccggcccccccaccctggaccccgtgaacgacctgcagctgaaggacatgagcgtggtggagggcggcctgagagccagaaagctggaggagctgatccagggcgcccagtgcgtgcacagccccagattccccgcccagtacctgaagctgagagagagaatgcagatccagaaggagatggagagactgagattcctgctgagcgaccagagcctgctgctgctgcccgagtaccaccagagagtggaggtgctgagaaccctgggctacgtggacgaggccggcaccgtgaagctggccggcagagtggcctgcgccatgagcagccacgagctgctgctgaccgagctgatgttcgacaacgccctgagcaccctgagacccgaggagatcgccgccctgctgagcggcctggtgtgccagagccccggcgacgccggcgaccagctgcccaacaccctgaagcagggcatcgagagagtgagagccgtggccaagagaatcggcgaggtgcaggtggcctgcggcctgaaccagaccgtggaggagttcgtgggcgagctgaacttcggcctggtggaggtggtgtacgagtgggccagaggcatgcccttcagcgagctggccggcctgagcggcacccccgagggcctggtggtgagatgcatccagagactggccgagatgtgcagaagcctgagaggcgccgccagactggtgggcgagcccgtgctgggcgccaagatggagaccgccgccaccctgctgagaagagacatcgtgttcgccgccagcctgtacacccagtag

SEQ ID NO: 101203 - DNA, 3162 bp, Artificial Sequence
  Description of Artificial Sequence: Synthetic coding sequence
atggacttcgcccccaaggactgccccacccccgcccccggcctgctgagcctgagctgcctgctggagcccctggacctgggcggcggcgacgaggacgagaacgaggccgtgggccagcccggcggccccagaggcgacaccgtgagcgccagcccctgcagcgcccccctggccagagccagcagcctggaggacctggtgctgaaggaggccagcaccgccgtgagcacccccgaggcccccgagccccccagccaggagcagtgggccatccccgtggacgccaccagccccgtgggcgacttctacagactgatcccccagcccgccttccagtgggccttcgagcccgacgtgttccagaagcaggccatcctgcacctggagagacacgacagcgtgttcgtggccgcccacaccagcgccggcaagaccgtggtggccgagtacgccatcgccctggcccagaagcacatgaccagaaccatctacaccagccccatcaaggccctgagcaaccagaagttcagagacttcagaaacaccttcggcgacgtgggcctgctgaccggcgacgtgcagctgcaccccgaggccagctgcctgatcatgaccaccgagatcctgagaagcatgctgtacagcggcagcgacgtgatcagagacctggagtgggtgatcttcgacgaggtgcactacatcaacgacgtggagagaggcgtggtgtgggaggaggtgctgatcatgctgcccgaccacgtgagcatcatcctgctgagcgccaccgtgcccaacgccctggagttcgccgactggatcggcagactgaagagaagacagatctacgtgatcagcaccgtgaccagacccgtgcccctggagcactacctgttcaccggcaacagcagcaagacccagggcgagctgttcctgctgctggacagcagaggcgccttccacaccaagggctactacgccgccgtggaggccaagaaggagagaatgagcaagcacgcccagaccttcggcgccaagcagcccacccaccagggcggccccgcccaggacagaggcgtgtacctgagcctgctggccagcctgagaaccagagcccagctgcccgtggtggtgttcaccttcagcagaggcagatgcgacgagcaggccagcggcctgaccagcctggacctgaccaccagcagcgagaagagcgagatccacctgttcctgcagagatgcctggccagactgagaggcagcgacagacagctgccccaggtgctgcacatgagcgagctgctgaacagaggcctgggcgtgcaccacagcggcatcctgcccatcctgaaggagatcgtggagatgctgttcagcagaggcctggtgaaggtgctgttcgccaccgagaccttcgccatgggcgtgaacatgcccgccagaaccgtggtgttcgacagcatgagaaagcacgacggcagcaccttcagagacctgctgcccggcgagtacgtgcagatggccggcagagccggcagaagaggcctggaccccaccggcaccgtgatcctgctgtgcaagggcagagtgcccgagatggccgacctgcacagaatgatgatgggcaagcccagccagctgcagagccagttcagactgacctacaccatgatcctgaacctgctgagagtggacgccctgagagtggaggacatgatgaagagaagcttcagcgagttccccagcagaaaggacagcaaggcccacgagcaggccctggccgagctgaccaagagactgggcgccctggaggagcccgacatgaccggccagctggtggacctgcccgagtactacagctggggcgaggagctgaccgagacccagcacatgatccagagaagaatcatggagagcgtgaacggcctgaagagcctgagcgccggcagagtggtggtggtgaagaaccaggagcaccacaacgccctgggcgtgatcctgcaggtgagcagcaacagcaccagcagagtgttcaccaccctggtgctgtgcgacaagcccctgagccaggacccccaggacagaggccccgccaccgccgaggtgccctaccccgacgacctggtgggcttcaagctgttcctgcccgagggcccctgcgaccacaccgtggtgaagctgcagcccggcgacatggccgccatcaccaccaaggtgctgagagtgaacggcgagaagatcctggaggacttcagcaagagacagcagcccaagttcaagaaggacccccccctggccgccgtgaccaccgccgtgcaggagctgctgagactggcccaggcccaccccgccggcccccccaccctggaccccgtgaacgacctgcagctgaaggacatgagcgtggtggagggcggcctgagagccagaaagctggaggagctgatccagggcgcccagtgcgtgcacagccccagattccccgcccagtacctgaagctgagagagagaatgcagatccagaaggagatggagagactgagattcctgctgagcgaccagagcctgctgctgctgcccgagtaccaccagagagtggaggtgctgagaaccctgggctacgtggacgaggccggcaccgtgaagctggccggcagagtggcctgcgccatgagcagccacgagctgctgctgaccgagctgatgttcgacaacgccctgagcaccctgagacccgaggagatcgccgccctgctgagcggcctggtgtgccagagccccggcgacgccggcgaccagctgcccaacaccctgaagcagggcatcgagagagtgagagccgtggccaagagaatcggcgaggtgcaggtggcctgcggcctgaaccagaccgtggaggagttcgtgggcgagctgaacttcggcctggtggaggtggtgtacgagtgggccagaggcatgcccttcagcgagctggccggcctgagcggcacccccgagggcctggtggtgagatgcatccagagactggccgagatgtgcagaagcctgagaggcgccgccagactggtgggcgagcccgtgctgggcgccaagatggagaccgccgccaccctgctgagaagagacatcgtgttcgccgccagcctgtacacccagtag

SEQ ID NO: 101204 - DNA, 2643 bp, Artificial Sequence
  Description of Artificial Sequence: Synthetic coding sequence
atgatggagaccgagagactggtgctgcccccccccgaccccctggacctgcccctgagagccgtggagctgggctgcaccggccactgggagctgctgaacctgcccggcgcccccgagagcagcctgccccacggcctgcccccctgcgcccccgacctgcagcaggaggccgagcagctgttcctgagcagccccgcctggctgcccctgcacggcgtggagcacagcgccagaaagtggcagagaaagaccgacccctggagcctgctggccgtgctgggcgcccccgtgcccagcgacctgcaggcccagagacaccccaccaccggccagatcctgggctacaaggaggtgctgctggagcactacctgttcaccggcaacagcagcaagacccagggcgagctgttcctgctgctggacagcagaggcgccttccacaccaagggctactacgccgccgtggaggccaagaaggagagaatgagcaagcacgcccagaccttcggcgccaagcagcccacccaccagggcggccccgcccaggacagaggcgtgtacctgagcctgctggccagcctgagaaccagagcccagctgcccgtggtggtgttcaccttcagcagaggcagatgcgacgagcaggccagcggcctgaccagcctggacctgaccaccagcagcgagaagagcgagatccacctgttcctgcagagatgcctggccagactgagaggcagcgacagacagctgccccaggtgctgcacatgagcgagctgctgaacagaggcctgggcgtgcaccacagcggcatcctgcccatcctgaaggagatcgtggagatgctgttcagcagaggcctggtgaaggtgctgttcgccaccgagaccttcgccatgggcgtgaacatgcccgccagaaccgtggtgttcgacagcatgagaaagcacgacggcagcaccttcagagacctgctgcccggcgagtacgtgcagatggccggcagagccggcagaagaggcctggaccccaccggcaccgtgatcctgctgtgcaagggcagagtgcccgagatggccgacctgcacagaatgatgatgggcaagcccagccagctgcagagccagttcagactgacctacaccatgatcctgaacctgctgagagtggacgccctgagagtggaggacatgatgaagagaagcttcagcgagttccccagcagaaaggacagcaaggcccacgagcaggccctggccgagctgaccaagagactgggcgccctggaggagcccgacatgaccggccagctggtggacctgcccgagtactacagctggggcgaggagctgaccgagacccagcacatgatccagagaagaatcatggagagcgtgaacggcctgaagagcctgagcgccggcagagtggtggtggtgaagaaccaggagcaccacaacgccctgggcgtgatcctgcaggtgagcagcaacagcaccagcagagtgttcaccaccctggtgctgtgcgacaagcccctgagccaggacccccaggacagaggccccgccaccgccgaggtgccctaccccgacgacctggtgggcttcaagctgttcctgcccgagggcccctgcgaccacaccgtggtgaagctgcagcccggcgacatggccgccatcaccaccaaggtgctgagagtgaacggcgagaagatcctggaggacttcagcaagagacagcagcccaagttcaagaaggacccccccctggccgccgtgaccaccgccgtgcaggagctgctgagactggcccaggcccaccccgccggcccccccaccctggaccccgtgaacgacctgcagctgaaggacatgagcgtggtggagggcggcctgagagccagaaagctggaggagctgatccagggcgcccagtgcgtgcacagccccagattccccgcccagtacctgaagctgagagagagaatgcagatccagaaggagatggagagactgagattcctgctgagcgaccagagcctgctgctgctgcccgagtaccaccagagagtggaggtgctgagaaccctgggctacgtggacgaggccggcaccgtgaagctggccggcagagtggcctgcgccatgagcagccacgagctgctgctgaccgagctgatgttcgacaacgccctgagcaccctgagacccgaggagatcgccgccctgctgagcggcctggtgtgccagagccccggcgacgccggcgaccagctgcccaacaccctgaagcagggcatcgagagagtgagagccgtggccaagagaatcggcgaggtgcaggtggcctgcggcctgaaccagaccgtggaggagttcgtgggcgagctgaacttcggcctggtggaggtggtgtacgagtgggccagaggcatgcccttcagcgagctggccggcctgagcggcacccccgagggcctggtggtgagatgcatccagagactggccgagatgtgcagaagcctgagaggcgccgccagactggtgggcgagcccgtgctgggcgccaagatggagaccgccgccaccctgctgagaagagacatcgtgttcgccgccagcctgtacacccagtag

SEQ ID NO: 101205 - DNA, 3267 bp, Artificial Sequence; identical to SEQ ID NO: 101202
  Description of Artificial Sequence: Synthetic coding sequence

SEQ ID NO: 101206 - DNA, 2643 bp, Artificial Sequence; identical to SEQ ID NO: 101204
  Description of Artificial Sequence: Synthetic coding sequence

SEQ ID NO: 101207 - DNA, 2643 bp, Artificial Sequence; identical to SEQ ID NO: 101204
  Description of Artificial Sequence: Synthetic coding sequence

SEQ ID NO: 101208 - DNA, 693 bp, Artificial Sequence; identical to SEQ ID NO: 101201
  Description of Artificial Sequence: Synthetic coding sequence

SEQ ID NO: 101209 - DNA, 2643 bp, Artificial Sequence; identical to SEQ ID NO: 101204
  Description of Artificial Sequence: Synthetic coding sequence

SEQ ID NO: 101210 - DNA, 3267 bp, Artificial Sequence; identical to SEQ ID NO: 101202
  Description of Artificial Sequence: Synthetic coding sequence

SEQ ID NO: 101211 - DNA, 3267 bp, Artificial Sequence; identical to SEQ ID NO: 101202
  Description of Artificial Sequence: Synthetic coding sequence

SEQ ID NO: 101212 - DNA, 693 bp, Artificial Sequence; identical to SEQ ID NO: 101201
  Description of Artificial Sequence: Synthetic coding sequence

SEQ ID NO: 101213 - DNA, 3267 bp, Artificial Sequence; identical to SEQ ID NO: 101197
  Description of Artificial Sequence: Synthetic coding sequence

SEQ ID NO: 101214 - DNA, 693 bp, Artificial Sequence; identical to SEQ ID NO: 101201
  Description of Artificial Sequence: Synthetic coding sequence

SEQ ID NO: 101215 - DNA, 2643 bp, Artificial Sequence; identical to SEQ ID NO: 101204
  Description of Artificial Sequence: Synthetic coding sequence

SEQ ID NO: 101216 - DNA, 693 bp, Artificial Sequence; identical to SEQ ID NO: 101201
  Description of Artificial Sequence: Synthetic coding sequence

SEQ ID NO: 101217 - DNA, 3162 bp, Artificial Sequence; identical to SEQ ID NO: 101203
  Description of Artificial Sequence: Synthetic coding sequence

SEQ ID NO: 101218 - DNA, 3162 bp, Artificial Sequence; identical to SEQ ID NO: 101203
  Description of Artificial Sequence: Synthetic coding sequence

SEQ ID NO: 101219 - DNA, 3162 bp, Artificial Sequence; identical to SEQ ID NO: 101203
  Description of Artificial Sequence: Synthetic coding sequence

SEQ ID NO: 101220 - DNA, 465 bp, Artificial Sequence
  Description of Artificial Sequence: Synthetic coding sequence
atggccaccaaggccgtgtgcgtgctgaagggcgacggccccgtgcagggcatcatcaacttcgagcagaaggagagcaacggccccgtgaaggtgtggggcagcatcaagggcctgaccgagggcctgcacggcttccacgtgcacgagttcggcgacaacaccgccggctgcaccagcgccggcccccacttcaaccccctgagcagaaagcacggcggccccaaggacgaggagagacacgtgggcgacctgggcaacgtgaccgccgacaaggacggcgtggccgacgtgagcatcgaggacagcgtgatcagcctgagcggcgaccactgcatcatcggcagaaccctggtggtgcacgagaaggccgacgacctgggcaagggcggcaacgaggagagcaccaagaccggcaacgccggcagcagactggcctgcggcgtgatcggcatcgcccagtag

SEQ ID NO: 101221 - DNA, 108 bp, Artificial Sequence
  Description of Artificial Sequence: Synthetic coding sequence
atggccaccaaggccgtgtgcgtgctgaagggcgacggccccgtgcagggcatcatcaacttcgagcagaaggagagcaacggccccgagggcgtgggcaagcactag

SEQ ID NO: 101222 - DNA, 1074 bp, Artificial Sequence
  Description of Artificial Sequence: Synthetic coding sequence
atggacagcgtggagaagaccaccaacagaagcgagcagaagagcagaaagttcctgaagagcctgatcagaaagcagccccaggagctgctgctggtgatcggcaccggcgtgagcgccgccgtggcccccggcatccccgccctgtgcagctggagaagctgcatcgaggccgtgatcgaggccgccgagcagctggaggtgctgcaccccggcgacgtggccgagttcagaagaaaggtgaccaaggacagagacctgctggtggtggcccacgacctgatcagaaagatgagccccagaaccggcgacgccaagcccagcttcttccaggactgcctgatggaggtgttcgacgacctggagcagcacatcagaagccccgtggtgctgcagagcatcctgagcctgatggacagaggcgccatggtgctgaccaccaactacgacaacctgctggaggccttcggcagaagacagaacaagcccatggagagcctggacctgaaggacaagaccaaggtgctggagtgggccagaggccacatgaagtacggcgtgctgcacatccacggcctgtacaccgacccctgcggcgtggtgctggaccccagcggctacaaggacgtgacccaggacgccgaggtgatggaggtgctgcagaacctgtacagaaccaagagcttcctgttcgtgggctgcggcgagaccctgagagaccagatcttccaggccctgttcctgtacagcgtgcccaacaaggtggacctggagcactacatgctggtgctgaaggagaacgaggaccacttcttcaagcaccaggccgacatgctgctgcacggcatcaaggtggtgagctacggcgactgcttcgaccacttccccggctacgtgcaggacctggccacccagatctgcaagcagcagagccccgacgccgacagagtggacagcaccaccctgctgggcaacgcctgccaggactgcgccaagagaaagctggaggagaacggcatcgaggtgagcaagaagagaacccagagcgacaccgacgacgccggcggcagctag

SEQ ID NO: 101223 - DNA, 636 bp, Artificial Sequence
  Description of Artificial Sequence: Synthetic coding sequence
atggaccccagaaaggtgaacgagctgagagccttcgtgaagatgtgcaagcaggaccccagcgtgctgcacaccgaggagatgagattcctgagagagtgggtggagagcatgggcggcaaggtgccccccgccacccagaaggccaagagcgaggagaacaccaaggaggagaagcccgacagcaagaaggtggaggaggacctgaaggccgacgagcccagcagcgaggagagcgacctggagatcgacaaggagggcgtgatcgagcccgacaccgacgccccccaggagatgggcgacgagaacgccgagatcaccgaggagatgatggaccaggccaacgacaagaaggtggccgccatcgaggccctgaacgacggcgagctgcagaaggccatcgacctgttcaccgacgccatcaagctgaaccccagactggccatcctgtacgccaagagagccagcgtgttcgtgaagctgcagaagcccaacgccgccatcagagactgcgacagagccatcgagatcaaccccgacagcgcccagccctacaagtggagaggcaaggcccacagactgctgggccactgggaggaggccgcccacgacctggccctggcctggacccagtag

SEQ ID NO: 101224 - DNA, 489 bp, Artificial Sequence
  Description of Artificial Sequence: Synthetic coding sequence
atgggcggcaaggtgccccccgccacccagaaggccaagagcgaggagaacaccaaggaggagaagcccgacagcaagaaggtggaggaggacctgaaggccgacgagcccagcagcgaggagagcgacctggagatcgacaaggagggcgtgatcgagcccgacaccgacgccccccaggagatgggcgacgagaacgccgagatcaccgaggagatgatggaccaggccaacgacaagaaggtggccgccatcgaggccctgaacgacggcgagctgcagaaggccatcgacctgttcaccgacgccatcaagctgaaccccagactggccatcctgtacgccaagagagccagcgtgttcgtgaagctgcagaagcccaacgccgccatcagagactgcgacagagccatcgagatcaaccccgacagcgcccagccctacaagtggagaggcaaggcccacagactgctgggccactgggagtag

SEQ ID NO: 101225 - DNA, 366 bp, Artificial Sequence
  Description of Artificial Sequence: Synthetic coding sequence
atggaccccagaaaggtgaacgagctgagagccttcgtgaagatgtgcaagcaggaccccagcgtgctgcacaccgaggagatgagattcctgagagagtgggtggagagcatgggcggcaaggtgccccccgccacccagaaggccaagagcgaggagaacaccaaggaggagaagcccgacagcaagaaggtggaggaggacctgaaggccgacgagcccagcagcgaggagagcgacctggagatcgacaaggagggcgtgatcgagcccgacaccgacgccccccaggagatgggcgacgagaacgccgagatcaccgaggagatgatggaccaggccaacgacaagagcggctgctactag

SEQ ID NO: 101226 - DNA, 2568 bp, Artificial Sequence
  Description of Artificial Sequence: Synthetic coding sequence
atgggcagcgacagagccagaaagggcggcggcggccccaaggacttcggcgccggcctgaagtacaacagcagacacgagaaggtgaacggcctggaggagggcgtggagttcctgcccgtgaacaacgtgaagaaggtggagaagcacggccccggcagatgggtggtgctggccgccgtgctgatcggcctgctgctggtgctgctgggcatcggcttcctggtgtggcacctgcagtacagagacgtgagagtgcagaaggtgttcaacggctacatgagaatcaccaacgagaacttcgtggacgcctacgagaacagcaacagcaccgagttcgtgagcctggccagcaaggtgaaggacgccctgaagctgctgtacagcggcgtgcccttcctgggcccctaccacaaggagagcgccgtgaccgccttcagcgagggcagcgtgatcgcctactactggagcgagttcagcatcccccagcacctggtggaggaggccgagagagtgatggccgaggagagagtggtgatgctgccccccagagccagaagcctgaagagcttcgtggtgaccagcgtggtggccttccccaccgacagcaagaccgtgcagagaacccaggacaacagctgcagcttcggcctgcacgccagaggcgtggagctgatgagattcaccacccccggcttccccgacagcccctaccccgcccacgccagatgccagtgggccctgagaggcgacgccgacagcgtgctgagcctgaccttcagaagcttcgacctggccagctgcgacgagagaggcagcgacctggtgaccgtgtacaacaccctgagccccatggagccccacgccctggtgcagctgtgcggcacctacccccccagctacaacctgaccttccacagcagccagaacgtgctgctgatcaccctgatcaccaacaccgagagaagacaccccggcttcgaggccaccttcttccagctgcccagaatgagcagctgcggcggcagactgagaaaggcccagggcaccttcaacagcccctactaccccggccactacccccccaacatcgactgcacctggaacatcgaggtgcccaacaaccagcacgtgaaggtgagattcaagttcttctacctgctggagcccggcgtgcccgccggcacctgccccaaggactacgtggagatcaacggcgagaagtactgcggcgagagaagccagttcgtggtgaccagcaacagcaacaagatcaccgtgagattccacagcgaccagagctacaccgacaccggcttcctggccgagtacctgagctacgacagcagcgacccctgccccggccagttcacctgcagaaccggcagatgcatcagaaaggagctgagatgcgacggctgggccgactgcaccgaccacagcgacgagctgaactgcagctgcgacgccggccaccagttcacctgcaagaacaagttctgcaagcccctgttctgggtgtgcgacagcgtgaacgactgcggcgacaacagcgacgagcagggctgcagctgccccgcccagaccttcagatgcagcaacggcaagtgcctgagcaagagccagcagtgcaacggcaaggacgactgcggcgacggcagcgacgaggccagctgccccaaggtgaacgtggtgacctgcaccaagcacacctacagatgcctgaacggcctgtgcctgagcaagggcaaccccgagtgcgacggcaaggaggactgcagcgacggcagcgacgagaaggactgcgactgcggcctgagaagcttcaccagacaggccagagtggtgggcggcaccgacgccgacgagggcgagtggccctggcaggtgagcctgcacgccctgggccagggccacatctgcggcgccagcctgatcagccccaactggctggtgagcgccgcccactgctacatcgacgacagaggcttcagatacagcgaccccacccagtggaccgccttcctgggcctgcacgaccagagccagagaagcgcccccggcgtgcaggagagaagactgaagagaatcatcagccaccccttcttcaacgacttcaccttcgactacgacatcgccctgctggagctggagaagcccgccgagtacagcagcatggtgagacccatctgcctgcccgacgccagccacgtgttccccgccggcaaggccatctgggtgaccggctggggccacacccagtacggcggcaccggcgccctgatcctgcagaagggcgagatcagagtgatcaaccagaccacctgcgagaacctgctgccccagcagatcacccccagaatgatgtgcgtgggcttcctgagcggcggcgtggacagctgccagggcgacagcggcggccccctgagcagcgtggaggccgacggcagaatcttccaggccggcgtggtgagctggggcgacggctgcgcccagagaaacaagcccggcgtgtacaccagactgcccctgttcagagactggatcaaggagaacaccggcgtgtag

SEQ ID NO: 101227 - DNA, 3414 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagaccagcgcctgcagataccccagccacagcagcagcagagtgctgctgaaggacagacacccccccgcccccagcccccagaacccccaggaccccagccccgacaccagcccccccacctgccccttcaagaccgccagcttcggctacctggacagaagccccagcgcctgcaagagagacgcccagaaggagagcgtgcagggcgccgcccaggacgtggccggcgtggccgcctgcctgcccctggcccagagcacccccttccccggccccgccgccggccccagaggcgtgctgctgaccagaaccggcaccagagcccacagcctgggcatcagagagaagatcagcgcctgggagggcagaagagaggccagccccagaatgagcatgtgcggcgagaagagagagggcagcggcagcgagtgggccgccagcgagggctgccccagcctgggctgccccagcgtggtgcccagcccctgcagcagcgagaagaccttcgacttcaagggcctgagaagaatgagcagaaccttcagcgagtgcagctaccccgagaccgaggaggagggcgaggccctgcccgtgagagacagcttctacagactggagaagagactgggcagaagcgagcccagcgccttcctgagaggccacggcagcagaaaggagagcagcgccgtgctgagcagaatccagaagatcgagcaggtgctgaaggagcagcccggcagaggcctgccccagctgcccagcagctgctacagcgtggacagaggcaagagaaagaccggcaccctgggcagcctggaggagcccgccggcggcgccagcgtgagcgccggcagcagagccgtgggcgtggccggcgtggccggcgaggccggccccccccccgagagagagggcagcggcagcaccaagcccggcacccccggcaacagccccagcagccagagactgcccagcaagagcagcctggaccccgccgtgaaccccgtgcccaagcccaagagaaccttcgagtacgaggccgacaagaaccccaagagcaagcccagcaacggcctgccccccagccccacccccgccgcccccccccccctgcccagcacccccgccccccccgtgaccagaagacccaagaaggacatgagaggccacagaaagagccagagcagaaagagcttcgagttcgaggacgccagcagcctgcagagcctgtaccccagcagccccaccgagaacggcaccgagaaccagcccaagttcggcagcaagagcaccctggaggagaacgcctacgaggacatcgtgggcgacctgcccaaggagaacccctacgaggacgtggacctgaagagcagaagagccggcagaaagagccagcagctgagcgagaacagcctggacagcctgcacagaatgtggagcccccaggacagaaagtacaacagcccccccacccagctgagcctgaagcccaacagccagagcctgagaagcggcaactggagcgagagaaagagccacagactgcccagactgcccaagagacacagccacgacgacatgctgctgctggcccagctgagcctgcccagcagccccagcagcctgaacgaggacagcctgagcaccaccagcgagctgctgagcagcagaagagccagaagaatccccaagctggtgcagagaatcaacagcatctacaacgccaagagaggcaagaagagactgaagaagctgagcatgagcagcatcgagaccgccagcctgagagacgagaacagcgagagcgagagcgacagcgacgacagattcaaggcccacacccagagactggtgcacatccagagcatgctgaagagagcccccagctacagaaccctggagctggagctgctggagtggcaggagagagagctgttcgagtacttcgtggtggtgagcctgaagaagaagcccagcagaaacacctacctgcccgaggtgagctaccagttccccaagctggacagacccaccaagcagatgagagaggccgaggagagactgaaggccatcccccagttctgcttccccgacgccaaggactggctgcccgtgagcgagtacagcagcgagaccttcagcttcatgctgaccggcgaggacggcagcagaagattcggctactgcagaagactgctgcccagcggcaagggccccagactgcccgaggtgtactgcgtgatcagcagactgggctgcttcggcctgttcagcaaggtgctggacgaggtggagagaagaagaggcatcagcgccgccctggtgtaccccttcatgagaagcctgatggagagccccttccccgcccccggcaagaccatcaaggtgaagaccttcctgcccggcgccggcaacgaggtgctggagctgagaagacccatggacagcagactggagcacgtggacttcgagtgcctgttcacctgcctgagcgtgagacagctgatcagaatcttcgccagcctgctgctggagagaagagtgatcttcgtggccgacaagctgagcaccctgagcagctgcagccacgccgtggtggccctgctgtaccccttcagctggcagcacaccttcatccccgtgctgcccgccagcatgatcgacatcgtgtgctgccccacccccttcctggtgggcctgctgagcagcagcctgcccaagctgaaggagctgcccgtggaggaggccctgatggtgaacctgggcagcgacagattcatcagacagatggacgacgaggacaccctgctgcccagaaagctgcaggccgccctggagcaggccctggagagaaagaacgagctgatcagccaggacagcgacagcgacagcgacgacgagtgcaacaccctgaacggcctggtgagcgaggtgttcatcagattcttcgtggagaccgtgggccactacagcctgttcctgacccagagcgagaagggcgagagagccttccagagagaggccttcagaaagagcgtggccagcaagagcatcagaagattcctggaggtgttcatggagagccagatgttcgccggcttcatccaggacagagagctgagaaagtgcagagccaagggcctgttcgagcagagagtggagcagtacctggaggagctgcccgacaccgagcagagcggcatgaacaagttcctgagaggcctgggcaacaagatgaagttcctgcacaagaagaactag

SEQ ID NO: 101228 - DNA, 3414 bp, Artificial Sequence; identical to SEQ ID NO: 101227
  Description of Artificial Sequence: Synthetic coding sequence

SEQ ID NO: 101229 - DNA, 1263 bp, Artificial Sequence
  Description of Artificial Sequence: Synthetic coding sequence
atgaccagcagaaagaacggcggcggcgcccacagctggcaggagaccccctgggagcagagaagagccctgggcctgcagagagccgagatgaccatgaccgccaacaagaacagcagcatcacccacggcgccggcggcaccaaggcccccagaggcaccctgagcagaaagagcttcgagttcgaggacgccagcagcctgcagagcctgtaccccagcagccccaccgagaacggcaccgagaaccagcccaagttcggcagcaagagcaccctggaggagaacgcctacgaggacatcgtgggcgacctgcccaaggagaacccctacgaggacgtggacctgaagagcagaagagccggcagaaagagccagcagctgagcgagaacagcctggacagcctgcacagaatgtggagcccccaggacagaaagtacaacagcccccccacccagctgagcctgaagcccaacagccagagcctgagaagcggcaactggagcgagagaaagagccacagactgcccagactgcccaagagacacagccacgacgacatgctgctgctggcccagctgagcctgcccagcagccccagcagcctgaacgaggacagcctgagcaccaccagcgagctgctgagcagcagaagagccagaagaatccccaagctggtgcagagaatcaacagcatctacaacgccaagagaggcaagaagagactgaagaagctgagcatgagcagcatcgagaccgccagcctgagagacgagaacagcgagagcgagagcgacagcgacgacagattcaaggcccacacccagagactggtgcacatccagagcatgctgaagagagcccccagctacagaaccctggagctggagctgctggagtggcaggagagagagctgctgagcaccctgtggtggtgccccagcagaagaagccacagagagacccccaccagccccaagagccccaccagcttccccagaaacgtgctgagccccgccctgcacgtggccgccggcagcttcagcttcctgagactgtgcagcagcagaaccagcttcagaagaagcgtgcagacccccgcctggagccccagccccgcccagctggccctgctggacagacccaccaagcagatgagagaggccgaggagagactgaaggccatcccccagttctgcttccccgacgccaaggactggctgcccgtgagcgagtacatgagacccttcctgagctgctag

SEQ ID NO: 101230 - DNA, 174 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagaccagcgcctgcagatactag

SEQ ID NO: 101231 - DNA, 123 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagccccccctag

SEQ ID NO: 101232 - DNA, 144 bp, Artificial Sequence
  Description of Artificial Sequence: Synthetic coding sequence
atgtggagcccccaggacagaaagtacaacagcccccccacccagctgagcctgaagcccaacagccagagcctgagaagcggcaactggagcgagagaaagagccacagactgcccagactgcccaagagacacagccactag

SEQ ID NO: 101233 - DNA, 219 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaaagagcttcgagttcgaggacgccagcagcctgcagagcctgtaccccagcagccccaccgagaacggcaccgagaaccagcccaagttcggcagcaagagcaccctggaggagaacgcctacgaggacatcgtgtag

SEQ ID NO: 101234 - DNA, 375 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagaccagcgcctgcagataccccagccacagcagcagcagagtgctgctgaaggacagacacccccccgcccccagcccccagaacccccaggaccccagccccgacaccagcccccccacctgccccttcaagaccgccagcttcggctacctggacagaagccccagcgcctgcaagagagacgcccagaaggagagcgtgcagggcgccgcccaggactag

SEQ ID NO: 101235 - DNA, 429 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagaccagcgcctgcagataccccagccacagcagcagcagagtgctgctgaaggacagacacccccccgcccccagcccccagaacccccaggaccccagccccgacaccagcccccccacctgccccttcaagaccgccagcttcggctacctggacagaagccccagcgcctgcaagagagacgcccagaaggagagcgtgcagggcgccgcccaggacgtggccggcgtggccgcctgcctgcccctggcccagagcacccccttccccggctag

SEQ ID NO: 101236 - DNA, 2154 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaaagagcttcgagttcgaggacgccagcagcctgcagagcctgtaccccagcagccccaccgagaacggcaccgagaaccagcccaagttcggcagcaagagcaccctggaggagaacgcctacgaggacatcgtgggcgacctgcccaaggagaacccctacgaggacgtggacctgaagagcagaagagccggcagaaagagccagcagctgagcgagaacagcctggacagcctgcacagaatgtggagcccccaggacagaaagtacaacagcccccccacccagctgagcctgaagcccaacagccagagcctgagaagcggcaactggagcgagagaaagagccacagactgcccagactgcccaagagacacagccacgacgacatgctgctgctggcccagctgagcctgcccagcagccccagcagcctgaacgaggacagcctgagcaccaccagcgagctgctgagcagcagaagagccagaagaatccccaagctggtgcagagaatcaacagcatctacaacgccaagagaggcaagaagagactgaagaagctgagcatgagcagcatcgagaccgccagcctgagagacgagaacagcgagagcgagagcgacagcgacgacagattcaaggcccacacccagagactggtgcacatccagagcatgctgaagagagcccccagctacagaaccctggagctggagctgctggagtggcaggagagagagctgttcgagtacttcgtggtggtgagcctgaagaagaagcccagcagaaacacctacctgcccgaggtgagctaccagttccccaagctggacagacccaccaagcagatgagagaggccgaggagagactgaaggccatcccccagttctgcttccccgacgccaaggactggctgcccgtgagcgagtacagcagcgagaccttcagcttcatgctgaccggcgaggacggcagcagaagattcggctactgcagaagactgctgcccagcggcaagggccccagactgcccgaggtgtactgcgtgatcagcagactgggctgcttcggcctgttcagcaaggtgctggacgaggtggagagaagaagaggcatcagcgccgccctggtgtaccccttcatgagaagcctgatggagagccccttccccgcccccggcaagaccatcaaggtgaagaccttcctgcccggcgccggcaacgaggtgctggagctgagaagacccatggacagcagactggagcacgtggacttcgagtgcctgttcacctgcctgagcgtgagacagctgatcagaatcttcgccagcctgctgctggagagaagagtgatcttcgtggccgacaagctgagcaccctgagcagctgcagccacgccgtggtggccctgctgtaccccttcagctggcagcacaccttcatccccgtgctgcccgccagcatgatcgacatcgtgtgctgccccacccccttcctggtgggcctgctgagcagcagcctgcccaagctgaaggagctgcccgtggaggaggccctgatggtgaacctgggcagcgacagattcatcagacagatggacgacgaggacaccctgctgcccagaaagctgcaggccgccctggagcaggccctggagagaaagaacgagctgatcagccaggacagcgacagcgacagcgacgacgagtgcaacaccctgaacggcctggtgagcgaggtgttcatcagattcttcgtggagaccgtgggccactacagcctgttcctgacccagagcgagaagggcgagagagccttccagagagaggccttcagaaagagcgtggccagcaagagcatcagaagattcctggaggtgttcatggagagccagatgttcgccggcttcatccaggacagagagctgagaaagtgcagagccaagggcctgttcgagcagagagtggagcagtacctggaggagctgcccgacaccgagcagagcggcatgaacaagttcctgagaggcctgggcaacaagatgaagttcctgcacaagaagaactag

SEQ ID NO: 101237 - DNA, 159 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagacctag

SEQ ID NO: 101238 - DNA, 336 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagaccagcgcctgcagataccccagccacagcagcagcagagtgctgctgaaggacagacacccccccgcccccagcccccagaacccccaggaccccagccccgacaccagcccccccacctgccccttcaagaccgccagcttcggctacctggacagaagccccagcgcctgcaagagatag

SEQ ID NO: 101239 - DNA, 162 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagaccagctag

SEQ ID NO: 101240 - DNA, 252 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagaccagcgcctgcagataccccagccacagcagcagcagagtgctgctgaaggacagacacccccccgcccccagcccccagaacccccaggacccctag

SEQ ID NO: 101241 - DNA, 288 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagaccagcgcctgcagataccccagccacagcagcagcagagtgctgctgaaggacagacacccccccgcccccagcccccagaacccccaggaccccagccccgacaccagcccccccacctgccccttcaagtag

SEQ ID NO: 101242 - DNA, 465 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagaccagcgcctgcagataccccagccacagcagcagcagagtgctgctgaaggacagacacccccccgcccccagcccccagaacccccaggaccccagccccgacaccagcccccccacctgccccttcaagaccgccagcttcggctacctggacagaagccccagcgcctgcaagagagacgcccagaaggagagcgtgcagggcgccgcccaggacgtggccggcgtggccgcctgcctgcccctggcccagagcacccccttccccggccccgccgccggccccagaggcgtgctgctgaccagatag

SEQ ID NO: 101243 - DNA, 540 bp, Artificial Sequence
  Description of Artificial Sequence: Synthetic coding sequence
atgtggagcccccaggacagaaagtacaacagcccccccacccagctgagcctgaagcccaacagccagagcctgagaagcggcaactggagcgagagaaagagccacagactgcccagactgcccaagagacacagccacgacgacatgctgctgctggcccagctgagcctgcccagcagccccagcagcctgaacgaggacagcctgagcaccaccagcgagctgctgagcagcagaagagccagaagaatccccaagctggtgcagagaatcaacagcatctacaacgccaagagaggcaagaagagactgaagaagctgagcatgagcagcatcgagaccgccagcctgagagacgagaacagcgagagcgagagcgacagcgacgacagattcaaggcccacacccagagactggtgcacatccagagcatgctgaagagagcccccagctacagaaccctggagctggagctgctggagtggcaggagagagagctgttcgagtacttcgtggtggtgagcctgaagaagtag

SEQ ID NO: 101244 - DNA, 2154 bp, Artificial Sequence; identical to SEQ ID NO: 101236
  Description of Artificial Sequence: Synthetic coding sequence

SEQ ID NO: 101245 - DNA, 411 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaaagagcttcgagttcgaggacgccagcagcctgcagagcctgtaccccagcagccccaccgagaacggcaccgagaaccagcccaagttcggcagcaagagcaccctggaggagaacgcctacgaggacatcgtgggcgacctgcccaaggagaacccctacgaggacgtggacctgaagagcagaagagccggcagaaagagccagcagctgagcgagaacagcctggacagcctgcacagaatgtggagcccccaggacagaaagtacaacagcccccccacccagctgagcctgaagcccaacagccagagcctgagaagcggctag

SEQ ID NO: 101246 - DNA, 225 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagaccagcgcctgcagataccccagccacagcagcagcagagtgctgctgaaggacagacacccccccgcctag

SEQ ID NO: 101247 - DNA, 420 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagaccagcgcctgcagataccccagccacagcagcagcagagtgctgctgaaggacagacacccccccgcccccagcccccagaacccccaggaccccagccccgacaccagcccccccacctgccccttcaagaccgccagcttcggctacctggacagaagccccagcgcctgcaagagagacgcccagaaggagagcgtgcagggcgccgcccaggacgtggccggcgtggccgcctgcctgcccctggcccagagcaccccctag

SEQ ID NO: 101248 - DNA, 1830 bp, Artificial Sequence
  Description of Artificial Sequence: Synthetic coding sequence
atgtggagcccccaggacagaaagtacaacagcccccccacccagctgagcctgaagcccaacagccagagcctgagaagcggcaactggagcgagagaaagagccacagactgcccagactgcccaagagacacagccacgacgacatgctgctgctggcccagctgagcctgcccagcagccccagcagcctgaacgaggacagcctgagcaccaccagcgagctgctgagcagcagaagagccagaagaatccccaagctggtgcagagaatcaacagcatctacaacgccaagagaggcaagaagagactgaagaagctgagcatgagcagcatcgagaccgccagcctgagagacgagaacagcgagagcgagagcgacagcgacgacagattcaaggcccacacccagagactggtgcacatccagagcatgctgaagagagcccccagctacagaaccctggagctggagctgctggagtggcaggagagagagctgttcgagtacttcgtggtggtgagcctgaagaagaagcccagcagaaacacctacctgcccgaggtgagctaccagttccccaagctggacagacccaccaagcagatgagagaggccgaggagagactgaaggccatcccccagttctgcttccccgacgccaaggactggctgcccgtgagcgagtacagcagcgagaccttcagcttcatgctgaccggcgaggacggcagcagaagattcggctactgcagaagactgctgcccagcggcaagggccccagactgcccgaggtgtactgcgtgatcagcagactgggctgcttcggcctgttcagcaaggtgctggacgaggtggagagaagaagaggcatcagcgccgccctggtgtaccccttcatgagaagcctgatggagagccccttccccgcccccggcaagaccatcaaggtgaagaccttcctgcccggcgccggcaacgaggtgctggagctgagaagacccatggacagcagactggagcacgtggacttcgagtgcctgttcacctgcctgagcgtgagacagctgatcagaatcttcgccagcctgctgctggagagaagagtgatcttcgtggccgacaagctgagcaccctgagcagctgcagccacgccgtggtggccctgctgtaccccttcagctggcagcacaccttcatccccgtgctgcccgccagcatgatcgacatcgtgtgctgccccacccccttcctggtgggcctgctgagcagcagcctgcccaagctgaaggagctgcccgtggaggaggccctgatggtgaacctgggcagcgacagattcatcagacagatggacgacgaggacaccctgctgcccagaaagctgcaggccgccctggagcaggccctggagagaaagaacgagctgatcagccaggacagcgacagcgacagcgacgacgagtgcaacaccctgaacggcctggtgagcgaggtgttcatcagattcttcgtggagaccgtgggccactacagcctgttcctgacccagagcgagaagggcgagagagccttccagagagaggccttcagaaagagcgtggccagcaagagcatcagaagattcctggaggtgttcatggagagccagatgttcgccggcttcatccaggacagagagctgagaaagtgcagagccaagggcctgttcgagcagagagtggagcagtacctggaggagctgcccgacaccgagcagagcggcatgaacaagttcctgagaggcctgggcaacaagatgaagttcctgcacaagaagaactag

SEQ ID NO: 101249 - DNA, 234 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaaagagcttcgagttcgaggacgccagcagcctgcagagcctgtaccccagcagccccaccgagaacggcaccgagaaccagcccaagttcggcagcaagagcaccctggaggagaacgcctacgaggacatcgtgggcgacctgcccaagtag

SEQ ID NO: 101250 - DNA, 81 bp, Artificial Sequence
  Description of Artificial Sequence: Synthetic coding sequence
atgaccatgaccgccaacaagaacagcagcatcacccacggcgccggcggcaccaaggcccccagaggcaccctgagctag

SEQ ID NO: 101251 - DNA, 1035 bp, Artificial Sequence
  Description of Artificial Sequence: Synthetic coding sequence
atgtggagcccccaggacagaaagtacaacagcccccccacccagctgagcctgaagcccaacagccagagcctgagaagcggcaactggagcgagagaaagagccacagactgcccagactgcccaagagacacagccacgacgacatgctgctgctggcccagctgagcctgcccagcagccccagcagcctgaacgaggacagcctgagcaccaccagcgagctgctgagcagcagaagagccagaagaatccccaagctggtgcagagaatcaacagcatctacaacgccaagagaggcaagaagagactgaagaagctgagcatgagcagcatcgagaccgccagcctgagagacgagaacagcgagagcgagagcgacagcgacgacagattcaaggcccacacccagagactggtgcacatccagagcatgctgaagagagcccccagctacagaaccctggagctggagctgctggagtggcaggagagagagctgttcgagtacttcgtggtggtgagcctgaagaagaagcccagcagaaacacctacctgcccgaggtgagctaccagttccccaagctggacagacccaccaagcagatgagagaggccgaggagagactgaaggccatcccccagttctgcttccccgacgccaaggactggctgcccgtgagcgagtacagcagcgagaccttcagcttcatgctgaccggcgaggacggcagcagaagattcggctactgcagaagactgctgcccagcggcaagggccccagactgcccgaggtgtactgcgtgatcagcagactgggctgcttcggcctgttcagcaaggtgctggacgaggtggagagaagaagaggcatcagcgccgccctggtgtaccccttcatgagaagcctgatggagagccccttccccgcccccggcaagaccatcaaggtgaagaccttcctgcccggcgccggcaacgaggtgctggagctgagaagacccatggacagcagactggagcacgtgtag

SEQ ID NO: 101252 - DNA, 231 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaaagagcttcgagttcgaggacgccagcagcctgcagagcctgtaccccagcagccccaccgagaacggcaccgagaaccagcccaagttcggcagcaagagcaccctggaggagaacgcctacgaggacatcgtgggcgacctgccctag

SEQ ID NO: 101253 - DNA, 225 bp, Artificial Sequence; identical to SEQ ID NO: 101246
  Description of Artificial Sequence: Synthetic coding sequence

SEQ ID NO: 101254 - DNA, 435 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagaccagcgcctgcagataccccagccacagcagcagcagagtgctgctgaaggacagacacccccccgcccccagcccccagaacccccaggaccccagccccgacaccagcccccccacctgccccttcaagaccgccagcttcggctacctggacagaagccccagcgcctgcaagagagacgcccagaaggagagcgtgcagggcgccgcccaggacgtggccggcgtggccgcctgcctgcccctggcccagagcacccccttccccggccccgcctag

SEQ ID NO: 101255 - DNA, 3414 bp, Artificial Sequence; identical to SEQ ID NO: 101227
  Description of Artificial Sequence: Synthetic coding sequence

SEQ ID NO: 101256 - DNA, 369 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagcgtgagccccccccccgtgctgagcccccccagaagccccatctaccccctgagcgacagcgagaccagcgcctgcagataccccagccacagcagcagcagagtgctgctgaaggacagacacccccccgcccccagcccccagaacccccaggaccccagccccgacaccagcccccccacctgccccttcaagaccgccagcttcggctacctggacagaagccccagcgcctgcaagagagacgcccagaaggagagcgtgcagggcgccgcctag

SEQ ID NO: 101257 - DNA, 93 bp, Artificial Sequence
  Description of Artificial Sequence: Synthetic coding sequence
atgaccatgaccgccaacaagaacagcagcatcacccacggcgccggcggcaccaaggcccccagaggcaccctgagcagaagccagagctag

SEQ ID NO: 101258 - DNA, 1758 bp, Artificial Sequence
  Description of Artificial Sequence: Synthetic coding sequence
atggccgaggccgccaccggcttcctggagcagctgaagagctgcatcgtgtggagctggacctacctgtggaccgtgtggttcttcatcgtgctgttcctggtgtacatcctgagagtgcccctgaagatcaacgacaacctgagcaccgtgagcatgttcctgaacaccctgacccccaagttctacgtggccctgaccggcaccagcagcctgatcagcggcctgatcctgatcttcgagtggtggtacttcagaaagtacggcaccagcttcatcgagcaggtgagcgtgagccacctgagacccctgctgggcggcgtggacaacaacagcagcaacaacagcaacagcagcaacggcgacagcgacagcaacagacagagcgtgagcgagtgcaaggtgtggagaaaccccctgaacctgttcagaggcgccgagtacaacagatacacctgggtgaccggcagagagcccctgacctactacgacatgaacctgagcgcccaggaccaccagaccttcttcacctgcgacagcgaccacctgagacccgccgacgccatcatgcagaaggcctggagagagagaaacccccaggccagaatcagcgccgcccacgaggccctggagatcaacgagatcagaagcagagtggaggtgcccctgatcgccagcagcaccatctgggagatcaagctgctgcccaagtgcgccaccgcctacatcctgctggccgaggaggaggccaccaccatcgccgaggccgagaagctgttcaagcaggccctgaaggccggcgacggctgctacagaagaagccagcagctgcagcaccacggcagccagtacgaggcccagcacagaagagacaccaacgtgctggtgtacatcaagagaagactggccatgtgcgccagaagactgggcagaaccagagaggccgtgaagatgatgagagacctgatgaaggagttccccctgctgagcatgttcaacatccacgagaacctgctggaggccctgctggagctgcaggcctacgccgacgtgcaggccgtgctggccaagtacgacgacatcagcctgcccaagagcgccaccatctgctacaccgccgccctgctgaaggccagagccgtgagcgacaagttcagccccgaggccgccagcagaagaggcctgagcaccgccgagatgaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctggcccactggaagagagtggagggcgccctgaacctgctgcactgcacctgggagggcaccttcagaatgatcccctaccccctggagaagggccacctgttctacccctaccccatctgcaccgagaccgccgacagagagctgctgcccagcttccacgaggtgagcgtgtaccccaagaaggagctgcccttcttcatcctgttcaccgccggcctgtgcagcttcaccgccatgctggccctgctgacccaccagttccccgagctgatgggcgtgttcgccaaggccatgatcgacatcttctgcagcgccgagttcagagactggaactgcaagagcatcttcatgagagtggaggacgagctggagatcccccccgccccccagagccagcacttccagaactag

SEQ ID NO: 101259 - DNA, 1500 bp, Artificial Sequence
  Description of Artificial Sequence: Synthetic coding sequence
atgagcatgttcctgaacaccctgacccccaagttctacgtggccctgaccggcaccagcagcctgatcagcggcctgatcctgatcttcgagtggtggtacttcagaaagtacggcaccagcttcatcgagcaggtgagcgtgagccacctgagacccctgctgggcggcgtggacaacaacagcagcaacaacagcaacagcagcaacggcgacagcgacagcaacagacagagcgtgagcgagtgcaaggtgtggagaaaccccctgaacctgttcagaggcgccgagtacaacagatacacctgggtgaccggcagagagcccctgacctactacgacatgaacctgagcgcccaggaccaccagaccttcttcacctgcgacagcgaccacctgagacccgccgacgccatcatgcagaaggcctggagagagagaaacccccaggccagaatcagcgccgcccacgaggccctggagatcaacgagtgcgccaccgcctacatcctgctggccgaggaggaggccaccaccatcgccgaggccgagaagctgttcaagcaggccctgaaggccggcgacggctgctacagaagaagccagcagctgcagcaccacggcagccagtacgaggcccagcacagaagagacaccaacgtgctggtgtacatcaagagaagactggccatgtgcgccagaagactgggcagaaccagagaggccgtgaagatgatgagagacctgatgaaggagttccccctgctgagcatgttcaacatccacgagaacctgctggaggccctgctggagctgcaggcctacgccgacgtgcaggccgtgctggccaagtacgacgacatcagcctgcccaagagcgccaccatctgctacaccgccgccctgctgaaggccagagccgtgagcgacaagttcagccccgaggccgccagcagaagaggcctgagcaccgccgagatgaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctggcccactggaagagagtggagggcgccctgaacctgctgcacagcttcagaatgatcccctaccccctggagaagggccacctgttctacccctaccccatctgcaccgagaccgccgacagagagctgctgcccagcttccacgaggtgagcgtgtaccccaagaaggagctgcccttcttcatcctgttcaccgccggcctgtgcagcttcaccgccatgctggccctgctgacccaccagttccccgagctgatgggcgtgttcgccaaggccttcctgagcaccctgttcgcccccctgaacttcgtgatggagaaggtggagagcatcctgcccagcagcctgtggcaccagctgaccagaatctag

SEQ ID NO: 101260 - DNA, 1536 bp, Artificial Sequence
  Description of Artificial Sequence: Synthetic coding sequence
atgttcggcaccgagagcagcctgagcatgttcctgaacaccctgacccccaagttctacgtggccctgaccggcaccagcagcctgatcagcggcctgatcctgatcttcgagtggtggtacttcagaaagtacggcaccagcttcatcgagcaggtgagcgtgagccacctgagacccctgctgggcggcgtggacaacaacagcagcaacaacagcaacagcagcaacggcgacagcgacagcaacagacagagcgtgagcgagtgcaaggtgtggagaaaccccctgaacctgttcagaggcgccgagtacaacagatacacctgggtgaccggcagagagcccctgacctactacgacatgaacctgagcgcccaggaccaccagaccttcttcacctgcgacagcgaccacctgagacccgccgacgccatcatgcagaaggcctggagagagagaaacccccaggccagaatcagcgccgcccacgaggccctggagatcaacgagtgcgccaccgcctacatcctgctggccgaggaggaggccaccaccatcgccgaggccgagaagctgttcaagcaggccctgaaggccggcgacggctgctacagaagaagccagcagctgcagcaccacggcagccagtacgaggcccagcacagaagagacaccaacgtgctggtgtacatcaagagaagactggccatgtgcgccagaagactgggcagaaccagagaggccgtgaagatgatgagagacctgatgaaggagttccccctgctgagcatgttcaacatccacgagaacctgctggaggccctgctggagctgcaggcctacgccgacgtgcaggccgtgctggccaagtacgacgacatcagcctgcccaagagcgccaccatctgctacaccgccgccctgctgaaggccagagccgtgagcgacaagttcagccccgaggccgccagcagaagaggcctgagcaccgccgagatgaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctggcccactggaagagagtggagggcgccctgaacctgctgcactgcacctgggagggcaccttcagaatgatcccctaccccctggagaagggccacctgttctacccctaccccatctgcaccgagaccgccgacagagagctgctgcccagcttccacgaggtgagcgtgtaccccaagaaggagctgcccttcttcatcctgttcaccgccggcctgtgcagcttcaccgccatgctggccctgctgacccaccagttccccgagctgatgggcgtgttcgccaaggccttcctgagcaccctgttcgcccccctgaacttcgtgatggagaaggtggagagcatcctgcccagcagcctgtggcaccagctgaccagaatctag

SEQ ID NO: 101261 - DNA, 1605 bp, Artificial Sequence
  Description of Artificial Sequence: Synthetic coding sequence
atgttcggcaccgagagcagcctgagcatgttcctgaacaccctgacccccaagttctacgtggccctgaccggcaccagcagcctgatcagcggcctgatcctgatcttcgagtggtggtacttcagaaagtacggcaccagcttcatcgagcaggtgagcgtgagccacctgagacccctgctgggcggcgtggacaacaacagcagcaacaacagcaacagcagcaacggcgacagcgacagcaacagacagagcgtgagcgagtgcaaggtgtggagaaaccccctgaacctgttcagaggcgccgagtacaacagatacacctgggtgaccggcagagagcccctgacctactacgacatgaacctgagcgcccaggaccaccagaccttcttcacctgcgacagcgaccacctgagacccgccgacgccatcatgcagaaggcctggagagagagaaacccccaggccagaatcagcgccgcccacgaggccctggagatcaacgagatcagaagcagagtggaggtgcccctgatcgccagcagcaccatctgggagatcaagctgctgcccaagtgcgccaccgcctacatcctgctggccgaggaggaggccaccaccatcgccgaggccgagaagctgttcaagcaggccctgaaggccggcgacggctgctacagaagaagccagcagctgcagcaccacggcagccagtacgaggcccagcacagaagagacaccaacgtgctggtgtacatcaagagaagactggccatgtgcgccagaagactgggcagaaccagagaggccgtgaagatgatgagagacctgatgaaggagttccccctgctgagcatgttcaacatccacgagaacctgctggaggccctgctggagctgcaggcctacgccgacgtgcaggccgtgctggccaagtacgacgacatcagcctgcccaagagcgccaccatctgctacaccgccgccctgctgaaggccagagccgtgagcgacaagttcagccccgaggccgccagcagaagaggcctgagcaccgccgagatgaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctggcccactggaagagagtggagggcgccctgaacctgctgcactgcacctgggagggcaccttcagaatgatcccctaccccctggagaagggccacctgttctacccctaccccatctgcaccgagaccgccgacagagagctgctgcccagcttccacgaggtgagcgtgtaccccaagaaggagctgcccttcttcatcctgttcaccgccggcctgtgcagcttcaccgccatgctggccctgctgacccaccagttccccgagctgatgggcgtgttcgccaaggccttcctgagcaccctgttcgcccccctgaacttcgtgatggagaaggtggagagcatcctgcccagcagcctgtggcaccagctgaccagaatctag

SEQ ID NO: 101262 - DNA, 1665 bp, Artificial Sequence
  Description of Artificial Sequence: Synthetic coding sequence
atggccgaggccgccaccggcttcctggagcagctgaagagctgcatcgtgtggagctggacctacctgtggaccgtgtggttcttcatcgtgctgttcctggtgtacatcctgagagtgcccctgaagatcaacgacaacctgagcaccgtgagcatgttcctgaacaccctgacccccaagttctacgtggccctgaccggcaccagcagcctgatcagcggcctgatcctgatcttcgagtggtggtacttcagaaagtacggcaccagcttcatcgagcaggtgagcgtgagccacctgagacccctgctgggcggcgtggacaacaacagcagcaacaacagcaacagcagcaacggcgacagcgacagcaacagacagagcgtgagcgagtgcaaggtgtggagaaaccccctgaacctgttcagaggcgccgagtacaacagatacacctgggtgaccggcagagagcccctgacctactacgacatgaacctgagcgcccaggaccaccagaccttcttcacctgcgacagcgaccacctgagacccgccgacgccatcatgcagaaggcctggagagagagaaacccccaggccagaatcagcgccgcccacgaggccctggagatcaacgagtgcgccaccgcctacatcctgctggccgaggaggaggccaccaccatcgccgaggccgagaagctgttcaagcaggccctgaaggccggcgacggctgctacagaagaagccagcagctgcagcaccacggcagccagtacgaggcccagcacagaagagacaccaacgtgctggtgtacatcaagagaagactggccatgtgcgccagaagactgggcagaaccagagaggccgtgaagatgatgagagacctgatgaaggagttccccctgctgagcatgttcaacatccacgagaacctgctggaggccctgctggagctgcaggcctacgccgacgtgcaggccgtgctggccaagtacgacgacatcagcctgcccaagagcgccaccatctgctacaccgccgccctgctgaaggccagagccgtgagcgacaagttcagccccgaggccgccagcagaagaggcctgagcaccgccgagatgaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctggcccactggaagagagtggagggcgccctgaacctgctgcactgcacctgggagggcaccttcagaatgatcccctaccccctggagaagggccacctgttctacccctaccccatctgcaccgagaccgccgacagagagctgctgcccagcttccacgaggtgagcgtgtaccccaagaaggagctgcccttcttcatcctgttcaccgccggcctgtgcagcttcaccgccatgctggccctgctgacccaccagttccccgagctgatgggcgtgttcgccaaggccttcctgagcaccctgttcgcccccctgaacttcgtgatggagaaggtggagagcatcctgcccagcagcctgtggcaccagctgaccagaatctag

SEQ ID NO: 101263 - DNA, 189 bp, Artificial Sequence
  Description of Artificial Sequence: Synthetic coding sequence
atgagcatgttcctgaacaccctgacccccaagttctacgtggccctgaccggcaccagcagcctgatcagcggcctgatcctgatcttcgagtggtggtacttcagaaagtacggcaccagcttcatcgagcaggtgagcgtgagccacctgagacccctgctgggcggcgtggacaacaacagctag

SEQ ID NO: 101264 - DNA, 264 bp, Artificial Sequence
  Description of Artificial Sequence: Synthetic coding sequence
atgagcatgttcctgaacaccctgacccccaagttctacgtggccctgaccggcaccagcagcctgatcagcggcctgatcctgatcttcgagtggtggtacttcagaaagtacggcaccagcttcatcgagcaggtgagcgtgagccacctgagacccctgctgggcggcgtggacaacaacagcagcaacaacagcaacagcagcaacggcgacagcgacagcaacagacagagcgtgagcgagtgcaaggtgtggagatag

SEQ ID NO: 101265 - DNA, 1323 bp, Artificial Sequence
  Description of Artificial Sequence: Synthetic coding sequence
atggccgagaacaacgagaacatcagcaagaacgtggacgtgagacccaagaccagcagaagcagaagcgccgacagaaaggacggctacgtgtggagcggcaagaagctgagctggagcaagaagagcgagagctacagcgacgccgagaccgtgaacggcatcgagaagaccgaggtgagcctgagaaaccaggagagaaagcacagctgcagcagcatcgagctggacctggaccacagctgcggccacagattcctgggcagaagcctgaagcagaagctgcaggacgccgtgggccagtgcttccccatcaagaactgcagcagcagacacagcagcggcctgcccagcaagagaaagatccacatcagcgagctgatgctggacaagtgccccttcccccccagaagcgacctggccttcagatggcacttcatcaagagacacaccgcccccatcaacagcaagagcgacgagtgggtgagcaccgacctgagccagaccgagctgagagacggccagctgaagagaagaaacatggaggagaacatcaactgcttcagccacaccaacgtgcagccctgcgtgatcaccaccgacaacgccctgtgcagagagggccccatgaccggcagcgtgatgaacctggtgagcaacaacagcatcgaggacagcgacatggacagcgacgacgagatcctgaccctgtgcaccagcagcagaaagagaaacaagcccaagtgggacctggacgacgagatcctgcagctggagaccccccccaagtaccacacccagatcgactacgtgcactgcctggtgcccgacctgctgcagatcaacaacaacccctgctactggggcgtgatggacaagtacgccgccgaggccctgctggagggcaagcccgagggcaccttcctgctgagagacagcgcccaggaggactacctgttcagcgtgagcttcagaagatacagcagaagcctgcacgccagaatcgagcagtggaaccacaacttcagcttcgacgcccacgacccctgcgtgttccacagccccgacatcaccggcctgctggagcactacaaggaccccagcgcctgcatgttcttcgagcccctgctgagcacccccctgatcagaaccttccccttcagcctgcagcacatctgcagaaccgtgatctgcaactgcaccacctacgacggcatcgacgccctgcccatccccagcagcatgaagctgtacctgaaggagtaccactacaagagcaaggtgagagtgctgagaatcgacgcccccgagcagcagtgctag

SEQ ID NO: 101266 - DNA, 1323 bp, Artificial Sequence; identical to SEQ ID NO: 101265
  Description of Artificial Sequence: Synthetic coding sequence

SEQ ID NO: 101267 - DNA, 1323 bp, Artificial Sequence; identical to SEQ ID NO: 101265
  Description of Artificial Sequence: Synthetic coding sequence

SEQ ID NO: 101268 - DNA, 1611 bp, Artificial Sequence
  Description of Artificial Sequence: Synthetic coding sequence
atggacaaggtgggcaagatgtggaacaacttcaagtacagatgccagaacctgttcggccacgagggcggcagcagaagcgagaacgtggacatgaacagcaacagatgcctgagcgtgaaggagaagaacatcagcatcggcgacagcaccccccagcagcagagcagccccctgagagagaacatcgccctgcagctgggcctgagccccagcaagaacagcagcagaagaaaccagaactgcgccaccgagatcccccagatcgtggagatcagcatcgagaaggacaacgacagctgcgtgacccccggcaccagactggccagaagagacagctacagcagacacgccccctggggcggcaagaagaagcacagctgcagcaccaagacccagagcagcctggacgccgacaagaagttcggcagaaccagaagcggcctgcagagaagagagagaagatacggcgtgagcagcgtgcacgacatggacagcgtgagcagcagaaccgtgggcagcagaagcctgagacagagactgcaggacaccgtgggcctgtgcttccccatgagaacctacagcaagcagagcaagcccctgttcagcaacaagagaaagatccacctgagcgagctgatgctggagaagtgccccttccccgccggcagcgacctggcccagaagtggcacctgatcaagcagcacaccgcccccgtgagcccccacagcaccttcttcgacaccttcgaccccagcctggtgagcaccgaggacgaggaggacagactgagagagagaagaagactgagcatcgaggagggcgtggaccccccccccaacgcccagatccacaccttcgaggccaccgcccaggtgaaccccctgtacaagctgggccccaagctggcccccggcatgaccgagatcagcggcgacagcagcgccatcccccaggccaactgcgacagcgaggaggacaccaccaccctgtgcctgcagagcagaagacagaagcagagacagatcagcggcgacagccacacccacgtgagcagacagggcgcctggaaggtgcacacccagatcgactacatccactgcctggtgcccgacctgctgcagatcaccggcaacccctgctactggggcgtgatggacagatacgaggccgaggccctgctggagggcaagcccgagggcaccttcctgctgagagacagcgcccaggaggactacctgttcagcgtgagcttcagaagatacaacagaagcctgcacgccagaatcgagcagtggaaccacaacttcagcttcgacgcccacgacccctgcgtgttccacagcagcaccgtgaccggcctgctggagcactacaaggaccccagcagctgcatgttcttcgagcccctgctgaccatcagcctgaacagaaccttccccttcagcctgcagtacatctgcagagccgtgatctgcagatgcaccacctacgacggcatcgacggcctgcccctgcccagcatgctgcaggacttcctgaaggagtaccactacaagcagaaggtgagagtgagatggctggagagagagcccgtgaaggccaagtag

SEQ ID NO: 101269 - DNA, 1611 bp, Artificial Sequence; identical to SEQ ID NO: 101268
  Description of Artificial Sequence: Synthetic coding sequence

SEQ ID NO: 101270 - DNA, 3264 bp, Artificial Sequence
  Description of Artificial Sequence: Synthetic coding sequence
atgagcgacagcgaggacagcaacttcagcgaggaggaggacagcgagagaagcagcgacggcgaggaggccgaggtggacgaggagagaagaagcgccgccggcagcgagaaggaggaggagcccgaggacgaggaggaggaggaggaggaggaggagtacgacgaggaggaggaggaggaggacgacgacagaccccccaagaagcccagacacggcggcttcatcctggacgaggccgacgtggacgacgagtacgaggacgaggaccagtgggaggacggcgccgaggacatcctggagaaggaggagatcgaggccagcaacatcgacaacgtggtgctggacgaggacagaagcggcgccagaagactgcagaacctgtggagagaccagagagaggaggagctgggcgagtactacatgaagaagtacgccaagagcagcgtgggcgagaccgtgtacggcggcagcgacgagctgagcgacgacatcacccagcagcagctgctgcccggcgtgaaggaccccaacctgtggaccgtgaagtgcaagatcggcgaggagagagccaccgccatcagcctgatgagaaagttcatcgcctaccagttcaccgacacccccctgcagatcaagagcgtggtggcccccgagcacgtgaagggctacatctacgtggaggcctacaagcagacccacgtgaagcaggccatcgagggcgtgggcaacctgagactgggctactggaaccagcagatggtgcccatcaaggagatgaccgacgtgctgaaggtggtgaaggaggtggccaacctgaagcccaagagctgggtgagactgaagagaggcatctacaaggacgacatcgcccaggtggactacgtggagcccagccagaacaccatcagcctgaagatgatccccagaatcgactacgacagaatcaaggccagaatgagcctgaaggactggttcgccaagagaaagaagttcaagagacccccccagagactgttcgacgccgagaagatcagaagcctgggcggcgacgtggccagcgacggcgacttcctgatcttcgagggcaacagatacagcagaaagggcttcctgttcaagagcttcgccatgagcgccgtgatcaccgagggcgtgaagcccaccctgagcgagctggagaagttcgaggaccagcccgagggcatcgacctggaggtggtgaccgagagcaccggcaaggagagagagcacaacttccagcccggcgacaacgtggaggtgtgcgagggcgagctgatcaacctgcagggcaagatcctgagcgtggacggcaacaagatcaccatcatgcccaagcacgaggacctgaaggacatgctggagttccccgcccaggagctgagaaagtacttcaagatgggcgaccacgtgaaggtgatcgccggcagattcgagggcgacaccggcctgatcgtgagagtggaggagaacttcgtgatcctgttcagcgacctgaccatgcacgagctgaaggtgctgcccagagacctgcagctgtgcagcgagaccgccagcggcgtggacgtgggcggccagcacgagtggggcgagctggtgcagctggacccccagaccgtgggcgtgatcgtgagactggagagagagaccttccaggtgctgaacatgtacggcaaggtggtgaccgtgagacaccaggccgtgaccagaaagaaggacaacagattcgccgtggccctggacagcgagcagaacaacatccacgtgaaggacatcgtgaaggtgatcgacggcccccacagcggcagagagggcgagatcagacacctgttcagaagcttcgccttcctgcactgcaagaagctggtggagaacggcggcatgttcgtgtgcaagaccagacacctggtgctggccggcggcagcaagcccagagacgtgaccaacttcaccgtgggcggcttcgcccccatgagccccagaatcagcagccccatgcaccccagcgccggcggccagagaggcggcttcggcagccccggcggcggcagcggcggcatgagcagaggcagaggcagaagagacaacgagctgatcggccagaccgtgagaatcagccagggcccctacaagggctacatcggcgtggtgaaggacgccaccgagagcaccgccagagtggagctgcacagcacctgccagaccatcagcgtggacagacagagactgaccaccgtgggcagcagaagacccggcggcatgaccagcacctacggcagaacccccatgtacggcagccagacccccatgtacggcagcggcagcagaacccccatgtacggcagccagacccccctgcaggacggcagcagaaccccccactacggcagccagacccccctgcacgacggcagcagaacccccgcccagagcggcgcctgggaccccaacaaccccaacacccccagcagagccgaggaggagtacgagtacgccttcgacgacgagcccacccccagcccccaggcctacggcggcacccccaacccccagacccccggctaccccgaccccagcagcccccaggtgaacccccagtacaacccccagacccccggcacccccgccatgtacaacaccgaccagttcagcccctacgccgcccccagcccccagggcagctaccagcccagccccagcccccagagctaccaccaggtggcccccagccccgccggctaccagaacacccacagccccgccagctaccaccccacccccagccccatggcctaccaggccagccccagccccagccccgtgggctacagccccatgacccccggcgcccccagccccggcggctacaacccccacacccccggcagcggcatcgagcagaacagcagcgactgggtgaccaccgacatccaggtgaaggtgagagacacctacctggacacccaggtggtgggccagaccggcgtgatcagaagcgtgaccggcggcatgtgcagcgtgtacctgaaggacagcgagaaggtggtgagcatcagcagcgagcacctggagcccatcacccccaccaagaacaacaaggtgaaggtgatcctgggcgaggacagagaggccaccggcgtgctgctgagcatcgacggcgaggacggcatcgtgagaatggacctggacgagcagctgaagatcctgaacctgagattcctgggcaagctgctggaggcctag

SEQ ID NO: 101271 - DNA, 3198 bp, Artificial Sequence
  Description of Artificial Sequence: Synthetic coding sequence
atgagcgacagcgaggacagcaacttcagcgaggaggaggacagcgagagaagcagcgacggcgaggaggccgaggtggacgaggagagaagaagcgccgccggcagcgagaaggaggacgacgacagaccccccaagaagcccagacacggcggcttcatcctggacgaggccgacgtggacgacgagtacgaggacgaggaccagtgggaggacggcgccgaggacatcctggagaaggaggagatcgaggccagcaacatcgacaacgtggtgctggacgaggacagaagcggcgccagaagactgcagaacctgtggagagaccagagagaggaggagctgggcgagtactacatgaagaagtacgccaagagcagcgtgggcgagaccgtgtacggcggcagcgacgagctgagcgacgacatcacccagcagcagctgctgcccggcgtgaaggaccccaacctgtggaccgtgaagtgcaagatcggcgaggagagagccaccgccatcagcctgatgagaaagttcatcgcctaccagttcaccgacacccccctgcagatcaagagcgtggtggcccccgagcacgtgaagggctacatctacgtggaggcctacaagcagacccacgtgaagcaggccatcgagggcgtgggcaacctgagactgggctactggaaccagcagatggtgcccatcaaggagatgaccgacgtgctgaaggtggtgaaggaggtggccaacctgaagcccaagagctgggtgagactgaagagaggcatctacaaggacgacatcgcccaggtggactacgtggagcccagccagaacaccatcagcctgaagatgatccccagaatcgactacgacagaatcaaggccagaatgagcctgaaggactggttcgccaagagaaagaagttcaagagacccccccagagactgttcgacgccgagaagatcagaagcctgggcggcgacgtggccagcgacggcgacttcctgatcttcgagggcaacagatacagcagaaagggcttcctgttcaagagcttcgccatgagcgccgtgatcaccgagggcgtgaagcccaccctgagcgagctggagaagttcgaggaccagcccgagggcatcgacctggaggtggtgaccgagagcaccggcaaggagagagagcacaacttccagcccggcgacaacgtggaggtgtgcgagggcgagctgatcaacctgcagggcaagatcctgagcgtggacggcaacaagatcaccatcatgcccaagcacgaggacctgaaggacatgctggagttccccgcccaggagctgagaaagtacttcaagatgggcgaccacgtgaaggtgatcgccggcagattcgagggcgacaccggcctgatcgtgagagtggaggagaacttcgtgatcctgttcagcgacctgaccatgcacgagctgaaggtgctgcccagagacctgcagctgtgcagcgagaccgccagcggcgtggacgtgggcggccagcacgagtggggcgagctggtgcagctggacccccagaccgtgggcgtgatcgtgagactggagagagagaccttccaggtgctgaacatgtacggcaaggtggtgaccgtgagacaccaggccgtgaccagaaagaaggacaacagattcgccgtggccctggacagcgagcagaacaacatccacgtgaaggacatcgtgaaggtgatcgacggcccccacagcggcagagagggcgagatcagacacctgttcagaagcttcgccttcctgcactgcaagaagctggtggagaacggcggcatgttcgtgtgcaagaccagacacctggtgctggccggcggcagcaagcccagagacgtgaccaacttcaccgtgggcggcttcgcccccatgagccccagaatcagcagccccatgcaccccagcgccggcggccagagaggcggcttcggcagccccggcggcggcagcggcggcatgagcagaggcagaggcagaagagacaacgagctgatcggccagaccgtgagaatcagccagggcccctacaagggctacatcggcgtggtgaaggacgccaccgagagcaccgccagagtggagctgcacagcacctgccagaccatcagcgtggacagacagagactgaccaccgtgggcagcagaagacccggcggcatgaccagcacctacggcagaacccccatgtacggcagccagacccccatgtacggcagcggcagcagaacccccatgtacggcagccagacccccctgcaggacggcagcagaaccccccactacggcagccagacccccctgcacgacggcagcagaacccccgcccagagcggcgcctgggaccccaacaaccccaacacccccagcagagccgaggaggagtacgagtacgccttcgacgacgagcccacccccagcccccaggcctacggcggcacccccaacccccagacccccggctaccccgaccccagcagcccccaggtgaacccccagtacaacccccagacccccggcacccccgccatgtacaacaccgaccagttcagcccctacgccgcccccagcccccagggcagctaccagcccagccccagcccccagagctaccaccaggtggcccccagccccgccggctaccagaacacccacagccccgccagctaccaccccacccccagccccatggcctaccaggccagccccagccccagccccgtgggctacagccccatgacccccggcgcccccagccccggcggctacaacccccacacccccggcagcggcatcgagcagaacagcagcgactgggtgaccaccgacatccaggtgaaggtgagagacacctacctggacacccaggtggtgggccagaccggcgtgatcagaagcgtgaccggcggcatgtgcagcgtgtacctgaaggacagcgagaaggtggtgagcatcagcagcgagcacctggagcccatcacccccaccaagaacaacaaggtgaaggtgatcctgggcgaggacagagaggccaccggcgtgctgctgagcatcgacggcgaggacggcatcgtgagaatggacctggacgagcagctgaagatcctgaacctgagattcctgggcaagctgctggaggcctag

SEQ ID NO: 101272 - DNA, 3252 bp, Artificial Sequence
  Description of Artificial Sequence: Synthetic coding sequence
atgagcgacagcgaggacagcaacttcagcgaggaggaggacagcgagagaagcagcgacggcgaggaggccgaggtggacgaggagagaagaagcgccgccggcagcgagaaggaggaggagcccgaggacgaggaggaggaggaggaggaggaggagtacgacgaggaggaggaggaggaggacgacgacagaccccccaagaagcccagacacggcggcttcatcctggacgaggccgacgtggacgacgagtacgaggacgaggaccagtgggaggacggcgccgaggacatcctggagaaggccagcaacatcgacaacgtggtgctggacgaggacagaagcggcgccagaagactgcagaacctgtggagagaccagagagaggaggagctgggcgagtactacatgaagaagtacgccaagagcagcgtgggcgagaccgtgtacggcggcagcgacgagctgagcgacgacatcacccagcagcagctgctgcccggcgtgaaggaccccaacctgtggaccgtgaagtgcaagatcggcgaggagagagccaccgccatcagcctgatgagaaagttcatcgcctaccagttcaccgacacccccctgcagatcaagagcgtggtggcccccgagcacgtgaagggctacatctacgtggaggcctacaagcagacccacgtgaagcaggccatcgagggcgtgggcaacctgagactgggctactggaaccagcagatggtgcccatcaaggagatgaccgacgtgctgaaggtggtgaaggaggtggccaacctgaagcccaagagctgggtgagactgaagagaggcatctacaaggacgacatcgcccaggtggactacgtggagcccagccagaacaccatcagcctgaagatgatccccagaatcgactacgacagaatcaaggccagaatgagcctgaaggactggttcgccaagagaaagaagttcaagagacccccccagagactgttcgacgccgagaagatcagaagcctgggcggcgacgtggccagcgacggcgacttcctgatcttcgagggcaacagatacagcagaaagggcttcctgttcaagagcttcgccatgagcgccgtgatcaccgagggcgtgaagcccaccctgagcgagctggagaagttcgaggaccagcccgagggcatcgacctggaggtggtgaccgagagcaccggcaaggagagagagcacaacttccagcccggcgacaacgtggaggtgtgcgagggcgagctgatcaacctgcagggcaagatcctgagcgtggacggcaacaagatcaccatcatgcccaagcacgaggacctgaaggacatgctggagttccccgcccaggagctgagaaagtacttcaagatgggcgaccacgtgaaggtgatcgccggcagattcgagggcgacaccggcctgatcgtgagagtggaggagaacttcgtgatcctgttcagcgacctgaccatgcacgagctgaaggtgctgcccagagacctgcagctgtgcagcgagaccgccagcggcgtggacgtgggcggccagcacgagtggggcgagctggtgcagctggacccccagaccgtgggcgtgatcgtgagactggagagagagaccttccaggtgctgaacatgtacggcaaggtggtgaccgtgagacaccaggccgtgaccagaaagaaggacaacagattcgccgtggccctggacagcgagcagaacaacatccacgtgaaggacatcgtgaaggtgatcgacggcccccacagcggcagagagggcgagatcagacacctgttcagaagcttcgccttcctgcactgcaagaagctggtggagaacggcggcatgttcgtgtgcaagaccagacacctggtgctggccggcggcagcaagcccagagacgtgaccaacttcaccgtgggcggcttcgcccccatgagccccagaatcagcagccccatgcaccccagcgccggcggccagagaggcggcttcggcagccccggcggcggcagcggcggcatgagcagaggcagaggcagaagagacaacgagctgatcggccagaccgtgagaatcagccagggcccctacaagggctacatcggcgtggtgaaggacgccaccgagagcaccgccagagtggagctgcacagcacctgccagaccatcagcgtggacagacagagactgaccaccgtgggcagcagaagacccggcggcatgaccagcacctacggcagaacccccatgtacggcagccagacccccatgtacggcagcggcagcagaacccccatgtacggcagccagacccccctgcaggacggcagcagaaccccccactacggcagccagacccccctgcacgacggcagcagaacccccgcccagagcggcgcctgggaccccaacaaccccaacacccccagcagagccgaggaggagtacgagtacgccttcgacgacgagcccacccccagcccccaggcctacggcggcacccccaacccccagacccccggctaccccgaccccagcagcccccaggtgaacccccagtacaacccccagacccccggcacccccgccatgtacaacaccgaccagttcagcccctacgccgcccccagcccccagggcagctaccagcccagccccagcccccagagctaccaccaggtggcccccagccccgccggctaccagaacacccacagccccgccagctaccaccccacccccagccccatggcctaccaggccagccccagccccagccccgtgggctacagccccatgacccccggcgcccccagccccggcggctacaacccccacacccccggcagcggcatcgagcagaacagcagcgactgggtgaccaccgacatccaggtgaaggtgagagacacctacctggacacccaggtggtgggccagaccggcgtgatcagaagcgtgaccggcggcatgtgcagcgtgtacctgaaggacagcgagaaggtggtgagcatcagcagcgagcacctggagcccatcacccccaccaagaacaacaaggtgaaggtgatcctgggcgaggacagagaggccaccggcgtgctgctgagcatcgacggcgaggacggcatcgtgagaatggacctggacgagcagctgaagatcctgaacctgagattcctgggcaagctgctggaggcctag

SEQ ID NO: 101273 - DNA, 3264 bp, Artificial Sequence; identical to SEQ ID NO: 101270
  Description of Artificial Sequence: Synthetic coding sequence

SEQ ID NO: 101274 - DNA, 3264 bp, Artificial Sequence; identical to SEQ ID NO: 101270
  Description of Artificial Sequence: Synthetic coding sequence

SEQ ID NO: 101275 - DNA, 3264 bp, Artificial Sequence; identical to SEQ ID NO: 101270
  Description of Artificial Sequence: Synthetic coding sequence

SEQ ID NO: 101276 - DNA, 5181 bp, Artificial Sequence
  Description of Artificial Sequence: Synthetic coding sequence
atgagcgacttcgtggagagcgaggccgaggagagcgaggaggagtacaacgacgagggcgaggtggtgcccagagtgaccaagaagttcgtggaggaggaggacgacgacgaggaggaggaggaggagaacctggacgaccaggacgagcagggcaacctgaagggcttcatcaacgacgacgacgacgaggacgagggcgaggaggacgagggcagcgacagcggcgacagcgaggacgacgtgggccacaagaagagaaagagaaccagcttcgacgacagactggaggacgacgacttcgacctgatcgaggagaacctgggcgtgaaggtgaagagaggccagaagtacagaagagtgaagaagatgagcgacgacgaggacgacgacgaggaggagtacggcaaggaggagcacgagaaggaggccatcgccgaggagatcttccaggacggcgagggcgaggagggccaggaggccatggaggcccccatggccccccccgaggaggaggaggaggacgacgaggagagcgacatcgacgacttcatcgtggacgacgacggccagcccctgaagaagcccaagtggagaaagaagctgcccggctacaccgacgccgccctgcaggaggcccaggagatcttcggcgtggacttcgactacgacgagttcgagaagtacaacgagtacgacgaggagctggaggaggagtacgagtacgaggacgacgaggccgagggcgagatcagagtgagacccaagaagaccaccaagaagagagtgagcagaagaagcatcttcgagatgtacgagcccagcgagctggagagcagccacctgaccgaccaggacaacgagatcagagccaccgacctgcccgagagattccagctgagaagcatccccgtgaagggcgccgaggacgacgagctggaggaggaggccgactggatctacagaaacgccttcgccacccccaccatcagcctgcaggagagctgcgactacctggacagaggccagcccgccagcagcttcagcagaaagggccccagcaccatccagaagatcaaggaggccctgggcttcatgagaaaccagcacttcgaggtgcccttcatcgccttctacagaaaggagtacgtggagcccgagctgcacatcaacgacctgtggagagtgtggcagtgggacgagaagtggacccagctgagaatcagaaaggagaacctgaccagactgttcgagaagatgcaggcctaccagtacgagcagatcagcgccgaccccgacaagcccctggccgacggcatcagagccctggacaccaccgacatggagagactgaaggacgtgcagagcatggacgagctgaaggacgtgtacaaccacttcctgctgtactacggcagagacatccccaagatgcagaacgccgccaaggccagcagaaagaagctgaagagagtgagagaggagggcgacgaggagggcgagggcgacgaggccgaggacgaggagcagagaggccccgagctgaagcaggccagcagaagagacatgtacaccatctgccagagcgccggcctggacggcctggccaagaagttcggcctgacccccgagcagttcggcgagaacctgagagacagctaccagagacacgagaccgagcagttccccgccgagcccctggagctggccaaggactacgtgtgcagccagttccccacccccgaggccgtgctggagggcgccagatacatggtggccctgcagatcgccagagagcccctggtgagacaggtgctgagacagaccttccaggagagagccaagctgaacatcacccccaccaagaagggcagaaaggacgtggacgaggcccactacgcctacagcttcaagtacctgaagaacaagcccgtgaaggagctgagagacgaccagttcctgaagatctgcctggccgaggacgagggcctgctgaccaccgacatcagcatcgacctgaagggcgtggagggctacggcaacgaccagacctacttcgaggagatcaagcagttctactacagagacgagttcagccaccaggtgcaggagtggaacagacagagaaccatggccatcgagagagccctgcagcagttcctgtacgtgcagatggccaaggagctgaagaacaagctgctggccgaggccaaggagtacgtgatcaaggcctgcagcagaaagctgtacaactggctgagagtggccccctacagacccgaccagcaggtggaggaggacgacgacttcatggacgagaaccagggcaagggcatcagagtgctgggcatcgccttcagcagcgccagagaccaccccgtgttctgcgccctggtgaacggcgagggcgaggtgaccgacttcctgagactgccccacttcaccaagagaagaaccgcctggagagaggaggagagagagaagaaggcccaggacatcgagaccctgaagaagttcctgctgaacaagaagccccacgtggtgaccgtggccggcgagaacagagacgcccagatgctgatcgaggacgtgaagagaatcgtgcacgagctggaccagggccagcagctgagcagcatcggcgtggagctggtggacaacgagctggccatcctgtacatgaacagcaagaagagcgaggccgagttcagagactacccccccgtgctgagacaggccgtgagcctggccagaagaatccaggaccccctgatcgagttcgcccaggtgtgcagcagcgacgaggacatcctgtgcctgaagttccaccccctgcaggagcacgtggtgaaggaggagctgctgaacgccctgtactgcgagttcatcaacagagtgaacgaggtgggcgtggacgtgaacagagccatcgcccacccctacagccaggccctgatccagtacgtgtgcggcctgggccccagaaagggcacccacctgctgaagatcctgaagcagaacaacaccagactggagagcagaacccagctggtgaccatgtgccacatgggccccaaggtgttcatgaactgcgccggcttcctgaagatcgacaccgccagcctgggcgacagcaccgacagctacatcgaggtgctggacggcagcagagtgcaccccgagacctacgagtgggccagaaagatggccgtggacgccctggagtacgacgagagcgccgaggacgccaaccccgccggcgccctggaggagatcctggagaaccccgagagactgaaggacctggacctggacgccttcgccgaggagctggagagacagggctacggcgacaagcacatcaccctgtacgacatcagagccgagctgagctgcagatacaaggacctgagaaccgcctacagaagccccaacaccgaggagatcttcaacatgctgaccaaggagacccccgagaccttctacatcggcaagctgatcatctgcaacgtgaccggcatcgcccacagaagaccccagggcgagagctacgaccaggccatcagaaacgacgagaccggcctgtggcagtgccccttctgccagcaggacaacttccccgagctgagcgaggtgtggaaccacttcgacagcggcagctgccccggccaggccatcggcgtgaagaccagactggacaacggcgtgaccggcttcatccccaccaagttcctgagcgacaaggtggtgaagagacccgaggagagagtgaaggtgggcatgaccgtgcactgcagaatcatgaagatcgacatcgagaagttcagcgccgacctgacctgcagaaccagcgacctgatggacagaaacaacgagtggaagctgcccaaggacacctactacgacttcgacgccgaggccgccgaccacaagcaggaggaggacatgaagagaaagcagcagagaaccacctacatcaagagagtgatcgcccaccccagcttccacaacatcaacttcaagcaggccgagaagatgatggagaccatggaccagggcgacgtgatcatcagacccagcagcaagggcgagaaccacctgaccgtgacctggaaggtgagcgacggcatctaccagcacgtggacgtgagagaggagggcaaggagaacgccttcagcctgggcgccaccctgtggatcaacagcgaggagttcgaggacctggacgagatcgtggccagatacgtgcagcccatggccagcttcgccagagacctgctgaaccacaagtactaccaggactgcagcggcggcgacagaaagaagctggaggagctgctgatcaagaccaagaaggagaagcccaccttcatcccctacttcatctgcgcctgcaaggagctgcccggcaagttcctgctgggctaccagcccagaggcaagcccagaatcgagtacgtgaccgtgacccccgagggcttcagatacagaggccagatcttccccaccgtgaacggcctgttcagatggttcaaggaccactaccaggaccccgtgcccggcatcacccccagcagcagcagcagaaccagaacccccgccagcatcaacgccacccccgccaacatcaacctggccgacctgaccagagccgtgaacgccctgccccagaacatgaccagccagatgttcagcgccatcgccgccgtgaccggccagggccagaaccccaacgccacccccgcccagtgggccagcagccagtacggctacggcggcagcggcggcggcagcagcgcctaccacgtgttccccacccccgcccagcagcccgtggccacccccctgatgacccccagctacagctacaccacccccagccagcccatcaccaccccccagtaccaccagctgcaggccagcaccaccccccagagcgcccaggcccagccccagcccagcagcagcagcagacagagacagcagcagcccaagagcaacagccacgccgccatcgactggggcaagatggccgagcagtggctgcaggagaaggaggccgagagaagaaagcagaagcagagactgacccccagacccagccccagccccatgatcgagagcacccccatgagcatcgccggcgacgccacccccctgctggacgagatggacagatag

SEQ ID NO: 101277 - DNA, 2181 bp, Artificial Sequence
  Description of Artificial Sequence: Synthetic coding sequence
atgagcgacttcgtggagagcgaggccgaggagagcgaggaggagtacaacgacgagggcgaggtggtgcccagagtgaccaagaagttcgtggaggaggaggacgacgacgaggaggaggaggaggagaacctggacgaccaggacgagcagggcaacctgaagggcttcatcaacgacgacgacgacgaggacgagggcgaggaggacgagggcagcgacagcggcgacagcgaggacgacgtgggccacaagaagagaaagagaaccagcttcgacgacagactggaggacgacgacttcgacctgatcgaggagaacctgggcgtgaaggtgaagagaggccagaagtacagaagagtgaagaagatgagcgacgacgaggacgacgacgaggaggagtacggcaaggaggagcacgagaaggaggccatcgccgaggagatcttccaggacggcgagggcgaggagggccaggaggccatggaggcccccatggccccccccgaggaggaggaggaggacgacgaggagagcgacatcgacgacttcatcgtggacgacgacggccagcccctgaagaagcccaagtggagaaagaagctgcccggctacaccgacgccgccctgcaggaggcccaggagatcttcggcgtggacttcgactacgacgagttcgagaagtacaacgagtacgacgaggagctggaggaggagtacgagtacgaggacgacgaggccgagggcgagatcagagtgagacccaagaagaccaccaagaagagagtgagcagaagaagcatcttcgagatgtacgagcccagcgagctggagagcagccacctgaccgaccaggacaacgagatcagagccaccgacctgcccgagagattccagctgagaagcatccccgtgaagggcgccgaggacgacgagctggaggaggaggccgactggatctacagaaacgccttcgccacccccaccatcagcctgcaggagagctgcgactacctggacagaggccagcccgccagcagcttcagcagaaagggccccagcaccatccagaagatcaaggaggccctgggcttcatgagaaaccagcacttcgaggtgcccttcatcgccttctacagaaaggagtacgtggagcccgagctgcacatcaacgacctgtggagagtgtggcagtgggacgagaagtggacccagctgagaatcagaaaggagaacctgaccagactgttcgagaagatgcaggcctaccagtacgagcagatcagcgccgaccccgacaagcccctggccgacggcatcagagccctggacaccaccgacatggagagactgaaggacgtgcagagcatggacgagctgaaggacgtgtacaaccacttcctgctgtactacggcagagacatccccaagatgcagaacgccgccaaggccagcagaaagaagctgaagagagtgagagaggagggcgacgaggagggcgagggcgacgaggccgaggacgaggagcagagaggccccgagctgaagcaggccagcagaagagacatgtacaccatctgccagagcgccggcctggacggcctggccaagaagttcggcctgacccccgagcagttcggcgagaacctgagagacagctaccagagacacgagaccgagcagttccccgccgagcccctggagctggccaaggactacgtgtgcagccagttccccacccccgaggccgtgctggagggcgccagatacatggtggccctgcagatcgccagagagcccctggtgagacaggtgctgagacagaccttccaggagagagccaagctgatgacccccagctacagctacaccacccccagccagcccatcaccaccccccagtaccaccagctgcaggccagcaccaccccccagagcgcccaggcccagccccagcccagcagcagcagcagacagagacagcagcagcccaagagcaacagccacgccgccatcgactggggcaagatggccgagcagtggctgcaggagaaggaggccgagagaagaaagcagaagcagagactgacccccagacccagccccagccccatgatcgagagcacccccatgagcatcgccggcgacgccacccccctgctggacgagatggacagatag

SEQ ID NO: 101278 - DNA, 2361 bp, Artificial Sequence
  Description of Artificial Sequence: Synthetic coding sequence
atgagcttcagcagagccctgctgtgggccagactgcccgccggcagacaggccggccacagagccgccatctgcagcgccctgagaccccacttcggccccttccccggcgtgctgggccaggtgagcgtgctggccaccgccagcagcagcgccagcggcggcagcaagatccccaacaccagcctgttcgtgcccctgaccgtgaagccccagggccccagcgccgacggcgacgtgggcgccgagctgaccagacccctggacaagaacgaggtgaagaaggtgctggacaagttctacaagagaaaggagatccagaagctgggcgccgactacggcctggacgccagactgttccaccaggccttcatcagcttcagaaactacatcatgcagagccacagcctggacgtggacatccacatcgtgctgaacgacatctgcttcggcgccgcccacgccgacgacctgttccccttcttcctgagacacgccaagcagatcttccccgtgctggactgcaaggacgacctgagaaagatcagcgacctgagaatcccccccaactggtaccccgacgccagagccatgcagagaaagatcatcttccacagcggccccaccaacagcggcaagacctaccacgccatccagaagtacttcagcgccaagagcggcgtgtactgcggccccctgaagctgctggcccacgagatcttcgagaagagcaacgccgccggcgtgccctgcgacctggtgaccggcgaggagagagtgaccgtgcagcccaacggcaagcaggccagccacgtgagctgcaccgtggagatgtgcagcgtgaccaccccctacgaggtggccgtgatcgacgagatccagatgatcagagaccccgccagaggctgggcctggaccagagccctgctgggcctgtgcgccgaggaggtgcacctgtgcggcgagcccgccgccatcgacctggtgatggagctgatgtacaccaccggcgaggaggtggaggtgagagactacaagagactgacccccatcagcgtgctggaccacgccctggagagcctggacaacctgagacccggcgactgcatcgtgtgcttcagcaagaacgacatctacagcgtgagcagacagatcgagatcagaggcctggagagcgccgtgatctacggcagcctgccccccggcaccaagctggcccaggccaagaagttcaacgaccccaacgacccctgcaagatcctggtggccaccgacgccatcggcatgggcctgaacctgagcatcagaagaatcatcttctacagcctgatcaagcccagcatcaacgagaagggcgagagagagctggagcccatcaccaccagccaggccctgcagatcgccggcagagccggcagattcagcagcagattcaaggagggcgaggtgaccaccatgaaccacgaggacctgagcctgctgaaggagatcctgaagagacccgtggaccccatcagagccgccggcctgcaccccaccgccgagcagatcgagatgttcgcctaccacctgcccgacgccaccctgagcaacctgatcgacatcttcgtggacttcagccaggtggacggccagtacttcgtgtgcaacatggacgacttcaagttcagcgccgagctgatccagcacatccccctgagcctgagagtgagatacgtgttctgcaccgcccccatcaacaagaagcagcccttcgtgtgcagcagcctgctgcagttcgccagacagtacagcagaaacgagcccctgaccttcgcctggctgagaagatacatcaagtggcccctgctgccccccaagaacatcaaggacctgatggacctggaggccgtgcacgacgtgctggacctgtacctgtggctgagctacagattcatggacatgttccccgacgccagcctgatcagagacctgcagaaggagctggacggcatcatccaggacggcgtgcacaacatcaccaagctgatcaagatgagcgagacccacaagctgctgaacctggagggcttccccagcggcagccagagcagactgagcggcaccctgaagagccaggccagaagaaccagaggcaccaaggccctgggcagcaaggccaccgagccccccagccccgacgccggcgagctgagcctggccagcagactggtgcagcagggcctgctgacccccgacatgctgaagcagctggagaaggagtggatgacccagcagaccgagcacaacaaggagaagaccgagagcggcacccaccccaagggcaccagaagaaagaagaaggagcccgacagcgactag

SEQ ID NO: 101279 - DNA, 792 bp, Artificial Sequence
  Description of Artificial Sequence: Synthetic coding sequence
atgagcttcagcagagccctgctgtgggccagactgcccgccggcagacaggccggccacagagccgccatctgcagcgccctgagaccccacttcggccccttccccggcgtgctgggccaggtgagcgtgctggccaccgccagcagcagcgccagcggcggcagcaagatccccaacaccagcctgttcgtgcccctgaccgtgaagccccagggccccagcgccgacggcgacgtgggcgccgagctgaccagacccctggacaagaacgaggtggccgtgatcgacgagatccagatgatcagagaccccgccagaggctgggcctggaccagagccctgctgggcctgtgcgccgaggaggtgcacctgtgcggcgagcccgccgccatcgacctggtgatggagctgatgtacaccaccggcgaggaggtggaggtgagagactacaagagactgacccccatcagcgtgctggaccacgccctggagagcctggacaacctgagacccggcgactgcatcgtgtgcttcagcaagaacgacatctacagcgtgagcagacagatcgagatcagaggcctggagagcgccgtgatctacggcagcctgccccccggcaccaagctggcccaggccaagaagttcaacgaccccaacgacccctgcaagatcctggtggccaccgacgccatcggcatgggcctgaacctgagcatcagaagaatcatcttctacagcctgatcaagcccagcatcaacgagaagggcgagagagagctggagtag

SEQ ID NO: 101280 - DNA, 1233 bp, Artificial Sequence
  Description of Artificial Sequence: Synthetic coding sequence
atggccgccgtgggcgccgaggccagaggcgcctggtgcgtgccctgcctggtgagcctggacaccctgcaggagctgtgcagaaaggagaagctgacctgcaagagcatcggcatcaccaagagaaacctgaacaactacgaggtggagtacctgtgcgactacaaggtggtgaaggacatggagtactacctggtgaagtggaagggctggcccgacagcaccaacacctgggagcccctgcagaacctgaagtgccccctgctgctgcagcagttcagcaacgacaagcacaactacctgagccaggtgaagaagggcaaggccatcacccccaaggacaacaacaagaccctgaagcccgccatcgccgagtacatcgtgaagaaggccaagcagagaatcgccctgcagagatggcaggacgagctgaacagaagaaagaaccacaagggcatgatcttcgtggagaacaccgtggacctggagggcccccccagcgacttctactacatcaacgagtacaagcccgcccccggcatcagcctggtgaacgaggccaccttcggctgcagctgcaccgactgcttcttccagaagtgctgccccgccgaggccggcgtgctgctggcctacaacaagaaccagcagatcaagatcccccccggcacccccatctacgagtgcaacagcagatgccagtgcggccccgactgccccaacagaatcgtgcagaagggcacccagtacagcctgtgcatcttcagaaccagcaacggcagaggctggggcgtgaagaccctggtgaagatcaagagaatgagcttcgtgatggagtacgtgggcgaggtgatcaccagcgaggaggccgagagaagaggccagttctacgacaacaagggcatcacctacctgttcgacctggactacgagagcgacgagttcaccgtggacgccgccagatacggcaacgtgagccacttcgtgaaccacagctgcgaccccaacctgcaggtgttcaacgtgttcatcgacaacctggacaccagactgcccagaatcgccctgttcagcaccagaaccatcaacgccggcgaggagctgaccttcgactaccagatgaagggcagcggcgacatcagcagcgacagcatcgaccacagccccgccaagaagagagtgagaaccgtgtgcaagtgcggcgccgtgacctgcagaggctacctgaactag

SEQ ID NO: 101281 - DNA, 693 bp, Artificial Sequence
  Description of Artificial Sequence: Synthetic coding sequence
atggccgccgtgggcgccgaggccagaggcgcctggtgcgtgccctgcctggtgagcctggacaccctgcaggagctgtgcagaaaggagaagctgacctgcaagagcatcggcatcaccaagagaaacctgaacaactacgaggtggagtacctgtgcgactacaaggtggtgaaggacatggagtactacctggtgaagtggaagggctggcccgacagcaccaacacctgggagcccctgcagaacctgaagtgccccctgctgctgcagcagttcagcaacgacaagcacaactacctgagccaggtgatcaccagcgaggaggccgagagaagaggccagttctacgacaacaagggcatcacctacctgttcgacctggactacgagagcgacgagttcaccgtggacgccgccagatacggcaacgtgagccacttcgtgaaccacagctgcgaccccaacctgcaggtgttcaacgtgttcatcgacaacctggacaccagactgcccagaatcgccctgttcagcaccagaaccatcaacgccggcgaggagctgaccttcgactaccagatgaagggcagcggcgacatcagcagcgacagcatcgaccacagccccgccaagaagagagtgagaaccgtgtgcaagtgcggcgccgtgacctgcagaggctacctgaactag

SEQ ID NO: 101282 - DNA, 459 bp, Artificial Sequence
  Description of Artificial Sequence: Synthetic coding sequence
atggagtactacctggtgaagtggaagggctggcccgacagcaccaacacctgggagcccctgcagaacctgaagtgccccctgctgctgcagcagttcagcaacgacaagcacaactacctgagccaggtgatcaccagcgaggaggccgagagaagaggccagttctacgacaacaagggcatcacctacctgttcgacctggactacgagagcgacgagttcaccgtggacgccgccagatacggcaacgtgagccacttcgtgaaccacagctgcgaccccaacctgcaggtgttcaacgtgttcatcgacaacctggacaccagactgcccagaatcgccctgttcagcaccagaaccatcaacgccggcgaggagctgaccttcgactaccagatgaagggcagcggcgacatcagcagcgacagcatcgaccacagccccgccaagaagtag

SEQ ID NO: 101283 - DNA, 1053 bp, Artificial Sequence
  Description of Artificial Sequence: Synthetic coding sequence
atggagtactacctggtgaagtggaagggctggcccgacagcaccaacacctgggagcccctgcagaacctgaagtgccccctgctgctgcagcagttcagcaacgacaagcacaactacctgagccaggtgaagaagggcaaggccatcacccccaaggacaacaacaagaccctgaagcccgccatcgccgagtacatcgtgaagaaggccaagcagagaatcgccctgcagagatggcaggacgagctgaacagaagaaagaaccacaagggcatgatcttcgtggagaacaccgtggacctggagggcccccccagcgacttctactacatcaacgagtacaagcccgcccccggcatcagcctggtgaacgaggccaccttcggctgcagctgcaccgactgcttcttccagaagtgctgccccgccgaggccggcgtgctgctggcctacaacaagaaccagcagatcaagatcccccccggcacccccatctacgagtgcaacagcagatgccagtgcggccccgactgccccaacagaatcgtgcagaagggcacccagtacagcctgtgcatcttcagaaccagcaacggcagaggctggggcgtgaagaccctggtgaagatcaagagaatgagcttcgtgatggagtacgtgggcgaggtgatcaccagcgaggaggccgagagaagaggccagttctacgacaacaagggcatcacctacctgttcgacctggactacgagagcgacgagttcaccgtggacgccgccagatacggcaacgtgagccacttcgtgaaccacagctgcgaccccaacctgcaggtgttcaacgtgttcatcgacaacctggacaccagactgcccagaatcgccctgttcagcaccagaaccatcaacgccggcgaggagctgaccttcgactaccagatgaagggcagcggcgacatcagcagcgacagcatcgaccacagccccgccaagaagagagtgagaaccgtgtgcaagtgcggcgccgtgacctgcagaggctacctgaactag

SEQ ID NO: 101284 - DNA, 2658 bp, Artificial Sequence
  Description of Artificial Sequence: Synthetic coding sequence
atgaagtggctgggcgagagcaagatcatggtggtgaacggcagaagaaacggcggcaagctgagcaacgaccaccagcagaaccagagcaagctgcagcacaccggcaaggacaccctgaaggccggcaagaacgccgtggagagaagaagcaacagatgcaacggcaacagcggcttcgagggccagagcagatacgtgcccagcagcggcatgagcgccaaggagctgtgcgagaacgacgacctggccaccagcctggtgctggacccctacctgggcttccagacccacaagatgaacaccagcgccttccccagcagaagcagcagacacttcagcaagagcgacagcttcagccacaacaaccccgtgagattcagacccatcaagggcagacaggaggagctgaaggaggtgatcgagagattcaagaaggacgagcacctggagaaggccttcaagtgcctgaccagcggcgagtgggccagacactacttcctgaacaagaacaagatgcaggagaagctgttcaaggagcacgtgttcatctacctgagaatgttcgccaccgacagcggcttcgagatcctgccctgcaacagatacagcagcgagcagaacggcgccaagatcgtggccaccaaggagtggaagagaaacgacaagatcgagctgctggtgggctgcatcgccgagctgagcgagatcgaggagaacatgctgctgagacacggcgagaacgacttcagcgtgatgtacagcaccagaaagaactgcgcccagctgtggctgggccccgccgccttcatcaaccacgactgcagacccaactgcaagttcgtgagcaccggcagagacaccgcctgcgtgaaggccctgagagacatcgagcccggcgaggagatcagctgctactacggcgacggcttcttcggcgagaacaacgagttctgcgagtgctacacctgcgagagaagaggcaccggcgccttcaagagcagagtgggcctgcccgcccccgcccccgtgatcaacagcaagtacggcctgagagagaccgacaagagactgaacagactgaagaagctgggcgacagcagcaagaacagcgacagccagagcgtgagcagcaacaccgacgccgacaccacccaggagaagaacaacgccaccagcaacagaaagagcagcgtgggcgtgaagaagaacagcaagagcagaaccctgaccagacagagcatgagcagaatccccgccagcagcaacagcaccagcagcaagctgacccacatcaacaacagcagagtgcccaagaagctgaagaagcccgccaagcccctgctgagcaagatcaagctgagaaaccactgcaagagactggagcagaagaacgccagcagaaagctggagatgggcaacctggtgctgaaggagcccaaggtggtgctgtacaagaacctgcccatcaagaaggacaaggagcccgagggccccgcccaggccgccgtggccagcggctgcctgaccagacacgccgccagagagcacagacagaaccccgtgagaggcgcccacagccagggcgagagcagcccctgcacctacatcaccagaagaagcgtgagaaccagaaccaacctgaaggaggccagcgacatcaagctggagcccaacaccctgaacggctacaagagcagcgtgaccgagccctgccccgacagcggcgagcagctgcagcccgcccccgtgctgcaggaggaggagctggcccacgagaccgcccagaagggcgaggccaagtgccacaagagcgacaccggcatgagcaagaagaagagcagacagggcaagctggtgaagcagttcgccaagatcgaggagagcacccccgtgcacgacagccccggcaaggacgacgccgtgcccgacctgatgggcccccacagcgaccagggcgagcacagcggcaccgtgggcgtgcccgtgagctacaccgactgcgcccccagccccgtgggctgcagcgtggtgaccagcgacagcttcaagaccaaggacagcttcagaaccgccaagagcaagaagaagagaagaatcaccagatacgacgcccagctgatcctggagaacaacagcggcatccccaagctgaccctgagaagaagacacgacagcagcagcaagaccaacgaccaggagaacgacggcatgaacagcagcaagatcagcatcaagctgagcaaggaccacgacaacgacaacaacctgtacgtggccaagctgaacaacggcttcaacagcggcagcggcagcagcagcaccaagctgaagatccagctgaagagagacgaggagaacagaggcagctacaccgagggcctgcacgagaacggcgtgtgctgcagcgaccccctgagcctgctggagagcagaatggaggtggacgactacagccagtacgaggaggagagcaccgacgacagcagcagcagcgagggcgacgaggaggaggacgactacgacgacgacttcgaggacgacttcatccccctgccccccgccaagagactgagactgatcgtgggcaaggacagcatcgacatcgacatcagcagcagaagaagagaggaccagagcctgagactgaacgcctag

SEQ ID NO: 101285 - DNA, 1182 bp, Artificial Sequence
  Description of Artificial Sequence: Synthetic coding sequence
atgaagtggctgggcgagagcaagatcatggtggtgaacggcagaagaaacggcggcaagctgagcaacgaccaccagcagaaccagagcaagctgcagcacaccggcaaggacaccctgaaggccggcaagaacgccgtggagagaagaagcaacagatgcaacggcaacagcggcttcgagggccagagcagatacgtgcccagcagcggcatgagcgccaaggagctgtgcgagaacgacgacctggccaccagcctggtgctggacccctacctgggcttccagacccacaagatgaacaccagcgccttccccagcagaagcagcagacacttcagcaagagcgacagcttcagccacaacaaccccgtgagattcagacccatcaagggcagacaggaggagctgaaggaggtgatcgagagattcaagaaggacgagcacctggagaaggccttcaagtgcctgaccagcggcgagtgggccagacactacttcctgaacaagaacaagatgcaggagaagctgttcaaggagcacgtgttcatctacctgagaatgttcgccaccgacagcggcttcgagatcctgccctgcaacagatacagcagcgagcagaacggcgccaagatcgtggccaccaaggagtggaagagaaacgacaagatcgagctgctggtgggctgcatcgccgagctgagcgagatcgaggagaacatgctgctgagacacggcgagaacgacttcagcgtgatgtacagcaccagaaagaactgcgcccagctgtggctgggccccgccgccttcatcaaccacgactgcagacccaactgcaagttcgtgagcaccggcagagacaccgcctgcgtgaaggccctgagagacatcgagcccggcgaggagatcagctgctactacggcgacggcttcttcggcgagaacaacgagttctgcgagtgctacacctgcgagagaagaggcaccggcgccttcaagagcagagtgggcctgcccgcccccgcccccgtgatcaacagcaagtacggcctgagagagaccgacaagagactgaacagactgaagaagctgggcgacagcagcaagaacagcgacagccagagcgtgagcagcaacaccgacgccgacaccacccaggagaagaacaacgccagcaagtag

SEQ ID NO: 101286 - DNA, 1182 bp, Artificial Sequence; identical to SEQ ID NO: 101285
  Description of Artificial Sequence: Synthetic coding sequence

SEQ ID NO: 101287 - DNA, 357 bp, Artificial Sequence
  Description of Artificial Sequence: Synthetic coding sequence
atgaagtggctgggcgagagcaagatcatggtggtgaacggcagaagaaacggcggcaagctgagcaacgaccaccagcagaaccagagcaagctgcagcacaccggcaaggacaccctgaaggccggcaagaacgccgtggagagaagaagcaacagatgcaacggcaacagcggcttcgagggccagagcagatacgtgcccagcagcggcatgagcgccaaggagctgtgcgagaacgacgacctggccaccagcctggtgctggacccctacctgggcttccagacccacaagatgaacaccagcgccttccccagcagaagcagcagacacttcagcaagagcgacagctag

SEQ ID NO: 101288 - DNA, 1389 bp, Artificial Sequence
  Description of Artificial Sequence: Synthetic coding sequence
atgggccccgacagagtgaccgccagagagctgtgcgagaacgacgacctggccaccagcctggtgctggacccctacctgggcttcagaacccacaagatgaacgtgagccccgtgccccccctgagaagacagcagcacctgagaagcgccctggagaccttcctgagacagagagacctggaggccgcctacagagccctgaccctgggcggctggaccgccagatacttccagagcagaggccccagacaggaggccgccctgaagacccacgtgtacagatacctgagagccttcctgcccgagagcggcttcaccatcctgccctgcaccagatacagcatggagaccaacggcgccaagatcgtgagcaccagagcctggaagaagaacgagaagctggagctgctggtgggctgcatcgccgagctgagagaggccgacgagggcctgctgagagccggcgagaacgacttcagcatcatgtacagcaccagaaagagaagcgcccagctgtggctgggccccgccgccttcatcaaccacgactgcaagcccaactgcaagttcgtgcccgccgacggcaacgccgcctgcgtgaaggtgctgagagacatcgagcccggcgacgaggtgacctgcttctacggcgagggcttcttcggcgagaagaacgagcactgcgagtgccacacctgcgagagaaagggcgagggcgccttcagaaccagacccagagagcccgccctgccccccagacccctggacaagtaccagctgagagagaccaagagaagactgcagcagggcctggacagcggcagcagacagggcctgctgggccccagagcctgcgtgcaccccagccccctgagaagagaccccttctgcgccgcctgccagcccctgagactgcccgcctgcagcgccagacccgacaccagccccctgtggctgcagtggctgccccagccccagcccagagtgagacccagaaagagaagaagacccagacccagaagagcccccgtgctgagcacccaccacgccgccagagtgagcctgcacagatggggcggctgcggcccccactgcagactgagaggcgaggccctggtggccctgggccagcccccccacgccagatgggccccccagcaggactggcactgggccagaagatacggcctgccctacgtggtgagagtggacctgagaagactggcccccgccccccccgccacccccgcccccgccggcacccccggccccatcctgatccccaagcaggccctggccttcgcccccttcagcccccccaagagactgagactggtggtgagccacggcagcatcgacctggacgtgggcggcgaggagctgtag

SEQ ID NO: 101289 - DNA, 390 bp, Artificial Sequence
  Description of Artificial Sequence: Synthetic coding sequence
atgcccagaagaggcagatggctgagctgcagccccgaggccgagggcatcagaagagtgggcagcagagccgccctgagagtgcaccccctggagcacagacccagatggggcacccccggcggcatgaccaagggcagcagattcctggcccccgagagcgagctgagctggggccccggcgacgccacccccggcctgtggttcttcatcagcgacggcgtgggcgaggacctgtggaacagcgccggctggagcagcgtgcccgagggcttcggccagagaatgagaggccccggcctgaccccccacaccgacgccggcggcgacggcaacaagagaagacacagcgagagactgtgcagagccagcgtgctgcagcccccctag

SEQ ID NO: 101290 - DNA, 744 bp, Artificial Sequence
  Description of Artificial Sequence: Synthetic coding sequence
atgcacctggccagactggtgggcagctgcagcctgctgctgctgctgggcgccctgagcggctgggccgccagcgacgaccccatcgagaaggtgatcgagggcatcaacagaggcctgagcaacgccgagagagaggtgggcaaggccctggacggcatcaacagcggcatcacccacgccggcagagaggtggagaaggtgttcaacggcctgagcaacatgggcagccacaccggcaaggagctggacaagggcgtgcagggcctgaaccacggcatggacaaggtggcccacgagatcaaccacggcatcggccaggccggcaaggaggccgagaagctgggccacggcgtgaacaacgccgccggccaggccggcaaggaggccgacaaggccgtgcagggcttccacaccggcgtgcaccaggccggcaaggaggccgagaagctgggccagggcgtgaaccacgccgccgaccaggccggcaaggaggtggagaagctgggccagggcgcccaccacgccgccggccaggccggcaaggagctgcagaacgcccacaacggcgtgaaccaggccagcaaggaggccaaccagctgctgaacggcaaccaccagagcggcagcagcagccaccagggcggcgccaccaccacccccctggccagcggcgccagcgtgaacacccccttcatcaacctgcccgccctgtggagaagcgtggccaacatcatgccctag

SEQ ID NO: 101291 - DNA, 1773 bp, Artificial Sequence
  Description of Artificial Sequence: Synthetic coding sequence
atgcacctggccagactggtgggcagctgcagcctgctgctgctgctgggcgccctgagcggctgggccgccagcgacgaccccatcgagaaggtgatcgagggcatcaacagaggcctgagcaacgccgagagagaggtgggcaaggccctggacggcatcaacagcggcatcacccacgccggcagagaggtggagaaggtgttcaacggcctgagcaacatgggcagccacaccggcaaggagctggacaagggcgtgcagggcctgaaccacggcatggacaaggtggcccacgagatcaaccacggcatcggccaggccggcaaggaggccgagaagctgggccacggcgtgaacaacgccgccggccaggtgggcaaggaggccgacaagctgatccaccacggcgtgcaccacggcgccaaccaggccggcagcgaggccggcaagttcggccagggcgtggacaacgccgccggccaggccggcaacgaggccggcagattcggccagggcgtgcaccacgccgccggccaggccggcaacgaggccggcagattcggccagggcgtgcaccacgccgccggccaggccggcaacgaggccggcagattcggccagggcgcccaccacggcctgagcgagggctggaaggagaccgagaagttcggccagggcatccaccacgccgccggccaggtgggcaaggaggccgagaagttcggccagggcgcccaccacgccgccggccaggccggcaacgaggccggcagattcggccagggcgtgcaccacggcctgagcgagggctggaaggagaccgagaagttcggccagggcgtgcaccacaccgccggccaggtgggcaaggaggccgagaagttcggccagggcgcccaccacgccgccggccaggccggcaacgaggccggcagattcggccagggcgcccaccacgccgccggccaggccggcaacgaggccggcagattcggccagggcgtgcaccacggcctgagcgagggctggaaggagaccgagaagttcggccagggcgtgcaccacgccgccagccagttcggcaaggagaccgagaagctgggccacggcgtgcaccacggcgtgaacgaggcctggaaggaggccgagaagttcggccagggcgtgcaccacgccgccagccaggtgggcaaggaggaggacagagtggtgcagggcctgcaccacggcgtgagccaggccggcagagaggccggccagttcggccacgacatccaccacaccgccggccaggccggcaaggagggcgacatcgccgtgcacggcgtgcagcccggcgtgcacgaggccggcaaggaggccggccagttcggccagggcgtgcaccacaccctggagcaggccggcaaggaggccgacaaggccgtgcagggcttccacaccggcgtgcaccaggccggcaaggaggccgagaagctgggccagggcgtgaaccacgccgccgaccaggccggcaaggaggtggagaagctgggccagggcgcccaccacgccgccggccaggccggcaaggagctgcagaacgcccacaacggcgtgaaccaggccagcaaggaggccaaccagctgctgaacggcaaccaccagagcggcagcagcagccaccagggcggcgccaccaccacccccctggccagcggcgccagcgtgaacacccccttcatcaacctgcccgccctgtggagaagcgtggccaacatcatgccctag

SEQ ID NO: 101292 - DNA, 288 bp, Artificial Sequence
  Description of Artificial Sequence: Synthetic coding sequence
atgggcagccacaccggcaaggagctggacaagggcgtgcagggcctgaaccacggcatggacaaggtggcccacgagatcaaccacggcatcggccaggccggcaaggaggccgagaagctgggccacggcgtgaacaacgccgccggccagggcaaccaccagagcggcagcagcagccaccagggcggcgccaccaccacccccctggccagcggcgccagcgtgaacacccccttcatcaacctgcccgccctgtggagaagcgtggccaacatcatgccctag

SEQ ID NO: 101293 - DNA, 738 bp, Artificial Sequence
  Description of Artificial Sequence: Synthetic coding sequence
atgtggctgtgccccctggccctgaacctgatcctgatggccgccagcggcgccgtgtgcgaggtgaaggacgtgtgcgtgggcagccccggcatccccggcacccccggcagccacggcctgcccggcagagacggcagagacggcctgaagggcgaccccggcccccccggccccatgggcccccccggcgagatgccctgcccccccggcaacgacggcctgcccggcgcccccggcatccccggcgagtgcggcgagaagggcgagcccggcgagagaggcccccccggcctgcccgcccacctggacgaggagctgcaggccaccctgcacgacttcagacaccagatcctgcagaccagaggcgccctgagcctgcagggcagcatcatgaccgtgggcgagaaggtgttcagcagcaacggccagagcatcaccttcgacgccatccaggaggcctgcgccagagccggcggcagaatcgccgtgcccagaaaccccgaggagaacgaggccatcgccagcttcgtgaagaagtacaacacctacgcctacgtgggcctgaccgagggccccagccccggcgacttcagatacagcgacggcacccccgtgaactacaccaactggtacagaggcgagcccgccggcagaggcaaggagcagtgcgtggagatgtacaccgacggccagtggaacgacagaaactgcctgtacagcagactgaccatctag

SEQ ID NO: 101294 - DNA, 570 bp, Artificial Sequence
  Description of Artificial Sequence: Synthetic coding sequence
atgggcccccccggcgagatgccctgcccccccggcaacgacggcctgcccggcgcccccggcatccccggcgagtgcggcgagaagggcgagcccggcgagagaggcccccccggcctgcccgcccacctggacgaggagctgcaggccaccctgcacgacttcagacaccagatcctgcagaccagaggcgccctgagcctgcagggcagcatcatgaccgtgggcgagaaggtgttcagcagcaacggccagagcatcaccttcgacgccatccaggaggcctgcgccagagccggcggcagaatcgccgtgcccagaaaccccgaggagaacgaggccatcgccagcttcgtgaagaagtacaacacctacgcctacgtgggcctgaccgagggccccagccccggcgacttcagatacagcgacggcacccccgtgaactacaccaactggtacagaggcgagcccgccggcagaggcaaggagcagtgcgtggagatgtacaccgacggccagtggaacgacagaaactgcctgtacagcagactgaccatctgcgagttctag

SEQ ID NO: 101295 - DNA, 747 bp, Artificial Sequence
  Description of Artificial Sequence: Synthetic coding sequence
atgtggctgtgccccctggccctgaacctgatcctgatggccgccagcggcgccgtgtgcgaggtgaaggacgtgtgcgtgggcagccccggcatccccggcacccccggcagccacggcctgcccggcagagacggcagagacggcctgaagggcgaccccggcccccccggccccatgggcccccccggcgagatgccctgcccccccggcaacgacggcctgcccggcgcccccggcatccccggcgagtgcggcgagaagggcgagcccggcgagagaggcccccccggcctgcccgcccacctggacgaggagctgcaggccaccctgcacgacttcagacaccagatcctgcagaccagaggcgccctgagcctgcagggcagcatcatgaccgtgggcgagaaggtgttcagcagcaacggccagagcatcaccttcgacgccatccaggaggcctgcgccagagccggcggcagaatcgccgtgcccagaaaccccgaggagaacgaggccatcgccagcttcgtgaagaagtacaacacctacgcctacgtgggcctgaccgagggccccagccccggcgacttcagatacagcgacggcacccccgtgaactacaccaactggtacagaggcgagcccgccggcagaggcaaggagcagtgcgtggagatgtacaccgacggccagtggaacgacagaaactgcctgtacagcagactgaccatctgcgagttctag

SEQ ID NO: 101296 - DNA, 747 bp, Artificial Sequence; identical to SEQ ID NO: 101295
  Description of Artificial Sequence: Synthetic coding sequence

SEQ ID NO: 101297 - DNA, 792 bp, Artificial Sequence
  Description of Artificial Sequence: Synthetic coding sequence
atgagaccctgccaggtgcccggcgccgccaccggccccagagccatgtggctgtgccccctggccctgaacctgatcctgatggccgccagcggcgccgtgtgcgaggtgaaggacgtgtgcgtgggcagccccggcatccccggcacccccggcagccacggcctgcccggcagagacggcagagacggcctgaagggcgaccccggcccccccggccccatgggcccccccggcgagatgccctgcccccccggcaacgacggcctgcccggcgcccccggcatccccggcgagtgcggcgagaagggcgagcccggcgagagaggcccccccggcctgcccgcccacctggacgaggagctgcaggccaccctgcacgacttcagacaccagatcctgcagaccagaggcgccctgagcctgcagggcagcatcatgaccgtgggcgagaaggtgttcagcagcaacggccagagcatcaccttcgacgccatccaggaggcctgcgccagagccggcggcagaatcgccgtgcccagaaaccccgaggagaacgaggccatcgccagcttcgtgaagaagtacaacacctacgcctacgtgggcctgaccgagggccccagccccggcgacttcagatacagcgacggcacccccgtgaactacaccaactggtacagaggcgagcccgccggcagaggcaaggagcagtgcgtggagatgtacaccgacggccagtggaacgacagaaactgcctgtacagcagactgaccatctgcgagttctag

SEQ ID NO: 101298 - DNA, 747 bp, Artificial Sequence; identical to SEQ ID NO: 101295
  Description of Artificial Sequence: Synthetic coding sequence

SEQ ID NO: 101299 - DNA, 477 bp, Artificial Sequence
  Description of Artificial Sequence: Synthetic coding sequence
atgtggctgtgccccctggccctgaacctgatcctgatggccgccagcggcgccgtgtgcgaggtgaaggacgtgtgcgtgggcagccccggcatccccggcacccccggcagccacggcctgcccggcagagacggcagagacggcctgaagggcgaccccggcccccccggccccatgggcccccccggcgagatgccctgcccccccggcaacgacggcctgcccggcgcccccggcatccccggcgagtgcggcgagaagggcgagcccggcgagagaggcccccccggcctgcccgcccacctggacgaggagctgcaggccaccctgcacgacttcagacaccagatcctgcagaccagaggcgccctgagcctgcagggcagcatcatgaccgtgggcgagaaggtgttcagcagcaacggccagagcatcaccttcgacgccatccaggaggcctgcgccagagcctag

SEQ ID NO: 101300 - DNA, 477 bp, Artificial Sequence; identical to SEQ ID NO: 101299
  Description of Artificial Sequence: Synthetic coding sequence

SEQ ID NO: 101301 - DNA, 747 bp, Artificial Sequence
  Description of Artificial Sequence: Synthetic coding sequence
atgtggctgtgccccctggccctgaccctgatcctgatggccgccagcggcgccgcctgcgaggtgaaggacgtgtgcgtgggcagccccggcatccccggcacccccggcagccacggcctgcccggcagagacggcagagacggcgtgaagggcgaccccggcccccccggccccatgggcccccccggcgagaccccctgcccccccggcaacaacggcctgcccggcgcccccggcgtgcccggcgagagaggcgagaagggcgaggccggcgagagaggcccccccggcctgcccgcccacctggacgaggagctgcaggccaccctgcacgacttcagacaccagatcctgcagaccagaggcgccctgagcctgcagggcagcatcatgaccgtgggcgagaaggtgttcagcagcaacggccagagcatcaccttcgacgccatccaggaggcctgcgccagagccggcggcagaatcgccgtgcccagaaaccccgaggagaacgaggccatcgccagcttcgtgaagaagtacaacacctacgcctacgtgggcctgaccgagggccccagccccggcgacttcagatacagcgacggcacccccgtgaactacaccaactggtacagaggcgagcccgccggcagaggcaaggagcagtgcgtggagatgtacaccgacggccagtggaacgacagaaactgcctgtacagcagactgaccatctgcgagttctag

SEQ ID NO: 101302 - DNA, 747 bp, Artificial Sequence; identical to SEQ ID NO: 101301
  Description of Artificial Sequence: Synthetic coding sequence

SEQ ID NO: 101303 - DNA, 477 bp, Artificial Sequence
  Description of Artificial Sequence: Synthetic coding sequence
atgtggctgtgccccctggccctgaccctgatcctgatggccgccagcggcgccgcctgcgaggtgaaggacgtgtgcgtgggcagccccggcatccccggcacccccggcagccacggcctgcccggcagagacggcagagacggcgtgaagggcgaccccggcccccccggccccatgggcccccccggcgagaccccctgcccccccggcaacaacggcctgcccggcgcccccggcgtgcccggcgagagaggcgagaagggcgaggccggcgagagaggcccccccggcctgcccgcccacctggacgaggagctgcaggccaccctgcacgacttcagacaccagatcctgcagaccagaggcgccctgagcctgcagggcagcatcatgaccgtgggcgagaaggtgttcagcagcaacggccagagcatcaccttcgacgccatccaggaggcctgcgccagagcctag

SEQ ID NO: 101304 - DNA, 645 bp, Artificial Sequence
  Description of Artificial Sequence: Synthetic coding sequence
atgagaccctgccaggtgcccggcgccgccaccggccccagagccatgtggctgtgccccctggccctgaccctgatcctgatggccgccagcggcgccgcctgcgaggtgaaggacgtgtgcgtgggcagccccggcatccccggcaagagaggcgagaagggcgaggccggcgagagaggcccccccggcctgcccgcccacctggacgaggagctgcaggccaccctgcacgacttcagacaccagatcctgcagaccagaggcgccctgagcctgcagggcagcatcatgaccgtgggcgagaaggtgttcagcagcaacggccagagcatcaccttcgacgccatccaggaggcctgcgccagagccggcggcagaatcgccgtgcccagaaaccccgaggagaacgaggccatcgccagcttcgtgaagaagtacaacacctacgcctacgtgggcctgaccgagggccccagccccggcgacttcagatacagcgacggcacccccgtgaactacaccaactggtacagaggcgagcccgccggcagaggcaaggagcagtgcgtggagatgtacaccgacggccagtggaacgacagaaactgcctgtacagcagactgaccatctgcgagttctag

SEQ ID NO: 101305 - DNA, 1146 bp, Artificial Sequence
  Description of Artificial Sequence: Synthetic coding sequence
atggccgagagccacctgctgcagtggctgctgctgctgctgcccaccctgtgcggccccggcaccgccgcctggaccaccagcagcctggcctgcgcccagggccccgagttctggtgccagagcctggagcaggccctgcagtgcagagccctgggccactgcctgcaggaggtgtggggccacgtgggcgccgacgacctgtgccaggagtgcgaggacatcgtgcacatcctgaacaagatggccaaggaggccatcttccaggacaccatgagaaagttcctggagcaggagtgcaacgtgctgcccctgaagctgctgatgccccagtgcaaccaggtgctggacgactacttccccctggtgatcgactacttccagaaccagaccgacagcaacggcatctgcatgcacctgggcctgtgcaagagcagacagcccgagcccgagcaggagcccggcatgagcgaccccctgcccaagcccctgagagaccccctgcccgaccccctgctggacaagctggtgctgcccgtgctgcccggcgccctgcaggccagacccggcccccacacccaggacctgagcgagcagcagttccccatccccctgccctactgctggctgtgcagagccctgatcaagagaatccaggccatgatccccaagggcgccctggccgtggccgtggcccaggtgtgcagagtggtgcccctggtggccggcggcatctgccagtgcctggccgagagatacagcgtgatcctgctggacaccctgctgggcagaatgctgccccagctggtgtgcagactggtgctgagatgcagcatggacgacagcgccggccccagaagccccaccggcgagtggctgcccagagacagcgagtgccacctgtgcatgagcgtgaccacccaggccggcaacagcagcgagcaggccatcccccaggccatgctgcaggcctgcgtgggcagctggctggacagagagaagtgcaagcagttcgtggagcagcacaccccccagctgctgaccctggtgcccagaggctgggacgcccacaccacctgccaggccctgggcgtgtgcggcaccatgagcagccccctgcagtgcatccacagccccgacctgtag

SEQ ID NO: 101306 - DNA, 1128 bp, Artificial Sequence
  Description of Artificial Sequence: Synthetic coding sequence
atgctgctgttcctgctgagcgccctggtgctgctgacccagcccctgggctacctggaggccgagatgaagacctacagccacagaaccatgcccagcgcctgcaccctggtgatgtgcagcagcgtggagagcggcctgcccggcagagacggcagagacggcagagagggccccagaggcgagaagggcgaccccggcctgcccggcgccgccggccaggccggcatgcccggccaggccggccccgtgggccccaagggcgacaacggcagcgtgggcgagcccggccccaagggcgacaccggccccagcggcccccccggcccccccggcgtgcccggccccgccggcagagagggccccctgggcaagcagggcaacatcggcccccagggcaagcccggccccaagggcgaggccggccccaagggcgaggtgggcgcccccggcatgcagggcagcgccggcgccagaggcctggccggccccaagggcgagagaggcgtgcccggcgagagaggcgtgcccggcaacaccggcgccgccggcagcgccggcgccatgggcccccagggcagccccggcgccagaggcccccccggcctgaagggcgacaagggcatccccggcgacaagggcgccaagggcgagagcggcctgcccgacgtggccagcctgagacagcaggtggaggccctgcagggccaggtgcagcacctgcaggccgccttcagccagtacaagaaggtggagctgttccccaacggccagagcgtgggcgagaagatcttcaagaccgccggcttcgtgaagcccttcaccgaggcccagctgctgtgcacccaggccggcggccagctggccagccccagaagcgccgccgagaacgccgccctgcagcagctggtggtggccaagaacgaggccgccttcctgagcatgaccgacagcaagaccgagggcaagttcacctaccccaccggcgagagcctggtgtacagcaactgggcccccggcgagcccaacgacgacggcggcagcgaggactgcgtggagatcttcaccaacggcaagtggaacgacagagcctgcggcgagaagagactggtggtgtgcgagttctag

SEQ ID NO: 101307 - DNA, 657 bp, Artificial Sequence
  Description of Artificial Sequence: Synthetic coding sequence
atgttcctgagcaccagcaagcacggcagacaggaggccatgctgctgttcctgctgagcgccctggtgctgctgacccagcccctgggctacctggaggccgagatgaagacctacagccacagaaccatgcccagcgcctgcaccctggtgatgtgcagcagcgtggagagcggcctgcccggcagagacggcagagacggcagagagggccccagaggcgagaagggcgaccccggcctgcccggcgccgccggccaggccggcatgcccggccaggccggccccgtgggccccaagggcgacaacggcagcgtgggcgagcccggccccaagggcgacaccggccccagcggcccccccggcccccccggcgtgcccggccccgccggcagagagggccccctgggcaagcagggcaacatcggcccccagggcaagcccggccccaagggcgaggccggccccaagggcgaggtgggcgcccccggcatgcagggcagcgccggcgccagaggcctggccggccccaagggcgagagaggcgtgcccggcgagagaggcgtgcccggcaacaccggcgccgccggcagcgccggcgccatgggcccccagggcagccccggcgccagaggcccccccggcctgaagggctag

SEQ ID NO: 101308 - DNA, 903 bp, Artificial Sequence
  Description of Artificial Sequence: Synthetic coding sequence
atggccgccgtggccgccctgcagctgggcctgagagccgccggcctgggcagagcccccgccagcgccgcctggagaagcgtgctgagagtgagccccagacccggcgtggcctggagacccagcagatgcggcagcagcgccgccgaggccagcgccaccaaggccgaggacgacagcttcctgcagtgggtgctgctgctgatccccgtgaccgccttcggcctgggcacctggcaggtgcagagaagaaagtggaagctgaacctgatcgccgagctggagagcagagtgctggccgagcccgtgcccctgcccgccgaccccatggagctgaagaacctggagtacagacccgtgaaggtgagaggctgcttcgaccacagcaaggagctgtacatgatgcccagaaccatggtggaccccgtgagagaggccagagagggcggcctgatcagcagcagcacccagagcggcgcctacgtggtgacccccttccactgcaccgacctgggcgtgaccatcctggtgaacagaggcttcgtgcccagaaagaaggtgaaccccgagaccagacagaagggccagatcgagggcgaggtggacctgatcggcatggtgagactgaccgagaccagacagcccttcgtgcccgagaacaaccccgagagaaaccactggcactacagagacctggaggccatggccagaatcaccggcgccgagcccatcttcatcgacgccaacttccagagcaccgtgcccggcggccccatcggcggccagaccagagtgaccctgagaaacgagcacctgcagtacatcgtgacctggtacggcctgagcgccgccaccagctacctgtggttcaagaagttcctgagaggcacccccggcgtgtag

SEQ ID NO: 101309 - DNA, 813 bp, Artificial Sequence
  Description of Artificial Sequence: Synthetic coding sequence
gcccccgccagcgccgcctggagaagcgtgctgagagtgagccccagacccggcgtggcctggagacccagcagatgcggcagcagcgccgccgaggccagcgccaccaaggccgaggacgacagcttcctgcagtgggtgctgctgctgatccccgtgaccgccttcggcctgggcacctggcaggtgcagagaagaaagtggaagctgaacctgatcgccgagctggagagcagagtgctggccgagcccgtgcccctgcccgccgaccccatggagctgaagaacctggagtacagacccgtgaaggtgagaggctgcttcgaccacagcaaggagctgtacatgatgcccagaaccatggtggaccccgtgagagaggccagagagggcggcctgatcagcagcagcacccagagcggcgcctacgtggtgacccccttccactgcaccgacctgggcaagaaggtgaaccccgagaccagacagaagggccagatcgagggcgaggtggacctgatcggcatggtgagactgaccgagaccagacagcccttcgtgcccgagaacaaccccgagagaaaccactggcactacagagacctggaggccatggccagaatcaccggcgccgagcccatcttcatcgacgccaacttccagagcaccgtgcccggcggccccatcggcggccagaccagagtgaccctgagaaacgagcacctgcagtacatcgtgacctggtacggcctgagcgccgccaccagctacctgtggttcaagaagttcctgagaggcacccccggcgtgtag

SEQ ID NO: 101310 - DNA, 771 bp, Artificial Sequence
  Description of Artificial Sequence: Synthetic coding sequence
atgagcgagctgcccggcgacgtgagagccttcctgagagagcaccccagcctgagactgcagaccgacgccagaaaggtgagatgcatcctgaccggccacgagctgccctgcagactgcccgagctgcaggtgtacaccagaggcaagaagtaccagagactggtgagagccagccccgccttcgactacgccgagttcgagccccacatcgtgcccagcaccaagaacccccaccagctgttctgcaagctgaccctgagacacatcaacaagtgccccgagcacgtgctgagacacacccagggcagaagataccagagagccctgtgcaagtacgaggagtgccagaagcagggcgtggagtacgtgcccgcctgcctggtgcacagaagaagaagaagagaggaccagatggacggcgacggccccagacccagagaggccttctgggagcccaccagcagcgacgagggcggcgccgccagcgacgacagcatgaccgacctgtacccccccgagctgttcaccagaaaggacctgggcagcaccgaggacggcgacggcaccgacgacttcctgaccgacaaggaggacgagaaggccaagccccccagagagaaggccaccgacgagagcagaagagagaccaccgtgtacagaggcctggtgcagaagagaggcaagaagcagctgggcagcctgaagaagaagttcaagagccaccacagaaagcccaagagcttcagcagctgcaagcagcccggctag

SEQ ID NO: 101311 - DNA, 810 bp, Artificial Sequence
  Description of Artificial Sequence: Synthetic coding sequence
atgggccagaacgacctgatgggcaccgccgaggacttcgccgaccagttcctgagagtgaccaagcagtacctgccccacgtggccagactgtgcctgatcagcaccttcctggaggacggcatcagaatgtggttccagtggagcgagcagagagactacatcgacaccacctggaactgcggctacctgctggccagcagcttcgtgttcctgaacctgctgggccagctgaccggctgcgtgctggtgctgagcagaaacttcgtgcagtacgcctgcttcggcctgttcggcatcatcgccctgcagaccatcgcctacagcatcctgtgggacctgaagttcctgatgagaaacctggccctgggcggcggcctgctgctgctgctggccgagagcagaagcgagggcaagagcatgttcgccggcgtgcccaccatgagagagagcagccccaagcagtacatgcagctgggcggcagagtgctgctggtgctgatgttcatgaccctgctgcacttcgacgccagcttcttcagcatcgtgcagaacatcgtgggcaccgccctgatgatcctggtggccatcggcttcaagaccaagctggccgccctgaccctggtggtgtggctgttcgccatcaacgtgtacttcaacgccttctggaccatccccgtgtacaagcccatgcacgacttcctgaagtacgacttcttccagaccatgagcgtgatcggcggcctgctgctggtggtggccctgggccccggcggcgtgagcatggacgagaagaagaaggagtggtag

SEQ ID NO: 101312 - DNA, 561 bp, Artificial Sequence
  Description of Artificial Sequence: Synthetic coding sequence
atgggccagaacgacctgatgggcaccgccgaggacttcgccgaccagttcctgagagtgaccaagcagtacctgccccacgtggccagactgtgcctgatcagcaccttcctggaggacggcatcagaatgtggttccagtggagcgagcagagagactacatcgacaccacctggaactgcggctacctgctggccagcagcttcgtgttcctgaacctgctgggccagctgaccggctgcgtgctggtgctgagcagaaacttcgtgcagtacgcctgcttcggcctgttcggcatcatcgccctgcagaccatcgcctacagcatcctgtgggacctgaagttcctgatgagaaacctggccctgggcggcggcctgctgctgctgctggccgagagcagaagcgagggcaagagcatgttcgccggcgtgcccaccatgagagagagcagccccaagcagtacatgcagctgggcggcagagtgctgctggtgctgatgttcatgaccctgctgcacttcgacgccagcttcttcagccagcccagccagcagtag

SEQ ID NO: 101313 - DNA, 567 bp, Artificial Sequence
  Description of Artificial Sequence: Synthetic coding sequence
atgggccagaacgacctgatgggcaccgccgaggacttcgccgaccagttcctgagagtgaccaagcagtacctgccccacgtggccagactgtgcctgatcagcaccttcctggaggacggcatcagaatgtggttccagtggagcgagcagagagactacatcgacaccacctggaactgcggctacctgctggccagcagcttcgtgttcctgaacctgctgggccagctgaccggctgcgtgctggtgctgagcagaaacttcgtgcagtacgcctgcttcggcctgttcggcatcatcgccctgcagaccatcgcctacagcatcctgtgggacctgaagttcctgatgagaaacctggccctgggcggcggcctgctgctgctgctggccgagagcagaagcgagggcaagagcatgttcgccggcgtgcccaccatgagagagagcagccccaagcacacctgcctggccaagaccagaggcagacagggcctggtgagaggcggcttcaacaagaccgccagcttctacgtgagcagcagcctgcccctgccctggtag

SEQ ID NO: 101314 - DNA, 783 bp, Artificial Sequence
  Description of Artificial Sequence: Synthetic coding sequence
atgagaagcctggccaccgagttcctgagagtgaccaagcagtacctgccccacgtggccagactgtgcctgatcagcaccttcctggaggacggcatcagaatgtggttccagtggagcgagcagagagactacatcgacaccacctggaactgcggctacctgctggccagcagcttcgtgttcctgaacctgctgggccagctgaccggctgcgtgctggtgctgagcagaaacttcgtgcagtacgcctgcttcggcctgttcggcatcatcgccctgcagaccatcgcctacagcatcctgtgggacctgaagttcctgatgagaaacctggccctgggcggcggcctgctgctgctgctggccgagagcagaagcgagggcaagagcatgttcgccggcgtgcccaccatgagagagagcagccccaagcagtacatgcagctgggcggcagagtgctgctggtgctgatgttcatgaccctgctgcacttcgacgccagcttcttcagcatcgtgcagaacatcgtgggcaccgccctgatgatcctggtggccatcggcttcaagaccaagctggccgccctgaccctggtggtgtggctgttcgccatcaacgtgtacttcaacgccttctggaccatccccgtgtacaagcccatgcacgacttcctgaagtacgacttcttccagaccatgagcgtgatcggcggcctgctgctggtggtggccctgggccccggcggcgtgagcatggacgagaagaagaaggagtggtag

SEQ ID NO: 101315 - DNA, 387 bp, Artificial Sequence
  Description of Artificial Sequence: Synthetic coding sequence
atgggccagaacgacctgatgggcaccgccgaggacttcgccgaccagttcctgagagtgaccaagcagtacctgccccacgtggccagactgtgcctgatcagcaccttcctggaggacggcatcagaatgtggttccagtggagcgagcagagagactacatcgacaccacctggaactgcggctacctgctggccagcagcttcgtgttcctgaacctgctgggccagctgaccggctgcgtgctggtgctgagcagaaacttcgtgcagtacgcctgcttcggcctgttcggcatcatcgccctgcagaccatcgcctacagcatcctgtgggacctgaagttcctgatgagactgagcagaaccagctgggcccagctgtag

SEQ ID NO: 101316 - DNA, 1086 bp, Artificial Sequence
  Description of Artificial Sequence: Synthetic coding sequence
atggccagcctgctggccaaggacgcctacctgcagagcctggccaagaagatctgcagccacagcgcccccgagcagcaggccagaaccagagccggcaagacccagggcagcgagaccgccggcccccccaagaagaagagaaagaagacccagaagaagttcagaaagagagaggagaaggccgccgagcacaaggccaagagcctgggcgagaagagccccgccgccagcggcgccagaagacccgaggccgccaaggaggaggccgcctgggccagcagcagcgccggcaaccccgccgacggcctggccaccgagcccgagagcgtgttcgccctggacgtgctgagacagagactgcacgagaagatccaggaggccagaggccagggcagcgccaaggagctgagccccgccgccctggagaagagaagaagaagaaagcaggagagagacagaaagaagagaaagagaaaggagctgagagccaaggagaaggccagaaaggccgaggaggccaccgaggcccaggaggtggtggaggccacccccgagggcgcctgcaccgagcccagagagccccccggcctgatcttcaacaaggtggaggtgagcgaggacgagcccgccagcaaggcccagagaagaaaggagaagagacagagagtgaagggcaacctgacccccctgaccggcagaaactacagacagctgctggagagactgcaggccagacagagcagactggacgagctgagaggccaggacgagggcaaggcccaggagctggaggccaagatgaagtggaccaacctgctgtacaaggccgagggcgtgaagatcagagacgacgagagactgctgcaggaggccctgaagagaaaggagaagagaagagcccagagacagagaagatgggagaagagaaccgccggcgtggtggagaagatgcagcagagacaggacagaagaagacagaacctgagaagaaagaaggccgccagagccgagagaagactgctgagagccagaaagaagggcagaatcctgccccaggacctggagagagccggcctggtgtag

SEQ ID NO: 101317 - DNA, 789 bp, Artificial Sequence
  Description of Artificial Sequence: Synthetic coding sequence
atggccatgagcagcggcggcagcggcggcggcgtgcccgagcaggaggacagcgtgctgttcagaagaggcaccggccagagcgacgacagcgacatctgggacgacaccgccctgatcaaggcctacgacaaggccgtggccagcttcaagcacgccctgaagaacggcgacatctgcgagaccagcggcaagcccaagaccacccccaagagaaagcccgccaagaagaacaagagccagaagaagaacaccgccgccagcctgcagcagtggaaggtgggcgacaagtgcagcgccatctggagcgaggacggctgcatctaccccgccaccatcgccagcatcgacttcaagagagagacctgcgtggtggtgtacaccggctacggcaacagagaggagcagaacctgagcgacctgctgagccccatctgcgaggtggccaacaacatcgagcagaacgcccaggagaacgagaacgagagccaggtgagcaccgacgagagcgagaacagcagaagccccggcaacaagagcgacaacatcaagcccaagagcgccccctggaacagcttcctgcccccccccccccccatgcccggccccagactgggccccggcaagatcatccccccccccccccccatctgccccgacagcctggacgacgccgacgccctgggcagcatgctgatcagctggtacatgagcggctaccacaccggctactacatgggcttcagacagaaccagaaggagggcagatgcagccacagcctgaactag

SEQ ID NO: 101318 - DNA, 885 bp, Artificial Sequence
  Description of Artificial Sequence: Synthetic coding sequence
atggccatgagcagcggcggcagcggcggcggcgtgcccgagcaggaggacagcgtgctgttcagaagaggcaccggccagagcgacgacagcgacatctgggacgacaccgccctgatcaaggcctacgacaaggccgtggccagcttcaagcacgccctgaagaacggcgacatctgcgagaccagcggcaagcccaagaccacccccaagagaaagcccgccaagaagaacaagagccagaagaagaacaccgccgccagcctgcagcagtggaaggtgggcgacaagtgcagcgccatctggagcgaggacggctgcatctaccccgccaccatcgccagcatcgacttcaagagagagacctgcgtggtggtgtacaccggctacggcaacagagaggagcagaacctgagcgacctgctgagccccatctgcgaggtggccaacaacatcgagcagaacgcccaggagaacgagaacgagagccaggtgagcaccgacgagagcgagaacagcagaagccccggcaacaagagcgacaacatcaagcccaagagcgccccctggaacagcttcctgcccccccccccccccatgcccggccccagactgggccccggcaagcccggcctgaagttcaacggccccccccccccccccccccccccccccccccacctgctgagctgctggctgccccccttccccagcggcccccccatcatccccccccccccccccatctgccccgacagcctggacgacgccgacgccctgggcagcatgctgatcagctggtacatgagcggctaccacaccggctactacatgggcttcagacagaaccagaaggagggcagatgcagccacagcctgaactag

SEQ ID NO: 101319 - DNA, 789 bp, Artificial Sequence; identical to SEQ ID NO: 101317
  Description of Artificial Sequence: Synthetic coding sequence

SEQ ID NO: 101320 - DNA, 849 bp, Artificial Sequence
  Description of Artificial Sequence: Synthetic coding sequence
atggccatgagcagcggcggcagcggcggcggcgtgcccgagcaggaggacagcgtgctgttcagaagaggcaccggccagagcgacgacagcgacatctgggacgacaccgccctgatcaaggcctacgacaaggccgtggccagcttcaagcacgccctgaagaacggcgacatctgcgagaccagcggcaagcccaagaccacccccaagagaaagcccgccaagaagaacaagagccagaagaagaacaccgccgccagcctgcagcagtggaaggtgggcgacaagtgcagcgccatctggagcgaggacggctgcatctaccccgccaccatcgccagcatcgacttcaagagagagacctgcgtggtggtgtacaccggctacggcaacagagaggagcagaacctgagcgacctgctgagccccatctgcgaggtggccaacaacatcgagcagaacgcccaggagaacgagaacgagagccaggtgagcaccgacgagagcgagaacagcagaagccccggcaacaagagcgacaacatcaagcccaagagcgccccctggaacagcttcctgcccccccccccccccatgcccggccccagactgggccccggcaagcccggcctgaagttcaacggccccccccccccccccccccccccccccccccacctgctgagctgctggctgccccccttccccagcggcccccccatcatccccccccccccccccatctgccccgacagcctggacgacgccgacgccctgggcagcatgctgatcagctggtacatgagcggctaccacaccggctactacatggagatgctggcctag

SEQ ID NO: 101321 - DNA, 885 bp, Artificial Sequence
  Description of Artificial Sequence: Synthetic coding sequence
atggccatgagcagcggcggcagcggcggcggcgtgcccgagcaggaggacagcgtgctgttcagaagaggcaccggccagagcgacgacagcgacatctgggacgacaccgccctgatcaaggcctacgacaaggccgtggccagcttcaagcacgccctgaagaacggcgacatctgcgagaccagcggcaagcccaagaccacccccaagagaaagcccgccaagaagaacaagagccagaagaagaacaccgccgccagcctgcagcagtggaaggtgggcgacaagtgcagcgccatctggagcgaggacggctgcatctaccccgccaccatcgccagcatcgacttcaagagagagacctgcgtggtggtgtacaccggctacggcaacagagaggagcagaacctgagcgacctgctgagccccatctgcgaggtggccaacaacatcgagcagaacgcccaggagaacgagaacgagagccaggtgagcaccgacgagagcgagaacagcagaagccccggcaacaagagcgacaacatcaagcccaagagcgccccctggaacagcttcctgcccccccccccccccatgcccggccccagactgggccccggcaagcccggcctgaagttcaacggccccccccccccccccccccccccccccccccacctgctgagctgctggctgccccccttccccagcggcccccccatcatccccccccccccccccatctgccccgacagcctggacgacgccgacgccctgggcagcatgctgatcagctggtacatgagcggctaccacaccggctactacatgaccggcttccactgcgtgagccaggacggcctgaacctgctgaccccctag

SEQ ID NO: 101322 - DNA, 684 bp, Artificial Sequence
  Description of Artificial Sequence: Synthetic coding sequence
atggccatgagcagcggcggcagcggcggcggcgtgcccgagcaggaggacagcgtgctgttcagaagaggcaccggccagagcgacgacagcgacatctgggacgacaccgccctgatcaaggcctacgacaaggccgtggccagcttcaagcacgccctgaagaacggcgacatctgcgagaccagcggcaagcccaagaccacccccaagagaaagcccgccaagaagaacaagagccagaagaagaacaccgccgccagcctgcagcagaacgagaacgagagccaggtgagcaccgacgagagcgagaacagcagaagccccggcaacaagagcgacaacatcaagcccaagagcgccccctggaacagcttcctgcccccccccccccccatgcccggccccagactgggccccggcaagcccggcctgaagttcaacggccccccccccccccccccccccccccccccccacctgctgagctgctggctgccccccttccccagcggcccccccatcatccccccccccccccccatctgccccgacagcctggacgacgccgacgccctgggcagcatgctgatcagctggtacatgagcggctaccacaccggctactacatgggcttcagacagaaccagaaggagggcagatgcagccacagcctgaactag

SEQ ID NO: 101323 - DNA, 849 bp, Artificial Sequence; identical to SEQ ID NO: 101320
  Description of Artificial Sequence: Synthetic coding sequence

SEQ ID NO: 101324 - DNA, 789 bp, Artificial Sequence; identical to SEQ ID NO: 101317
  Description of Artificial Sequence: Synthetic coding sequence

SEQ ID NO: 101325 - DNA, 885 bp, Artificial Sequence; identical to SEQ ID NO: 101318
  Description of Artificial Sequence: Synthetic coding sequence

SEQ ID NO: 101326 - DNA, 885 bp, Artificial Sequence; identical to SEQ ID NO: 101321
  Description of Artificial Sequence: Synthetic coding sequence

SEQ ID NO: 101327 - DNA, 684 bp, Artificial Sequence; identical to SEQ ID NO: 101322
  Description of Artificial Sequence: Synthetic coding sequence

SEQ ID NO: 101328 - DNA, 4494 bp, Artificial Sequence
  Description of Artificial Sequence: Synthetic coding sequence
atgcccagatgcatcgcccacttctgcgagaagccccccagcgtgagctacagcatcctggagagcgtgagcaaggccaagttcgccgccggcagcgtggtgagcttcaagtgcatggagggcttcgtgctgaacaccagcgccaagatcgagtgcatgagaggcggccagtggaaccccagccccatgagcatccagtgcatccccgtgagatgcggcgagccccccagcatcatgaacggctacgccagcggcagcaactacagcttcggcgccatggtggcctacagctgcaacaagggcttctacatcaagggcgagaagaagagcacctgcgaggccaccggccagtggagcagccccatccccacctgccaccccgtgagctgcggcgagccccccaaggtggagaacggcttcctggagcacaccaccggcagaatcttcgagagcgaggtgagataccagtgcaaccccggctacaagagcgtgggcagccccgtgttcgtgtgccaggccaacagacactggcacagcgagagccccctgatgtgcgtgcccctggactgcggcaagcccccccccatccagaacggcttcatgaagggcgagaacttcgaggtgggcagcaaggtgcagttcttctgcaacgagggctacgagctggtgggcgacagcagctggacctgccagaagagcggcaagtggaacaagaagagcaaccccaagtgcatgcccgccaagtgccccgagccccccctgctggagaaccagctggtgctgaaggagctgaccaccgaggtgggcgtggtgaccttcagctgcaaggagggccacgtgctgcagggccccagcgtgctgaagtgcctgcccagccagcagtggaacgacagcttccccgtgtgcaagatcgtgctgtgcacccccccccccctgatcagcttcggcgtgcccatccccagcagcgccctgcacttcggcagcaccgtgaagtacagctgcgtgggcggcttcttcctgagaggcaacagcaccaccctgtgccagcccgacggcacctggagcagccccctgcccgagtgcgtgcccgtggagtgcccccagcccgaggagatccccaacggcatcatcgacgtgcagggcctggcctacctgagcaccgccctgtacacctgcaagcccggcttcgagctggtgggcaacaccaccaccctgtgcggcgagaacggccactggctgggcggcaagcccacctgcaaggccatcgagtgcctgaagcccaaggagatcctgaacggcaagttcagctacaccgacctgcactacggccagaccgtgacctacagctgcaacagaggcttcagactggagggccccagcgccctgacctgcctggagaccggcgactgggacgtggacgcccccagctgcaacgccatccactgcgacagcccccagcccatcgagaacggcttcgtggagggcgccgactacagctacggcgccatcatcatctacagctgcttccccggcttccaggtggccggccacgccatgcagacctgcgaggagagcggctggagcagcagcatccccacctgcatgcccatcgactgcggcctgcccccccacatcgacttcggcgactgcaccaagctgaaggacgaccagggctacttcgagcaggaggacgacatgatggaggtgccctacgtgaccccccaccccccctaccacctgggcgccgtggccaagacctgggagaacaccaaggagagccccgccacccacagcagcaacttcctgtacggcaccatggtgagctacacctgcaaccccggctacgagctgctgggcaaccccgtgctgatctgccaggaggacggcacctggaacggcagcgcccccagctgcatcagcatcgagtgcgacctgcccaccgcccccgagaacggcttcctgagattcaccgagaccagcatgggcagcgccgtgcagtacagctgcaagcccggccacatcctggccggcagcgacctgagactgtgcctggagaacagaaagtggagcggcgccagccccagatgcgaggccatcagctgcaagaagcccaaccccgtgatgaacggcagcatcaagggcagcaactacacctacctgagcaccctgtactacgagtgcgaccccggctacgtgctgaacggcaccgagagaagaacctgccaggacgacaagaactgggacgaggacgagcccatctgcatccccgtggactgcagcagcccccccgtgagcgccaacggccaggtgagaggcgacgagtacaccttccagaaggagatcgagtacacctgcaacgagggcttcctgctggagggcgccagaagcagagtgtgcctggccaacggcagctggagcggcgccacccccgactgcgtgcccgtgagatgcgccacccccccccagctggccaacggcgtgaccgagggcctggactacggcttcatgaaggaggtgaccttccactgccacgagggctacatcctgcacggcgcccccaagctgacctgccagagcgacggcaactgggacgccgagatccccctgtgcaagcccgtgaactgcggcccccccgaggacctggcccacggcttccccaacggcttcagcttcatccacggcggccacatccagtaccagtgcttccccggctacaagctgcacggcaacagcagcagaagatgcctgagcaacggcagctggagcggcagcagccccagctgcctgccctgcagatgcagcacccccgtgatcgagtacggcaccgtgaacggcaccgacttcgactgcggcaaggccgccagaatccagtgcttcaagggcttcaagctgctgggcctgagcgagatcacctgcgaggccgacggccagtggagcagcggcttcccccactgcgagcacaccagctgcggcagcctgcccatgatccccaacgccttcatcagcgagaccagcagctggaaggagaacgtgatcacctacagctgcagaagcggctacgtgatccagggcagcagcgacctgatctgcaccgagaagggcgtgtggagccagccctaccccgtgtgcgagcccctgagctgcggcagcccccccagcgtggccaacgccgtggccaccggcgaggcccacacctacgagagcgaggtgaagctgagatgcctggagggctacaccatggacaccgacaccgacaccttcacctgccagaaggacggcagatggttccccgagagaatcagctgcagccccaagaagtgccccctgcccgagaacatcacccacatcctggtgcacggcgacgacttcagcgtgaacagacaggtgagcgtgagctgcgccgagggctacaccttcgagggcgtgaacatcagcgtgtgccagctggacggcacctgggagccccccttcagcgacgagagctgcagccccgtgagctgcggcaagcccgagagccccgagcacggcttcgtggtgggcagcaagtacaccttcgagagcaccatcatctaccagtgcgagcccggctacgagctggagggcaacagagagagagtgtgccaggagaacagacagtggagcggcggcgtggccatctgcaaggagaccagatgcgagacccccctggagttcctgaacggcaaggccgacatcgagaacagaaccaccggccccaacgtggtgtacagctgcaacagaggctacagcctggagggccccagcgaggcccactgcaccgagaacggcacctggagccaccccgtgcccctgtgcaagcccaacccctgccccgtgcccttcgtgatccccgagaacgccctgctgagcgagaaggagttctacgtggaccagaacgtgagcatcaagtgcagagagggcttcctgctgcagggccacggcatcatcacctgcaaccccgacgagacctggacccagaccagcgccaagtgcgagaagatcagctgcggcccccccgcccacgtggagaacgccatcgccagaggcgtgcactaccagtacggcgacatgatcacctacagctgctacagcggctacatgctggagggcttcctgagaagcgtgtgcctggagaacggcacctggaccagcccccccatctgcagagccgtgtgcagattcccctgccagaacggcggcatctgccagagacccaacgcctgcagctgccccgagggctggatgggcagactgtgcgaggagcccatctgcatcctgccctgcctgaacggcggcagatgcgtggccccctaccagtgcgactgcccccccggctggaccggcagcagatgccacaccgccgtgtgccagagcccctgcctgaacggcggcaagtgcgtgagacccaacagatgccactgcctgagcagctggaccggccacaactgcagcagaaagagaagaaccggcttctag

SEQ ID NO: 101329 - DNA, 4650 bp, Artificial Sequence
  Description of Artificial Sequence: Synthetic coding sequence
atgtggcccagactggccttctgctgctggggcctggccctggtgagcggctgggccaccttccagcagatgagccccagcagaaacttcagcttcagactgttccccgagaccgcccccggcgcccccggcagcatccccgccccccccgcccccggcgacgaggccgccggcagcagagtggagagactgggccaggccttcagaagaagagtgagactgctgagagagctgagcgagagactggagctggtgttcctggtggacgacagcagcagcgtgggcgaggtgaacttcagaagcgagctgatgttcgtgagaaagctgctgagcgacttccccgtggtgcccaccgccaccagagtggccatcgtgaccttcagcagcaagaactacgtggtgcccagagtggactacatcagcaccagaagagccagacagcacaagtgcgccctgctgctgcaggagatccccgccatcagctacagaggcggcggcacctacaccaagggcgccttccagcaggccgcccagatcctgctgcacgccagagagaacagcaccaaggtggtgttcctgatcaccgacggctacagcaacggcggcgaccccagacccatcgccgccagcctgagagacagcggcgtggagatcttcaccttcggcatctggcagggcaacatcagagagctgaacgacatggccagcacccccaaggaggagcactgctacctgctgcacagcttcgaggagttcgaggccctggccagaagagccctgcacgaggacctgcccagcggcagcttcatccaggacgacatggtgcactgcagctacctgtgcgacgagggcaaggactgctgcgacagaatgggcagctgcaagtgcggcacccacaccggccacttcgagtgcatctgcgagaagggctactacggcaagggcctgcagtacgagtgcaccgcctgccccagcggcacctacaagcccgagggcagccccggcggcatcagcagctgcatcccctgccccgacgagaaccacaccagcccccccggcagcaccagccccgaggactgcgtgtgcagagagggctacagagccagcggccagacctgcgagctggtgcactgccccgccctgaagccccccgagaacggctacttcatccagaacacctgcaacaaccacttcaacgccgcctgcggcgtgagatgccaccccggcttcgacctggtgggcagcagcatcatcctgtgcctgcccaacggcctgtggagcggcagcgagagctactgcagagtgagaacctgcccccacctgagacagcccaagcacggccacatcagctgcagcaccagagagatgctgtacaagaccacctgcctggtggcctgcgacgagggctacagactggagggcagcgacaagctgacctgccagggcaacagccagtgggacggccccgagcccagatgcgtggagagacactgcagcaccttccagatgcccaaggacgtgatcatcagcccccacaactgcggcaagcagcccgccaagttcggcaccatctgctacgtgagctgcagacagggcttcatcctgagcggcgtgaaggagatgctgagatgcaccaccagcggcaagtggaacgtgggcgtgcaggccgccgtgtgcaaggacgtggaggccccccagatcaactgccccaaggacatcgaggccaagaccctggagcagcaggacagcgccaacgtgacctggcagatccccaccgccaaggacaacagcggcgagaaggtgagcgtgcacgtgcaccccgccttcacccccccctacctgttccccatcggcgacgtggccatcgtgtacaccgccaccgacctgagcggcaaccaggccagctgcatcttccacatcaaggtgatcgacgccgagccccccgtgatcgactggtgcagaagccccccccccgtgcaggtgagcgagaaggtgcacgccgccagctgggacgagccccagttcagcgacaacagcggcgccgagctggtgatcaccagaagccacacccagggcgacctgttcccccagggcgagaccatcgtgcagtacaccgccaccgaccccagcggcaacaacagaacctgcgacatccacatcgtgatcaagggcagcccctgcgagatccccttcacccccgtgaacggcgacttcatctgcacccccgacaacaccggcgtgaactgcaccctgacctgcctggagggctacgacttcaccgagggcagcaccgacaagtactactgcgcctacgaggacggcgtgtggaagcccacctacaccaccgagtggcccgactgcgccaagaagagattcgccaaccacggcttcaagagcttcgagatgttctacaaggccgccagatgcgacgacaccgacctgatgaagaagttcagcgaggccttcgagaccaccctgggcaagatggtgcccagcttctgcagcgacgccgaggacatcgactgcagactggaggagaacctgaccaagaagtactgcctggagtacaactacgactacgagaacggcttcgccatcggccccggcggctggggcgccgccaacagactggactacagctacgacgacttcctggacaccgtgcaggagaccgccaccagcatcggcaacgccaagagcagcagaatcaagagaagcgcccccctgagcgactacaagatcaagctgatcttcaacatcaccgccagcgtgcccctgcccgacgagagaaacgacaccctggagtgggagaaccagcagagactgctgcagaccctggagaccatcaccaacaagctgaagagaaccctgaacaaggaccccatgtacagcttccagctggccagcgagatcctgatcgccgacagcaacagcctggagaccaagaaggccagccccttctgcagacccggcagcgtgctgagaggcagaatgtgcgtgaactgccccctgggcacctactacaacctggagcacttcacctgcgagagctgcagaatcggcagctaccaggacgaggagggccagctggagtgcaagctgtgccccagcggcatgtacaccgagtacatccacagcagaaacatcagcgactgcaaggcccagtgcaagcagggcacctacagctacagcggcctggagacctgcgagagctgccccctgggcacctaccagcccaagttcggcagcagaagctgcctgagctgccccgagaacaccagcaccgtgaagagaggcgccgtgaacatcagcgcctgcggcgtgccctgccccgagggcaagttcagcagaagcggcctgatgccctgccacccctgccccagagactactaccagcccaacgccggcaaggccttctgcctggcctgccccttctacggcaccacccccttcgccggcagcagaagcatcaccgagtgcagcagcttcagcagcaccttcagcgccgccgaggagagcgtggtgccccccgccagcctgggccacatcaagaagagacacgagatcagcagcagagtgttccacgagtgcttcttcaacccctgccacaacagcggcacctgccagcagctgggcagaggctacgtgtgcctgtgccccctgggctacaccggcctgaagtgcgagaccgacatcgacgagtgcagccccctgccctgcctgaacaacggcgtgtgcaaggacctggtgggcgagttcatctgcgagtgccccagcggctacaccggccagagatgcgaggagaacatcaacgagtgcagcagcagcccctgcctgaacaagggcatctgcgtggacggcgtggccggctacagatgcacctgcgtgaagggcttcgtgggcctgcactgcgagaccgaggtgaacgagtgccagagcaacccctgcctgaacaacgccgtgtgcgaggaccaggtgggcggcttcctgtgcaagtgcccccccggcttcctgggcaccagatgcggcaagaacgtggacgagtgcctgagccagccctgcaagaacggcgccacctgcaaggacggcgccaacagcttcagatgcctgtgcgccgccggcttcaccggcagccactgcgagctgaacatcaacgagtgccagagcaacccctgcagaaaccaggccacctgcgtggacgagctgaacagctacagctgcaagtgccagcccggcttcagcggcaagagatgcgagaccgagcagagcaccggcttcaacctggacttcgaggtgagcggcatctacggctacgtgatgctggacggcatgctgcccagcctgcacgccctgacctgcaccttctggatgaagagcagcgacgacatgaactacggcacccccatcagctacgccgtggacaacggcagcgacaacaccctgctgctgaccgactacaacggctgggtgctgtacgtgaacggcagagagaagatcaccaactgccccagcgtgaacgacggcagatggcaccacatcgccatcacctggaccagcgccaacggcatctggaaggtgtacatcgacggcaagctgagcgacggcggcgccggcctgagcgtgggcctgcccatccccggcatgttctag

SEQ ID NO: 101330 - DNA, 2538 bp, Artificial Sequence
  Description of Artificial Sequence: Synthetic coding sequence
atgagccccagcagaaacttcagcttcagactgttccccgagaccgcccccggcgcccccggcagcatccccgccccccccgcccccggcgacgaggccgccggcagcagagtggagagactgggccaggccttcagaagaagagtgagactgctgagagagctgagcgagagactggagctggtgttcctggtggacgacagcagcagcgtgggcgaggtgaacttcagaagcgagctgatgttcgtgagaaagctgctgagcgacttccccgtggtgcccaccgccaccagagtggccatcgtgaccttcagcagcaagaactacgtggtgcccagagtggactacatcagcaccagaagagccagacagcacaagtgcgccctgctgctgcaggagatccccgccatcagctacagaggcggcggcacctacaccaagggcgccttccagcaggccgcccagatcctgctgcacgccagagagaacagcaccaaggtggtgttcctgatcaccgacggctacagcaacggcggcgaccccagacccatcgccgccagcctgagagacagcggcgtggagatcttcaccttcggcatctggcagggcaacatcagagagctgaacgacatggccagcacccccaaggaggagcactgctacctgctgcacagcttcgaggagttcgaggccctggccagaagagccctgcacgaggacctgcccagcggcagcttcatccaggacgacatggtgcactgcagctacctgtgcgacgagggcaaggactgctgcgacagaatgggcagctgcaagtgcggcacccacaccggccacttcgagtgcatctgcgagaagggctactacggcaagggcctgcagtacgagtgcaccgcctgccccagcggcacctacaagcccgagggcagccccggcggcatcagcagctgcatcccctgccccgacgagaaccacaccagcccccccggcagcaccagccccgaggactgcgtgtgcagagagggctacagagccagcggccagacctgcgagctggtgcactgccccgccctgaagccccccgagaacggctacttcatccagaacacctgcaacaaccacttcaacgccgcctgcggcgtgagatgccaccccggcttcgacctggtgggcagcagcatcatcctgtgcctgcccaacggcctgtggagcggcagcgagagctactgcagagtgagaacctgcccccacctgagacagcccaagcacggccacatcagctgcagcaccagagagatgctgtacaagaccacctgcctggtggcctgcgacgagggctacagactggagggcagcgacaagctgacctgccagggcaacagccagtgggacggccccgagcccagatgcgtggagagacactgcagcaccttccagatgcccaaggacgtgatcatcagcccccacaactgcggcaagcagcccgccaagttcggcaccatctgctacgtgagctgcagacagggcttcatcctgagcggcgtgaaggagatgctgagatgcaccaccagcggcaagtggaacgtgggcgtgcaggccgccgtgtgcaaggacgtggaggccccccagatcaactgccccaaggacatcgaggccaagaccctggagcagcaggacagcgccaacgtgacctggcagatccccaccgccaaggacaacagcggcgagaaggtgagcgtgcacgtgcaccccgccttcacccccccctacctgttccccatcggcgacgtggccatcgtgtacaccgccaccgacctgagcggcaaccaggccagctgcatcttccacatcaaggtgatcgacgccgagccccccgtgatcgactggtgcagaagccccccccccgtgcaggtgagcgagaaggtgcacgccgccagctgggacgagccccagttcagcgacaacagcggcgccgagctggtgatcaccagaagccacacccagggcgacctgttcccccagggcgagaccatcgtgcagtacaccgccaccgaccccagcggcaacaacagaacctgcgacatccacatcgtgatcaagggcagcccctgcgagatccccttcacccccgtgaacggcgacttcatctgcacccccgacaacaccggcgtgaactgcaccctgacctgcctggagggctacgacttcaccgagggcagcaccgacaagtactactgcgcctacgaggacggcgtgtggaagcccacctacaccaccgagtggcccgactgcgccaagaagagattcgccaaccacggcttcaagagcttcgagatgttctacaaggccgccagatgcgacgacaccgacctgatgaagaagttcagcgaggccttcgagaccaccctgggcaagatggtgcccagcttctgcagcgacgccgaggacatcgactgcagactggaggagaacctgaccaagaagtactgcctggagtacaactacgactacgagaacggcttcgccatcggcaactag

SEQ ID NO: 101331 - DNA, 1548 bp, Artificial Sequence
  Description of Artificial Sequence: Synthetic coding sequence
ctggagaaccagctggtgctgaaggagctgaccaccgaggtgggcgtggtgaccttcagctgcaaggagggccacgtgctgcagggccccagcgtgctgaagtgcctgcccagccagcagtggaacgacagcttccccgtgtgcaagatcgtgctgtgcacccccccccccctgatcagcttcggcgtgcccatccccagcagcgccctgcacttcggcagcaccgtgaagtacagctgcgtgggcggcttcttcctgagaggcaacagcaccaccctgtgccagcccgacggcacctggagcagccccctgcccgagtgcgtgcccgtggagtgcccccagcccgaggagatccccaacggcatcatcgacgtgcagggcctggcctacctgagcaccgccctgtacacctgcaagcccggcttcgagctggtgggcaacaccaccaccctgtgcggcgagaacggccactggctgggcggcaagcccacctgcaaggccatcgagtgcctgaagcccaaggagatcctgaacggcaagttcagctacaccgacctgcactacggccagaccgtgacctacagctgcaacagaggcttcagactggagggccccagcgccctgacctgcctggagaccggcgactgggacgtggacgcccccagctgcaacgccatccactgcgacagcccccagcccatcgagaacggcttcgtggagggcgccgactacagctacggcgccatcatcatctacagctgcttccccggcttccaggtggccggccacgccatgcagacctgcgaggagagcggctggagcagcagcatccccacctgcatgcccatcgactgcggcctgcccccccacatcgacttcggcgactgcaccaagctgaaggacgaccagggctacttcgagcaggaggacgacatgatggaggtgccctacgtgaccccccaccccccctaccacctgggcgccgtggccaagacctgggagaacaccaaggagagccccgccacccacagcagcaacttcctgtacggcaccatggtgagctacacctgcaaccccggctacgagctgctgggcaaccccgtgctgatctgccaggaggacggcacctggaacggcagcgcccccagctgcatcagcatcgagtgcgacctgcccaccgcccccgagaacggcttcctgagattcaccgagaccagcatgggcagcgccgtgcagtacagctgcaagcccggccacatcctggccggcagcgacctgagactgtgcctggagaacagaaagtggagcggcgccagccccagatgcgaggccatcagctgcaagaagcccaaccccgtgatgaacggcagcatcaagggcagcaactacacctacctgagcaccctgtactacgagtgcgaccccggctacgtgctgaacggcaccgagagaagaacctgccaggacgacaagaccggcatgagaatgagccccttcgccttcctgtggaccgccgtgcacccccagagccagcccatggccagatag

SEQ ID NO: 101332 - DNA, 10647 bp, Artificial Sequence
  Description of Artificial Sequence: Synthetic coding sequence
atgagccccagcagaaacttcagcttcagactgttccccgagaccgcccccggcgcccccggcagcatccccgccccccccgcccccggcgacgaggccgccggcagcagagtggagagactgggccaggccttcagaagaagagtgagactgctgagagagctgagcgagagactggagctggtgttcctggtggacgacagcagcagcgtgggcgaggtgaacttcagaagcgagctgatgttcgtgagaaagctgctgagcgacttccccgtggtgcccaccgccaccagagtggccatcgtgaccttcagcagcaagaactacgtggtgcccagagtggactacatcagcaccagaagagccagacagcacaagtgcgccctgctgctgcaggagatccccgccatcagctacagaggcggcggcacctacaccaagggcgccttccagcaggccgcccagatcctgctgcacgccagagagaacagcaccaaggtggtgttcctgatcaccgacggctacagcaacggcggcgaccccagacccatcgccgccagcctgagagacagcggcgtggagatcttcaccttcggcatctggcagggcaacatcagagagctgaacgacatggccagcacccccaaggaggagcactgctacctgctgcacagcttcgaggagttcgaggccctggccagaagagccctgcacgaggacctgcccagcggcagcttcatccaggacgacatggtgcactgcagctacctgtgcgacgagggcaaggactgctgcgacagaatgggcagctgcaagtgcggcacccacaccggccacttcgagtgcatctgcgagaagggctactacggcaagggcctgcagtacgagtgcaccgcctgccccagcggcacctacaagcccgagggcagccccggcggcatcagcagctgcatcccctgccccgacgagaaccacaccagcccccccggcagcaccagccccgaggactgcgtgtgcagagagggctacagagccagcggccagacctgcgagctggtgcactgccccgccctgaagccccccgagaacggctacttcatccagaacacctgcaacaaccacttcaacgccgcctgcggcgtgagatgccaccccggcttcgacctggtgggcagcagcatcatcctgtgcctgcccaacggcctgtggagcggcagcgagagctactgcagagtgagaacctgcccccacctgagacagcccaagcacggccacatcagctgcagcaccagagagatgctgtacaagaccacctgcctggtggcctgcgacgagggctacagactggagggcagcgacaagctgacctgccagggcaacagccagtgggacggccccgagcccagatgcgtggagagacactgcagcaccttccagatgcccaaggacgtgatcatcagcccccacaactgcggcaagcagcccgccaagttcggcaccatctgctacgtgagctgcagacagggcttcatcctgagcggcgtgaaggagatgctgagatgcaccaccagcggcaagtggaacgtgggcgtgcaggccgccgtgtgcaaggacgtggaggccccccagatcaactgccccaaggacatcgaggccaagaccctggagcagcaggacagcgccaacgtgacctggcagatccccaccgccaaggacaacagcggcgagaaggtgagcgtgcacgtgcaccccgccttcacccccccctacctgttccccatcggcgacgtggccatcgtgtacaccgccaccgacctgagcggcaaccaggccagctgcatcttccacatcaaggtgatcgacgccgagccccccgtgatcgactggtgcagaagccccccccccgtgcaggtgagcgagaaggtgcacgccgccagctgggacgagccccagttcagcgacaacagcggcgccgagctggtgatcaccagaagccacacccagggcgacctgttcccccagggcgagaccatcgtgcagtacaccgccaccgaccccagcggcaacaacagaacctgcgacatccacatcgtgatcaagggcagcccctgcgagatccccttcacccccgtgaacggcgacttcatctgcacccccgacaacaccggcgtgaactgcaccctgacctgcctggagggctacgacttcaccgagggcagcaccgacaagtactactgcgcctacgaggacggcgtgtggaagcccacctacaccaccgagtggcccgactgcgccaagaagagattcgccaaccacggcttcaagagcttcgagatgttctacaaggccgccagatgcgacgacaccgacctgatgaagaagttcagcgaggccttcgagaccaccctgggcaagatggtgcccagcttctgcagcgacgccgaggacatcgactgcagactggaggagaacctgaccaagaagtactgcctggagtacaactacgactacgagaacggcttcgccatcggccccggcggctggggcgccgccaacagactggactacagctacgacgacttcctggacaccgtgcaggagaccgccaccagcatcggcaacgccaagagcagcagaatcaagagaagcgcccccctgagcgactacaagatcaagctgatcttcaacatcaccgccagcgtgcccctgcccgacgagagaaacgacaccctggagtgggagaaccagcagagactgctgcagaccctggagaccatcaccaacaagctgaagagaaccctgaacaaggaccccatgtacagcttccagctggccagcgagatcctgatcgccgacagcaacagcctggagaccaagaaggccagccccttctgcagacccggcagcgtgctgagaggcagaatgtgcgtgaactgccccctgggcacctactacaacctggagcacttcacctgcgagagctgcagaatcggcagctaccaggacgaggagggccagctggagtgcaagctgtgccccagcggcatgtacaccgagtacatccacagcagaaacatcagcgactgcaaggcccagtgcaagcagggcacctacagctacagcggcctggagacctgcgagagctgccccctgggcacctaccagcccaagttcggcagcagaagctgcctgagctgccccgagaacaccagcaccgtgaagagaggcgccgtgaacatcagcgcctgcggcgtgccctgccccgagggcaagttcagcagaagcggcctgatgccctgccacccctgccccagagactactaccagcccaacgccggcaaggccttctgcctggcctgccccttctacggcaccacccccttcgccggcagcagaagcatcaccgagtgcagcagcttcagcagcaccttcagcgccgccgaggagagcgtggtgccccccgccagcctgggccacatcaagaagagacacgagatcagcagccaggtgttccacgagtgcttcttcaacccctgccacaacagcggcacctgccagcagctgggcagaggctacgtgtgcctgtgccccctgggctacaccggcctgaagtgcgagaccgacatcgacgagtgcagccccctgccctgcctgaacaacggcgtgtgcaaggacctggtgggcgagttcatctgcgagtgccccagcggctacaccggccagagatgcgaggagaacatcaacgagtgcagcagcagcccctgcctgaacaagggcatctgcgtggacggcgtggccggctacagatgcacctgcgtgaagggcttcgtgggcctgcactgcgagaccgaggtgaacgagtgccagagcaacccctgcctgaacaacgccgtgtgcgaggaccaggtgggcggcttcctgtgcaagtgcccccccggcttcctgggcaccagatgcggcaagaacgtggacgagtgcctgagccagccctgcaagaacggcgccacctgcaaggacggcgccaacagcttcagatgcctgtgcgccgccggcttcaccggcagccactgcgagctgaacatcaacgagtgccagagcaacccctgcagaaaccaggccacctgcgtggacgagctgaacagctacagctgcaagtgccagcccggcttcagcggcaagagatgcgagaccgagcagagcaccggcttcaacctggacttcgaggtgagcggcatctacggctacgtgatgctggacggcatgctgcccagcctgcacgccctgacctgcaccttctggatgaagagcagcgacgacatgaactacggcacccccatcagctacgccgtggacaacggcagcgacaacaccctgctgctgaccgactacaacggctgggtgctgtacgtgaacggcagagagaagatcaccaactgccccagcgtgaacgacggcagatggcaccacatcgccatcacctggaccagcgccaacggcatctggaaggtgtacatcgacggcaagctgagcgacggcggcgccggcctgagcgtgggcctgcccatccccggcggcggcgccctggtgctgggccaggagcaggacaagaagggcgagggcttcagccccgccgagagcttcgtgggcagcatcagccagctgaacctgtgggactacgtgctgagcccccagcaggtgaagagcctggccaccagctgccccgaggagctgagcaagggcaacgtgctggcctggcccgacttcctgagcggcatcgtgggcaaggtgaagatcgacagcaagagcatcttctgcagcgactgccccagactgggcggcagcgtgccccacctgagaaccgccagcgaggacctgaagcccggcagcaaggtgaacctgttctgcgaccccggcttccagctggtgggcaaccccgtgcagtactgcctgaaccagggccagtggacccagcccctgccccactgcgagagaatcagctgcggcgtgcccccccccctggagaacggcttccacagcgccgacgacttctacgccggcagcaccgtgacctaccagtgcaacaacggctactacctgctgggcgacagcagaatgttctgcaccgacaacggcagctggaacggcgtgagccccagctgcctggacgtggacgagtgcgccgtgggcagcgactgcagcgagcacgccagctgcctgaacgtggacggcagctacatctgcagctgcgtgcccccctacaccggcgacggcaagaactgcgccgagcccatcaagtgcaaggcccccggcaaccccgagaacggccacagcagcggcgagatctacaccgtgggcgccgaggtgaccttcagctgccaggagggctaccagctgatgggcgtgaccaagatcacctgcctggagagcggcgagtggaaccacctgatcccctactgcaaggccgtgagctgcggcaagcccgccatccccgagaacggctgcatcgaggagctggccttcaccttcggcagcaaggtgacctacagatgcaacaagggctacaccctggccggcgacaaggagagcagctgcctggccaacagcagctggagccacagcccccccgtgtgcgagcccgtgaagtgcagcagccccgagaacatcaacaacggcaagtacatcctgagcggcctgacctacctgagcaccgccagctacagctgcgacaccggctacagcctgcagggccccagcatcatcgagtgcaccgccagcggcatctgggacagagccccccccgcctgccacctggtgttctgcggcgagccccccgccatcaaggacgccgtgatcaccggcaacaacttcaccttcagaaacaccgtgacctacacctgcaaggagggctacaccctggccggcctggacaccatcgagtgcctggccgacggcaagtggagcagaagcgaccagcagtgcctggccgtgagctgcgacgagccccccatcgtggaccacgccagccccgagaccgcccacagactgttcggcgacatcgccttctactactgcagcgacggctacagcctggccgacaacagccagctgctgtgcaacgcccagggcaagtgggtgccccccgagggccaggacatgcccagatgcatcgcccacttctgcgagaagccccccagcgtgagctacagcatcctggagagcgtgagcaaggccaagttcgccgccggcagcgtggtgagcttcaagtgcatggagggcttcgtgctgaacaccagcgccaagatcgagtgcatgagaggcggccagtggaaccccagccccatgagcatccagtgcatccccgtgagatgcggcgagccccccagcatcatgaacggctacgccagcggcagcaactacagcttcggcgccatggtggcctacagctgcaacaagggcttctacatcaagggcgagaagaagagcacctgcgaggccaccggccagtggagcagccccatccccacctgccaccccgtgagctgcggcgagccccccaaggtggagaacggcttcctggagcacaccaccggcagaatcttcgagagcgaggtgagataccagtgcaaccccggctacaagagcgtgggcagccccgtgttcgtgtgccaggccaacagacactggcacagcgagagccccctgatgtgcgtgcccctggactgcggcaagcccccccccatccagaacggcttcatgaagggcgagaacttcgaggtgggcagcaaggtgcagttcttctgcaacgagggctacgagctggtgggcgacagcagctggacctgccagaagagcggcaagtggaacaagaagagcaaccccaagtgcatgcccgccaagtgccccgagccccccctgctggagaaccagctggtgctgaaggagctgaccaccgaggtgggcgtggtgaccttcagctgcaaggagggccacgtgctgcagggccccagcgtgctgaagtgcctgcccagccagcagtggaacgacagcttccccgtgtgcaagatcgtgctgtgcacccccccccccctgatcagcttcggcgtgcccatccccagcagcgccctgcacttcggcagcaccgtgaagtacagctgcgtgggcggcttcttcctgagaggcaacagcaccaccctgtgccagcccgacggcacctggagcagccccctgcccgagtgcgtgcccgtggagtgcccccagcccgaggagatccccaacggcatcatcgacgtgcagggcctggcctacctgagcaccgccctgtacacctgcaagcccggcttcgagctggtgggcaacaccaccaccctgtgcggcgagaacggccactggctgggcggcaagcccacctgcaaggccatcgagtgcctgaagcccaaggagatcctgaacggcaagttcagctacaccgacctgcactacggccagaccgtgacctacagctgcaacagaggcttcagactggagggccccagcgccctgacctgcctggagaccggcgactgggacgtggacgcccccagctgcaacgccatccactgcgacagcccccagcccatcgagaacggcttcgtggagggcgccgactacagctacggcgccatcatcatctacagctgcttccccggcttccaggtggccggccacgccatgcagacctgcgaggagagcggctggagcagcagcatccccacctgcatgcccatcgactgcggcctgcccccccacatcgacttcggcgactgcaccaagctgaaggacgaccagggctacttcgagcaggaggacgacatgatggaggtgccctacgtgaccccccaccccccctaccacctgggcgccgtggccaagacctgggagaacaccaaggagagccccgccacccacagcagcaacttcctgtacggcaccatggtgagctacacctgcaaccccggctacgagctgctgggcaaccccgtgctgatctgccaggaggacggcacctggaacggcagcgcccccagctgcatcagcatcgagtgcgacctgcccaccgcccccgagaacggcttcctgagattcaccgagaccagcatgggcagcgccgtgcagtacagctgcaagcccggccacatcctggccggcagcgacctgagactgtgcctggagaacagaaagtggagcggcgccagccccagatgcgaggccatcagctgcaagaagcccaaccccgtgatgaacggcagcatcaagggcagcaactacacctacctgagcaccctgtactacgagtgcgaccccggctacgtgctgaacggcaccgagagaagaacctgccaggacgacaagaactgggacgaggacgagcccatctgcatccccgtggactgcagcagcccccccgtgagcgccaacggccaggtgagaggcgacgagtacaccttccagaaggagatcgagtacacctgcaacgagggcttcctgctggagggcgccagaagcagagtgtgcctggccaacggcagctggagcggcgccacccccgactgcgtgcccgtgagatgcgccacccccccccagctggccaacggcgtgaccgagggcctggactacggcttcatgaaggaggtgaccttccactgccacgagggctacatcctgcacggcgcccccaagctgacctgccagagcgacggcaactgggacgccgagatccccctgtgcaagcccgtgaactgcggcccccccgaggacctggcccacggcttccccaacggcttcagcttcatccacggcggccacatccagtaccagtgcttccccggctacaagctgcacggcaacagcagcagaagatgcctgagcaacggcagctggagcggcagcagccccagctgcctgccctgcagatgcagcacccccgtgatcgagtacggcaccgtgaacggcaccgacttcgactgcggcaaggccgccagaatccagtgcttcaagggcttcaagctgctgggcctgagcgagatcacctgcgaggccgacggccagtggagcagcggcttcccccactgcgagcacaccagctgcggcagcctgcccatgatccccaacgccttcatcagcgagaccagcagctggaaggagaacgtgatcacctacagctgcagaagcggctacgtgatccagggcagcagcgacctgatctgcaccgagaagggcgtgtggagccagccctaccccgtgtgcgagcccctgagctgcggcagcccccccagcgtggccaacgccgtggccaccggcgaggcccacacctacgagagcgaggtgaagctgagatgcctggagggctacaccatggacaccgacaccgacaccttcacctgccagaaggacggcagatggttccccgagagaatcagctgcagccccaagaagtgccccctgcccgagaacatcacccacatcctggtgcacggcgacgacttcagcgtgaacagacaggtgagcgtgagctgcgccgagggctacaccttcgagggcgtgaacatcagcgtgtgccagctggacggcacctgggagccccccttcagcgacgagagctgcagccccgtgagctgcggcaagcccgagagccccgagcacggcttcgtggtgggcagcaagtacaccttcgagagcaccatcatctaccagtgcgagcccggctacgagctggagggcaacagagagagagtgtgccaggagaacagacagtggagcggcggcgtggccatctgcaaggagaccagatgcgagacccccctggagttcctgaacggcaaggccgacatcgagaacagaaccaccggccccaacgtggtgtacagctgcaacagaggctacagcctggagggccccagcgaggcccactgcaccgagaacggcacctggagccaccccgtgcccctgtgcaagcccaacccctgccccgtgcccttcgtgatccccgagaacgccctgctgagcgagaaggagttctacgtggaccagaacgtgagcatcaagtgcagagagggcttcctgctgcagggccacggcatcatcacctgcaaccccgacgagacctggacccagaccagcgccaagtgcgagaagatcagctgcggcccccccgcccacgtggagaacgccatcgccagaggcgtgcactaccagtacggcgacatgatcacctacagctgctacagcggctacatgctggagggcttcctgagaagcgtgtgcctggagaacggcacctggaccagcccccccatctgcagagccgtgtgcagattcccctgccagaacggcggcatctgccagagacccaacgcctgcagctgccccgagggctggatgggcagactgtgcgaggagcccatctgcatcctgccctgcctgaacggcggcagatgcgtggccccctaccagtgcgactgcccccccggctggaccggcagcagatgccacaccgccgtgtgccagagcccctgcctgaacggcggcaagtgcgtgagacccaacagatgccactgcctgagcagctggaccggccacaactgcagcagaaagagaagaaccggcttctag

SEQ ID NO: 101333 - DNA, 10716 bp, Artificial Sequence
  Description of Artificial Sequence: Synthetic coding sequence
atgtggcccagactggccttctgctgctggggcctggccctggtgagcggctgggccaccttccagcagatgagccccagcagaaacttcagcttcagactgttccccgagaccgcccccggcgcccccggcagcatccccgccccccccgcccccggcgacgaggccgccggcagcagagtggagagactgggccaggccttcagaagaagagtgagactgctgagagagctgagcgagagactggagctggtgttcctggtggacgacagcagcagcgtgggcgaggtgaacttcagaagcgagctgatgttcgtgagaaagctgctgagcgacttccccgtggtgcccaccgccaccagagtggccatcgtgaccttcagcagcaagaactacgtggtgcccagagtggactacatcagcaccagaagagccagacagcacaagtgcgccctgctgctgcaggagatccccgccatcagctacagaggcggcggcacctacaccaagggcgccttccagcaggccgcccagatcctgctgcacgccagagagaacagcaccaaggtggtgttcctgatcaccgacggctacagcaacggcggcgaccccagacccatcgccgccagcctgagagacagcggcgtggagatcttcaccttcggcatctggcagggcaacatcagagagctgaacgacatggccagcacccccaaggaggagcactgctacctgctgcacagcttcgaggagttcgaggccctggccagaagagccctgcacgaggacctgcccagcggcagcttcatccaggacgacatggtgcactgcagctacctgtgcgacgagggcaaggactgctgcgacagaatgggcagctgcaagtgcggcacccacaccggccacttcgagtgcatctgcgagaagggctactacggcaagggcctgcagtacgagtgcaccgcctgccccagcggcacctacaagcccgagggcagccccggcggcatcagcagctgcatcccctgccccgacgagaaccacaccagcccccccggcagcaccagccccgaggactgcgtgtgcagagagggctacagagccagcggccagacctgcgagctggtgcactgccccgccctgaagccccccgagaacggctacttcatccagaacacctgcaacaaccacttcaacgccgcctgcggcgtgagatgccaccccggcttcgacctggtgggcagcagcatcatcctgtgcctgcccaacggcctgtggagcggcagcgagagctactgcagagtgagaacctgcccccacctgagacagcccaagcacggccacatcagctgcagcaccagagagatgctgtacaagaccacctgcctggtggcctgcgacgagggctacagactggagggcagcgacaagctgacctgccagggcaacagccagtgggacggccccgagcccagatgcgtggagagacactgcagcaccttccagatgcccaaggacgtgatcatcagcccccacaactgcggcaagcagcccgccaagttcggcaccatctgctacgtgagctgcagacagggcttcatcctgagcggcgtgaaggagatgctgagatgcaccaccagcggcaagtggaacgtgggcgtgcaggccgccgtgtgcaaggacgtggaggccccccagatcaactgccccaaggacatcgaggccaagaccctggagcagcaggacagcgccaacgtgacctggcagatccccaccgccaaggacaacagcggcgagaaggtgagcgtgcacgtgcaccccgccttcacccccccctacctgttccccatcggcgacgtggccatcgtgtacaccgccaccgacctgagcggcaaccaggccagctgcatcttccacatcaaggtgatcgacgccgagccccccgtgatcgactggtgcagaagccccccccccgtgcaggtgagcgagaaggtgcacgccgccagctgggacgagccccagttcagcgacaacagcggcgccgagctggtgatcaccagaagccacacccagggcgacctgttcccccagggcgagaccatcgtgcagtacaccgccaccgaccccagcggcaacaacagaacctgcgacatccacatcgtgatcaagggcagcccctgcgagatccccttcacccccgtgaacggcgacttcatctgcacccccgacaacaccggcgtgaactgcaccctgacctgcctggagggctacgacttcaccgagggcagcaccgacaagtactactgcgcctacgaggacggcgtgtggaagcccacctacaccaccgagtggcccgactgcgccaagaagagattcgccaaccacggcttcaagagcttcgagatgttctacaaggccgccagatgcgacgacaccgacctgatgaagaagttcagcgaggccttcgagaccaccctgggcaagatggtgcccagcttctgcagcgacgccgaggacatcgactgcagactggaggagaacctgaccaagaagtactgcctggagtacaactacgactacgagaacggcttcgccatcggccccggcggctggggcgccgccaacagactggactacagctacgacgacttcctggacaccgtgcaggagaccgccaccagcatcggcaacgccaagagcagcagaatcaagagaagcgcccccctgagcgactacaagatcaagctgatcttcaacatcaccgccagcgtgcccctgcccgacgagagaaacgacaccctggagtgggagaaccagcagagactgctgcagaccctggagaccatcaccaacaagctgaagagaaccctgaacaaggaccccatgtacagcttccagctggccagcgagatcctgatcgccgacagcaacagcctggagaccaagaaggccagccccttctgcagacccggcagcgtgctgagaggcagaatgtgcgtgaactgccccctgggcacctactacaacctggagcacttcacctgcgagagctgcagaatcggcagctaccaggacgaggagggccagctggagtgcaagctgtgccccagcggcatgtacaccgagtacatccacagcagaaacatcagcgactgcaaggcccagtgcaagcagggcacctacagctacagcggcctggagacctgcgagagctgccccctgggcacctaccagcccaagttcggcagcagaagctgcctgagctgccccgagaacaccagcaccgtgaagagaggcgccgtgaacatcagcgcctgcggcgtgccctgccccgagggcaagttcagcagaagcggcctgatgccctgccacccctgccccagagactactaccagcccaacgccggcaaggccttctgcctggcctgccccttctacggcaccacccccttcgccggcagcagaagcatcaccgagtgcagcagcttcagcagcaccttcagcgccgccgaggagagcgtggtgccccccgccagcctgggccacatcaagaagagacacgagatcagcagccaggtgttccacgagtgcttcttcaacccctgccacaacagcggcacctgccagcagctgggcagaggctacgtgtgcctgtgccccctgggctacaccggcctgaagtgcgagaccgacatcgacgagtgcagccccctgccctgcctgaacaacggcgtgtgcaaggacctggtgggcgagttcatctgcgagtgccccagcggctacaccggccagagatgcgaggagaacatcaacgagtgcagcagcagcccctgcctgaacaagggcatctgcgtggacggcgtggccggctacagatgcacctgcgtgaagggcttcgtgggcctgcactgcgagaccgaggtgaacgagtgccagagcaacccctgcctgaacaacgccgtgtgcgaggaccaggtgggcggcttcctgtgcaagtgcccccccggcttcctgggcaccagatgcggcaagaacgtggacgagtgcctgagccagccctgcaagaacggcgccacctgcaaggacggcgccaacagcttcagatgcctgtgcgccgccggcttcaccggcagccactgcgagctgaacatcaacgagtgccagagcaacccctgcagaaaccaggccacctgcgtggacgagctgaacagctacagctgcaagtgccagcccggcttcagcggcaagagatgcgagaccgagcagagcaccggcttcaacctggacttcgaggtgagcggcatctacggctacgtgatgctggacggcatgctgcccagcctgcacgccctgacctgcaccttctggatgaagagcagcgacgacatgaactacggcacccccatcagctacgccgtggacaacggcagcgacaacaccctgctgctgaccgactacaacggctgggtgctgtacgtgaacggcagagagaagatcaccaactgccccagcgtgaacgacggcagatggcaccacatcgccatcacctggaccagcgccaacggcatctggaaggtgtacatcgacggcaagctgagcgacggcggcgccggcctgagcgtgggcctgcccatccccggcggcggcgccctggtgctgggccaggagcaggacaagaagggcgagggcttcagccccgccgagagcttcgtgggcagcatcagccagctgaacctgtgggactacgtgctgagcccccagcaggtgaagagcctggccaccagctgccccgaggagctgagcaagggcaacgtgctggcctggcccgacttcctgagcggcatcgtgggcaaggtgaagatcgacagcaagagcatcttctgcagcgactgccccagactgggcggcagcgtgccccacctgagaaccgccagcgaggacctgaagcccggcagcaaggtgaacctgttctgcgaccccggcttccagctggtgggcaaccccgtgcagtactgcctgaaccagggccagtggacccagcccctgccccactgcgagagaatcagctgcggcgtgcccccccccctggagaacggcttccacagcgccgacgacttctacgccggcagcaccgtgacctaccagtgcaacaacggctactacctgctgggcgacagcagaatgttctgcaccgacaacggcagctggaacggcgtgagccccagctgcctggacgtggacgagtgcgccgtgggcagcgactgcagcgagcacgccagctgcctgaacgtggacggcagctacatctgcagctgcgtgcccccctacaccggcgacggcaagaactgcgccgagcccatcaagtgcaaggcccccggcaaccccgagaacggccacagcagcggcgagatctacaccgtgggcgccgaggtgaccttcagctgccaggagggctaccagctgatgggcgtgaccaagatcacctgcctggagagcggcgagtggaaccacctgatcccctactgcaaggccgtgagctgcggcaagcccgccatccccgagaacggctgcatcgaggagctggccttcaccttcggcagcaaggtgacctacagatgcaacaagggctacaccctggccggcgacaaggagagcagctgcctggccaacagcagctggagccacagcccccccgtgtgcgagcccgtgaagtgcagcagccccgagaacatcaacaacggcaagtacatcctgagcggcctgacctacctgagcaccgccagctacagctgcgacaccggctacagcctgcagggccccagcatcatcgagtgcaccgccagcggcatctgggacagagccccccccgcctgccacctggtgttctgcggcgagccccccgccatcaaggacgccgtgatcaccggcaacaacttcaccttcagaaacaccgtgacctacacctgcaaggagggctacaccctggccggcctggacaccatcgagtgcctggccgacggcaagtggagcagaagcgaccagcagtgcctggccgtgagctgcgacgagccccccatcgtggaccacgccagccccgagaccgcccacagactgttcggcgacatcgccttctactactgcagcgacggctacagcctggccgacaacagccagctgctgtgcaacgcccagggcaagtgggtgccccccgagggccaggacatgcccagatgcatcgcccacttctgcgagaagccccccagcgtgagctacagcatcctggagagcgtgagcaaggccaagttcgccgccggcagcgtggtgagcttcaagtgcatggagggcttcgtgctgaacaccagcgccaagatcgagtgcatgagaggcggccagtggaaccccagccccatgagcatccagtgcatccccgtgagatgcggcgagccccccagcatcatgaacggctacgccagcggcagcaactacagcttcggcgccatggtggcctacagctgcaacaagggcttctacatcaagggcgagaagaagagcacctgcgaggccaccggccagtggagcagccccatccccacctgccaccccgtgagctgcggcgagccccccaaggtggagaacggcttcctggagcacaccaccggcagaatcttcgagagcgaggtgagataccagtgcaaccccggctacaagagcgtgggcagccccgtgttcgtgtgccaggccaacagacactggcacagcgagagccccctgatgtgcgtgcccctggactgcggcaagcccccccccatccagaacggcttcatgaagggcgagaacttcgaggtgggcagcaaggtgcagttcttctgcaacgagggctacgagctggtgggcgacagcagctggacctgccagaagagcggcaagtggaacaagaagagcaaccccaagtgcatgcccgccaagtgccccgagccccccctgctggagaaccagctggtgctgaaggagctgaccaccgaggtgggcgtggtgaccttcagctgcaaggagggccacgtgctgcagggccccagcgtgctgaagtgcctgcccagccagcagtggaacgacagcttccccgtgtgcaagatcgtgctgtgcacccccccccccctgatcagcttcggcgtgcccatccccagcagcgccctgcacttcggcagcaccgtgaagtacagctgcgtgggcggcttcttcctgagaggcaacagcaccaccctgtgccagcccgacggcacctggagcagccccctgcccgagtgcgtgcccgtggagtgcccccagcccgaggagatccccaacggcatcatcgacgtgcagggcctggcctacctgagcaccgccctgtacacctgcaagcccggcttcgagctggtgggcaacaccaccaccctgtgcggcgagaacggccactggctgggcggcaagcccacctgcaaggccatcgagtgcctgaagcccaaggagatcctgaacggcaagttcagctacaccgacctgcactacggccagaccgtgacctacagctgcaacagaggcttcagactggagggccccagcgccctgacctgcctggagaccggcgactgggacgtggacgcccccagctgcaacgccatccactgcgacagcccccagcccatcgagaacggcttcgtggagggcgccgactacagctacggcgccatcatcatctacagctgcttccccggcttccaggtggccggccacgccatgcagacctgcgaggagagcggctggagcagcagcatccccacctgcatgcccatcgactgcggcctgcccccccacatcgacttcggcgactgcaccaagctgaaggacgaccagggctacttcgagcaggaggacgacatgatggaggtgccctacgtgaccccccaccccccctaccacctgggcgccgtggccaagacctgggagaacaccaaggagagccccgccacccacagcagcaacttcctgtacggcaccatggtgagctacacctgcaaccccggctacgagctgctgggcaaccccgtgctgatctgccaggaggacggcacctggaacggcagcgcccccagctgcatcagcatcgagtgcgacctgcccaccgcccccgagaacggcttcctgagattcaccgagaccagcatgggcagcgccgtgcagtacagctgcaagcccggccacatcctggccggcagcgacctgagactgtgcctggagaacagaaagtggagcggcgccagccccagatgcgaggccatcagctgcaagaagcccaaccccgtgatgaacggcagcatcaagggcagcaactacacctacctgagcaccctgtactacgagtgcgaccccggctacgtgctgaacggcaccgagagaagaacctgccaggacgacaagaactgggacgaggacgagcccatctgcatccccgtggactgcagcagcccccccgtgagcgccaacggccaggtgagaggcgacgagtacaccttccagaaggagatcgagtacacctgcaacgagggcttcctgctggagggcgccagaagcagagtgtgcctggccaacggcagctggagcggcgccacccccgactgcgtgcccgtgagatgcgccacccccccccagctggccaacggcgtgaccgagggcctggactacggcttcatgaaggaggtgaccttccactgccacgagggctacatcctgcacggcgcccccaagctgacctgccagagcgacggcaactgggacgccgagatccccctgtgcaagcccgtgaactgcggcccccccgaggacctggcccacggcttccccaacggcttcagcttcatccacggcggccacatccagtaccagtgcttccccggctacaagctgcacggcaacagcagcagaagatgcctgagcaacggcagctggagcggcagcagccccagctgcctgccctgcagatgcagcacccccgtgatcgagtacggcaccgtgaacggcaccgacttcgactgcggcaaggccgccagaatccagtgcttcaagggcttcaagctgctgggcctgagcgagatcacctgcgaggccgacggccagtggagcagcggcttcccccactgcgagcacaccagctgcggcagcctgcccatgatccccaacgccttcatcagcgagaccagcagctggaaggagaacgtgatcacctacagctgcagaagcggctacgtgatccagggcagcagcgacctgatctgcaccgagaagggcgtgtggagccagccctaccccgtgtgcgagcccctgagctgcggcagcccccccagcgtggccaacgccgtggccaccggcgaggcccacacctacgagagcgaggtgaagctgagatgcctggagggctacaccatggacaccgacaccgacaccttcacctgccagaaggacggcagatggttccccgagagaatcagctgcagccccaagaagtgccccctgcccgagaacatcacccacatcctggtgcacggcgacgacttcagcgtgaacagacaggtgagcgtgagctgcgccgagggctacaccttcgagggcgtgaacatcagcgtgtgccagctggacggcacctgggagccccccttcagcgacgagagctgcagccccgtgagctgcggcaagcccgagagccccgagcacggcttcgtggtgggcagcaagtacaccttcgagagcaccatcatctaccagtgcgagcccggctacgagctggagggcaacagagagagagtgtgccaggagaacagacagtggagcggcggcgtggccatctgcaaggagaccagatgcgagacccccctggagttcctgaacggcaaggccgacatcgagaacagaaccaccggccccaacgtggtgtacagctgcaacagaggctacagcctggagggccccagcgaggcccactgcaccgagaacggcacctggagccaccccgtgcccctgtgcaagcccaacccctgccccgtgcccttcgtgatccccgagaacgccctgctgagcgagaaggagttctacgtggaccagaacgtgagcatcaagtgcagagagggcttcctgctgcagggccacggcatcatcacctgcaaccccgacgagacctggacccagaccagcgccaagtgcgagaagatcagctgcggcccccccgcccacgtggagaacgccatcgccagaggcgtgcactaccagtacggcgacatgatcacctacagctgctacagcggctacatgctggagggcttcctgagaagcgtgtgcctggagaacggcacctggaccagcccccccatctgcagagccgtgtgcagattcccctgccagaacggcggcatctgccagagacccaacgcctgcagctgccccgagggctggatgggcagactgtgcgaggagcccatctgcatcctgccctgcctgaacggcggcagatgcgtggccccctaccagtgcgactgcccccccggctggaccggcagcagatgccacaccgccgtgtgccagagcccctgcctgaacggcggcaagtgcgtgagacccaacagatgccactgcctgagcagctggaccggccacaactgcagcagaaagagaagaaccggcttctag

SEQ ID NO: 101334 - DNA, 1356 bp, Artificial Sequence
  Description of Artificial Sequence: Synthetic coding sequence
atggacttcgacgtgggcagaaccacccacctgagcagcagcccctgcagcgccagcaacggcggcgagagcggccaggtgagcaagagaagatgcctgatcggcgagagcggccacgacaccccctggtgcagccccatcaaggtgaagtacggcgacgtgtactgcagagccccccagggcggctactacaagaccgccctgggcaccagatgcgacatcagatgccagaagggctacgagctgcacggcagcagcctgctgatctgccagagcaacaagagatggagcgacaaggtgatctgcaagcagaagagatgccccaccctggccatgcccgccaacggcggcttcaagtgcgtggacggcgcctacttcaacagcagatgcgagtactactgcagccccggctacaccctgaagggcgagagaaccgtgacctgcatggacaacaaggcctggagcggcagacccgccagctgcgtggacatggagccccccagaatcaagtgccccagcgtgaaggagagaatcgccgagcccaacaagctgaccgtgagagtgagctgggagacccccgagggcagagacaccgccgacggcatcctgaccgacgtgatcctgaagggcctgccccccggcagcaacttccccgagggcgaccacaagatccagtacaccgtgtacgacagagccgagaacaagggcacctgcaagttcagagtgaaggtgagagtgaagagatgcggcaagctgaacgcccccgagaacggctacatgaagtgcagcagcgacggcgacaactacggcgccacctgcgagttcagctgcatcggcggctacgagctgcagggcagccccgccagagtgtgccagagcaacctggcctggagcggcaccgagcccacctgcgccgccatgaacgtgaacgtgggcgtgagaaccgccgccgccctgctggaccagttctacgagaagagaagactgctgatcgtgagcacccccaccgccagaaacctgctgtacagactgcagctgggcatgctgcagcaggcccagtgcggcctggacctgagacacatcaccgtggtggagctggtgggcgtgttccccaccctgatcggcagaatcggcgccaagatcatgccccccgccctggccctgcagctgagactgctgctgagaatccccctgtacagcttcagcatggtgctggtggacaagcacggcatggacaaggagagatacgtgagcctggtgatgcccgtggccctgttcaacctgatcgacaccttccccctgagaaaggaggagatggtgctgcaggccgagatgagccagacctgcaacacctag

SEQ ID NO: 101335 - DNA, 1395 bp, Artificial Sequence
  Description of Artificial Sequence: Synthetic coding sequence
atgggcagccccgcccacagacccgccctgctgctgctgctgccccccctgctgctgctgctgctgctgagagtgccccccagcagaagcttccccggcagcggcgacagccccctggaggacgacgaggtgggctacagccaccccagatacaaggacaccccctggtgcagccccatcaaggtgaagtacggcgacgtgtactgcagagccccccagggcggctactacaagaccgccctgggcaccagatgcgacatcagatgccagaagggctacgagctgcacggcagcagcctgctgatctgccagagcaacaagagatggagcgacaaggtgatctgcaagcagaagagatgccccaccctggccatgcccgccaacggcggcttcaagtgcgtggacggcgcctacttcaacagcagatgcgagtactactgcagccccggctacaccctgaagggcgagagaaccgtgacctgcatggacaacaaggcctggagcggcagacccgccagctgcgtggacatggagccccccagaatcaagtgccccagcgtgaaggagagaatcgccgagcccaacaagctgaccgtgagagtgagctgggagacccccgagggcagagacaccgccgacggcatcctgaccgacgtgatcctgaagggcctgccccccggcagcaacttccccgagggcgaccacaagatccagtacaccgtgtacgacagagccgagaacaagggcacctgcaagttcagagtgaaggtgagagtgaagagatgcggcaagctgaacgcccccgagaacggctacatgaagtgcagcagcgacggcgacaactacggcgccacctgcgagttcagctgcatcggcggctacgagctgcagggcagccccgccagagtgtgccagagcaacctggcctggagcggcaccgagcccacctgcgccgccatgaacgtgaacgtgggcgtgagaaccgccgccgccctgctggaccagttctacgagaagagaagactgctgatcgtgagcacccccaccgccagaaacctgctgtacagactgcagctgggcatgctgcagcaggcccagtgcggcctggacctgagacacatcaccgtggtggagctggtgggcgtgttccccaccctgatcggcagaatcggcgccaagatcatgccccccgccctggccctgcagctgagactgctgctgagaatccccctgtacagcttcagcatggtgctggtggacaagcacggcatggacaaggagagatacgtgagcctggtgatgcccgtggccctgttcaacctgatcgacaccttccccctgagaaaggaggagatggtgctgcaggccgagatgagccagacctgcaacacctag

SEQ ID NO: 101336 - DNA, 1218 bp, Artificial Sequence
  Description of Artificial Sequence: Synthetic coding sequence
atgggcagccccgcccacagacccgccctgctgctgctgctgccccccctgctgctgctgctgctgctgagagtgccccccagcagaagcttccccggcagcggcgacagccccctggaggacgacgaggtgggctacagccaccccagatacaaggacaccccctggtgcagccccatcaaggtgaagtacggcgacgtgtactgcagagccccccagggcggctactacaagaccgccctgggcaccagatgcgacatcagatgccagaagggctacgagctgcacggcagcagcctgctgatctgccagagcaacaagagatggagcgacaaggtgatctgcaagcacatggagccccccagaatcaagtgccccagcgtgaaggagagaatcgccgagcccaacaagctgaccgtgagagtgagctgggagacccccgagggcagagacaccgccgacggcatcctgaccgacgtgatcctgaagggcctgccccccggcagcaacttccccgagggcgaccacaagatccagtacaccgtgtacgacagagccgagaacaagggcacctgcaagttcagagtgaaggtgagagtgaagagatgcggcaagctgaacgcccccgagaacggctacatgaagtgcagcagcgacggcgacaactacggcgccacctgcgagttcagctgcatcggcggctacgagctgcagggcagccccgccagagtgtgccagagcaacctggcctggagcggcaccgagcccacctgcgccgccatgaacgtgaacgtgggcgtgagaaccgccgccgccctgctggaccagttctacgagaagagaagactgctgatcgtgagcacccccaccgccagaaacctgctgtacagactgcagctgggcatgctgcagcaggcccagtgcggcctggacctgagacacatcaccgtggtggagctggtgggcgtgttccccaccctgatcggcagaatcggcgccaagatcatgccccccgccctggccctgcagctgagactgctgctgagaatccccctgtacagcttcagcatggtgctggtggacaagcacggcatggacaaggagagatacgtgagcctggtgatgcccgtggccctgttcaacctgatcgacaccttccccctgagaaaggaggagatggtgctgcaggccgagatgagccagacctgcaacacctag

SEQ ID NO: 101337 - DNA, 1140 bp, Artificial Sequence
  Description of Artificial Sequence: Synthetic coding sequence
atgggcagccccgcccacagacccgccctgctgctgctgctgccccccctgctgctgctgctgctgctgagagtgccccccagcagaagcttccccggcagcggcgacagccccctggaggacgacgaggtgggctacagccaccccagatacaaggacaccccctggtgcagccccatcaaggtgaagtacggcgacgtgtactgcagagccccccagggcggctactacaagaccgccctgggcaccagatgcgacatcagatgccagaagggctacgagctgcacggcagcagcctgctgatctgccagagcaacaagagatggagcgacaaggtgatctgcaagcagaagagatgccccaccctggccatgcccgccaacggcggcttcaagtgcgtggacggcgcctacttcaacagcagatgcgagtactactgcagccccggctacaccctgaagggcgagagaaccgtgacctgcatggacaacaaggcctggagcggcagacccgccagctgcgtggacatggagccccccagaatcaagtgccccagcgtgaaggagagaatcgccgagcccaacaagctgaccgtgagagtgagctgggagacccccgagggcagagacaccgccgacggcatcctgaccgacgtgatcctgaagggcctgccccccggcagcaacttccccgagggcgaccacaagatccagtacaccgtgtacgacagagccgagaacaagggcacctgcaagttcagagtgaaggtgagagtgaagagatgcggcaagctgaacgcccccgagaacggctacatgaagtgcagcagcgacggcgacaactacggcgccacctgcgagttcagctgcatcggcggctacgagctgcagggcagccccgccagagtgtgccagagcaacctggcctggagcggcaccgagcccacctgcgccgccatgaacgtgaacgtgggcgtgagaaccgccgccgccctgctggaccagttctacgagaagagaagactgctgatcgtgagcacccccaccgccagaaacctgctgtacagactgcagctgggcatgctgcaggccgtggccgccaaccccaccctgctgctgcagtacggcgccagcggctag

SEQ ID NO: 101338 - DNA, 1335 bp, Artificial Sequence
  Description of Artificial Sequence: Synthetic coding sequence
atgggcagccccgcccacagacccgccctgctgctgctgctgccccccctgctgctgctgctgctgctgagagtgccccccagcagaagcttccccgacaccccctggtgcagccccatcaaggtgaagtacggcgacgtgtactgcagagccccccagggcggctactacaagaccgccctgggcaccagatgcgacatcagatgccagaagggctacgagctgcacggcagcagcctgctgatctgccagagcaacaagagatggagcgacaaggtgatctgcaagcagaagagatgccccaccctggccatgcccgccaacggcggcttcaagtgcgtggacggcgcctacttcaacagcagatgcgagtactactgcagccccggctacaccctgaagggcgagagaaccgtgacctgcatggacaacaaggcctggagcggcagacccgccagctgcgtggacatggagccccccagaatcaagtgccccagcgtgaaggagagaatcgccgagcccaacaagctgaccgtgagagtgagctgggagacccccgagggcagagacaccgccgacggcatcctgaccgacgtgatcctgaagggcctgccccccggcagcaacttccccgagggcgaccacaagatccagtacaccgtgtacgacagagccgagaacaagggcacctgcaagttcagagtgaaggtgagagtgaagagatgcggcaagctgaacgcccccgagaacggctacatgaagtgcagcagcgacggcgacaactacggcgccacctgcgagttcagctgcatcggcggctacgagctgcagggcagccccgccagagtgtgccagagcaacctggcctggagcggcaccgagcccacctgcgccgccatgaacgtgaacgtgggcgtgagaaccgccgccgccctgctggaccagttctacgagaagagaagactgctgatcgtgagcacccccaccgccagaaacctgctgtacagactgcagctgggcatgctgcagcaggcccagtgcggcctggacctgagacacatcaccgtggtggagctggtgggcgtgttccccaccctgatcggcagaatcggcgccaagatcatgccccccgccctggccctgcagctgagactgctgctgagaatccccctgtacagcttcagcatggtgctggtggacaagcacggcatggacaaggagagatacgtgagcctggtgatgcccgtggccctgttcaacctgatcgacaccttccccctgagaaaggaggagatggtgctgcaggccgagatgagccagacctgcaacacctag

SEQ ID NO: 101339 - DNA, 1398 bp, Artificial Sequence
  Description of Artificial Sequence: Synthetic coding sequence
atggccagccagctgacccagagaggcgccctgttcctgctgttcttcctgacccccgccgtgacccccacctggtacgccggcagcggctactaccccgacgagagctacaacgaggtgtacgccgaggaggtgccccaggcccccgccctggactacagagtgcccagatggtgctacaccctgaacatccaggacggcgaggccacctgctacagccccaagggcggcaactaccacagcagcctgggcaccagatgcgagctgagctgcgacagaggcttcagactgatcggcagaagaagcgtgcagtgcctgcccagcagaagatggagcggcaccgcctactgcagacagatgagatgccacgccctgcccttcatcaccagcggcacctacacctgcaccaacggcgtgctgctggacagcagatgcgactacagctgcagcagcggctaccacctggagggcgacagaagcagaatctgcatggaggacggcagatggagcggcggcgagcccgtgtgcgtggacatcgacccccccaagatcagatgcccccacagcagagagaagatggccgagcccgagaagctgaccgccagagtgtactgggacccccccctggtgaaggacagcgccgacggcaccatcaccagagtgaccctgagaggccccgagcccggcagccacttccccgagggcgagcacgtgatcagatacaccgcctacgacagagcctacaacagagccagctgcaagttcatcgtgaaggtgcaggtgagaagatgccccaccctgaagcccccccagcacggctacctgacctgcaccagcgccggcgacaactacggcgccacctgcgagtaccactgcgacggcggctacgacagacagggcacccccagcagagtgtgccagagcagcagacagtggagcggcagcccccccatctgcgcccccatgaagatcaacgtgaacgtgaacagcgccgccggcctgctggaccagttctacgagaagcagagactgctgatcatcagcgcccccgaccccagcaacagatactacaagatgcagatcagcatgctgcagcagagcacctgcggcctggacctgagacacgtgaccatcatcgagctggtgggccagcccccccaggaggtgggcagaatcagagagcagcagctgagcgccaacatcatcgaggagctgagacagttccagagactgaccagaagctacttcaacatggtgctgatcgacaagcagggcatcgacagagacagatacatggagcccgtgacccccgaggagatcttcaccttcatcgacgactacctgctgagcaaccaggagctgacccagagaagagagcagagagacatctgcgagtag

SEQ ID NO: 101340 - DNA, 1452 bp, Artificial Sequence
  Description of Artificial Sequence: Synthetic coding sequence
tgaaccttcatggtggaggacgccgtggaggccatcggcttcggcaagttccagtggaagctgagcgtgctgaccggcctggcctggatggccgacgccatggagatgatgatcctgagcatcctggccccccagctgcactgcgagtggagactgcccagctggcaggtggccctgctgaccagcgtggtgttcgtgggcatgatgagcagcagcaccctgtggggcaacatcagcgaccagtacggcagaaagaccggcctgaagatcagcgtgctgtggaccctgtactacggcatcctgagcgccttcgcccccgtgtacagctggatcctggtgctgagaggcctggtgggcttcggcatcggcggcgtgccccagagcgtgaccctgtacgccgagttcctgcccatgaaggccagagccaagtgcatcctgctgatcgaggtgttctgggccatcggcaccgtgttcgaggtggtgctggccgtgttcgtgatgcccagcctgggctggagatggctgctgatcctgagcgccgtgcccctgctgctgttcgccgtgctgtgcttctggctgcccgagagcgccagatacgacgtgctgagcggcaaccaggagaaggccatcgccaccctgaagagaatcgccaccgagaacggcgcccccatgcccctgggcaagctgatcatcagcagacaggaggacagaggcaagatgagagacctgttcaccccccacttcagatggaccaccctgctgctgtggttcatctggttcagcaacgccttcagctactacggcctggtgctgctgaccaccgagctgttccaggccggcgacgtgtgcggcatcagcagcagaaagaaggccgtggaggccaagtgcagcctggcctgcgagtacctgagcgaggaggactacatggacctgctgtggaccaccctgagcgagttccccggcgtgctggtgaccctgtggatcatcgacagactgggcagaaagaagaccatggccctgtgcttcgtgatcttcagcttctgcagcctgctgctgttcatctgcgtgggcagaaacgtgctgaccctgctgctgttcatcgccagagccttcatcagcggcggcttccaggccgcctacgtgtacacccccgaggtgtaccccaccgccaccagagccctgggcctgggcacctgcagcggcatggccagagtgggcgccctgatcacccccttcatcgcccaggtgatgctggagagcagcgtgtacctgaccctggccgtgtacagcggctgctgcctgctggccgccctggccagctgcttcctgcccatcgagaccaagggcagaggcctgcaggagagcagccacagagagtggggccaggagatggtgggcagaggcatgcacggcgccggcgtgaccagaagcaacagcggcagccaggagtag

SEQ ID NO: 101341 - DNA, 39 bp, Artificial Sequence
  Description of Artificial Sequence: Synthetic coding sequence
atggaggaggacctgttccagctgagacagctgccctag

SEQ ID NO: 101342 - DNA, 1023 bp, Artificial Sequence
  Description of Artificial Sequence: Synthetic coding sequence
atggccgccggcagactgatcatcaagaccgagttcctgcccaccaagtacagaggctacatgctgcccctgagccaggtgttctggctggccggcagcctgctgatcatcggcctggccagcgtgatcatccccaccatcggctggagatggctgatcagagtggccagcatccccggcatcatcctgatcgtggccttcaagttcatccccgagagcgccagattcaacgtgagcaccggcaacaccagagccgccctggccaccctggagagagtggccaagatgaacagaagcgtgatgcccgagggcaagctggtggagcccgtgctggagaagagaggcagattcgccgacctgctggacgccaagtacctgagaaccaccctgcagatctgggtgatctggctgggcatcagcttcgcctactacggcgtgatcctggccagcgccgagctgctggagagagacctggtgtgcggcagcaagagcgacagcgccgtggtggtgaccggcggcgacagcggcgagagccagagcccctgctactgccacatgttcgcccccagcgactacagaaccatgatcatcagcaccatcggcgagatcgccctgaaccccctgaacatcctgggcatcaacttcctgggcagaagactgagcctgagcatcaccatgggctgcaccgccctgttcttcctgctgctgaacatctgcaccagcagcgccggcctgatcggcttcctgttcatgctgagagccctggtggccgccaacttcaacaccgtgtacatctacaccgccgaggtgtaccccaccaccatgagagccctgggcatgggcaccagcggcagcctgtgcagaatcggcgccatggtggcccccttcatcagccaggtgctgatgagcgccagcatcctgggcgccctgtgcctgttcagcagcgtgtgcgtggtgtgcgccatcagcgccttcaccctgcccatcgagaccaagggcagagccctgcagcagatcaagtag

SEQ ID NO: 101343 - DNA, 1479 bp, Artificial Sequence
  Description of Artificial Sequence: Synthetic coding sequence
atggccaccaagcccaccgagcccgtgaccatcctgagcctgagaaagctgagcctgggcaccgccgagccccaggtgaaggagcccaagaccttcaccgtggaggacgccgtggagaccatcggcttcggcagattccacatcgccctgttcctgatcatgggcagcaccggcgtggtggaggccatggagatcatgctgatcgccgtggtgagccccgtgatcagatgcgagtggcagctggagaactggcaggtggccctggtgaccaccatggtgttcttcggctacatggtgttcagcatcctgttcggcctgctggccgacagatacggcagatggaagatcctgctgatcagcttcctgtggggcgcctacttcagcctgctgaccagcttcgcccccagctacatctggttcgtgttcctgagaaccatggtgggctgcggcgtgagcggccacagccagggcctgatcatcaagaccgagttcctgcccaccaagtacagaggctacatgctgcccctgagccaggtgttctggctggccggcagcctgctgatcatcggcctggccagcgtgatcatccccaccatcggctggagatggctgatcagagtggccagcatccccggcatcatcctgatcgtggccttcaagttcatccccgagagcgccagattcaacgtgagcaccggcaacaccagagccgccctggccaccctggagagagtggccaagatgaacagaagcgtgatgcccgagggcaagctggtggagcccgtgctggagaagagaggcagattcgccgacctgctggacgccaagtacctgagaaccaccctgcagatctgggtgatctggctgggcatcagcttcgcctactacggcgtgatcctggccagcgccgagctgctggagagagacctggtgtgcggcagcaagagcgacagcgccgtggtggtgaccggcggcgacagcggcgagagccagagcccctgctactgccacatgttcgcccccagcgactacagaaccatgatcatcagcaccatcggcgagatcgccctgaaccccctgaacatcctgggcatcaacttcctgggcagaagactgagcctgagcatcaccatgggctgcaccgccctgttcttcctgctgctgaacatctgcaccagcagcgccggcctgatcggcttcctgttcatgctgagagccctggtggccgccaacttcaacaccgtgtacatctacaccgccgaggtgtaccccaccaccatgagagccctgggcatgggcaccagcggcagcctgtgcagaatcggcgccatggtggcccccttcatcagccaggtgctgatgagcgccagcatcctgggcgccctgtgcctgttcagcagcgtgtgcgtggtgtgcgccatcagcgccttcaccctgcccatcgagaccaagggcagagccctgcagcagatcaagtag

SEQ ID NO: 101344 - DNA, 1023 bp, Artificial Sequence; identical to SEQ ID NO: 101342
  Description of Artificial Sequence: Synthetic coding sequence

SEQ ID NO: 101345 - DNA, 1758 bp, Artificial Sequence
  Description of Artificial Sequence: Synthetic coding sequence
atgggcagcctgaaggaggagctgctgaaggccatctggcacgccttcaccgccctggaccaggaccacagcggcaaggtgagcaagagccagctgaaggtgctgagccacaacctgtgcaccgtgctgaaggtgccccacgaccccgtggccctggaggagcacttcagagacgacgacgagggccccgtgagcaaccagggctacatgccctacctgaacagattcatcctggagaaggtgcaggacaacttcgacaagatcgagttcaacagaatgtgctggaccctgtgcgtgaagaagaacctgaccaagaaccccctgctgatcaccgaggaggacgccttcaagatctgggtgatcttcaacttcctgagcgaggacaagtaccccctgatcatcgtgagcgaggagatcgagtacctgctgaagaagctgaccgaggccatgggcggcggctggcagcaggagcagttcgagcactacaagatcaacttcgacgacagcaagaacggcctgagcgcctgggagctgatcgagctgatcggcaacggccagttcagcaagggcatggacagacagaccgtgagcatggccatcaacgaggtgttcaacgagctgatcctggacgtgctgaagcagggctacatgatgaagaagggccacagaagaaagaactggaccgagagatggttcgtgctgaagcccaacatcatcagctactacgtgagcgaggacctgaaggacaagaagggcgacatcctgctggacgagaactgctgcgtggagagcctgcccgacaaggacggcaagaagtgcctgttcctggtgaagtgcttcgacaagaccttcgagatcagcgccagcgacaagaagaagaagcaggagtggatccaggccatccacagcaccatccacctgctgaagctgggcagcccccccccccacaaggaggccagacagagaagaaaggagctgagaaagaagcagctggccgagcaggaggagctggagagacagatgaaggagctgcaggccgccaacgagagcaagcagcaggagctggaggccgtgagaaagaagctggaggaggccgccagcagagccgccgaggaggagaagaagagactgcagacccaggtggagctgcaggccagattcagcaccgagctggagagagagaagctgatcagacagcagatggaggagcaggtggcccagaagagcagcgagctggagcagtacctgcagagagtgagagagctggaggacatgtacctgaagctgcaggaggccctggaggacgagagacaggccagacaggacgaggagaccgtgagaaagctgcaggccagactgctggaggaggagagcagcaagagagccgagctggagaagtggcacctggagcagcagcaggccatccagaccaccgaggccgagaagcaggagctggagaaccagagagtgctgaaggagcaggccctgcaggaggccatggagcagctggagcagctggagctggagagaaagcaggccctggagcagtacgaggaggtgaagaagaagctggagatggccaccaacaagaccaagagctggaaggacaaggtggcccaccacgagggcctgatcagactgatcgagcccggcagcaagaacccccacctgatcaccaactggggccccgccgccttcaccgaggccgagctggaggagagagagaagaactggaaggagaagaagaccaccgagtag

SEQ ID NO: 101346 - DNA, 3129 bp, Artificial Sequence
  Description of Artificial Sequence: Synthetic coding sequence
atggagcaggacaccgccgccgtggccgccaccgtggccgccgccgacgccaccgccaccatcgtggtgatcgaggacgagcagcccggccccagcaccagccaggaggagggcgccgccgccgccgccaccgaggccaccgccgccaccgagaagggcgagaagaagaaggagaagaacgtgagcagcttccagctgaagctggccgccaaggcccccaagagcgagaaggagatggaccccgagtacgaggagaagatgaaggccgacagagccaagagattcgagttcctgctgaagcagaccgagctgttcgcccacttcatccagcccagcgcccagaagagccccaccagccccctgaacatgaagctgggcagacccagaatcaagaaggacgagaagcagagcctgatcagcgccggcgactacagacacagaagaaccgagcaggaggaggacgaggagctgctgagcgagagcagaaagaccagcaacgtgtgcatcagattcgaggtgagccccagctacgtgaagggcggccccctgagagactaccagatcagaggcctgaactggctgatcagcctgtacgagaacggcgtgaacggcatcctggccgacgagatgggcctgggcaagaccctgcagaccatcgccctgctgggctacctgaagcactacagaaacatccccggcccccacatggtgctggtgcccaagagcaccctgcacaactggatgaacgagttcaagagatgggtgcccagcctgagagtgatctgcttcgtgggcgacaaggacgccagagccgccttcatcagagacgagatgatgcccggcgagtgggacgtgtgcgtgaccagctacgagatggtgatcaaggagaagagcgtgttcaagaagttccactggagatacctggtgatcgacgaggcccacagaatcaagaacgagaagagcaagctgagcgagatcgtgagagagttcaagagcaccaacagactgctgctgaccggcacccccctgcagaacaacctgcacgagctgtgggccctgctgaacttcctgctgcccgacgtgttcaacagcgccgacgacttcgacagctggttcgacaccaagaactgcctgggcgaccagaagctggtggagagactgcacgccgtgctgaagcccttcctgctgagaagaatcaagaccgacgtggagaagagcctgccccccaagaaggagatcaagatctacctgggcctgagcaagatgcagagagagtggtacaccaagatcctgatgaaggacatcgacgtgctgaacagcagcggcaagatggacaagatgagactgctgaacatcctgatgcagctgagaaagtgctgcaaccacccctacctgttcgacggcgccgagcccggccccccctacaccaccgacgagcacatcgtgagcaacagcggcaagatggtggtgctggacaagctgctggccaagctgaaggagcagggcagcagagtgctgatcttcagccagatgaccagactgctggacatcctggaggactactgcatgtggagaggctacgagtactgcagactggacggccagaccccccacgaggagagagaggaggccatcgaggccttcaacgcccccaacagcagcaagttcatcttcatgctgagcaccagagccggcggcctgggcatcaacctggccagcgccgacgtggtgatcctgtacgacagcgactggaacccccaggtggacctgcaggccatggacagagcccacagaatcggccagaagaagcccgtgagagtgttcagactgatcaccgacaacaccgtggaggagagaatcgtggagagagccgagatcaagctgagactggacagcatcgtgatccagcagggcagactgatcgaccagcagagcaacaagctggccaaggaggagatgctgcagatgatcagacacggcgccacccacgtgttcgccagcaaggagagcgagctgaccgacgaggacatcaccaccatcctggagagaggcgagaagaagaccgccgagatgaacgagagactgcagaagatgggcgagagcagcctgagaaacttcagaatggacatcgagcagagcctgtacaagttcgagggcgaggactacagagagaagcagaagctgggcatggtggagtggatcgagccccccaagagagagagaaaggccaactacgccgtggacgcctacttcagagaggccctgagagtgagcgagcccaagatccccaaggcccccagaccccccaagcagcccaacgtgcaggacttccagttcttcccccccagactgttcgagctgctggagaaggagatcctgtactacagaaagaccatcggctacaaggtgcccagaaaccccgacatccccaaccccgccctggcccagagagaggagcagaagaagatcgacggcgccgagcccctgacccccgaggagaccgaggagaaggagaagctgctgacccagggcttcaccaactggaccaagagagacttcaaccagttcatcaaggccaacgagaagtacggcagagacgacatcgacaacatcgccagagaggtggagggcaagagccccgaggaggtgatggagtacagcgccgtgttctgggagagatgcaacgagctgcaggacatcgagaagatcatggcccagatcgagagaggcgaggccagaatccagagaagaatcagcatcaagaaggccctggacgccaagatcgccagatacaaggcccccttccaccagctgagaatccagtacggcaccagcaagggcaagaactacaccgaggaggaggacagattcctgatctgcatgctgcacaagatgggcttcgacagagagaacgtgtacgaggagctgagacagtgcgtgagaaacgccccccagttcagattcgactggttcatcaagagcagaaccgccatggagttccagagaagatgcaacaccctgatcagcctgatcgagaaggagaacatggagatcgaggagagagagagagccgagaagaagaagagagccaccaagacccccatggtgaagttcagcgccttcagctag

SEQ ID NO: 101347 - DNA, 3165 bp, Artificial Sequence
  Description of Artificial Sequence: Synthetic coding sequence
atggagcaggacaccgccgccgtggccgccaccgtggccgccgccgacgccaccgccaccatcgtggtgatcgaggacgagcagcccggccccagcaccagccaggaggagggcgccgccgccgccgccaccgaggccaccgccgccaccgagaagggcgagaagaagaaggagaagaacgtgagcagcttccagctgaagctggccgccaaggcccccaagagcgagaaggagatggaccccgagtacgaggagaagatgaaggccgacagagccaagagattcgagttcctgctgaagcagaccgagctgttcgcccacttcatccagcccagcgcccagaagagccccaccagccccctgaacatgaagctgggcagacccagaatcaagaaggacgagaagcagagcctgatcagcgccggcgactacagacacagaagaaccgagcaggaggaggacgaggagctgctgagcgagagcagaaagaccagcaacgtgtgcatcagattcgaggtgagccccagctacgtgaagggcggccccctgagagactaccagatcagaggcctgaactggctgatcagcctgtacgagaacggcgtgaacggcatcctggccgacgagatgggcctgggcaagaccctgcagaccatcgccctgctgggctacctgaagcactacagaaacatccccggcccccacatggtgctggtgcccaagagcaccctgcacaactggatgaacgagttcaagagatgggtgcccagcctgagagtgatctgcttcgtgggcgacaaggacgccagagccgccttcatcagagacgagatgatgcccggcgagtgggacgtgtgcgtgaccagctacgagatggtgatcaaggagaagagcgtgttcaagaagttccactggagatacctggtgatcgacgaggcccacagaatcaagaacgagaagagcaagctgagcgagatcgtgagagagttcaagagcaccaacagactgctgctgaccggcacccccctgcagaacaacctgcacgagctgtgggccctgctgaacttcctgctgcccgacgtgttcaacagcgccgacgacttcgacagctggttcgacaccaagaactgcctgggcgaccagaagctggtggagagactgcacgccgtgctgaagcccttcctgctgagaagaatcaagaccgacgtggagaagagcctgccccccaagaaggagatcaagatctacctgggcctgagcaagatgcagagagagtggtacaccaagatcctgatgaaggacatcgacgtgctgaacagcagcggcaagatggacaagatgagactgctgaacatcctgatgcagctgagaaagtgctgcaaccacccctacctgttcgacggcgccgagcccggccccccctacaccaccgacgagcacatcgtgagcaacagcggcaagatggtggtgctggacaagctgctggccaagctgaaggagcagggcagcagagtgctgatcttcagccagatgaccagactgctggacatcctggaggactactgcatgtggagaggctacgagtactgcagactggacggccagaccccccacgaggagagagaggacaagttcctggaggtggagttcctgggccagagagaggccatcgaggccttcaacgcccccaacagcagcaagttcatcttcatgctgagcaccagagccggcggcctgggcatcaacctggccagcgccgacgtggtgatcctgtacgacagcgactggaacccccaggtggacctgcaggccatggacagagcccacagaatcggccagaagaagcccgtgagagtgttcagactgatcaccgacaacaccgtggaggagagaatcgtggagagagccgagatcaagctgagactggacagcatcgtgatccagcagggcagactgatcgaccagcagagcaacaagctggccaaggaggagatgctgcagatgatcagacacggcgccacccacgtgttcgccagcaaggagagcgagctgaccgacgaggacatcaccaccatcctggagagaggcgagaagaagaccgccgagatgaacgagagactgcagaagatgggcgagagcagcctgagaaacttcagaatggacatcgagcagagcctgtacaagttcgagggcgaggactacagagagaagcagaagctgggcatggtggagtggatcgagccccccaagagagagagaaaggccaactacgccgtggacgcctacttcagagaggccctgagagtgagcgagcccaagatccccaaggcccccagaccccccaagcagcccaacgtgcaggacttccagttcttcccccccagactgttcgagctgctggagaaggagatcctgtactacagaaagaccatcggctacaaggtgcccagaaaccccgacatccccaaccccgccctggcccagagagaggagcagaagaagatcgacggcgccgagcccctgacccccgaggagaccgaggagaaggagaagctgctgacccagggcttcaccaactggaccaagagagacttcaaccagttcatcaaggccaacgagaagtacggcagagacgacatcgacaacatcgccagagaggtggagggcaagagccccgaggaggtgatggagtacagcgccgtgttctgggagagatgcaacgagctgcaggacatcgagaagatcatggcccagatcgagagaggcgaggccagaatccagagaagaatcagcatcaagaaggccctggacgccaagatcgccagatacaaggcccccttccaccagctgagaatccagtacggcaccagcaagggcaagaactacaccgaggaggaggacagattcctgatctgcatgctgcacaagatgggcttcgacagagagaacgtgtacgaggagctgagacagtgcgtgagaaacgccccccagttcagattcgactggttcatcaagagcagaaccgccatggagttccagagaagatgcaacaccctgatcagcctgatcgagaaggagaacatggagatcgaggagagagagagagccgagaagaagaagagagccaccaagacccccatggtgaagttcagcgccttcagctag

SEQ ID NO: 101348 - DNA, 3129 bp, Artificial Sequence; identical to SEQ ID NO: 101346
  Description of Artificial Sequence: Synthetic coding sequence

SEQ ID NO: 101349 - DNA, 3018 bp, Artificial Sequence
  Description of Artificial Sequence: Synthetic coding sequence
atggagcaggacaccgccgccgtggccgccaccgtggccgccgccgacgccaccgccaccatcgtggtgatcgaggacgagcagcccggccccagcaccagccaggaggagaagaacgtgagcagcttccagctgaagctggccgccaaggcccccaagagcgagaaggagatggaccccgagtacgaggagaagatgaaggccgacagagccaagagattcgagttcctgctgaagcagaccgagctgttcgcccacttcatccagcccagcgcccagaagagccccaccagccccctgaacatgaagctgggcagacccagaatcaagaaggacgagaagcagagcctgatcagcgccggcgactacagacacagaagaaccgagcaggaggaggacgaggagctgctgagcgagagcagaaagaccagcaacgtgtgcatcagattcgaggtgagccccagctacgtgaagggcggccccctgagagactaccagatcagaggcctgaactggctgatcagcctgtacgagaacggcgtgaacggcatcctggccgacgagatgggcctgggcaagaccctgcagaccatcgccctgctgggctacctgaagcactacagaaacatccccggcccccacatggtgctggtgcccaagagcaccctgcacaactggatgaacgagttcaagagatgggtgcccagcctgagagtgatctgcttcgtgggcgacaaggacgccagagccgccttcatcagagacgagatgatgcccggcgagtgggacgtgtgcgtgaccagctacgagatggtgatcaaggagaagagcgtgttcaagaagttccactggagatacctggtgatcgacgaggcccacagaatcaagaacgagaagagcaagctgagcgagatcgtgagagagttcaagagcaccaacagactgctgctgaccggcacccccctgcagaacaacctgcacgagctgtgggccctgctgaacttcctgctgcccgacgtgttcaacagcgccgacgacttcgacagctggttcgacaccaagaactgcctgggcgaccagaagctggtggagagactgcacgccgtgctgaagcccttcctgctgagaagaatcaagaccgacgtggagaagagcctgccccccaagaaggagatcaagatctacctgggcctgagcaagatgcagagagagtggtacaccaagatcctgatgaaggacatcgacgtgctgaacagcagcggcaagatggacaagatgagactgctgaacatcctgatgcagctgagaaagtgctgcaaccacccctacctgttcgacggcgccgagcccggccccccctacaccaccgacgagcacatcgtgagcaacagcggcaagatggtggtgctggacaagctgctggccaagctgaaggagcagggcagcagagtgctgatcttcagccagatgaccagactgctggacatcctggaggactactgcatgtggagaggctacgagtactgcagactggacggccagaccccccacgaggagagagaggacaagttcctggaggtggagttcctgggccagagagaggccatcgaggccttcaacgcccccaacagcagcaagttcatcttcatgctgagcaccagagccggcggcctgggcatcaacctggccagcgccgacgtggtgatcctgtacgacagcgactggaacccccaggtggacctgcaggccatggacagagcccacagaatcggccagaagaagcccgtgagagtgttcagactgatcaccgacaacaccgtggaggagagaatcgtggagagagccgagatcaagctgagactggacagcatcgtgatccagcagggcagactgatcgaccagcagagcaacaagctggccaaggaggagatgctgcagatgatcagacacggcgccacccacgtgttcgccagcaaggagagcgagctgaccgacgaggacatcaccaccatcctggagagaggcgagaagaagaccgccgagatgaacgagagactgcagaagatgggcgagagcagcctgagaaacttcagaatggacatcgagcagagcctgtacaagttcgagggcgaggactacagagagaagcagaagctgggcatggtggagtggatcgagccccccaagagagagagaaaggccaactacgccgtggacgcctacttcagagaggccctgagagtgagcgagcccaagatccccaaggcccccagaccccccaagcagcccaacgtgcaggacttccagttcttcccccccagactgttcgagctgctggagaaggagatcctgtactacagaaagaccatcggctacaaggtgcccagaaaccccgacatccccaaccccgccctggcccagagagaggagcagaagaagatcgacggcgccgagcccctgacccccgaggagaccgaggagaaggagaagctgctgacccagggcttcaccaactggaccaagagagacttcaaccagttcatcaaggccaacgagaagtacggcagagacgacatcgacaacatcgccagagaggtggagggcaagagccccgaggaggtgatggagtacagcgccgtgttctgggagagatgcaacgagctgcaggacatcgagaagatcatggcccagatcgagagaggcgaggccagaatccagagaagaatcagcatcaagaaggccctggacgccaagatcgccagatacaaggcccccttccaccagctgagaatccagtacggcaccagcaagggcaagaactacaccgaggaggaggacagattcctgatctgcatgctgcacaagatgggcttcgacagagagaacgtgtacgaggagctgagacagtgcgtgagaaacgccccccagttcagattcgactggttcatcaagagcagaaccgccatggagttccagagaagatgcaacaccctgatcagcctgatcgagaaggagtag

SEQ ID NO: 101350 - DNA, 837 bp, Artificial Sequence
  Description of Artificial Sequence: Synthetic coding sequence
atgctgatgaagagactggccgccagatgcttcgccggcctgctgatcctgagccccctgaccgtgatcagcgacagcagacccgccgacagcggcaaggccatcgaggacggcaacctggaggagatggaggaggaggtgagactgaagaagagaaagagaagaagaaacgtggacaaggaccccgccaaggaggacgtggagaaggccaagaagagaagaggcagaccccccgccgagaagctgagccccaacccccccaagctgaccaagcagatgaacgccatcatcgacaccgtgatcaactacaaggacagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgggcgacctggagaaggacgtgatgctgctgtgccacaacgcccagaccttcaacctggagggcagccagatctacgaggacagcatcgtgctgcagagcgtgttcaagagcgccagacagaagatcgccaaggaggaggagagcgaggacgagagcaacgaggaggaggaggaggaggacgaggaggagagcgagagcgaggccaagagcgtgaaggtgaagatcaagctgaacaagaaggacgacaagggcagagacaagggcaagggcaagaagagacccaacagaggcaaggccaagcccgtggtgagcgacttcgacagcgacgaggagcaggacgagagagagcagagcgagggcagcggcaccgacgacgagtag

SEQ ID NO: 101351 - DNA, 711 bp, Artificial Sequence
  Description of Artificial Sequence: Synthetic coding sequence
atggaggaggaggtgagactgaagaagagaaagagaagaagaaacgtggacaaggaccccgccaaggaggacgtggagaaggccaagaagagaagaggcagaccccccgccgagaagctgagccccaacccccccaagctgaccaagcagatgaacgccatcatcgacaccgtgatcaactacaaggacagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgggcgacctggagaaggacgtgatgctgctgtgccacaacgcccagaccttcaacctggagggcagccagatctacgaggacagcatcgtgctgcagagcgtgttcaagagcgccagacagaagatcgccaaggaggaggagagcgaggacgagagcaacgaggaggaggaggaggaggacgaggaggagagcgagagcgaggccaagagcgtgaaggtgaagatcaagctgaacaagaaggacgacaagggcagagacaagggcaagggcaagaagagacccaacagaggcaaggccaagcccgtggtgagcgacttcgacagcgacgaggagcaggacgagagagagcagagcgagggcagcggcaccgacgacgagtag

SEQ ID NO: 101352 - DNA, 4773 bp, Artificial Sequence
  Description of Artificial Sequence: Synthetic coding sequence
atgagcacccccaccgaccccggcgccatgccccaccccggccccagccccggccccggccccagccccggccccatcctgggccccagccccggccccggccccagccccggcagcgtgcacagcatgatgggccccagccccggcccccccagcgtgagccaccccatgcccaccatgggcagcaccgacttcccccaggagggcatgcaccagatgcacaagcccatcgacggcatccacgacaagggcatcgtggaggacatccactgcggcagcatgaagggcaccggcatgagacccccccaccccggcatgggccccccccagagccccatggaccagcacagccagggctacatgagcccccaccccagccccctgggcgcccccgagcacgtgagcagccccatgagcggcggcggccccacccccccccagatgccccccagccagcccggcgccctgatccccggcgacccccaggccatgagccagcccaacagaggccccagccccttcagccccgtgcagctgcaccagctgagagcccagatcctggcctacaagatgctggccagaggccagcccctgcccgagaccctgcagctggccgtgcagggcaagagaaccctgcccggcctgcagcagcagcagcagcagcagcagcagcagcagcagcagcagcagcagcagcagcagcagcagcagcagccccagcagcagcccccccagccccagacccagcagcagcagcagcccgccctggtgaactacaacagacccagcggccccggccccgagctgagcggccccagcaccccccagaagctgcccgtgcccgcccccggcggcagacccagccccgccccccccgccgccgcccagccccccgccgccgccgtgcccggccccagcgtgccccagcccgcccccggccagcccagccccgtgctgcagctgcagcagaagcagagcagaatcagccccatccagaagccccagggcctggaccccgtggagatcctgcaggagagagagtacagactgcaggccagaatcgcccacagaatccaggagctggagaacctgcccggcagcctgccccccgacctgagaaccaaggccaccgtggagctgaaggccctgagactgctgaacttccagagacagctgagacaggaggtggtggcctgcatgagaagagacaccaccctggagaccgccctgaacagcaaggcctacaagagaagcaagagacagaccctgagagaggccagaatgaccgagaagctggagaagcagcagaagatcgagcaggagagaaagagaagacagaagcaccaggagtacctgaacagcatcctgcagcacgccaaggacttcaaggagtaccacagaagcgtggccggcaagatccagaagctgagcaaggccgtggccacctggcacgccaacaccgagagagagcagaagaaggagaccgagagaatcgagaaggagagaatgagaagactgatggccgaggacgaggagggctacagaaagctgatcgaccagaagaaggacagaagactggcctacctgctgcagcagaccgacgagtacgtggccaacctgaccaacctggtgtgggagcacaagcaggcccaggccgccaaggagaagaagaagagaagaagaagaaagaagaaggccgaggagaacgccgagggcggcgagagcgccctgggccccgacggcgagcccatcgacgagagcagccagatgagcgacctgcccgtgaaggtgacccacaccgagaccggcaaggtgctgttcggccccgaggcccccaaggccagccagctggacgcctggctggagatgaaccccggctacgaggtggcccccagaagcgacagcgaggagagcgacagcgactacgaggaggaggacgaggaggaggagagcagcagacaggagaccgaggagaagatcctgctggaccccaacagcgaggaggtgagcgagaaggacgccaagcagatcatcgagaccgccaagcaggacgtggacgacgagtacagcatgcagtacagcgccagaggcagccagagctactacaccgtggcccacgccatcagcgagagagtggagaagcagagcgccctgctgatcaacggcaccctgaagcactaccagctgcagggcctggagtggatggtgagcctgtacaacaacaacctgaacggcatcctggccgacgagatgggcctgggcaagaccatccagaccatcgccctgatcacctacctgatggagcacaagagactgaacggcccctacctgatcatcgtgcccctgagcaccctgagcaactggacctacgagttcgacaagtgggcccccagcgtggtgaagatcagctacaagggcacccccgccatgagaagaagcctggtgccccagctgagaagcggcaagttcaacgtgctgctgaccacctacgagtacatcatcaaggacaagcacatcctggccaagatcagatggaagtacatgatcgtggacgagggccacagaatgaagaaccaccactgcaagctgacccaggtgctgaacacccactacgtggcccccagaagaatcctgctgaccggcacccccctgcagaacaagctgcccgagctgtgggccctgctgaacttcctgctgcccaccatcttcaagagctgcagcaccttcgagcagtggttcaacgcccccttcgccatgaccggcgagagagtggacctgaacgaggaggagaccatcctgatcatcagaagactgcacaaggtgctgagacccttcctgctgagaagactgaagaaggaggtggagagccagctgcccgagaaggtggagtacgtgatcaagtgcgacatgagcgccctgcagaagatcctgtacagacacatgcaggccaagggcatcctgctgaccgacggcagcgagaaggacaagaagggcaagggcggcgccaagaccctgatgaacaccatcatgcagctgagaaagatctgcaaccacccctacatgttccagcacatcgaggagagcttcgccgagcacctgggctacagcaacggcgtgatcaacggcgccgagctgtacagagccagcggcaagttcgagctgctggacagaatcctgcccaagctgagagccaccaaccacagagtgctgctgttctgccagatgaccagcctgatgaccatcatggaggactacttcgccttcagaaacttcctgtacctgagactggacggcaccaccaagagcgaggacagagccgccctgctgaagaagttcaacgagcccggcagccagtacttcatcttcctgctgagcaccagagccggcggcctgggcctgaacctgcaggccgccgacaccgtggtgatcttcgacagcgactggaacccccaccaggacctgcaggcccaggacagagcccacagaatcggccagcagaacgaggtgagagtgctgagactgtgcaccgtgaacagcgtggaggagaagatcctggccgccgccaagtacaagctgaacgtggaccagaaggtgatccaggccggcatgttcgaccagaagagcagcagccacgagagaagagccttcctgcaggccatcctggagcacgaggaggagaacgaggaggaggacgaggtgcccgacgacgagaccctgaaccagatgatcgccagaagagaggaggagttcgacctgttcatgagaatggacatggacagaagaagagaggacgccagaaaccccaagagaaagcccagactgatggaggaggacgagctgcccagctggatcatcaaggacgacgccgaggtggagagactgacctgcgaggaggaggaggagaagatcttcggcagaggcagcagacagagaagagacgtggactacagcgacgccctgaccgagaagcagtggctgagagccatcgaggacggcaacctggaggagatggaggaggaggtgagactgaagaagagaaagagaagaagaaacgtggacaaggaccccgccaaggaggacgtggagaaggccaagaagagaagaggcagaccccccgccgagaagctgagccccaacccccccaagctgaccaagcagatgaacgccatcatcgacaccgtgatcaactacaaggacagatgcaacgtggagaaggtgcccagcaacagccagctggagatcgagggcaacagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgggcgacctggagaaggacgtgatgctgctgtgccacaacgcccagaccttcaacctggagggcagccagatctacgaggacagcatcgtgctgcagagcgtgttcaagagcgccagacagaagatcgccaaggaggaggagagcgaggacgagagcaacgaggaggaggaggaggaggacgaggaggagagcgagagcgaggccaagagcgtgaaggtgaagatcaagctgaacaagaaggacgacaagggcagagacaagggcaagggcaagaagagacccaacagaggcaaggccaagcccgtggtgagcgacttcgacagcgacgaggagcaggacgagagagagcagagcgagggcagcggcaccgacgacgagtag

SEQ ID NO: 101353 - DNA, 4719 bp, Artificial Sequence
  Description of Artificial Sequence: Synthetic coding sequence
atgagcacccccaccgaccccggcgccatgccccaccccggccccagccccggccccggccccagccccggccccatcctgggccccagccccggccccggccccagccccggcagcgtgcacagcatgatgggccccagccccggcccccccagcgtgagccaccccatgcccaccatgggcagcaccgacttcccccaggagggcatgcaccagatgcacaagcccatcgacggcatccacgacaagggcatcgtggaggacatccactgcggcagcatgaagggcaccggcatgagacccccccaccccggcatgggccccccccagagccccatggaccagcacagccagggctacatgagcccccaccccagccccctgggcgcccccgagcacgtgagcagccccatgagcggcggcggccccacccccccccagatgccccccagccagcccggcgccctgatccccggcgacccccaggccatgagccagcccaacagaggccccagccccttcagccccgtgcagctgcaccagctgagagcccagatcctggcctacaagatgctggccagaggccagcccctgcccgagaccctgcagctggccgtgcagggcaagagaaccctgcccggcctgcagcagcagcagcagcagcagcagcagcagcagcagcagcagcagcagcagcagcagcagcagcagcagccccagcagcagcccccccagccccagacccagcagcagcagcagcccgccctggtgaactacaacagacccagcggccccggccccgagctgagcggccccagcaccccccagaagctgcccgtgcccgcccccggcggcagacccagccccgccccccccgccgccgcccagccccccgccgccgccgtgcccggccccagcgtgccccagcccgcccccggccagcccagccccgtgctgcagctgcagcagaagcagagcagaatcagccccatccagaagccccagggcctggaccccgtggagatcctgcaggagagagagtacagactgcaggccagaatcgcccacagaatccaggagctggagaacctgcccggcagcctgccccccgacctgagaaccaaggccaccgtggagctgaaggccctgagactgctgaacttccagagacagctgagacaggaggtggtggcctgcatgagaagagacaccaccctggagaccgccctgaacagcaaggcctacaagagaagcaagagacagaccctgagagaggccagaatgaccgagaagctggagaagcagcagaagatcgagcaggagagaaagagaagacagaagcaccaggagtacctgaacagcatcctgcagcacgccaaggacttcaaggagtaccacagaagcgtggccggcaagatccagaagctgagcaaggccgtggccacctggcacgccaacaccgagagagagcagaagaaggagaccgagagaatcgagaaggagagaatgagaagactgatggccgaggacgaggagggctacagaaagctgatcgaccagaagaaggacagaagactggcctacctgctgcagcagaccgacgagtacgtggccaacctgaccaacctggtgtgggagcacaagcaggcccaggccgccaaggagaagaagaagagaagaagaagaaagaagaaggccgaggagaacgccgagggcggcgagagcgccctgggccccgacggcgagcccatcgacgagagcagccagatgagcgacctgcccgtgaaggtgacccacaccgagaccggcaaggtgctgttcggccccgaggcccccaaggccagccagctggacgcctggctggagatgaaccccggctacgaggtggcccccagaagcgacagcgaggagagcgacagcgactacgaggaggaggacgaggaggaggagagcagcagacaggagaccgaggagaagatcctgctggaccccaacagcgaggaggtgagcgagaaggacgccaagcagatcatcgagaccgccaagcaggacgtggacgacgagtacagcatgcagtacagcgccagaggcagccagagctactacaccgtggcccacgccatcagcgagagagtggagaagcagagcgccctgctgatcaacggcaccctgaagcactaccagctgcagggcctggagtggatggtgagcctgtacaacaacaacctgaacggcatcctggccgacgagatgggcctgggcaagaccatccagaccatcgccctgatcacctacctgatggagcacaagagactgaacggcccctacctgatcatcgtgcccctgagcaccctgagcaactggacctacgagttcgacaagtgggcccccagcgtggtgaagatcagctacaagggcacccccgccatgagaagaagcctggtgccccagctgagaagcggcaagttcaacgtgctgctgaccacctacgagtacatcatcaaggacaagcacatcctggccaagatcagatggaagtacatgatcgtggacgagggccacagaatgaagaaccaccactgcaagctgacccaggtgctgaacacccactacgtggcccccagaagaatcctgctgaccggcacccccctgcagaacaagctgcccgagctgtgggccctgctgaacttcctgctgcccaccatcttcaagagctgcagcaccttcgagcagtggttcaacgcccccttcgccatgaccggcgagagagtggacctgaacgaggaggagaccatcctgatcatcagaagactgcacaaggtgctgagacccttcctgctgagaagactgaagaaggaggtggagagccagctgcccgagaaggtggagtacgtgatcaagtgcgacatgagcgccctgcagaagatcctgtacagacacatgcaggccaagggcatcctgctgaccgacggcagcgagaaggacaagaagggcaagggcggcgccaagaccctgatgaacaccatcatgcagctgagaaagatctgcaaccacccctacatgttccagcacatcgaggagagcttcgccgagcacctgggctacagcaacggcgtgatcaacggcgccgagctgtacagagccagcggcaagttcgagctgctggacagaatcctgcccaagctgagagccaccaaccacagagtgctgctgttctgccagatgaccagcctgatgaccatcatggaggactacttcgccttcagaaacttcctgtacctgagactggacggcaccaccaagagcgaggacagagccgccctgctgaagaagttcaacgagcccggcagccagtacttcatcttcctgctgagcaccagagccggcggcctgggcctgaacctgcaggccgccgacaccgtggtgatcttcgacagcgactggaacccccaccaggacctgcaggcccaggacagagcccacagaatcggccagcagaacgaggtgagagtgctgagactgtgcaccgtgaacagcgtggaggagaagatcctggccgccgccaagtacaagctgaacgtggaccagaaggtgatccaggccggcatgttcgaccagaagagcagcagccacgagagaagagccttcctgcaggccatcctggagcacgaggaggagaacgaggaggaggacgaggtgcccgacgacgagaccctgaaccagatgatcgccagaagagaggaggagttcgacctgttcatgagaatggacatggacagaagaagagaggacgccagaaaccccaagagaaagcccagactgatggaggaggacgagctgcccagctggatcatcaaggacgacgccgaggtggagagactgacctgcgaggaggaggaggagaagatcttcggcagaggcagcagacagagaagagacgtggactacagcgacgccctgaccgagaagcagtggctgagagccatcgaggacggcaacctggaggagatggaggaggaggtgagactgaagaagagaaagagaagaagaaacgtggacaaggaccccgccaaggaggacgtggagaaggccaagaagagaagaggcagaccccccgccgagaagctgagccccaacccccccaagctgaccaagcagatgaacgccatcatcgacaccgtgatcaactacaaggacagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgggcgacctggagaaggacgtgatgctgctgtgccacaacgcccagaccttcaacctggagggcagccagatctacgaggacagcatcgtgctgcagagcgtgttcaagagcgccagacagaagatcgccaaggaggaggagagcgaggacgagagcaacgaggaggaggaggaggaggacgaggaggagagcgagagcgaggccaagagcgtgaaggtgaagatcaagctgaacaagaaggacgacaagggcagagacaagggcaagggcaagaagagacccaacagaggcaaggccaagcccgtggtgagcgacttcgacagcgacgaggagcaggacgagagagagcagagcgagggcagcggcaccgacgacgagtag

SEQ ID NO: 101354 - DNA, 360 bp, Artificial Sequence
  Description of Artificial Sequence: Synthetic coding sequence
atgctgctgtgccacaacgcccagaccttcaacctggagggcagccagatctacgaggacagcatcgtgctgcagagcgtgttcaagagcgccagacagaagatcgccaaggaggaggagagcgaggacgagagcaacgaggaggaggaggaggaggacgaggaggagagcgagagcgaggccaagagcgtgaaggtgaagatcaagctgaacaagaaggacgacaagggcagagacaagggcaagggcaagaagagacccaacagaggcaaggccaagcccgtggtgagcgacttcgacagcgacgaggagcaggacgagagagagcagagcgagggcagcggcaccgacgacgagtag

SEQ ID NO: 101355 - DNA, 711 bp, Artificial Sequence; identical to SEQ ID NO: 101351
  Description of Artificial Sequence: Synthetic coding sequence

SEQ ID NO: 101356 - DNA, 711 bp, Artificial Sequence; identical to SEQ ID NO: 101351
  Description of Artificial Sequence: Synthetic coding sequence

SEQ ID NO: 101357 - DNA, 765 bp, Artificial Sequence
  Description of Artificial Sequence: Synthetic coding sequence
atggaggaggaggtgagactgaagaagagaaagagaagaagaaacgtggacaaggaccccgccaaggaggacgtggagaaggccaagaagagaagaggcagaccccccgccgagaagctgagccccaacccccccaagctgaccaagcagatgaacgccatcatcgacaccgtgatcaactacaaggacagatgcaacgtggagaaggtgcccagcaacagccagctggagatcgagggcaacagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgggcgacctggagaaggacgtgatgctgctgtgccacaacgcccagaccttcaacctggagggcagccagatctacgaggacagcatcgtgctgcagagcgtgttcaagagcgccagacagaagatcgccaaggaggaggagagcgaggacgagagcaacgaggaggaggaggaggaggacgaggaggagagcgagagcgaggccaagagcgtgaaggtgaagatcaagctgaacaagaaggacgacaagggcagagacaagggcaagggcaagaagagacccaacagaggcaaggccaagcccgtggtgagcgacttcgacagcgacgaggagcaggacgagagagagcagagcgagggcagcggcaccgacgacgagtag

SEQ ID NO: 101358 - DNA, 4719 bp, Artificial Sequence; identical to SEQ ID NO: 101353
  Description of Artificial Sequence: Synthetic coding sequence

SEQ ID NO: 101359 - DNA, 4773 bp, Artificial Sequence; identical to SEQ ID NO: 101352
  Description of Artificial Sequence: Synthetic coding sequence

SEQ ID NO: 101360 - DNA, 534 bp, Artificial Sequence
  Description of Artificial Sequence: Synthetic coding sequence
atggaggaggaggtgagactgaagaagagaaagagaagaagaaacgtggacaaggaccccgccaaggaggacgtggagaaggccaagaagagaagaggcagaccccccgccgagaagctgagccccaacccccccaagctgaccaagcagatgaacgccatcatcgacaccgtgatcaactacaaggacagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgggcgacctggagaaggacgtgatgctgctgtgccacaacgcccagaccttcaacctggagggcagccagatctacgaggacagcatcgtgctgcagagcgtgttcaagagcgccagacagaagatcgccaaggaggaggagagcgaggacgagagcaacgaggaggaggaggaggaggacgaggaggagagcgagagcgagtag

SEQ ID NO: 101361 - DNA, 816 bp, Artificial Sequence
  Description of Artificial Sequence: Synthetic coding sequence
atgaagagactggccgccagatgcttcgccggcctgctgatcctgagccccctgaccgtgatcagcgacagcagacccgccgacagcggcaaggccatcgaggacggcaacctggaggagatggaggaggaggtgagactgaagaagagaaagagaagaagaaacgtggacaaggaccccgccaaggaggacgtggagaaggccaagaagagaagaggcagaccccccgccgagaagctgagccccaacccccccaagctgaccaagcagatgaacgccatcatcgacaccgtgatcaactacaaggacagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgggcgacctggagaaggacgtgatgctgctgtgccacaacgcccagaccttcaacctggagggcagccagatctacgaggacagcatcgtgctgcagagcgtgttcaagagcgccagacagaagatcgccaaggaggaggagagcgaggacgagagcaacgaggaggaggaggaggaggacgaggaggagagcgagagcgaggccaagagcgtgaaggtgaagatcaagctgaacaagaaggacgacaagggcagagacaagggcaagggcaagaagagacccaacagaggcaaggccaagcccgtggtgagcgacttcgacagcgacgaggagcaggacgagagagtgagcgtggccgactggtag

SEQ ID NO: 101362 - DNA, 462 bp, Artificial Sequence
  Description of Artificial Sequence: Synthetic coding sequence
atgaagagactggccgccagatgcttcgccggcctgctgatcctgagccccctgaccgtgatcagcgacagcagacccgccgacagcggcaaggccatcgaggacggcaacctggaggagatggaggaggaggtgagactgaagaagagaaagagaagaagaaacgtggacaaggaccccgccaaggaggacgtggagaaggccaagaagagaagaggcagaccccccgccgagaagctgagccccaacccccccaagctgaccaagcagatgaacgccatcatcgacaccgtgatcaactacaaggacagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgggcgacctgtag

SEQ ID NO: 101363 - DNA, 468 bp, Artificial Sequence
  Description of Artificial Sequence: Synthetic coding sequence
atgagcacccccaccgaccccggcgccatgccccaccccggccccagccccggccccggccccagccccggccccatcctgggccccagccccggccccggccccagccccggcagcgtgcacagcatgatgggccccagccccggcccccccagcgtgagccaccccatgcccaccatgggcagcaccgacttcccccaggagggcatgcaccagatgcacaagcccatcgacggcatccacgacaagggcatcgtggaggacatccactgcggcagcatgaagggcaccggcatgagacccccccaccccggcatgggccccccccagagccccatggaccagcacagccagggctacatgagcccccaccccagccccctgggcgcccccgagcacgtgagcagccccatgagcggcggcggccccacccccccccagatgccccccagccagcccggcgcctag

SEQ ID NO: 101364 - DNA, 1680 bp, Artificial Sequence
  Description of Artificial Sequence: Synthetic coding sequence
atgagcacccccaccgaccccggcgccatgccccaccccggccccagccccggccccggccccagccccggccccatcctgggccccagccccggccccggccccagccccggcagcgtgcacagcatgatgggccccagccccggcccccccagcgtgagccaccccatgcccaccatgggcagcaccgacttcccccaggagggcatgcaccagatgcacaagcccatcgacggcatccacgacaagggcatcgtggaggacatccactgcggcagcatgaagggcaccggcatgagacccccccaccccggcatgggccccccccagagccccatggaccagcacagccagggctacatgagcccccaccccagccccctgggcgcccccgagcacgtgagcagccccatgagcggcggcggccccacccccccccagatgccccccagccagcccggcgccctgatccccggcgacccccaggccatgagccagcccaacagaggccccagccccttcagccccgtgcagctgcaccagctgagagcccagatcctggcctacaagatgctggccagaggccagcccctgcccgagaccctgcagctggccgtgcagggcaagagaaccctgcccggcctgcagcagcagcagcagcagcagcagcagcagcagcagcagcagcagcagcagcagcagcagcagcagcagccccagcagcagcccccccagccccagacccagcagcagcagcagcccgccctggtgaactacaacagacccagcggccccggccccgagctgagcggccccagcaccccccagaagctgcccgtgcccgcccccggcggcagacccagccccgccccccccgccgccgcccagccccccgccgccgccgtgcccggccccagcgtgccccagcccgcccccggccagcccagccccgtgctgcagctgcagcagaagcagagcagaatcagccccatccagaagccccagggcctggaccccgtggagatcctgcaggagagagagtacagactgcaggccagaatcgcccacagaatccaggagctggagaacctgcccggcagcctgccccccgacctgagaaccaaggccaccgtggagctgaaggccctgagactgctgaacttccagagacagctgagacaggaggtggtggcctgcatgagaagagacaccaccctggagaccgccctgaacagcaaggcctacaagagaagcaagagacagaccctgagagaggccagaatgaccgagaagctggagaagcagcagaagatcgagcaggagagaaagagaagacagaagcaccaggagtacctgaacagcatcctgcagcacgccaaggacttcaaggagtaccacagaagcgtggccggcaagatccagaagctgagcaaggccgtggccacctggcacgccaacaccgagagagagcagaagaaggagaccgagagaatcgagaaggagagaatgagaagactgatggccgaggacgaggagggctacagaaagctgatcgaccagaagaaggacagaagactggcctacctgctgcagcagaccgacgagtacgtggccaacctgaccaacctggtgtgggagcacaagcaggcccaggccgccaaggagaagaagaagagatag

SEQ ID NO: 101365 - DNA, 516 bp, Artificial Sequence
  Description of Artificial Sequence: Synthetic coding sequence
atggaggaggaggtgagactgaagaagagaaagagaagaagaaacgtggacaaggaccccgccaaggaggacgtggagaaggccaagaagagaagaggcagaccccccgccgagaagctgagccccaacccccccaagctgaccaagcagatgaacgccatcatcgacaccgtgatcaactacaaggacagatgcaacgtggagaaggtgcccagcaacagccagctggagatcgagggcaacagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgggcgacctggagaaggacgtgatgctgctgtgccacaacgcccagaccttcaacctggagggcagccagatctacgaggacagcatcgtgctgcagagcgtgttcaagagcgccagacagaagatcgcctag

SEQ ID NO: 101366 - DNA, 201 bp, Artificial Sequence
  Description of Artificial Sequence: Synthetic coding sequence
atgagcacccccaccgaccccggcgccatgccccaccccggccccagccccggccccggccccagccccggccccatcctgggccccagccccggccccggccccagccccggcagcgtgcacagcatgatgggccccagccccggcccccccagcgtgagccaccccatgcccaccatgggcagcaccgacttcccctag

SEQ ID NO: 101367 - DNA, 4944 bp, Artificial Sequence
  Description of Artificial Sequence: Synthetic coding sequence
atgagcacccccgacccccccctgggcggcacccccagacccggccccagccccggccccggccccagccccggcgccatgctgggccccagccccggccccagccccggcagcgcccacagcatgatgggccccagccccggcccccccagcgccggccaccccatccccacccagggccccggcggctacccccaggacaacatgcaccagatgcacaagcccatggagagcatgcacgagaagggcatgagcgacgaccccagatacaaccagatgaagggcatgggcatgagaagcggcggccacgccggcatgggccccccccccagccccatggaccagcacagccagggctaccccagccccctgggcggcagcgagcacgccagcagccccgtgcccgccagcggccccagcagcggcccccagatgagcagcggccccggcggcgcccccctggacggcgccgacccccaggccctgggccagcagaacagaggccccacccccttcaaccagaaccagctgcaccagctgagagcccagatcatggcctacaagatgctggccagaggccagcccctgcccgaccacctgcagatggccgtgcagggcaagagacccatgcccggcatgcagcagcagatgcccaccctgcccccccccagcgtgagcgccaccggccccggccccggccccggccccggccccggccccggccccggccccgccccccccaactacagcagaccccacggcatgggcggccccaacatgcccccccccggccccagcggcgtgccccccggcatgcccggccagccccccggcggcccccccaagccctggcccgagggccccatggccaacgccgccgcccccaccagcaccccccagaagctgatccccccccagcccaccggcagacccagccccgccccccccgccgtgccccccgccgccagccccgtgatgcccccccagacccagagccccggccagcccgcccagcccgcccccatggtgcccctgcaccagaagcagagcagaatcacccccatccagaagcccagaggcctggaccccgtggagatcctgcaggagagagagtacagactgcaggccagaatcgcccacagaatccaggagctggagaacctgcccggcagcctggccggcgacctgagaaccaaggccaccatcgagctgaaggccctgagactgctgaacttccagagacagctgagacaggaggtggtggtgtgcatgagaagagacaccgccctggagaccgccctgaacgccaaggcctacaagagaagcaagagacagagcctgagagaggccagaatcaccgagaagctggagaagcagcagaagatcgagcaggagagaaagagaagacagaagcaccaggagtacctgaacagcatcctgcagcacgccaaggacttcaaggagtaccacagaagcgtgaccggcaagatccagaagctgaccaaggccgtggccacctaccacgccaacaccgagagagagcagaagaaggagaacgagagaatcgagaaggagagaatgagaagactgatggccgaggacgaggagggctacagaaagctgatcgaccagaagaaggacaagagactggcctacctgctgcagcagaccgacgagtacgtggccaacctgaccgagctggtgagacagcacaaggccgcccaggtggccaaggagaagaagaagaagaagaagaagaagaaggccgagaacgccgagggccagacccccgccatcggccccgacggcgagcccctggacgagaccagccagatgagcgacctgcccgtgaaggtgatccacgtggagagcggcaagatcctgaccggcaccgacgcccccaaggccggccagctggaggcctggctggagatgaaccccggctacgaggtggcccccagaagcgacagcgaggagagcggcagcgaggaggaggaggaggaggaggaggaggagcagccccaggccgcccagccccccaccctgcccgtggaggagaagaagaagatccccgaccccgacagcgacgacgtgagcgaggtggacgccagacacatcatcgagaacgccaagcaggacgtggacgacgagtacggcgtgagccaggccctggccagaggcctgcagagctactacgccgtggcccacgccgtgaccgagagagtggacaagcagagcgccctgatggtgaacggcgtgctgaagcagtaccagatcaagggcctggagtggctggtgagcctgtacaacaacaacctgaacggcatcctggccgacgagatgggcctgggcaagaccatccagaccatcgccctgatcacctacctgatggagcacaagagaatcaacggccccttcctgatcatcgtgcccctgagcaccctgagcaactgggcctacgagttcgacaagtgggcccccagcgtggtgaaggtgagctacaagggcagccccgccgccagaagagccttcgtgccccagctgagaagcggcaagttcaacgtgctgctgaccacctacgagtacatcatcaaggacaagcacatcctggccaagatcagatggaagtacatgatcgtggacgagggccacagaatgaagaaccaccactgcaagctgacccaggtgctgaacacccactacgtggcccccagaagactgctgctgaccggcacccccctgcagaacaagctgcccgagctgtgggccctgctgaacttcctgctgcccaccatcttcaagagctgcagcaccttcgagcagtggttcaacgcccccttcgccatgaccggcgagaaggtggacctgaacgaggaggagaccatcctgatcatcagaagactgcacaaggtgctgagacccttcctgctgagaagactgaagaaggaggtggaggcccagctgcccgagaaggtggagtacgtgatcaagtgcgacatgagcgccctgcagagagtgctgtacagacacatgcaggccaagggcgtgctgctgaccgacggcagcgagaaggacaagaagggcaagggcggcaccaagaccctgatgaacaccatcatgcagctgagaaagatctgcaaccacccctacatgttccagcacatcgaggagagcttcagcgagcacctgggcttcaccggcggcatcgtgcagggcctggacctgtacagagccagcggcaagttcgagctgctggacagaatcctgcccaagctgagagccaccaaccacaaggtgctgctgttctgccagatgaccagcctgatgaccatcatggaggactacttcgcctacagaggcttcaagtacctgagactggacggcaccaccaaggccgaggacagaggcatgctgctgaagaccttcaacgagcccggcagcgagtacttcatcttcctgctgagcaccagagccggcggcctgggcctgaacctgcagagcgccgacaccgtgatcatcttcgacagcgactggaacccccaccaggacctgcaggcccaggacagagcccacagaatcggccagcagaacgaggtgagagtgctgagactgtgcaccgtgaacagcgtggaggagaagatcctggccgccgccaagtacaagctgaacgtggaccagaaggtgatccaggccggcatgttcgaccagaagagcagcagccacgagagaagagccttcctgcaggccatcctggagcacgaggagcaggacgagagcagacactgcagcaccggcagcggcagcgccagcttcgcccacaccgcccccccccccgccggcgtgaaccccgacctggaggagccccccctgaaggaggaggacgaggtgcccgacgacgagaccgtgaaccagatgatcgccagacacgaggaggagttcgacctgttcatgagaatggacctggacagaagaagagaggaggccagaaaccccaagagaaagcccagactgatggaggaggacgagctgcccagctggatcatcaaggacgacgccgaggtggagagactgacctgcgaggaggaggaggagaagatgttcggcagaggcagcagacacagaaaggaggtggactacagcgacagcctgaccgagaagcagtggctgaaggccatcgaggagggcaccctggaggagatcgaggaggaggtgagacagaagaagagcagcagaaagagaaagagagacagcgacgccggcagcagcacccccaccaccagcaccagaagcagagacaaggacgacgagagcaagaagcagaagaagagaggcagaccccccgccgagaagctgagccccaacccccccaacctgaccaagaagatgaagaagatcgtggacgccgtgatcaagtacaaggacagcagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgaacgacctggagaaggacgtgatgctgctgtgccagaacgcccagaccttcaacctggagggcagcctgatctacgaggacagcatcgtgctgcagagcgtgttcaccagcgtgagacagaagatcgagaaggaggacgacagcgagggcgaggagagcgaggaggaggaggagggcgaggaggagggcagcgagagcgagagcagaagcgtgaaggtgaagatcaagctgggcagaaaggagaaggcccaggacagactgaagggcggcagaagaagacccagcagaggcagcagagccaagcccgtggtgagcgacgacgacagcgaggaggagcaggaggaggacagaagcggcagcggcagcgaggaggactag

SEQ ID NO: 101368 - DNA, 5040 bp, Artificial Sequence
  Description of Artificial Sequence: Synthetic coding sequence
atgagcacccccgacccccccctgggcggcacccccagacccggccccagccccggccccggccccagccccggcgccatgctgggccccagccccggccccagccccggcagcgcccacagcatgatgggccccagccccggcccccccagcgccggccaccccatccccacccagggccccggcggctacccccaggacaacatgcaccagatgcacaagcccatggagagcatgcacgagaagggcatgagcgacgaccccagatacaaccagatgaagggcatgggcatgagaagcggcggccacgccggcatgggccccccccccagccccatggaccagcacagccagggctaccccagccccctgggcggcagcgagcacgccagcagccccgtgcccgccagcggccccagcagcggcccccagatgagcagcggccccggcggcgcccccctggacggcgccgacccccaggccctgggccagcagaacagaggccccacccccttcaaccagaaccagctgcaccagctgagagcccagatcatggcctacaagatgctggccagaggccagcccctgcccgaccacctgcagatggccgtgcagggcaagagacccatgcccggcatgcagcagcagatgcccaccctgcccccccccagcgtgagcgccaccggccccggccccggccccggccccggccccggccccggccccggccccgccccccccaactacagcagaccccacggcatgggcggccccaacatgcccccccccggccccagcggcgtgccccccggcatgcccggccagccccccggcggcccccccaagccctggcccgagggccccatggccaacgccgccgcccccaccagcaccccccagaagctgatccccccccagcccaccggcagacccagccccgccccccccgccgtgccccccgccgccagccccgtgatgcccccccagacccagagccccggccagcccgcccagcccgcccccatggtgcccctgcaccagaagcagagcagaatcacccccatccagaagcccagaggcctggaccccgtggagatcctgcaggagagagagtacagactgcaggccagaatcgcccacagaatccaggagctggagaacctgcccggcagcctggccggcgacctgagaaccaaggccaccatcgagctgaaggccctgagactgctgaacttccagagacagctgagacaggaggtggtggtgtgcatgagaagagacaccgccctggagaccgccctgaacgccaaggcctacaagagaagcaagagacagagcctgagagaggccagaatcaccgagaagctggagaagcagcagaagatcgagcaggagagaaagagaagacagaagcaccaggagtacctgaacagcatcctgcagcacgccaaggacttcaaggagtaccacagaagcgtgaccggcaagatccagaagctgaccaaggccgtggccacctaccacgccaacaccgagagagagcagaagaaggagaacgagagaatcgagaaggagagaatgagaagactgatggccgaggacgaggagggctacagaaagctgatcgaccagaagaaggacaagagactggcctacctgctgcagcagaccgacgagtacgtggccaacctgaccgagctggtgagacagcacaaggccgcccaggtggccaaggagaagaagaagaagaagaagaagaagaaggccgagaacgccgagggccagacccccgccatcggccccgacggcgagcccctggacgagaccagccagatgagcgacctgcccgtgaaggtgatccacgtggagagcggcaagatcctgaccggcaccgacgcccccaaggccggccagctggaggcctggctggagatgaaccccggctacgaggtggcccccagaagcgacagcgaggagagcggcagcgaggaggaggaggaggaggaggaggaggagcagccccaggccgcccagccccccaccctgcccgtggaggagaagaagaagatccccgaccccgacagcgacgacgtgagcgaggtggacgccagacacatcatcgagaacgccaagcaggacgtggacgacgagtacggcgtgagccaggccctggccagaggcctgcagagctactacgccgtggcccacgccgtgaccgagagagtggacaagcagagcgccctgatggtgaacggcgtgctgaagcagtaccagatcaagggcctggagtggctggtgagcctgtacaacaacaacctgaacggcatcctggccgacgagatgggcctgggcaagaccatccagaccatcgccctgatcacctacctgatggagcacaagagaatcaacggccccttcctgatcatcgtgcccctgagcaccctgagcaactgggcctacgagttcgacaagtgggcccccagcgtggtgaaggtgagctacaagggcagccccgccgccagaagagccttcgtgccccagctgagaagcggcaagttcaacgtgctgctgaccacctacgagtacatcatcaaggacaagcacatcctggccaagatcagatggaagtacatgatcgtggacgagggccacagaatgaagaaccaccactgcaagctgacccaggtgctgaacacccactacgtggcccccagaagactgctgctgaccggcacccccctgcagaacaagctgcccgagctgtgggccctgctgaacttcctgctgcccaccatcttcaagagctgcagcaccttcgagcagtggttcaacgcccccttcgccatgaccggcgagaaggtggacctgaacgaggaggagaccatcctgatcatcagaagactgcacaaggtgctgagacccttcctgctgagaagactgaagaaggaggtggaggcccagctgcccgagaaggtggagtacgtgatcaagtgcgacatgagcgccctgcagagagtgctgtacagacacatgcaggccaagggcgtgctgctgaccgacggcagcgagaaggacaagaagggcaagggcggcaccaagaccctgatgaacaccatcatgcagctgagaaagatctgcaaccacccctacatgttccagcacatcgaggagagcttcagcgagcacctgggcttcaccggcggcatcgtgcagggcctggacctgtacagagccagcggcaagttcgagctgctggacagaatcctgcccaagctgagagccaccaaccacaaggtgctgctgttctgccagatgaccagcctgatgaccatcatggaggactacttcgcctacagaggcttcaagtacctgagactggacggcaccaccaaggccgaggacagaggcatgctgctgaagaccttcaacgagcccggcagcgagtacttcatcttcctgctgagcaccagagccggcggcctgggcctgaacctgcagagcgccgacaccgtgatcatcttcgacagcgactggaacccccaccaggacctgcaggcccaggacagagcccacagaatcggccagcagaacgaggtgagagtgctgagactgtgcaccgtgaacagcgtggaggagaagatcctggccgccgccaagtacaagctgaacgtggaccagaaggtgatccaggccggcatgttcgaccagaagagcagcagccacgagagaagagccttcctgcaggccatcctggagcacgaggagcaggacgagagcagacactgcagcaccggcagcggcagcgccagcttcgcccacaccgcccccccccccgccggcgtgaaccccgacctggaggagccccccctgaaggaggaggacgaggtgcccgacgacgagaccgtgaaccagatgatcgccagacacgaggaggagttcgacctgttcatgagaatggacctggacagaagaagagaggaggccagaaaccccaagagaaagcccagactgatggaggaggacgagctgcccagctggatcatcaaggacgacgccgaggtggagagactgacctgcgaggaggaggaggagaagatgttcggcagaggcagcagacacagaaaggaggtggactacagcgacagcctgaccgagaagcagtggctgaagaagatcaccggcaaggacatccacgacaccgccagcagcgtggccagaggcctgcagttccagagaggcctgcagttctgcaccagagccagcaaggccatcgaggagggcaccctggaggagatcgaggaggaggtgagacagaagaagagcagcagaaagagaaagagagacagcgacgccggcagcagcacccccaccaccagcaccagaagcagagacaaggacgacgagagcaagaagcagaagaagagaggcagaccccccgccgagaagctgagccccaacccccccaacctgaccaagaagatgaagaagatcgtggacgccgtgatcaagtacaaggacagcagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgaacgacctggagaaggacgtgatgctgctgtgccagaacgcccagaccttcaacctggagggcagcctgatctacgaggacagcatcgtgctgcagagcgtgttcaccagcgtgagacagaagatcgagaaggaggacgacagcgagggcgaggagagcgaggaggaggaggagggcgaggaggagggcagcgagagcgagagcagaagcgtgaaggtgaagatcaagctgggcagaaaggagaaggcccaggacagactgaagggcggcagaagaagacccagcagaggcagcagagccaagcccgtggtgagcgacgacgacagcgaggaggagcaggaggaggacagaagcggcagcggcagcgaggaggactag

SEQ ID NO: 101369 - DNA, 4854 bp, Artificial Sequence
  Description of Artificial Sequence: Synthetic coding sequence
atgagcacccccgacccccccctgggcggcacccccagacccggccccagccccggccccggccccagccccggcgccatgctgggccccagccccggccccagccccggcagcgcccacagcatgatgggccccagccccggcccccccagcgccggccaccccatccccacccagggccccggcggctacccccaggacaacatgcaccagatgcacaagcccatggagagcatgcacgagaagggcatgagcgacgaccccagatacaaccagatgaagggcatgggcatgagaagcggcggccacgccggcatgggccccccccccagccccatggaccagcacagccagggctaccccagccccctgggcggcagcgagcacgccagcagccccgtgcccgccagcggccccagcagcggcccccagatgagcagcggccccggcggcgcccccctggacggcgccgacccccaggccctgggccagcagaacagaggccccacccccttcaaccagaaccagctgcaccagctgagagcccagatcatggcctacaagatgctggccagaggccagcccctgcccgaccacctgcagatggccgtgcagggcaagagacccatgcccggcatgcagcagcagatgcccaccctgcccccccccagcgtgagcgccaccggccccggccccggccccggccccggccccggccccggccccggccccgccccccccaactacagcagaccccacggcatgggcggccccaacatgcccccccccggccccagcggcgtgccccccggcatgcccggccagccccccggcggcccccccaagccctggcccgagggccccatggccaacgccgccgcccccaccagcaccccccagaagctgatccccccccagcccaccggcagacccagccccgccccccccgccgtgccccccgccgccagccccgtgatgcccccccagacccagagccccggccagcccgcccagcccgcccccatggtgcccctgcaccagaagcagagcagaatcacccccatccagaagcccagaggcctggaccccgtggagatcctgcaggagagagagtacagactgcaggccagaatcgcccacagaatccaggagctggagaacctgcccggcagcctggccggcgacctgagaaccaaggccaccatcgagctgaaggccctgagactgctgaacttccagagacagctgagacaggaggtggtggtgtgcatgagaagagacaccgccctggagaccgccctgaacgccaaggcctacaagagaagcaagagacagagcctgagagaggccagaatcaccgagaagctggagaagcagcagaagatcgagcaggagagaaagagaagacagaagcaccaggagtacctgaacagcatcctgcagcacgccaaggacttcaaggagtaccacagaagcgtgaccggcaagatccagaagctgaccaaggccgtggccacctaccacgccaacaccgagagagagcagaagaaggagaacgagagaatcgagaaggagagaatgagaagactgatggccgaggacgaggagggctacagaaagctgatcgaccagaagaaggacaagagactggcctacctgctgcagcagaccgacgagtacgtggccaacctgaccgagctggtgagacagcacaaggccgcccaggtggccaaggagaagaagaagaagaagaagaagaagaaggccgagaacgccgagggccagacccccgccatcggccccgacggcgagcccctggacgagaccagccagatgagcgacctgcccgtgaaggtgatccacgtggagagcggcaagatcctgaccggcaccgacgcccccaaggccggccagctggaggcctggctggagatgaaccccggctacgaggtggcccccagaagcgacagcgaggagagcggcagcgaggaggaggaggaggaggaggaggaggagcagccccaggccgcccagccccccaccctgcccgtggaggagaagaagaagatccccgaccccgacagcgacgacgtgagcgaggtggacgccagacacatcatcgagaacgccaagcaggacgtggacgacgagtacggcgtgagccaggccctggccagaggcctgcagagctactacgccgtggcccacgccgtgaccgagagagtggacaagcagagcgccctgatggtgaacggcgtgctgaagcagtaccagatcaagggcctggagtggctggtgagcctgtacaacaacaacctgaacggcatcctggccgacgagatgggcctgggcaagaccatccagaccatcgccctgatcacctacctgatggagcacaagagaatcaacggccccttcctgatcatcgtgcccctgagcaccctgagcaactgggcctacgagttcgacaagtgggcccccagcgtggtgaaggtgagctacaagggcagccccgccgccagaagagccttcgtgccccagctgagaagcggcaagttcaacgtgctgctgaccacctacgagtacatcatcaaggacaagcacatcctggccaagatcagatggaagtacatgatcgtggacgagggccacagaatgaagaaccaccactgcaagctgacccaggtgctgaacacccactacgtggcccccagaagactgctgctgaccggcacccccctgcagaacaagctgcccgagctgtgggccctgctgaacttcctgctgcccaccatcttcaagagctgcagcaccttcgagcagtggttcaacgcccccttcgccatgaccggcgagaaggtggacctgaacgaggaggagaccatcctgatcatcagaagactgcacaaggtgctgagacccttcctgctgagaagactgaagaaggaggtggaggcccagctgcccgagaaggtggagtacgtgatcaagtgcgacatgagcgccctgcagagagtgctgtacagacacatgcaggccaagggcgtgctgctgaccgacggcagcgagaaggacaagaagggcaagggcggcaccaagaccctgatgaacaccatcatgcagctgagaaagatctgcaaccacccctacatgttccagcacatcgaggagagcttcagcgagcacctgggcttcaccggcggcatcgtgcagggcctggacctgtacagagccagcggcaagttcgagctgctggacagaatcctgcccaagctgagagccaccaaccacaaggtgctgctgttctgccagatgaccagcctgatgaccatcatggaggactacttcgcctacagaggcttcaagtacctgagactggacggcaccaccaaggccgaggacagaggcatgctgctgaagaccttcaacgagcccggcagcgagtacttcatcttcctgctgagcaccagagccggcggcctgggcctgaacctgcagagcgccgacaccgtgatcatcttcgacagcgactggaacccccaccaggacctgcaggcccaggacagagcccacagaatcggccagcagaacgaggtgagagtgctgagactgtgcaccgtgaacagcgtggaggagaagatcctggccgccgccaagtacaagctgaacgtggaccagaaggtgatccaggccggcatgttcgaccagaagagcagcagccacgagagaagagccttcctgcaggccatcctggagcacgaggagcaggacgaggaggaggacgaggtgcccgacgacgagaccgtgaaccagatgatcgccagacacgaggaggagttcgacctgttcatgagaatggacctggacagaagaagagaggaggccagaaaccccaagagaaagcccagactgatggaggaggacgagctgcccagctggatcatcaaggacgacgccgaggtggagagactgacctgcgaggaggaggaggagaagatgttcggcagaggcagcagacacagaaaggaggtggactacagcgacagcctgaccgagaagcagtggctgaagaccctgaaggccatcgaggagggcaccctggaggagatcgaggaggaggtgagacagaagaagagcagcagaaagagaaagagagacagcgacgccggcagcagcacccccaccaccagcaccagaagcagagacaaggacgacgagagcaagaagcagaagaagagaggcagaccccccgccgagaagctgagccccaacccccccaacctgaccaagaagatgaagaagatcgtggacgccgtgatcaagtacaaggacagcagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgaacgacctggagaaggacgtgatgctgctgtgccagaacgcccagaccttcaacctggagggcagcctgatctacgaggacagcatcgtgctgcagagcgtgttcaccagcgtgagacagaagatcgagaaggaggacgacagcgagggcgaggagagcgaggaggaggaggagggcgaggaggagggcagcgagagcgagagcagaagcgtgaaggtgaagatcaagctgggcagaaaggagaaggcccaggacagactgaagggcggcagaagaagacccagcagaggcagcagagccaagcccgtggtgagcgacgacgacagcgaggaggagcaggaggaggacagaagcggcagcggcagcgaggaggactag

SEQ ID NO: 101370 - DNA, 5046 bp, Artificial Sequence
  Description of Artificial Sequence: Synthetic coding sequence
atgagcacccccgacccccccctgggcggcacccccagacccggccccagccccggccccggccccagccccggcgccatgctgggccccagccccggccccagccccggcagcgcccacagcatgatgggccccagccccggcccccccagcgccggccaccccatccccacccagggccccggcggctacccccaggacaacatgcaccagatgcacaagcccatggagagcatgcacgagaagggcatgagcgacgaccccagatacaaccagatgaagggcatgggcatgagaagcggcggccacgccggcatgggccccccccccagccccatggaccagcacagccagggctaccccagccccctgggcggcagcgagcacgccagcagccccgtgcccgccagcggccccagcagcggcccccagatgagcagcggccccggcggcgcccccctggacggcgccgacccccaggccctgggccagcagaacagaggccccacccccttcaaccagaaccagctgcaccagctgagagcccagatcatggcctacaagatgctggccagaggccagcccctgcccgaccacctgcagatggccgtgcagggcaagagacccatgcccggcatgcagcagcagatgcccaccctgcccccccccagcgtgagcgccaccggccccggccccggccccggccccggccccggccccggccccggccccgccccccccaactacagcagaccccacggcatgggcggccccaacatgcccccccccggccccagcggcgtgccccccggcatgcccggccagccccccggcggcccccccaagccctggcccgagggccccatggccaacgccgccgcccccaccagcaccccccagaagctgatccccccccagcccaccggcagacccagccccgccccccccgccgtgccccccgccgccagccccgtgatgcccccccagacccagagccccggccagcccgcccagcccgcccccatggtgcccctgcaccagaagcagagcagaatcacccccatccagaagcccagaggcctggaccccgtggagatcctgcaggagagagagtacagactgcaggccagaatcgcccacagaatccaggagctggagaacctgcccggcagcctggccggcgacctgagaaccaaggccaccatcgagctgaaggccctgagactgctgaacttccagagacagctgagacaggaggtggtggtgtgcatgagaagagacaccgccctggagaccgccctgaacgccaaggcctacaagagaagcaagagacagagcctgagagaggccagaatcaccgagaagctggagaagcagcagaagatcgagcaggagagaaagagaagacagaagcaccaggagtacctgaacagcatcctgcagcacgccaaggacttcaaggagtaccacagaagcgtgaccggcaagatccagaagctgaccaaggccgtggccacctaccacgccaacaccgagagagagcagaagaaggagaacgagagaatcgagaaggagagaatgagaagactgatgggccagagagagaagagcagaagaggcctgggcagccagagctgggccagaatcttcgccgacctgagcgaccaccagaacgactgcgtgaccagcgtgaccgagagcctggtgggccagatcctggccgcctgcagcggcgaggagggcgaggtggagtggaagggcagagacagagtgagaagactgagagccgaggacgaggagggctacagaaagctgatcgaccagaagaaggacaagagactggcctacctgctgcagcagaccgacgagtacgtggccaacctgaccgagctggtgagacagcacaaggccgcccaggtggccaaggagaagaagaagaagaagaagaagaagaaggccgagaacgccgagggccagacccccgccatcggccccgacggcgagcccctggacgagaccagccagatgagcgacctgcccgtgaaggtgatccacgtggagagcggcaagatcctgaccggcaccgacgcccccaaggccggccagctggaggcctggctggagatgaaccccggctacgaggtggcccccagaagcgacagcgaggagagcggcagcgaggaggaggaggaggaggaggaggaggagcagccccaggccgcccagccccccaccctgcccgtggaggagaagaagaagatccccgaccccgacagcgacgacgtgagcgaggtggacgccagacacatcatcgagaacgccaagcaggacgtggacgacgagtacggcgtgagccaggccctggccagaggcctgcagagctactacgccgtggcccacgccgtgaccgagagagtggacaagcagagcgccctgatggtgaacggcgtgctgaagcagtaccagatcaagggcctggagtggctggtgagcctgtacaacaacaacctgaacggcatcctggccgacgagatgggcctgggcaagaccatccagaccatcgccctgatcacctacctgatggagcacaagagaatcaacggccccttcctgatcatcgtgcccctgagcaccctgagcaactgggcctacgagttcgacaagtgggcccccagcgtggtgaaggtgagctacaagggcagccccgccgccagaagagccttcgtgccccagctgagaagcggcaagttcaacgtgctgctgaccacctacgagtacatcatcaaggacaagcacatcctggccaagatcagatggaagtacatgatcgtggacgagggccacagaatgaagaaccaccactgcaagctgacccaggtgctgaacacccactacgtggcccccagaagactgctgctgaccggcacccccctgcagaacaagctgcccgagctgtgggccctgctgaacttcctgctgcccaccatcttcaagagctgcagcaccttcgagcagtggttcaacgcccccttcgccatgaccggcgagaaggtggacctgaacgaggaggagaccatcctgatcatcagaagactgcacaaggtgctgagacccttcctgctgagaagactgaagaaggaggtggaggcccagctgcccgagaaggtggagtacgtgatcaagtgcgacatgagcgccctgcagagagtgctgtacagacacatgcaggccaagggcgtgctgctgaccgacggcagcgagaaggacaagaagggcaagggcggcaccaagaccctgatgaacaccatcatgcagctgagaaagatctgcaaccacccctacatgttccagcacatcgaggagagcttcagcgagcacctgggcttcaccggcggcatcgtgcagggcctggacctgtacagagccagcggcaagttcgagctgctggacagaatcctgcccaagctgagagccaccaaccacaaggtgctgctgttctgccagatgaccagcctgatgaccatcatggaggactacttcgcctacagaggcttcaagtacctgagactggacggcaccaccaaggccgaggacagaggcatgctgctgaagaccttcaacgagcccggcagcgagtacttcatcttcctgctgagcaccagagccggcggcctgggcctgaacctgcagagcgccgacaccgtgatcatcttcgacagcgactggaacccccaccaggacctgcaggcccaggacagagcccacagaatcggccagcagaacgaggtgagagtgctgagactgtgcaccgtgaacagcgtggaggagaagatcctggccgccgccaagtacaagctgaacgtggaccagaaggtgatccaggccggcatgttcgaccagaagagcagcagccacgagagaagagccttcctgcaggccatcctggagcacgaggagcaggacgaggaggaggacgaggtgcccgacgacgagaccgtgaaccagatgatcgccagacacgaggaggagttcgacctgttcatgagaatggacctggacagaagaagagaggaggccagaaaccccaagagaaagcccagactgatggaggaggacgagctgcccagctggatcatcaaggacgacgccgaggtggagagactgacctgcgaggaggaggaggagaagatgttcggcagaggcagcagacacagaaaggaggtggactacagcgacagcctgaccgagaagcagtggctgaagaccctgaaggccatcgaggagggcaccctggaggagatcgaggaggaggtgagacagaagaagagcagcagaaagagaaagagagacagcgacgccggcagcagcacccccaccaccagcaccagaagcagagacaaggacgacgagagcaagaagcagaagaagagaggcagaccccccgccgagaagctgagccccaacccccccaacctgaccaagaagatgaagaagatcgtggacgccgtgatcaagtacaaggacagcagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgaacgacctggagaaggacgtgatgctgctgtgccagaacgcccagaccttcaacctggagggcagcctgatctacgaggacagcatcgtgctgcagagcgtgttcaccagcgtgagacagaagatcgagaaggaggacgacagcgagggcgaggagagcgaggaggaggaggagggcgaggaggagggcagcgagagcgagagcagaagcgtgaaggtgaagatcaagctgggcagaaaggagaaggcccaggacagactgaagggcggcagaagaagacccagcagaggcagcagagccaagcccgtggtgagcgacgacgacagcgaggaggagcaggaggaggacagaagcggcagcggcagcgaggaggactag

SEQ ID NO: 101371 - DNA, 4944 bp, Artificial Sequence; identical to SEQ ID NO: 101367
  Description of Artificial Sequence: Synthetic coding sequence

SEQ ID NO: 101372 - DNA, 4842 bp, Artificial Sequence
  Description of Artificial Sequence: Synthetic coding sequence
atgagcacccccgacccccccctgggcggcacccccagacccggccccagccccggccccggccccagccccggcgccatgctgggccccagccccggccccagccccggcagcgcccacagcatgatgggccccagccccggcccccccagcgccggccaccccatccccacccagggccccggcggctacccccaggacaacatgcaccagatgcacaagcccatggagagcatgcacgagaagggcatgagcgacgaccccagatacaaccagatgaagggcatgggcatgagaagcggcggccacgccggcatgggccccccccccagccccatggaccagcacagccagggctaccccagccccctgggcggcagcgagcacgccagcagccccgtgcccgccagcggccccagcagcggcccccagatgagcagcggccccggcggcgcccccctggacggcgccgacccccaggccctgggccagcagaacagaggccccacccccttcaaccagaaccagctgcaccagctgagagcccagatcatggcctacaagatgctggccagaggccagcccctgcccgaccacctgcagatggccgtgcagggcaagagacccatgcccggcatgcagcagcagatgcccaccctgcccccccccagcgtgagcgccaccggccccggccccggccccggccccggccccggccccggccccggccccgccccccccaactacagcagaccccacggcatgggcggccccaacatgcccccccccggccccagcggcgtgccccccggcatgcccggccagccccccggcggcccccccaagccctggcccgagggccccatggccaacgccgccgcccccaccagcaccccccagaagctgatccccccccagcccaccggcagacccagccccgccccccccgccgtgccccccgccgccagccccgtgatgcccccccagacccagagccccggccagcccgcccagcccgcccccatggtgcccctgcaccagaagcagagcagaatcacccccatccagaagcccagaggcctggaccccgtggagatcctgcaggagagagagtacagactgcaggccagaatcgcccacagaatccaggagctggagaacctgcccggcagcctggccggcgacctgagaaccaaggccaccatcgagctgaaggccctgagactgctgaacttccagagacagctgagacaggaggtggtggtgtgcatgagaagagacaccgccctggagaccgccctgaacgccaaggcctacaagagaagcaagagacagagcctgagagaggccagaatcaccgagaagctggagaagcagcagaagatcgagcaggagagaaagagaagacagaagcaccaggagtacctgaacagcatcctgcagcacgccaaggacttcaaggagtaccacagaagcgtgaccggcaagatccagaagctgaccaaggccgtggccacctaccacgccaacaccgagagagagcagaagaaggagaacgagagaatcgagaaggagagaatgagaagactgatggccgaggacgaggagggctacagaaagctgatcgaccagaagaaggacaagagactggcctacctgctgcagcagaccgacgagtacgtggccaacctgaccgagctggtgagacagcacaaggccgcccaggtggccaaggagaagaagaagaagaagaagaagaagaaggccgagaacgccgagggccagacccccgccatcggccccgacggcgagcccctggacgagaccagccagatgagcgacctgcccgtgaaggtgatccacgtggagagcggcaagatcctgaccggcaccgacgcccccaaggccggccagctggaggcctggctggagatgaaccccggctacgaggtggcccccagaagcgacagcgaggagagcggcagcgaggaggaggaggaggaggaggaggaggagcagccccaggccgcccagccccccaccctgcccgtggaggagaagaagaagatccccgaccccgacagcgacgacgtgagcgaggtggacgccagacacatcatcgagaacgccaagcaggacgtggacgacgagtacggcgtgagccaggccctggccagaggcctgcagagctactacgccgtggcccacgccgtgaccgagagagtggacaagcagagcgccctgatggtgaacggcgtgctgaagcagtaccagatcaagggcctggagtggctggtgagcctgtacaacaacaacctgaacggcatcctggccgacgagatgggcctgggcaagaccatccagaccatcgccctgatcacctacctgatggagcacaagagaatcaacggccccttcctgatcatcgtgcccctgagcaccctgagcaactgggcctacgagttcgacaagtgggcccccagcgtggtgaaggtgagctacaagggcagccccgccgccagaagagccttcgtgccccagctgagaagcggcaagttcaacgtgctgctgaccacctacgagtacatcatcaaggacaagcacatcctggccaagatcagatggaagtacatgatcgtggacgagggccacagaatgaagaaccaccactgcaagctgacccaggtgctgaacacccactacgtggcccccagaagactgctgctgaccggcacccccctgcagaacaagctgcccgagctgtgggccctgctgaacttcctgctgcccaccatcttcaagagctgcagcaccttcgagcagtggttcaacgcccccttcgccatgaccggcgagaaggtggacctgaacgaggaggagaccatcctgatcatcagaagactgcacaaggtgctgagacccttcctgctgagaagactgaagaaggaggtggaggcccagctgcccgagaaggtggagtacgtgatcaagtgcgacatgagcgccctgcagagagtgctgtacagacacatgcaggccaagggcgtgctgctgaccgacggcagcgagaaggacaagaagggcaagggcggcaccaagaccctgatgaacaccatcatgcagctgagaaagatctgcaaccacccctacatgttccagcacatcgaggagagcttcagcgagcacctgggcttcaccggcggcatcgtgcagggcctggacctgtacagagccagcggcaagttcgagctgctggacagaatcctgcccaagctgagagccaccaaccacaaggtgctgctgttctgccagatgaccagcctgatgaccatcatggaggactacttcgcctacagaggcttcaagtacctgagactggacggcaccaccaaggccgaggacagaggcatgctgctgaagaccttcaacgagcccggcagcgagtacttcatcttcctgctgagcaccagagccggcggcctgggcctgaacctgcagagcgccgacaccgtgatcatcttcgacagcgactggaacccccaccaggacctgcaggcccaggacagagcccacagaatcggccagcagaacgaggtgagagtgctgagactgtgcaccgtgaacagcgtggaggagaagatcctggccgccgccaagtacaagctgaacgtggaccagaaggtgatccaggccggcatgttcgaccagaagagcagcagccacgagagaagagccttcctgcaggccatcctggagcacgaggagcaggacgaggaggaggacgaggtgcccgacgacgagaccgtgaaccagatgatcgccagacacgaggaggagttcgacctgttcatgagaatggacctggacagaagaagagaggaggccagaaaccccaagagaaagcccagactgatggaggaggacgagctgcccagctggatcatcaaggacgacgccgaggtggagagactgacctgcgaggaggaggaggagaagatgttcggcagaggcagcagacacagaaaggaggtggactacagcgacagcctgaccgagaagcagtggctgaaggccatcgaggagggcaccctggaggagatcgaggaggaggtgagacagaagaagagcagcagaaagagaaagagagacagcgacgccggcagcagcacccccaccaccagcaccagaagcagagacaaggacgacgagagcaagaagcagaagaagagaggcagaccccccgccgagaagctgagccccaacccccccaacctgaccaagaagatgaagaagatcgtggacgccgtgatcaagtacaaggacagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgaacgacctggagaaggacgtgatgctgctgtgccagaacgcccagaccttcaacctggagggcagcctgatctacgaggacagcatcgtgctgcagagcgtgttcaccagcgtgagacagaagatcgagaaggaggacgacagcgagggcgaggagagcgaggaggaggaggagggcgaggaggagggcagcgagagcgagagcagaagcgtgaaggtgaagatcaagctgggcagaaaggagaaggcccaggacagactgaagggcggcagaagaagacccagcagaggcagcagagccaagcccgtggtgagcgacgacgacagcgaggaggagcaggaggaggacagaagcggcagcggcagcgaggaggactag

SEQ ID NO: 101373 - DNA, 4851 bp, Artificial Sequence
  Description of Artificial Sequence: Synthetic coding sequence
atgagcacccccgacccccccctgggcggcacccccagacccggccccagccccggccccggccccagccccggcgccatgctgggccccagccccggccccagccccggcagcgcccacagcatgatgggccccagccccggcccccccagcgccggccaccccatccccacccagggccccggcggctacccccaggacaacatgcaccagatgcacaagcccatggagagcatgcacgagaagggcatgagcgacgaccccagatacaaccagatgaagggcatgggcatgagaagcggcggccacgccggcatgggccccccccccagccccatggaccagcacagccagggctaccccagccccctgggcggcagcgagcacgccagcagccccgtgcccgccagcggccccagcagcggcccccagatgagcagcggccccggcggcgcccccctggacggcgccgacccccaggccctgggccagcagaacagaggccccacccccttcaaccagaaccagctgcaccagctgagagcccagatcatggcctacaagatgctggccagaggccagcccctgcccgaccacctgcagatggccgtgcagggcaagagacccatgcccggcatgcagcagcagatgcccaccctgcccccccccagcgtgagcgccaccggccccggccccggccccggccccggccccggccccggccccggccccgccccccccaactacagcagaccccacggcatgggcggccccaacatgcccccccccggccccagcggcgtgccccccggcatgcccggccagccccccggcggcccccccaagccctggcccgagggccccatggccaacgccgccgcccccaccagcaccccccagaagctgatccccccccagcccaccggcagacccagccccgccccccccgccgtgccccccgccgccagccccgtgatgcccccccagacccagagccccggccagcccgcccagcccgcccccatggtgcccctgcaccagaagcagagcagaatcacccccatccagaagcccagaggcctggaccccgtggagatcctgcaggagagagagtacagactgcaggccagaatcgcccacagaatccaggagctggagaacctgcccggcagcctggccggcgacctgagaaccaaggccaccatcgagctgaaggccctgagactgctgaacttccagagacagctgagacaggaggtggtggtgtgcatgagaagagacaccgccctggagaccgccctgaacgccaaggcctacaagagaagcaagagacagagcctgagagaggccagaatcaccgagaagctggagaagcagcagaagatcgagcaggagagaaagagaagacagaagcaccaggagtacctgaacagcatcctgcagcacgccaaggacttcaaggagtaccacagaagcgtgaccggcaagatccagaagctgaccaaggccgtggccacctaccacgccaacaccgagagagagcagaagaaggagaacgagagaatcgagaaggagagaatgagaagactgatggccgaggacgaggagggctacagaaagctgatcgaccagaagaaggacaagagactggcctacctgctgcagcagaccgacgagtacgtggccaacctgaccgagctggtgagacagcacaaggccgcccaggtggccaaggagaagaagaagaagaagaagaagaagaaggccgagaacgccgagggccagacccccgccatcggccccgacggcgagcccctggacgagaccagccagatgagcgacctgcccgtgaaggtgatccacgtggagagcggcaagatcctgaccggcaccgacgcccccaaggccggccagctggaggcctggctggagatgaaccccggctacgaggtggcccccagaagcgacagcgaggagagcggcagcgaggaggaggaggaggaggaggaggaggagcagccccaggccgcccagccccccaccctgcccgtggaggagaagaagaagatccccgaccccgacagcgacgacgtgagcgaggtggacgccagacacatcatcgagaacgccaagcaggacgtggacgacgagtacggcgtgagccaggccctggccagaggcctgcagagctactacgccgtggcccacgccgtgaccgagagagtggacaagcagagcgccctgatggtgaacggcgtgctgaagcagtaccagatcaagggcctggagtggctggtgagcctgtacaacaacaacctgaacggcatcctggccgacgagatgggcctgggcaagaccatccagaccatcgccctgatcacctacctgatggagcacaagagaatcaacggccccttcctgatcatcgtgcccctgagcaccctgagcaactgggcctacgagttcgacaagtgggcccccagcgtggtgaaggtgagctacaagggcagccccgccgccagaagagccttcgtgccccagctgagaagcggcaagttcaacgtgctgctgaccacctacgagtacatcatcaaggacaagcacatcctggccaagatcagatggaagtacatgatcgtggacgagggccacagaatgaagaaccaccactgcaagctgacccaggtgctgaacacccactacgtggcccccagaagactgctgctgaccggcacccccctgcagaacaagctgcccgagctgtgggccctgctgaacttcctgctgcccaccatcttcaagagctgcagcaccttcgagcagtggttcaacgcccccttcgccatgaccggcgagaaggtggacctgaacgaggaggagaccatcctgatcatcagaagactgcacaaggtgctgagacccttcctgctgagaagactgaagaaggaggtggaggcccagctgcccgagaaggtggagtacgtgatcaagtgcgacatgagcgccctgcagagagtgctgtacagacacatgcaggccaagggcgtgctgctgaccgacggcagcgagaaggacaagaagggcaagggcggcaccaagaccctgatgaacaccatcatgcagctgagaaagatctgcaaccacccctacatgttccagcacatcgaggagagcttcagcgagcacctgggcttcaccggcggcatcgtgcagggcctggacctgtacagagccagcggcaagttcgagctgctggacagaatcctgcccaagctgagagccaccaaccacaaggtgctgctgttctgccagatgaccagcctgatgaccatcatggaggactacttcgcctacagaggcttcaagtacctgagactggacggcaccaccaaggccgaggacagaggcatgctgctgaagaccttcaacgagcccggcagcgagtacttcatcttcctgctgagcaccagagccggcggcctgggcctgaacctgcagagcgccgacaccgtgatcatcttcgacagcgactggaacccccaccaggacctgcaggcccaggacagagcccacagaatcggccagcagaacgaggtgagagtgctgagactgtgcaccgtgaacagcgtggaggagaagatcctggccgccgccaagtacaagctgaacgtggaccagaaggtgatccaggccggcatgttcgaccagaagagcagcagccacgagagaagagccttcctgcaggccatcctggagcacgaggagcaggacgaggaggaggacgaggtgcccgacgacgagaccgtgaaccagatgatcgccagacacgaggaggagttcgacctgttcatgagaatggacctggacagaagaagagaggaggccagaaaccccaagagaaagcccagactgatggaggaggacgagctgcccagctggatcatcaaggacgacgccgaggtggagagactgacctgcgaggaggaggaggagaagatgttcggcagaggcagcagacacagaaaggaggtggactacagcgacagcctgaccgagaagcagtggctgaagaccctgaaggccatcgaggagggcaccctggaggagatcgaggaggaggtgagacagaagaagagcagcagaaagagaaagagagacagcgacgccggcagcagcacccccaccaccagcaccagaagcagagacaaggacgacgagagcaagaagcagaagaagagaggcagaccccccgccgagaagctgagccccaacccccccaacctgaccaagaagatgaagaagatcgtggacgccgtgatcaagtacaaggacagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgaacgacctggagaaggacgtgatgctgctgtgccagaacgcccagaccttcaacctggagggcagcctgatctacgaggacagcatcgtgctgcagagcgtgttcaccagcgtgagacagaagatcgagaaggaggacgacagcgagggcgaggagagcgaggaggaggaggagggcgaggaggagggcagcgagagcgagagcagaagcgtgaaggtgaagatcaagctgggcagaaaggagaaggcccaggacagactgaagggcggcagaagaagacccagcagaggcagcagagccaagcccgtggtgagcgacgacgacagcgaggaggagcaggaggaggacagaagcggcagcggcagcgaggaggactag

SEQ ID NO: 101374 - DNA, 4845 bp, Artificial Sequence
  Description of Artificial Sequence: Synthetic coding sequence
atgagcacccccgacccccccctgggcggcacccccagacccggccccagccccggccccggccccagccccggcgccatgctgggccccagccccggccccagccccggcagcgcccacagcatgatgggccccagccccggcccccccagcgccggccaccccatccccacccagggccccggcggctacccccaggacaacatgcaccagatgcacaagcccatggagagcatgcacgagaagggcatgagcgacgaccccagatacaaccagatgaagggcatgggcatgagaagcggcggccacgccggcatgggccccccccccagccccatggaccagcacagccagggctaccccagccccctgggcggcagcgagcacgccagcagccccgtgcccgccagcggccccagcagcggcccccagatgagcagcggccccggcggcgcccccctggacggcgccgacccccaggccctgggccagcagaacagaggccccacccccttcaaccagaaccagctgcaccagctgagagcccagatcatggcctacaagatgctggccagaggccagcccctgcccgaccacctgcagatggccgtgcagggcaagagacccatgcccggcatgcagcagcagatgcccaccctgcccccccccagcgtgagcgccaccggccccggccccggccccggccccggccccggccccggccccggccccgccccccccaactacagcagaccccacggcatgggcggccccaacatgcccccccccggccccagcggcgtgccccccggcatgcccggccagccccccggcggcccccccaagccctggcccgagggccccatggccaacgccgccgcccccaccagcaccccccagaagctgatccccccccagcccaccggcagacccagccccgccccccccgccgtgccccccgccgccagccccgtgatgcccccccagacccagagccccggccagcccgcccagcccgcccccatggtgcccctgcaccagaagcagagcagaatcacccccatccagaagcccagaggcctggaccccgtggagatcctgcaggagagagagtacagactgcaggccagaatcgcccacagaatccaggagctggagaacctgcccggcagcctggccggcgacctgagaaccaaggccaccatcgagctgaaggccctgagactgctgaacttccagagacagctgagacaggaggtggtggtgtgcatgagaagagacaccgccctggagaccgccctgaacgccaaggcctacaagagaagcaagagacagagcctgagagaggccagaatcaccgagaagctggagaagcagcagaagatcgagcaggagagaaagagaagacagaagcaccaggagtacctgaacagcatcctgcagcacgccaaggacttcaaggagtaccacagaagcgtgaccggcaagatccagaagctgaccaaggccgtggccacctaccacgccaacaccgagagagagcagaagaaggagaacgagagaatcgagaaggagagaatgagaagactgatggccgaggacgaggagggctacagaaagctgatcgaccagaagaaggacaagagactggcctacctgctgcagcagaccgacgagtacgtggccaacctgaccgagctggtgagacagcacaaggccgcccaggtggccaaggagaagaagaagaagaagaagaagaagaaggccgagaacgccgagggccagacccccgccatcggccccgacggcgagcccctggacgagaccagccagatgagcgacctgcccgtgaaggtgatccacgtggagagcggcaagatcctgaccggcaccgacgcccccaaggccggccagctggaggcctggctggagatgaaccccggctacgaggtggcccccagaagcgacagcgaggagagcggcagcgaggaggaggaggaggaggaggaggaggagcagccccaggccgcccagccccccaccctgcccgtggaggagaagaagaagatccccgaccccgacagcgacgacgtgagcgaggtggacgccagacacatcatcgagaacgccaagcaggacgtggacgacgagtacggcgtgagccaggccctggccagaggcctgcagagctactacgccgtggcccacgccgtgaccgagagagtggacaagcagagcgccctgatggtgaacggcgtgctgaagcagtaccagatcaagggcctggagtggctggtgagcctgtacaacaacaacctgaacggcatcctggccgacgagatgggcctgggcaagaccatccagaccatcgccctgatcacctacctgatggagcacaagagaatcaacggccccttcctgatcatcgtgcccctgagcaccctgagcaactgggcctacgagttcgacaagtgggcccccagcgtggtgaaggtgagctacaagggcagccccgccgccagaagagccttcgtgccccagctgagaagcggcaagttcaacgtgctgctgaccacctacgagtacatcatcaaggacaagcacatcctggccaagatcagatggaagtacatgatcgtggacgagggccacagaatgaagaaccaccactgcaagctgacccaggtgctgaacacccactacgtggcccccagaagactgctgctgaccggcacccccctgcagaacaagctgcccgagctgtgggccctgctgaacttcctgctgcccaccatcttcaagagctgcagcaccttcgagcagtggttcaacgcccccttcgccatgaccggcgagaaggtggacctgaacgaggaggagaccatcctgatcatcagaagactgcacaaggtgctgagacccttcctgctgagaagactgaagaaggaggtggaggcccagctgcccgagaaggtggagtacgtgatcaagtgcgacatgagcgccctgcagagagtgctgtacagacacatgcaggccaagggcgtgctgctgaccgacggcagcgagaaggacaagaagggcaagggcggcaccaagaccctgatgaacaccatcatgcagctgagaaagatctgcaaccacccctacatgttccagcacatcgaggagagcttcagcgagcacctgggcttcaccggcggcatcgtgcagggcctggacctgtacagagccagcggcaagttcgagctgctggacagaatcctgcccaagctgagagccaccaaccacaaggtgctgctgttctgccagatgaccagcctgatgaccatcatggaggactacttcgcctacagaggcttcaagtacctgagactggacggcaccaccaaggccgaggacagaggcatgctgctgaagaccttcaacgagcccggcagcgagtacttcatcttcctgctgagcaccagagccggcggcctgggcctgaacctgcagagcgccgacaccgtgatcatcttcgacagcgactggaacccccaccaggacctgcaggcccaggacagagcccacagaatcggccagcagaacgaggtgagagtgctgagactgtgcaccgtgaacagcgtggaggagaagatcctggccgccgccaagtacaagctgaacgtggaccagaaggtgatccaggccggcatgttcgaccagaagagcagcagccacgagagaagagccttcctgcaggccatcctggagcacgaggagcaggacgaggaggaggacgaggtgcccgacgacgagaccgtgaaccagatgatcgccagacacgaggaggagttcgacctgttcatgagaatggacctggacagaagaagagaggaggccagaaaccccaagagaaagcccagactgatggaggaggacgagctgcccagctggatcatcaaggacgacgccgaggtggagagactgacctgcgaggaggaggaggagaagatgttcggcagaggcagcagacacagaaaggaggtggactacagcgacagcctgaccgagaagcagtggctgaaggccatcgaggagggcaccctggaggagatcgaggaggaggtgagacagaagaagagcagcagaaagagaaagagagacagcgacgccggcagcagcacccccaccaccagcaccagaagcagagacaaggacgacgagagcaagaagcagaagaagagaggcagaccccccgccgagaagctgagccccaacccccccaacctgaccaagaagatgaagaagatcgtggacgccgtgatcaagtacaaggacagcagcagcggcagacagctgagcgaggtgttcatccagctgcccagcagaaaggagctgcccgagtactacgagctgatcagaaagcccgtggacttcaagaagatcaaggagagaatcagaaaccacaagtacagaagcctgaacgacctggagaaggacgtgatgctgctgtgccagaacgcccagaccttcaacctggagggcagcctgatctacgaggacagcatcgtgctgcagagcgtgttcaccagcgtgagacagaagatcgagaaggaggacgacagcgagggcgaggagagcgaggaggaggaggagggcgaggaggagggcagcgagagcgagagcagaagcgtgaaggtgaagatcaagctgggcagaaaggagaaggcccaggacagactgaagggcggcagaagaagacccagcagaggcagcagagccaagcccgtggtgagcgacgacgacagcgaggaggagcaggaggaggacagaagcggcagcggcagcgaggaggactag

SEQ ID NO: 101375 - DNA, 3159 bp, Artificial Sequence
  Description of Artificial Sequence: Synthetic coding sequence
atgagcagcgccgccgagcccccccccccccccccccccgagagcgcccccagcaagcccgccgccagcatcgccagcggcggcagcaacagcagcaacaagggcggccccgagggcgtggccgcccaggccgtggccagcgccgccagcgccggccccgccgacgccgagatggaggagatcttcgacgacgccagccccggcaagcagaaggagatccaggagcccgaccccacctacgaggagaagatgcagaccgacagagccaacagattcgagtacctgctgaagcagaccgagctgttcgcccacttcatccagcccgccgcccagaagacccccaccagccccctgaagatgaagcccggcagacccagaatcaagaaggacgagaagcagaacctgctgagcgtgggcgactacagacacagaagaaccgagcaggaggaggacgaggagctgctgaccgagagcagcaaggccaccaacgtgtgcaccagattcgaggacagccccagctacgtgaagtggggcaagctgagagactaccaggtgagaggcctgaactggctgatcagcctgtacgagaacggcatcaacggcatcctggccgacgagatgggcctgggcaagaccctgcagaccatcagcctgctgggctacatgaagcactacagaaacatccccggcccccacatggtgctggtgcccaagagcaccctgcacaactggatgagcgagttcaagagatgggtgcccaccctgagaagcgtgtgcctgatcggcgacaaggagcagagagccgccttcgtgagagacgtgctgctgcccggcgagtgggacgtgtgcgtgaccagctacgagatgctgatcaaggagaagagcgtgttcaagaagttcaactggagatacctggtgatcgacgaggcccacagaatcaagaacgagaagagcaagctgagcgagatcgtgagagagttcaagaccaccaacagactgctgctgaccggcacccccctgcagaacaacctgcacgagctgtggagcctgctgaacttcctgctgcccgacgtgttcaacagcgccgacgacttcgacagctggttcgacaccaacaactgcctgggcgaccagaagctggtggagagactgcacatggtgctgagacccttcctgctgagaagaatcaaggccgacgtggagaagagcctgccccccaagaaggaggtgaagatctacgtgggcctgagcaagatgcagagagagtggtacaccagaatcctgatgaaggacatcgacatcctgaacagcgccggcaagatggacaagatgagactgctgaacatcctgatgcagctgagaaagtgctgcaaccacccctacctgttcgacggcgccgagcccggccccccctacaccaccgacatgcacctggtgaccaacagcggcaagatggtggtgctggacaagctgctgcccaagctgaaggagcagggcagcagagtgctgatcttcagccagatgaccagagtgctggacatcctggaggactactgcatgtggagaaactacgagtactgcagactggacggccagaccccccacgacgagagacaggacagcatcaacgcctacaacgagcccaacagcaccaagttcgtgttcatgctgagcaccagagccggcggcctgggcatcaacctggccaccgccgacgtggtgatcctgtacgacagcgactggaacccccaggtggacctgcaggccatggacagagcccacagaatcggccagaccaagaccgtgagagtgttcagattcatcaccgacaacaccgtggaggagagaatcgtggagagagccgagatgaagctgagactggacagcatcgtgatccagcagggcagactggtggaccagaacctgaacaagatcggcaaggacgagatgctgcagatgatcagacacggcgccacccacgtgttcgccagcaaggagagcgagatcaccgacgaggacatcgacggcatcctggagagaggcgccaagaagaccgccgagatgaacgagaagctgagcaagatgggcgagagcagcctgagaaacttcaccatggacaccgagagcagcgtgtacaacttcgagggcgaggactacagagagaagcagaagatcgccttcaccgagtggatcgagccccccaagagagagagaaaggccaactacgccgtggacgcctacttcagagaggccctgagagtgagcgagcccaaggcccccaaggcccccagaccccccaagcagcccaacgtgcaggacttccagttcttcccccccagactgttcgagctgctggagaaggagatcctgttctacagaaagaccatcggctacaaggtgcccagaaaccccgagctgcccaacgccgcccaggcccagaaggaggagcagctgaagatcgacgaggccgagagcctgaacgacgaggagctggaggagaaggagaagctgctgacccagggcttcaccaactggaacaagagagacttcaaccagttcatcaaggccaacgagaagtggggcagagacgacatcgagaacatcgccagagaggtggagggcaagacccccgaggaggtgatcgagtacagcgccgtgttctgggagagatgcaacgagctgcaggacatcgagaagatcatggcccagatcgagagaggcgaggccagaatccagagaagaatcagcatcaagaaggccctggacaccaagatcggcagatacaaggcccccttccaccagctgagaatcagctacggcaccaacaagggcaagaactacaccgaggaggaggacagattcctgatctgcatgctgcacaagctgggcttcgacaaggagaacgtgtacgacgagctgagacagtgcatcagaaacagcccccagttcagattcgactggttcctgaagagcagaaccgccatggagctgcagagaagatgcaacaccctgatcaccctgatcgagagagagaacatggagctggaggagaaggagaaggccgagaagaagaagagaggccccaagcccagcacccagaagagaaagatggacggcgcccccgacggcagaggcagaaagaagaagctgaagctgtag

SEQ ID NO: 101376 - DNA, 2988 bp, Artificial Sequence
  Description of Artificial Sequence: Synthetic coding sequence
atggaggagatcttcgacgacgccagccccggcaagcagaaggagatccaggagcccgaccccacctacgaggagaagatgcagaccgacagagccaacagattcgagtacctgctgaagcagaccgagctgttcgcccacttcatccagcccgccgcccagaagacccccaccagccccctgaagatgaagcccggcagacccagaatcaagaaggacgagaagcagaacctgctgagcgtgggcgactacagacacagaagaaccgagcaggaggaggacgaggagctgctgaccgagagcagcaaggccaccaacgtgtgcaccagattcgaggacagccccagctacgtgaagtggggcaagctgagagactaccaggtgagaggcctgaactggctgatcagcctgtacgagaacggcatcaacggcatcctggccgacgagatgggcctgggcaagaccctgcagaccatcagcctgctgggctacatgaagcactacagaaacatccccggcccccacatggtgctggtgcccaagagcaccctgcacaactggatgagcgagttcaagagatgggtgcccaccctgagaagcgtgtgcctgatcggcgacaaggagcagagagccgccttcgtgagagacgtgctgctgcccggcgagtgggacgtgtgcgtgaccagctacgagatgctgatcaaggagaagagcgtgttcaagaagttcaactggagatacctggtgatcgacgaggcccacagaatcaagaacgagaagagcaagctgagcgagatcgtgagagagttcaagaccaccaacagactgctgctgaccggcacccccctgcagaacaacctgcacgagctgtggagcctgctgaacttcctgctgcccgacgtgttcaacagcgccgacgacttcgacagctggttcgacaccaacaactgcctgggcgaccagaagctggtggagagactgcacatggtgctgagacccttcctgctgagaagaatcaaggccgacgtggagaagagcctgccccccaagaaggaggtgaagatctacgtgggcctgagcaagatgcagagagagtggtacaccagaatcctgatgaaggacatcgacatcctgaacagcgccggcaagatggacaagatgagactgctgaacatcctgatgcagctgagaaagtgctgcaaccacccctacctgttcgacggcgccgagcccggccccccctacaccaccgacatgcacctggtgaccaacagcggcaagatggtggtgctggacaagctgctgcccaagctgaaggagcagggcagcagagtgctgatcttcagccagatgaccagagtgctggacatcctggaggactactgcatgtggagaaactacgagtactgcagactggacggccagaccccccacgacgagagacaggacagcatcaacgcctacaacgagcccaacagcaccaagttcgtgttcatgctgagcaccagagccggcggcctgggcatcaacctggccaccgccgacgtggtgatcctgtacgacagcgactggaacccccaggtggacctgcaggccatggacagagcccacagaatcggccagaccaagaccgtgagagtgttcagattcatcaccgacaacaccgtggaggagagaatcgtggagagagccgagatgaagctgagactggacagcatcgtgatccagcagggcagactggtggaccagaacctgaacaagatcggcaaggacgagatgctgcagatgatcagacacggcgccacccacgtgttcgccagcaaggagagcgagatcaccgacgaggacatcgacggcatcctggagagaggcgccaagaagaccgccgagatgaacgagaagctgagcaagatgggcgagagcagcctgagaaacttcaccatggacaccgagagcagcgtgtacaacttcgagggcgaggactacagagagaagcagaagatcgccttcaccgagtggatcgagccccccaagagagagagaaaggccaactacgccgtggacgcctacttcagagaggccctgagagtgagcgagcccaaggcccccaaggcccccagaccccccaagcagcccaacgtgcaggacttccagttcttcccccccagactgttcgagctgctggagaaggagatcctgttctacagaaagaccatcggctacaaggtgcccagaaaccccgagctgcccaacgccgcccaggcccagaaggaggagcagctgaagatcgacgaggccgagagcctgaacgacgaggagctggaggagaaggagaagctgctgacccagggcttcaccaactggaacaagagagacttcaaccagttcatcaaggccaacgagaagtggggcagagacgacatcgagaacatcgccagagaggtggagggcaagacccccgaggaggtgatcgagtacagcgccgtgttctgggagagatgcaacgagctgcaggacatcgagaagatcatggcccagatcgagagaggcgaggccagaatccagagaagaatcagcatcaagaaggccctggacaccaagatcggcagatacaaggcccccttccaccagctgagaatcagctacggcaccaacaagggcaagaactacaccgaggaggaggacagattcctgatctgcatgctgcacaagctgggcttcgacaaggagaacgtgtacgacgagctgagacagtgcatcagaaacagcccccagttcagattcgactggttcctgaagagcagaaccgccatggagctgcagagaagatgcaacaccctgatcaccctgatcgagagagagaacatggagctggaggagaaggagaaggccgagaagaagaagagaggccccaagcccagcacccagaagagaaagatggacggcgcccccgacggcagaggcagaaagaagaagctgaagctgtag

SEQ ID NO: 101377 - DNA, 2988 bp, Artificial Sequence; identical to SEQ ID NO: 101376
  Description of Artificial Sequence: Synthetic coding sequence

SEQ ID NO: 101378 - DNA, 2865 bp, Artificial Sequence
  Description of Artificial Sequence: Synthetic coding sequence
atgagcctgcccctgaccgaggagcagagaaagaagatcgaggagaacagacagaaggccctggccagaagagccgagaagctgctggccgagcagcaccagagaaccagcagcggcaccagcatcgccggcaaccccttccaggccaagcagggccccagccagaacttccccagagagagctgcaagcccgtgagccacggcgtgatcttcaagcagcagaacctgagcagcagcagcaacgccgaccagagaccccacgacagccacagcttccaggccaagggcatctggaagaagcccgaggagatgcccaccgcctgccccggccacagccccagaagccagatggccctgaccggcatcagcccccccctggcccagagcccccccgaggtgcccaagcagcagctgctgagctacgagctgggccagggccacgcccaggccagccccgagatcagattcacccccttcgccaaccccacccacaagcccctggccaagcccaagagcagccaggagacccccgcccacagcagcggccagccccccagagacgccaagctggaggccaagaccgccaaggccagccccagcggccagaacatcagctacatccacagcagcagcgagagcgtgacccccagaaccgagggcagactgcagcagaagagcggcagcagcgtgcagaagggcgtgaacagccagaagggcaagtgcgtgagaaacggcgacagattccaggtgctgatcggctacaacgccgagctgatcgccgtgttcaagaccctgcccagcaagaactacgaccccgacaccaagacctggaacttcagcatgaacgactacagcgccctgatgaaggccgcccagagcctgcccaccgtgaacctgcagcccctggagtgggcctacggcagcagcgagagccccagcaccagcagcgagggccaggccggcctgcccagcgcccccagcctgagcttcgtgaagggcagatgcatgctgatcagcagagcctacttcgaggccgacatcagctacagccaggacctgatcgccctgttcaagcagatggacagcagaagatacgacgtgaagaccagaaagtggagcttcctgctggaggagcacagcaagctgatcgccaaggtgagatgcctgccccaggtgcagctggaccccctgcccaccaccctgaccctggccttcgccagccagctgaagaagaccagcctgagcctgacccccgacgtgcccgaggccgacctgagcgaggtggaccccaagctggtgagcaacctgatgcccttccagagagccggcgtgaacttcgccatcgccaagggcggcagactgctgctggccgacgacatgggcctgggcaagaccatccaggccatctgcatcgccgccttctacagaaaggagtggcccctgctggtggtggtgcccagcagcgtgagattcacctgggagcaggccttcctgagatggctgcccagcctgagccccgactgcatcaacgtggtggtgaccggcaaggacagactgaccgccggcctgatcaacatcgtgagcttcgacctgctgagcaagctggagaagcagctgaagacccccttcaaggtggtgatcatcgacgagagccacttcctgaagaacagcagaaccgccagatgcagagccgccatgcccgtgctgaaggtggccaagagagtgatcctgctgagcggcacccccgccatgagcagacccgccgagctgtacacccagatcatcgccgtgaagcccaccttcttcccccagttccacgccttcggcctgagatactgcgacgccaagagaatgccctggggctgggactacagcggcagcagcaacctgggcgagctgaagctgctgctggaggaggccgtgatgctgagaagactgaagagcgacgtgctgagccagctgcccgccaagcagagaaagatcgtggtgatcgcccccggcagaatcaacgccagaaccagagccgccctggacgccgccgccaaggagatgaccaccaaggacaagaccaagcagcagcagaaggacgccctgatcctgttcttcaacagaaccgccgaggccaagatccccagcgtgatcgagtacatcctggacctgctggagagcggcagagagaagttcctggtgttcgcccaccacaaggtggtgctggacgccatcacccaggagctggagagaaagcacgtgcagcacatcagaatcgacggcagcaccagcagcgccgagagagaggacctgtgccagcagttccagctgagcgagagacacgccgtggccgtgctgagcatcaccgccgccaacatgggcctgaccttcagcagcgccgacctggtggtgttcgccgagctgttctggaaccccggcgtgctgatccaggccgaggacagagtgcacagaatcggccagaccagcagcgtgggcatccactacctggtggccaagggcaccgccgacgactacctgtggcccctgatccaggagaagatcaaggtgctggccgaggccggcctgagcgagaccaacttcagcgagatgaccgagagcaccgactacctgtacaaggaccccaagcagcagaagatctacgacctgttccagaagagcttcgagaaggagggcagcgacatggagctgctggaggccgccgagagcttcgaccccggcagcgccagcggcaccagcggcagcagcagccagaacatgggcgacaccctggacgagagcagcctgaccgccagcccccagaagaagagaagattcgagttcttcgacaactgggacagcttcaccagccccctgtag

SEQ ID NO: 101379 - DNA, 2865 bp, Artificial Sequence; identical to SEQ ID NO: 101378
  Description of Artificial Sequence: Synthetic coding sequence

SEQ ID NO: 101380 - DNA, 60 bp, Artificial Sequence
  Description of Artificial Sequence: Synthetic coding sequence
atgagcctgcccctgaccgaggagcagagaaagaagatcgaggagaacagacagaagtag

SEQ ID NO: 101381 - DNA, 441 bp, Artificial Sequence
  Description of Artificial Sequence: Synthetic coding sequence
atgagcctgcccctgaccgaggagcagagaaagaagatcgaggagaacagacagaaggccctggccagaagagccgagaagctgctggccgagcagcaccagagaaccagcagcggcaccagcatcgccggcaaccccttccaggccaagcagggccccagccagaacttccccagagagagctgcaagcccgtgagccacggcgtgatcttcaagcagcagaacctgagcagcagcagcaacgccgaccagagaccccacgacagccacagcttccaggccaagggcatctggaagaagcccgaggagatgcccaccgcctgccccggccacagccccagaagccagatggccctgaccggcatcagcccccccctggcccagagcccccccgaggtgcccaagcagcagctgctgagctacgagctgggccagggctag

SEQ ID NO: 101382 - DNA, 279 bp, Artificial Sequence
  Description of Artificial Sequence: Synthetic coding sequence
atgagcctgcccctgaccgaggagcagagaaagaagatcgaggagaacagacagaaggccctggccagaagagccgagaagctgctggccgagcagcaccagagaaccagcagcggcaccagcatcgccggcaaccccttccaggccaagcagggccccagccagaacttccccagagagagctgcaagcccgtgagccacggcgtgatcttcaagcagcagaacctgagcagcagcagcaacgccgaccagagaccccacgacagccacagcttctag

SEQ ID NO: 101383 - DNA, 393 bp, Artificial Sequence
  Description of Artificial Sequence: Synthetic coding sequence
atgagcctgcccctgaccgaggagcagagaaagaagatcgaggagaacagacagaaggccctggccagaagagccgagaagctgctggccgagcagcaccagagaaccagcagcggcaccagcatcgccggcaaccccttccaggccaagcagggccccagccagaacttccccagagagagctgcaagcccgtgagccacggcgtgatcttcaagcagcagaacctgagcagcagcagcaacgccgaccagagaccccacgacagccacagcttccaggccaagggcatctggaagaagcccgaggagatgcccaccgcctgccccggccacagccccagaagccagatggccctgaccggcatcagcccccccctggcccagagcccctag

SEQ ID NO: 101384 - DNA, 3318 bp, Artificial Sequence
  Description of Artificial Sequence: Synthetic coding sequence
atggccgccgccgccggcggcggcggccccggcaccgccgtgggcgccaccggcagcggcatcgccgccgccgccgccggcctggccgtgtacagaagaaaggacggcggccccgccaccaagttctgggagagccccgagaccgtgagccagctggacagcgtgagagtgtggctgggcaagcactacaagaagtacgtgcacgccgacgcccccaccaacaagaccctggccggcctggtggtgcagctgctgcagttccaggaggacgccttcggcaagcacgtgaccaaccccgccttcaccaagctgcccgccaagtgcttcatggacttcaaggccggcggcgccctgtgccacatcctgggcgccgcctacaagtacaagaacgagcagggctggagaagattcgacctgcagaaccccagcagaatggacagaaacgtggagatgttcatgaacatcgagaagaccctggtgcagaacaactgcctgaccagacccaacatctacctgatccccgacatcgacctgaagctggccaacaagctgaaggacatcatcaagagacaccagggcaccttcaccgacgagaagagcaaggccagccaccacatctacccctacagcagcagccaggacgacgaggagtggctgagacccgtgatgagaaaggagaagcaggtgctggtgcactggggcttctaccccgacagctacgacacctgggtgcacagcaacgacgtggacgccgagatcgaggacccccccatccccgagaagccctggaaggtgcacgtgaagtggatcctggacaccgacatcttcaacgagtggatgaacgaggaggactacgaggtggacgagaacagaaagcccgtgagcttcagacagagaatcagcaccaagaacgaggagcccgtgagaagccccgagagaagagacagaaaggccagcgccaacgccagaaagagaaagcacagccccagcccccccccccccacccccaccgagagcagaaagaagagcggcaagaagggccaggccagcctgtacggcaagagaagaagccagaaggaggaggacgagcaggaggacctgaccaaggacatggaggaccccacccccgtgcccaacatcgaggaggtggtgctgcccaagaacgtgaacctgaagaaggacagcgagaacacccccgtgaagggcggcaccgtggccgacctggacgagcaggacgaggagaccgtgaccgccggcggcaaggaggacgaggaccccgccaagggcgaccagagcagaagcgtggacctgggcgaggacaacgtgaccgagcagaccaaccacatcatcatccccagctacgccagctggttcgactacaactgcatccacgtgatcgagagaagagccctgcccgagttcttcaacggcaagaacaagagcaagacccccgagatctacctggcctacagaaacttcatgatcgacacctacagactgaacccccaggagtacctgaccagcaccgcctgcagaagaaacctgaccggcgacgtgtgcgccgtgatgagagtgcacgccttcctggagcagtggggcctggtgaactaccaggtggaccccgagagcagacccatggccatgggccccccccccaccccccacttcaacgtgctggccgacacccccagcggcctggtgcccctgcacctgagaagcccccaggtgcccgccgcccagcagatgctgaacttccccgagaagaacaaggagaagcccgtggacctgcagaacttcggcctgagaaccgacatctacagcaagaagaccctggccaagagcaagggcgccagcgccggcagagagtggaccgagcaggagaccctgctgctgctggaggccctggagatgtacaaggacgactggaacaaggtgagcgagcacgtgggcagcagaacccaggacgagtgcatcctgcacttcctgagactgcccatcgaggacccctacctggagaacagcgacgccagcctgggccccctggcctaccagcccgtgcccttcagccagagcggcaaccccgtgatgagcaccgtggccttcctggccagcgtggtggaccccagagtggccagcgccgccgccaaggccgccctggaggagttcagcagagtgagagaggaggtgcccctggagctggtggaggcccacgtgaagaaggtgcaggaggccgccagagccagcggcaaggtggaccccacctacggcctggagagcagctgcatcgccggcaccggccccgacgagcccgagaagctggagggcgccgaggaggagaagatggaggccgaccccgacggccagcagcccgagaaggccgagaacaaggtggagaacgagaccgacgagggcgacaaggcccaggacggcgagaacgagaagaacagcgagaaggagcaggacagcgaggtgagcgaggacaccaagagcgaggagaaggagaccgaggagaacaaggagctgaccgacacctgcaaggagagagagagcgacaccggcaagaagaaggtggagcacgagatcagcgagggcaacgtggccaccgccgccgccgccgccctggccagcgccgccaccaaggccaagcacctggccgccgtggaggagagaaagatcaagagcctggtggccctgctggtggagacccagatgaagaagctggagatcaagctgagacacttcgaggagctggagaccatcatggacagagagaaggaggccctggagcagcagagacagcagctgctgaccgagagacagaacttccacatggagcagctgaagtacgccgagctgagagccagacagcagatggagcagcagcagcacggccagaacccccagcaggcccaccagcacagcggcggccccggcctggcccccctgggcgccgccggccaccccggcatgatgccccaccagcagccccccccctaccccctgatgcaccaccagatgccccccccccaccccccccagcccggccagatccccggccccggcagcatgatgcccggccagcacatgcccggcagaatgatccccaccgtggccgccaacatccaccccagcggcagcggccccaccccccccggcatgccccccatgcccggcaacatcctgggccccagagtgcccctgaccgcccccaacggcatgtaccccccccccccccagcagcagccccccccccccccccccgccgacggcgtgccccccccccccgcccccggcccccccgccagcgccgccccctag

SEQ ID NO: 101385 - DNA, 3645 bp, Artificial Sequence
  Description of Artificial Sequence: Synthetic coding sequence
atggccgtgagaaagaaggacggcggccccaacgtgaagtactacgaggccgccgacaccgtgacccagttcgacaacgtgagactgtggctgggcaagaactacaagaagtacatccaggccgagccccccaccaacaagagcctgagcagcctggtggtgcagctgctgcagttccaggaggaggtgttcggcaagcacgtgagcaacgcccccctgaccaagctgcccatcaagtgcttcctggacttcaaggccggcggcagcctgtgccacatcctggccgccgcctacaagttcaagagcgaccagggctggagaagatacgacttccagaaccccagcagaatggacagaaacgtggagatgttcatgaccatcgagaagagcctggtgcagaacaactgcctgagcagacccaacatcttcctgtgccccgagatcgagcccaagctgctgggcaagctgaaggacatcatcaagagacaccagggcaccgtgaccgaggacaagaacaacgccagccacgtggtgtaccccgtgcccggcaacctggaggaggaggagtgggtgagacccgtgatgaagagagacaagcaggtgctgctgcactggggctactaccccgacagctacgacacctggatccccgccagcgagatcgaggccagcgtggaggacgcccccacccccgagaagcccagaaaggtgcacgccaagtggatcctggacaccgacaccttcaacgagtggatgaacgaggaggactacgaggtgaacgacgacaagaaccccgtgagcagaagaaagaagatcagcgccaagaccctgaccgacgaggtgaacagccccgacagcgacagaagagacaagaagggcggcaactacaagaagagaaagagaagccccagccccagccccacccccgaggccaagaagaagaacgccaagaagggccccagcaccccctacaccaagagcaagagaggccacagagaggaggagcaggaggacctgaccaaggacatggacgagcccagccccgtgcccaacgtggaggaggtgaccctgcccaagaccgtgaacaccaagaaggacagcgagagcgcccccgtgaagggcggcaccatgaccgacctggacgagcaggaggacgagagcatggagaccaccggcaaggacgaggacgagaacagcaccggcaacaagggcgagcagaccaagaaccccgacctgcacgaggacaacgtgaccgagcagacccaccacatcatcatccccagctacgccgcctggttcgactacaacagcgtgcacgccatcgagagaagagccctgcccgagttcttcaacggcaagaacaagagcaagacccccgagatctacctggcctacagaaacttcatgatcgacacctacagactgaacccccaggagtacctgaccagcaccgcctgcagaagaaacctggccggcgacgtgtgcgccatcatgagagtgcacgccttcctggagcagtggggcctgatcaactaccaggtggacgccgagagcagacccacccccatgggccccccccccaccagccacttccacgtgctggccgacacccccagcggcctggtgcccctgcagcccaagaccccccagcagaccagcgccagccagcagatgctgaacttccccgacaagggcaaggagaagcccaccgacatgcagaacttcggcctgagaaccgacatgtacaccaagaagaacgtgcccagcaagagcaaggccgccgccagcgccaccagagagtggaccgagcaggagaccctgctgctgctggaggccctggagatgtacaaggacgactggaacaaggtgagcgagcacgtgggcagcagaacccaggacgagtgcatcctgcacttcctgagactgcccatcgaggacccctacctggaggacagcgaggccagcctgggccccctggcctaccagcccatccccttcagccagagcggcaaccccgtgatgagcaccgtggccttcctggccagcgtggtggaccccagagtggccagcgccgccgccaagagcgccctggaggagttcagcaagatgaaggaggaggtgcccaccgccctggtggaggcccacgtgagaaaggtggaggaggccgccaaggtgaccggcaaggccgaccccgccttcggcctggagagcagcggcatcgccggcaccaccagcgacgagcccgagagaatcgaggagagcggcaacgacgaggccagagtggagggccaggccaccgacgagaagaaggagcccaaggagcccagagagggcggcggcgccatcgaggaggaggccaaggagaagaccagcgaggcccccaagaaggacgaggagaagggcaaggagggcgacagcgagaaggagagcgagaagagcgacggcgaccccatcgtggaccccgagaaggagaaggagcccaaggagggccaggaggaggtgctgaaggaggtggtggagagcgagggcgagagaaagaccaaggtggagagagacatcggcgagggcaacctgagcaccgccgccgccgccgccctggccgccgccgccgtgaaggccaagcacctggccgccgtggaggagagaaagatcaagagcctggtggccctgctggtggagacccagatgaagaagctggagatcaagctgagacacttcgaggagctggagaccatcatggacagagagagagaggccctggagtaccagagacagcagctgctggccgacagacaggccttccacatggagcagctgaagtacgccgagatgagagccagacagcagcacttccagcagatgcaccagcagcagcagcagcccccccccgccctgccccccggcagccagcccatcccccccaccggcgccgccggcccccccgccgtgcacggcctggccgtggcccccgccagcgtggtgcccgcccccgccggcagcggcgccccccccggcagcctgggccccagcgagcagatcggccaggccggcagcaccgccggcccccagcagcagcagcccgccggcgccccccagcccggcgccgtgccccccggcgtgcccccccccggcccccacggccccagccccttccccaaccagcagaccccccccagcatgatgcccggcgccgtgcccggcagcggccaccccggcgtggccggcaacgcccccctgggcctgcccttcggcatgcccccccccccccccccccccgcccccagcatcatccccttcggcagcctggccgacagcatcagcatcaacctgcccgccccccccaacctgcacggccaccaccaccacctgcccttcgcccccggcaccctgcccccccccaacctgcccgtgagcatggccaaccccctgcaccccaacctgcccgccaccaccaccatgcccagcagcctgcccctgggccccggcctgggcagcgccgccgcccagagccccgccatcgtggccgccgtgcagggcaacctgctgcccagcgccagccccctgcccgaccccggcacccccctgccccccgaccccaccgcccccagccccggcaccgtgacccccgtgccccccccccagtag

SEQ ID NO: 101386 - DNA, 3393 bp, Artificial Sequence
  Description of Artificial Sequence: Synthetic coding sequence
atggccgtgagaaagaaggacggcggccccaacgtgaagtactacgaggccgccgacaccgtgacccagttcgacaacgtgagactgtggctgggcaagaactacaagaagtacatccaggccgagccccccaccaacaagagcctgagcagcctggtggtgcagctgctgcagttccaggaggaggtgttcggcaagcacgtgagcaacgcccccctgaccaagctgcccatcaagtgcttcctggacttcaaggccggcggcagcctgtgccacatcctggccgccgcctacaagttcaagagcgaccagggctggagaagatacgacttccagaaccccagcagaatggacagaaacgtggagatgttcatgaccatcgagaagagcctggtgcagaacaactgcctgagcagacccaacatcttcctgtgccccgagatcgagcccaagctgctgggcaagctgaaggacatcatcaagagacaccagggcaccgtgaccgaggacaagaacaacgccagccacgtggtgtaccccgtgcccggcaacctggaggaggaggagtgggtgagacccgtgatgaagagagacaagcaggtgctgctgcactggggctactaccccgacagctacgacacctggatccccgccagcgagatcgaggccagcgtggaggacgcccccacccccgagaagcccagaaaggtgcacgccaagtggatcctggacaccgacaccttcaacgagtggatgaacgaggaggactacgaggtgaacgacgacaagaaccccgtgagcagaagaaagaagatcagcgccaagaccctgaccgacgaggtgaacagccccgacagcgacagaagagacaagaagggcggcaactacaagaagagaaagagaagccccagccccagccccacccccgaggccaagaagaagaacgccaagaagggccccagcaccccctacaccaagagcaagagaggccacagagaggaggagcaggaggacctgaccaaggacatggacgagcccagccccgtgcccaacgtggaggaggtgaccctgcccaagaccgtgaacaccaagaaggacagcgagagcgcccccgtgaagggcggcaccatgaccgacctggacgagcaggaggacgagagcatggagaccaccggcaaggacgaggacgagaacagcaccggcaacaagggcgagcagaccaagaaccccgacctgcacgaggacaacgtgaccgagcagacccaccacatcatcatccccagctacgccgcctggttcgactacaacagcgtgcacgccatcgagagaagagccctgcccgagttcttcaacggcaagaacaagagcaagacccccgagatctacctggcctacagaaacttcatgatcgacacctacagactgaacccccaggagtacctgaccagcaccgcctgcagaagaaacctggccggcgacgtgtgcgccatcatgagagtgcacgccttcctggagcagtggggcctgatcaactaccaggtggacgccgagagcagacccacccccatgggccccccccccaccagccacttccacgtgctggccgacacccccagcggcctggtgcccctgcagcccaagaccccccagggcagacaggtggacgccgacaccaaggccggcagaaagggcaaggagctggacgacctggtgcccgagaccgccaagggcaagcccgagctgcagaccagcgccagccagcagatgctgaacttccccgacaagggcaaggagaagcccaccgacatgcagaacttcggcctgagaaccgacatgtacaccaagaagaacgtgcccagcaagagcaaggccgccgccagcgccaccagagagtggaccgagcaggagaccctgctgctgctggaggccctggagatgtacaaggacgactggaacaaggtgagcgagcacgtgggcagcagaacccaggacgagtgcatcctgcacttcctgagactgcccatcgaggacccctacctggaggacagcgaggccagcctgggccccctggcctaccagcccatccccttcagccagagcggcaaccccgtgatgagcaccgtggccttcctggccagcgtggtggaccccagagtggccagcgccgccgccaagagcgccctggaggagttcagcaagatgaaggaggaggtgcccaccgccctggtggaggcccacgtgagaaaggtggaggaggccgccaaggtgaccggcaaggccgaccccgccttcggcctggagagcagcggcatcgccggcaccaccagcgacgagcccgagagaatcgaggagagcggcaacgacgaggccagagtggagggccaggccaccgacgagaagaaggagcccaaggagcccagagagggcggcggcgccatcgaggaggaggccaaggagaagaccagcgaggcccccaagaaggacgaggagaagggcaaggagggcgacagcgagaaggagagcgagaagagcgacggcgaccccatcgtggaccccgagaaggagaaggagcccaaggagggccaggaggaggtgctgaaggaggtggtggagagcgagggcgagagaaagaccaaggtggagagagacatcggcgagggcaacctgagcaccgccgccgccgccgccctggccgccgccgccgtgaaggccaagcacctggccgccgtggaggagagaaagatcaagagcctggtggccctgctggtggagacccagatgaagaagctggagatcaagctgagacacttcgaggagctggagaccatcatggacagagagagagaggccctggagtaccagagacagcagctgctggccgacagacaggccttccacatggagcagctgaagtacgccgagatgagagccagacagcagcacttccagcagatgcaccagcagcagcagcagcccccccccgccctgccccccggcagccagcccatcccccccaccggcgccgccggcccccccgccgtgcacggcctggccgtggcccccgccagcgtggtgcccgcccccgccggcagcggcgccccccccggcagcctgggccccagcgagcagatcggccaggccggcagcaccgccggcccccagcagcagcagcccgccggcgccccccagcccggcgccgtgccccccggcgtgcccccccccggcccccacggccccagccccttccccaaccagcagaccccccccagcatgatgcccggcgccgtgcccggcagcggccaccccggcgtggccgaccccggcacccccctgccccccgaccccaccgcccccagccccggcaccgtgacccccgtgccccccccccagtag

SEQ ID NO: 101387 - DNA, 3459 bp, Artificial Sequence
  Description of Artificial Sequence: Synthetic coding sequence
atggccgtgagaaagaaggacggcggccccaacgtgaagtactacgaggccgccgacaccgtgacccagttcgacaacgtgagactgtggctgggcaagaactacaagaagtacatccaggccgagccccccaccaacaagagcctgagcagcctggtggtgcagctgctgcagttccaggaggaggtgttcggcaagcacgtgagcaacgcccccctgaccaagctgcccatcaagtgcttcctggacttcaaggccggcggcagcctgtgccacatcctggccgccgcctacaagttcaagagcgaccagggctggagaagatacgacttccagaaccccagcagaatggacagaaacgtggagatgttcatgaccatcgagaagagcctggtgcagaacaactgcctgagcagacccaacatcttcctgtgccccgagatcgagcccaagctgctgggcaagctgaaggacatcatcaagagacaccagggcaccgtgaccgaggacaagaacaacgccagccacgtggtgtaccccgtgcccggcaacctggaggaggaggagtgggtgagacccgtgatgaagagagacaagcaggtgctgctgcactggggctactaccccgacagctacgacacctggatccccgccagcgagatcgaggccagcgtggaggacgcccccacccccgagaagcccagaaaggtgcacgccaagtggatcctggacaccgacaccttcaacgagtggatgaacgaggaggactacgaggtgaacgacgacaagaaccccgtgagcagaagaaagaagatcagcgccaagaccctgaccgacgaggtgaacagccccgacagcgacagaagagacaagaagggcggcaactacaagaagagaaagagaagccccagccccagccccacccccgaggccaagaagaagaacgccaagaagggccccagcaccccctacaccaagagcaagagaggccacagagaggaggagcaggaggacctgaccaaggacatggacgagcccagccccgtgcccaacgtggaggaggtgaccctgcccaagaccgtgaacaccaagaaggacagcgagagcgcccccgtgaagggcggcaccatgaccgacctggacgagcaggaggacgagagcatggagaccaccggcaaggacgaggacgagaacagcaccggcaacaagggcgagcagaccaagaaccccgacctgcacgaggacaacgtgaccgagcagacccaccacatcatcatccccagctacgccgcctggttcgactacaacagcgtgcacgccatcgagagaagagccctgcccgagttcttcaacggcaagaacaagagcaagacccccgagatctacctggcctacagaaacttcatgatcgacacctacagactgaacccccaggagtacctgaccagcaccgcctgcagaagaaacctggccggcgacgtgtgcgccatcatgagagtgcacgccttcctggagcagtggggcctgatcaactaccaggtggacgccgagagcagacccacccccatgggccccccccccaccagccacttccacgtgctggccgacacccccagcggcctggtgcccctgcagcccaagaccccccagggcagacaggtggacgccgacaccaaggccggcagaaagggcaaggagctggacgacctggtgcccgagaccgccaagggcaagcccgagctgcagaccagcgccagccagcagatgctgaacttccccgacaagggcaaggagaagcccaccgacatgcagaacttcggcctgagaaccgacatgtacaccaagaagaacgtgcccagcaagagcaaggccgccgccagcgccaccagagagtggaccgagcaggagaccctgctgctgctggaggccctggagatgtacaaggacgactggaacaaggtgagcgagcacgtgggcagcagaacccaggacgagtgcatcctgcacttcctgagactgcccatcgaggacccctacctggaggacagcgaggccagcctgggccccctggcctaccagcccatccccttcagccagagcggcaaccccgtgatgagcaccgtggccttcctggccagcgtggtggaccccagagtggccagcgccgccgccaagagcgccctggaggagttcagcaagatgaaggaggaggtgcccaccgccctggtggaggcccacgtgagaaaggtggaggaggccgccaaggtgaccggcaaggccgaccccgccttcggcctggagagcagcggcatcgccggcaccaccagcgacgagcccgagagaatcgaggagagcggcaacgacgaggccagagtggagggccaggccaccgacgagaagaaggagcccaaggagcccagagagggcggcggcgccatcgaggaggaggccaaggagaagaccagcgaggcccccaagaaggacgaggagaagggcaaggagggcgacagcgagaaggagagcgagaagagcgacggcgaccccatcgtggaccccgagaaggagaaggagcccaaggagggccaggaggaggtgctgaaggaggtggtggagagcgagggcgagagaaagaccaaggtggagagagacatcggcgagggcaacctgagcaccgccgccgccgccgccctggccgccgccgccgtgaaggccaagcacctggccgccgtggaggagagaaagatcaagagcctggtggccctgctggtggagacccagatgaagaagctggagatcaagctgagacacttcgaggagctggagaccatcatggacagagagagagaggccctggagtaccagagacagcagctgctggccgacagacaggccttccacatggagcagctgaagtacgccgagatgagagccagacagcagcacttccagcagatgcaccagcagcagcagcagcccccccccgccctgccccccggcagccagcccatcccccccaccggcgccgccggcccccccgccgtgcacggcctggccgtggcccccgccagcgtggtgcccgcccccgccggcagcggcgccccccccggcagcctgggccccagcgagcagatcggccaggccggcagcaccgccggcccccagcagcagcagcccgccggcgccccccagcccggcgccgtgccccccggcgtgcccccccccggcccccacggccccagccccttccccaaccagcagaccccccccagcatgatgcccggcgccgtgcccggcagcggccaccccggcgtggccgcccagagccccgccatcgtggccgccgtgcagggcaacctgctgcccagcgccagccccctgcccgaccccggcacccccctgccccccgaccccaccgcccccagccccggcaccgtgacccccgtgccccccccccagtag

SEQ ID NO: 101388 - DNA, 1425 bp, Artificial Sequence
  Description of Artificial Sequence: Synthetic coding sequence
atggccgccagagccggcttccagagcgtggcccccagcggcggcgccggcgccagcggcggcgccggcgccgccgccgccctgggccccggcggcacccccggcccccccgtgagaatgggccccgcccccggccagggcctgtacagaagccccatgcccggcgccgcctaccccagacccggcatgctgcccggcagcagaatgaccccccagggccccagcatgggcccccccggctacggcggcaaccccagcgtgagacccggcctggcccagagcggcatggaccagagcagaaagagacccgccccccagcagatccagcaggtgcagcagcaggccgtgcagaacagaaaccacaacgccaagaagaagaagatggccgacaagatcctgccccagagaatcagagagctggtgcccgagagccaggcctacatggacctgctggccttcgagagaaagctggaccagaccatcatgagaaagagactggacatccaggaggccctgaagagacccatcaagcagaagagaaagctgagaatcttcatcagcaacaccttcaaccccgccaagagcgacgccgaggacggcgagggcaccgtggccagctgggagctgagagtggagggcagactgctggaggacagcgccctgagcaagtacgacgccaccaagcagaagagaaagttcagcagcttcttcaagagcctggtgatcgagctggacaaggacctgtacggccccgacaaccacctggtggagtggcacagaaccgccaccacccaggagaccgacggcttccaggtgaagagacccggcgacgtgaacgtgagatgcaccgtgctgctgatgctggactaccagcccccccagttcaagctggaccccagactggccagactgctgggcatccacacccagaccagacccgtgatcatccaggccctgtggcagtacatcaagacccacaagctgcaggacccccacgagagagagttcgtgatctgcgacaagtacctgcagcagatcttcgagagccagagaatgaagttcagcgagatcccccagagactgcacgccctgctgatgccccccgagcccatcatcatcaaccacgtgatcagcgtggaccccaacgaccagaagaagaccgcctgctacgacatcgacgtggaggtggacgacaccctgaagacccagatgaacagcttcctgctgagcaccgccagccagcaggagatcgccaccctggacaacaagaccatgaccgacgtggtgggcaaccccgaggaggagagaagagccgagttctacttccagccctgggcccaggaggccgtgtgcagatacttctacagcaaggtgcagcagagaagacaggagctggagcaggccctgggcatcagaaacacctag

SEQ ID NO: 101389 - DNA, 1548 bp, Artificial Sequence
  Description of Artificial Sequence: Synthetic coding sequence
atggccgccagagccggcttccagagcgtggcccccagcggcggcgccggcgccagcggcggcgccggcgccgccgccgccctgggccccggcggcacccccggcccccccgtgagaatgggccccgcccccggccagggcctgtacagaagccccatgcccggcgccgcctaccccagacccggcatgctgcccggcagcagaatgaccccccagggccccagcatgggcccccccggctacggcggcaaccccagcgtgagacccggcctggcccagagcggcatggaccagagcagaaagagacccgccccccagcagatccagcaggtgcagcagcaggccgtgcagaacagaaaccacaacgccaagaagaagaagatggccgacaagatcctgccccagagaatcagagagctggtgcccgagagccaggcctacatggacctgctggccttcgagagaaagctggaccagaccatcatgagaaagagactggacatccaggaggccctgaagagacccatcaagcagaagagaaagctgagaatcttcatcagcaacaccttcaaccccgccaagagcgacgccgaggacggcgagggcaccgtggccagctgggagctgagagtggagggcagactgctggaggacagcgccctgagcaagtacgacgccaccaagcagaagagaaagttcagcagcttcttcaagagcctggtgatcgagctggacaaggacctgtacggccccgacaaccacctggtggagtggcacagaaccgccaccacccaggagaccgacggcttccaggtgaagagacccggcgacgtgaacgtgagatgcaccgtgctgctgatgctggactaccagcccccccagttcaagctggaccccagactggccagactgctgggcatccacacccagaccagacccgtgatcatccaggccctgtggcagtacatcaagacccacaagctgcaggacccccacgagagagagttcgtgatctgcgacaagtacctgcagcagatcttcgagagccagagaatgaagttcagcgagatcccccagagactgcacgccctgctgatgccccccgagcccatcatcatcaaccacgtgatcagcgtggaccccaacgaccagaagaagaccgcctgctacgacatcgacgtggaggtggacgacaccctgaagacccagatgaacagcttcctgctgagcaccgccagccagcaggagatcgccaccctggacaacaagatccacgagaccatcgagaccatcaaccagctgaagacccagagagagttcatgctgagcttcgccagagacccccagggcttcatcaacgactggctgcagagccagtgcagagacctgaagaccatgaccgacgtggtgggcaaccccgaggaggagagaagagccgagttctacttccagccctgggcccaggaggccgtgtgcagatacttctacagcaaggtgcagcagagaagacaggagctggagcaggccctgggcatcagaaacacctag

SEQ ID NO: 101390 - DNA, 876 bp, Artificial Sequence
  Description of Artificial Sequence: Synthetic coding sequence
atgatgcccctgaacaagagaggcagcagcctgcccttcaagagcctggtgatcgagctggacaaggacctgtacggccccgacaaccacctggtggagtggcacagaaccgccaccacccaggagaccgacggcttccaggtgaagagacccggcgacgtgaacgtgagatgcaccgtgctgctgatgctggactaccagcccccccagttcaagctggaccccagactggccagactgctgggcatccacacccagaccagacccgtgatcatccaggccctgtggcagtacatcaagacccacaagctgcaggacccccacgagagagagttcgtgatctgcgacaagtacctgcagcagatcttcgagagccagagaatgaagttcagcgagatcccccagagactgcacgccctgctgatgccccccgagcccatcatcatcaaccacgtgatcagcgtggaccccaacgaccagaagaagaccgcctgctacgacatcgacgtggaggtggacgacaccctgaagacccagatgaacagcttcctgctgagcaccgccagccagcaggagatcgccaccctggacaacaagatccacgagaccatcgagaccatcaaccagctgaagacccagagagagttcatgctgagcttcgccagagacccccagggcttcatcaacgactggctgcagagccagtgcagagacctgaagaccatgaccgacgtggtgggcaaccccgaggaggagagaagagccgagttctacttccagccctgggcccaggaggccgtgtgcagatacttctacagcaaggtgcagcagagaagacaggagctggagcaggccctgggcatcagaaacacctag

SEQ ID NO: 101391 - DNA, 1362 bp, Artificial Sequence; identical to SEQ ID NO: 72420
  Description of Artificial Sequence: Synthetic coding sequence

SEQ ID NO: 101392 - DNA, 1452 bp, Artificial Sequence
  Description of Artificial Sequence: Synthetic coding sequence
atgggcagaagagtgggcgtggaggtgacccccagatgggccccccagaagtgccagggcgccagaccccagagacccggcatgagccccggcaacagaatgcccatggccggcctgcaggtgggcccccccgccggcagccccttcggcgccgccgcccccctgagacccggcatgccccccaccatgatggaccccttcagaaagagactgctggtgccccaggcccagccccccatgcccgcccagagaagaggcctgaagagaagaaagatggccgacaaggtgctgccccagagaatcagagagctggtgcccgagagccaggcctacatggacctgctggccttcgagagaaagctggaccagaccatcgccagaaagagaatggagatccaggaggccatcaagaagcccctgacccagaagagaaagctgagaatctacatcagcaacaccttcagccccagcaaggccgagggcgacagcgccggcaccgccggcacccccggcggcacccccgccggcgacaaggtggccagctgggagctgagagtggagggcaagctgctggacgaccccagcaagcagaagagaaagttcagcagcttcttcaagagcctggtgatcgagctggacaaggagctgtacggccccgacaaccacctggtggagtggcacagaatgcccaccacccaggagaccgacggcttccaggtgaagagacccggcgacctgaacgtgaagtgcaccctgctgctgatgctggaccaccagcccccccagtacaagctggaccccagactggccagactgctgggcgtgcacacccagaccagagccgccatcatgcaggccctgtggctgtacatcaagcacaaccagctgcaggacggccacgagagagagtacatcaactgcaacagatacttcagacagatcttcagctgcggcagactgagattcagcgagatccccatgaagctggccggcctgctgcagcaccccgaccccatcgtgatcaaccacgtgatcagcgtggaccccaacgaccagaagaagaccgcctgctacgacatcgacgtggaggtggacgaccccctgaaggcccagatgagcaacttcctggccagcaccaccaaccagcaggagatcgccagcctggacgtgaagatccacgagaccatcgagagcatcaaccagctgaagacccagagagacttcatgctgagcttcagcaccgacccccaggacttcatccaggagtggctgagaagccagagaagagacctgaagatcatcaccgacgtgatcggcaaccccgaggaggagagaagagccgccttctaccaccagccctgggcccaggaggccgtgggcagacacatcttcgccaaggtgcagcagagaagacaggagctggagcaggtgctgggcatcagactgacctag

SEQ ID NO: 101393 - DNA, 1596 bp, Artificial Sequence
  Description of Artificial Sequence: Synthetic coding sequence
atgagcggcagaggcgccggcggcttccccctgccccccctgagccccggcggcggcgccgtggccgccgccctgggcgccccccccccccccgccggccccggcatgctgcccggccccgccctgagaggccccggccccgccggcggcgtgggcggccccggcgccgccgccttcagacccatgggccccgccggccccgccgcccagtaccagagacccggcatgagccccggcaacagaatgcccatggccggcctgcaggtgggcccccccgccggcagccccttcggcgccgccgcccccctgagacccggcatgccccccaccatgatggaccccttcagaaagagactgctggtgccccaggcccagccccccatgcccgcccagagaagaggcctgaagagaagaaagatggccgacaaggtgctgccccagagaatcagagagctggtgcccgagagccaggcctacatggacctgctggccttcgagagaaagctggaccagaccatcgccagaaagagaatggagatccaggaggccatcaagaagcccctgacccagaagagaaagctgagaatctacatcagcaacaccttcagccccagcaaggccgagggcgacagcgccggcaccgccggcacccccggcggcacccccgccggcgacaaggtggccagctgggagctgagagtggagggcaagctgctggacgaccccagcaagcagaagagaaagttcagcagcttcttcaagagcctggtgatcgagctggacaaggagctgtacggccccgacaaccacctggtggagtggcacagaatgcccaccacccaggagaccgacggcttccaggtgaagagacccggcgacctgaacgtgaagtgcaccctgctgctgatgctggaccaccagcccccccagtacaagctggaccccagactggccagactgctgggcgtgcacacccagaccagagccgccatcatgcaggccctgtggctgtacatcaagcacaaccagctgcaggacggccacgagagagagtacatcaactgcaacagatacttcagacagatcttcagctgcggcagactgagattcagcgagatccccatgaagctggccggcctgctgcagcaccccgaccccatcgtgatcaaccacgtgatcagcgtggaccccaacgaccagaagaagaccgcctgctacgacatcgacgtggaggtggacgaccccctgaaggcccagatgagcaacttcctggccagcaccaccaaccagcaggagatcgccagcctggacgtgaagatccacgagaccatcgagagcatcaaccagctgaagacccagagagacttcatgctgagcttcagcaccgacccccaggacttcatccaggagtggctgagaagccagagaagagacctgaagatcatcaccgacgtgatcggcaaccccgaggaggagagaagagccgccttctaccaccagccctgggcccaggaggccgtgggcagacacatcttcgccaaggtgcagcagagaagacaggagctggagcaggtgctgggcatcagactgacctag

SEQ ID NO: 101394 - DNA, 1485 bp, Artificial Sequence
  Description of Artificial Sequence: Synthetic coding sequence
atgagcggcagaggcgccggcggcttccccctgccccccctgagccccggcggcggcgccgccttcagacccatgggccccgccggccccgccgcccagtaccagagacccggcatgagccccggcaacagaatgcccatggccggcctgcaggtgggcccccccgccggcagccccttcggcgccgccgcccccctgagacccggcatgccccccaccatgatggaccccttcagaaagagactgctggtgccccaggcccagccccccatgcccgcccagagaagaggcctgaagagaagaaagatggccgacaaggtgctgccccagagaatcagagagctggtgcccgagagccaggcctacatggacctgctggccttcgagagaaagctggaccagaccatcgccagaaagagaatggagatccaggaggccatcaagaagcccctgacccagaagagaaagctgagaatctacatcagcaacaccttcagccccagcaaggccgagggcgacagcgccggcaccgccggcacccccggcggcacccccgccggcgacaaggtggccagctgggagctgagagtggagggcaagctgctggacgaccccagcaagcagaagagaaagttcagcagcttcttcaagagcctggtgatcgagctggacaaggagctgtacggccccgacaaccacctggtggagtggcacagaatgcccaccacccaggagaccgacggcttccaggtgaagagacccggcgacctgaacgtgaagtgcaccctgctgctgatgctggaccaccagcccccccagtacaagctggaccccagactggccagactgctgggcgtgcacacccagaccagagccgccatcatgcaggccctgtggctgtacatcaagcacaaccagctgcaggacggccacgagagagagtacatcaactgcaacagatacttcagacagatcttcagctgcggcagactgagattcagcgagatccccatgaagctggccggcctgctgcagcaccccgaccccatcgtgatcaaccacgtgatcagcgtggaccccaacgaccagaagaagaccgcctgctacgacatcgacgtggaggtggacgaccccctgaaggcccagatgagcaacttcctggccagcaccaccaaccagcaggagatcgccagcctggacgtgaagatccacgagaccatcgagagcatcaaccagctgaagacccagagagacttcatgctgagcttcagcaccgacccccaggacttcatccaggagtggctgagaagccagagaagagacctgaagatcatcaccgacgtgatcggcaaccccgaggaggagagaagagccgccttctaccaccagccctgggcccaggaggccgtgggcagacacatcttcgccaaggtgcagcagagaagacaggagctggagcaggtgctgggcatcagactgacctag

SEQ ID NO: 101395 - DNA, 1452 bp, Artificial Sequence
  Description of Artificial Sequence: Synthetic coding sequence
atggccgccgacgaggtggccggcggcgccagaaaggccaccaagagcaagctgttcgagttcctggtgcacggcgtgagacccggcatgcccagcggcgccagaatgccccaccagggcgcccccatgggcccccccggcagcccctacatgggcagccccgccgtgagacccggcctggcccccgccggcatggagcccgccagaaagagagccgcccccccccccggccagagccaggcccagagccagggccagcccgtgcccaccgcccccgccagaagcagaagcgccaagagaagaaagatggccgacaagatcctgccccagagaatcagagagctggtgcccgagagccaggcctacatggacctgctggccttcgagagaaagctggaccagaccatcatgagaaagagagtggacatccaggaggccctgaagagacccatgaagcagaagagaaagctgagactgtacatcagcaacaccttcaaccccgccaagcccgacgccgaggacagcgacggcagcatcgccagctgggagctgagagtggagggcaagctgctggacgaccccagcaagcagaagagaaagttcagcagcttcttcaagagcctggtgatcgagctggacaaggacctgtacggccccgacaaccacctggtggagtggcacagaacccccaccacccaggagaccgacggcttccaggtgaagagacccggcgacctgagcgtgagatgcaccctgctgctgatgctggactaccagcccccccagttcaagctggaccccagactggccagactgctgggcctgcacacccagagcagaagcgccatcgtgcaggccctgtggcagtacgtgaagaccaacagactgcaggacagccacgacaaggagtacatcaacggcgacaagtacttccagcagatcttcgactgccccagactgaagttcagcgagatcccccagagactgaccgccctgctgctgccccccgaccccatcgtgatcaaccacgtgatcagcgtggaccccagcgaccagaagaagaccgcctgctacgacatcgacgtggaggtggaggagcccctgaagggccagatgagcagcttcctgctgagcaccgccaaccagcaggagatcagcgccctggacagcaagatccacgagaccatcgagagcatcaaccagctgaagatccagagagacttcatgctgagcttcagcagagaccccaagggctacgtgcaggacctgctgagaagccagagcagagacctgaaggtgatgaccgacgtggccggcaaccccgaggaggagagaagagccgagttctaccaccagccctggagccaggaggccgtgagcagatacttctactgcaagatccagcagagaagacaggagctggagcagagcctggtggtgagaaacacctag

SEQ ID NO: 101396 - DNA, 1308 bp, Artificial Sequence
  Description of Artificial Sequence: Synthetic coding sequence
atgacccccggcctgcagcacccccccaccgtggtgcagagacccggcatgcccagcggcgccagaatgccccaccagggcgcccccatgggcccccccggcagcccctacatgggcagccccgccgcccccgccagaagcagaagcgccaagagaagaaagatggccgacaagatcctgccccagagaatcagagagctggtgcccgagagccaggcctacatggacctgctggccttcgagagaaagctggaccagaccatcatgagaaagagagtggacatccaggaggccctgaagagacccatgaagcagaagagaaagctgagactgtacatcagcaacaccttcaaccccgccaagcccgacgccgaggacagcgacggcagcatcgccagctgggagctgagagtggagggcaagctgctggacgaccccagcaagcagaagagaaagttcagcagcttcttcaagagcctggtgatcgagctggacaaggacctgtacggccccgacaaccacctggtggagtggcacagaacccccaccacccaggagaccgacggcttccaggtgaagagacccggcgacctgagcgtgagatgcaccctgctgctgatgctggactaccagcccccccagttcaagctggaccccagactggccagactgctgggcctgcacacccagagcagaagcgccatcgtgcaggccctgtggcagtacgtgaagaccaacagactgcaggacagccacgacaaggagtacatcaacggcgacaagtacttccagcagatcttcgactgccccagactgaagttcagcgagatcccccagagactgaccgccctgctgctgccccccgaccccatcgtgatcaaccacgtgatcagcgtggaccccagcgaccagaagaagaccgcctgctacgacatcgacgtggaggtggaggagcccctgaagggccagatgagcagcttcctgctgagcaccgccaaccagcaggagatcagcgccctggacagcaagatccacgagaccatcgagagcatcaaccagctgaagatccagagagacttcatgctgagcttcagcagagaccccaagggctacgtgcaggacctgctgagaagccagagcagagacctgaaggtgatgaccgacgtggccggcaaccccgaggaggagagaagagccgagttctaccaccagccctggagccaggaggccgtgagcagatacttctactgcaagatccagcagagaagacaggagctggagcagagcctggtggtgagaaacacctag

SEQ ID NO: 101397 - DNA, 1413 bp, Artificial Sequence
  Description of Artificial Sequence: Synthetic coding sequence
atgacccccggcctgcagcacccccccaccgtggtgcagagacccggcatgcccagcggcgccagaatgccccaccagggcgcccccatgggcccccccggcagcccctacatgggcagccccgccgtgagacccggcctggcccccgccggcatggagcccgccagaaagagagccgcccccccccccggccagagccaggcccagagccagggccagcccgtgcccaccgcccccgccagaagcagaagcgccaagagaagaaagatggccgacaagatcctgccccagagaatcagagagctggtgcccgagagccaggcctacatggacctgctggccttcgagagaaagctggaccagaccatcatgagaaagagagtggacatccaggaggccctgaagagacccatgaagcagaagagaaagctgagactgtacatcagcaacaccttcaaccccgccaagcccgacgccgaggacagcgacggcagcatcgccagctgggagctgagagtggagggcaagctgctggacgaccccagcaagcagaagagaaagttcagcagcttcttcaagagcctggtgatcgagctggacaaggacctgtacggccccgacaaccacctggtggagtggcacagaacccccaccacccaggagaccgacggcttccaggtgaagagacccggcgacctgagcgtgagatgcaccctgctgctgatgctggactaccagcccccccagttcaagctggaccccagactggccagactgctgggcctgcacacccagagcagaagcgccatcgtgcaggccctgtggcagtacgtgaagaccaacagactgcaggacagccacgacaaggagtacatcaacggcgacaagtacttccagcagatcttcgactgccccagactgaagttcagcgagatcccccagagactgaccgccctgctgctgccccccgaccccatcgtgatcaaccacgtgatcagcgtggaccccagcgaccagaagaagaccgcctgctacgacatcgacgtggaggtggaggagcccctgaagggccagatgagcagcttcctgctgagcaccgccaaccagcaggagatcagcgccctggacagcaagatccacgagaccatcgagagcatcaaccagctgaagatccagagagacttcatgctgagcttcagcagagaccccaagggctacgtgcaggacctgctgagaagccagagcagagacctgaaggtgatgaccgacgtggccggcaaccccgaggaggagagaagagccgagttctaccaccagccctggagccaggaggccgtgagcagatacttctactgcaagatccagcagagaagacaggagctggagcagagcctggtggtgagaaacacctag

SEQ ID NO: 101398 - DNA, 1413 bp, Artificial Sequence; identical to SEQ ID NO: 101397
  Description of Artificial Sequence: Synthetic coding sequence

SEQ ID NO: 101399 - DNA, 420 bp, Artificial Sequence
  Description of Artificial Sequence: Synthetic coding sequence
atgacccccggcctgcagcacccccccaccgtggtgcagagacccggcatgcccagcggcgccagaatgccccaccagggcgcccccatgggcccccccggcagcccctacatgggcagccccgccgtgagacccggcctggcccccgccggcatggagcccgccagaaagagagccgcccccccccccggccagagccaggcccagagccagggccagcccgtgcccaccgcccccgccagaagcagaagcgccaagagaagaaagatggccgacaagatcctgccccagagaatcagagagctggtgcccgagagccaggcctacatggacctgctggccttcgagagaaagctggaccagaccatcatgagaaagagagtggacatccaggaggccctgaagagacccatgaagtag

SEQ ID NO: 101400 - DNA, 3081 bp, Artificial Sequence
  Description of Artificial Sequence: Synthetic coding sequence
atgaacctgttcaacctggacagattcagattcgagaagagaaacaagatcgaggaggcccccgaggccaccccccagcccagccagcccggccccagcagccccatcagcctgagcgccgaggaggagaacgccgagggcgaggtgagcagagccaacacccccgacagcgacatcaccgagaagaccgaggacagcagcgtgcccgagacccccgacaacgagagaaaggccagcatcagctacttcaagaaccagagaggcatccagtacatcgacctgagcagcgacagcgaggacgtggtgagccccaactgcagcaacaccgtgcaggagaagaccttcaacaaggacaccgtgatcatcgtgagcgagcccagcgaggacgaggagagccagggcctgcccaccatggccagaagaaacgacgacatcagcgagctggaggacctgagcgagctggaggacctgaaggacgccaagctgcagaccctgaaggagctgttcccccagagaagcgacaacgacctgctgaagctgatcgagagcaccagcaccatggacggcgccatcgccgccgccctgctgatgttcggcgacgccggcggcggccccagaaagagaaagctgagcagcagcagcgagccctacgaggaggacgagttcaacgacgaccagagcatcaagaagaccagactggaccacggcgaggagagcaacgagagcgccgagagcagcagcaactgggagaagcaggagagcatcgtgctgaagctgcagaaggagttccccaacttcgacaagcaggagctgagagaggtgctgaaggagcacgagtggatgtacaccgaggccctggagagcctgaaggtgttcgccgaggaccaggacatgcagtacgtgagccagagcgaggtgcccaacggcaaggaggtgagcagcagaagccagaactaccccaagaacgccaccaagaccaagctgaagcagaagttcagcatgaaggcccagaacggcttcaacaagaagagaaagaagaacgtgttcaaccccaagagagtggtggaggacagcgagtacgacagcggcagcgacgtgggcagcagcctggacgaggactacagcagcggcgaggaggtgatggaggacggctacaagggcaagatcctgcacttcctgcaggacgccagcatcggcgagctgaccctgatcccccagtgcagccagaagaaggcccagaagatcaccgagctgagacccttcaacagctgggaggccctgttcaccaagatgagcaagaccaacggcctgagcgaggacctgatctggcactgcaagaccctgatccaggagagagacgtggtgatcagactgatgaacaagtgcgaggacatcagcaacaagctgaccaagcaggtgaccatgctgaccggcaacggcggcggctggaacatcgagcagcccagcatcctgaaccagagcctgagcctgaagccctaccagaaggtgggcctgaactggctggccctggtgcacaagcacggcctgaacggcatcctggccgacgagatgggcctgggcaagaccatccaggccatcgccttcctggcctacctgtaccaggagggcaacaacggcccccacctgatcgtggtgcccgccagcaccatcgacaactggctgagagaggtgaacctgtggtgccccaccctgaaggtgctgtgctactacggcagccaggaggagagaaagcagatcagattcaacatccacagcagatacgaggactacaacgtgatcgtgaccacctacaactgcgccatcagcagcagcgacgacagaagcctgttcagaagactgaagctgaactacgccatcttcgacgagggccacatgctgaagaacatgggcagcatcagataccagcacctgatgaccatcaacgccaacaacagactgctgctgaccggcacccccgtgcagaacaacctgctggagctgatgagcctgctgaacttcgtgatgccccacatgttcagcagcagcaccagcgagatcagaagaatgttcagcagcaagaccaagagcgccgacgagcagagcatctacgagaaggagagaatcgcccacgccaagcagatcatcaagcccttcatcctgagaagagtgaaggaggaggtgctgaagcagctgccccccaagaaggacagaatcgagctgtgcgccatgagcgagaagcaggagcagctgtacctgggcctgttcaacagactgaagaagagcatcaacaacctggagaagaacaccgagatgtgcaacgtgatgatgcagctgagaaagatggccaaccaccccctgctgcacagacagtactacaccgccgagaagctgaaggagatgagccagctgatgctgaaggagcccacccactgcgaggccaaccccgacctgatcttcgaggacatggaggtgatgaccgacttcgagctgcacgtgctgtgcaagcagtacagacacatcaacaacttccagctggacatggacctgatcctggacagcggcaagttcagagtgctgggctgcatcctgagcgagctgaagcagaagggcgacagagtggtgctgttcagccagttcaccatgatgctggacatcctggaggtgctgctgaagcaccaccagcacagatacctgagactggacggcaagacccagatcagcgagagaatccacctgatcgacgagttcaacaccgacatggacatcttcgtgttcctgctgagcaccaaggccggcggcctgggcatcaacctgaccagcgccaacgtggtgatcctgcacgacatcgactgcaacccctacaacgacaagcaggccgaggacagatgccacagagtgggccagaccaaggaggtgctggtgatcaagctgatcagccagggcaccatcgaggagagcatgctgaagatcaaccagcagaagctgaagctggagcaggacatgaccaccgtggacgagggcgacgagggcagcatgcccgccgacatcgccaccctgctgaagaccagcatgggcctgtag

SEQ ID NO: 101401 - DNA, 3087 bp, Artificial Sequence
  Description of Artificial Sequence: Synthetic coding sequence
atgaacctgttcaacctggacagattcagattcgagaagagaaacaagatcgaggaggcccccgaggccaccccccagcccagccagcccggccccagcagccccatcagcctgagcgccgaggaggagaacgccgagggcgaggtgagcagagccaacacccccgacagcgacatcaccgagaagaccgaggacagcagcgtgcccgagacccccgacaacgagagaaaggccagcatcagctacttcaagaaccagagaggcatccagtacatcgacctgagcagcgacagcgaggacgtggtgagccccaactgcagcaacaccgtgcaggagaagaccttcaacaaggacaccgtgatcatcgtgagcgagcccagcgaggacgaggagagccagggcctgcccaccatggccagaagaaacgacgacatcagcgagctggaggacctgagcgagctggaggacctgaaggacgccaagctgcagaccctgaaggagctgttcccccagagaagcgacaacgacctgctgaagctgatcgagagcaccagcaccatggacggcgccatcgccgccgccctgctgatgttcggcgacgccggcggcggccccagaaagagaaagctgagcagcagcagcgagccctacgaggaggacgagttcaacgacgaccagagcatcaagaagaccagactggaccacggcgaggagagcaacgagagcgccgagagcagcagcaactgggagaagcaggagagcatcgtgctgaagctgcagaaggagttccccaacttcgacaagcaggagctgagagaggtgctgaaggagcacgagtggatgtacaccgaggccctggagagcctgaaggtgttcgccgaggaccaggacatgcagtacgtgagccagagcgaggtgcccaacggcaaggaggtgagcagcagaagccagaactaccccaagaacgccaccaagaccaagctgaagcagaagttcagcatgaaggcccagaacggcttcaacaagaagagaaagaagaacgtgttcaaccccaagagagtggtggaggacagcgagtacgacagcggcagcgacgtgggcagcagcctggacgaggactacagcagcggcgaggaggtgatggaggacggctacaagggcaagatcctgcacttcctgcaggacgccagcatcggcgagctgaccctgatcccccagtgcagccagaagaaggcccagaagatcaccgagctgagacccttcaacagctgggaggccctgttcaccaagatgagcaagaccaacggcctgagcgaggacctgatctggcactgcaagaccctgatccaggagagagacgtggtgatcagactgatgaacaagtgcgaggacatcagcaacaagctgaccaagcaggtgaccatgctgaccggcaacggcggcggctggaacatcgagcagcccagcatcctgaaccagagcctgagcctgaagccctaccagaaggtgggcctgaactggctggccctggtgcacaagcacggcctgaacggcatcctggccgacgagatgggcctgggcaagaccatccaggccatcgccttcctggcctacctgtaccaggagggcaacaacggcccccacctgatcgtggtgcccgccagcaccatcgacaactggctgagagaggtgaacctgtggtgccccaccctgaaggtgctgtgctactacggcagccaggaggagagaaagcagatcagattcaacatccacagcagatacgaggactacaacgtgatcgtgaccacctacaactgcgccatcagcagcagcgacgacagaagcctgttcagaagactgaagctgaactacgccatcttcgacgagggccacatgctgaagaacatgggcagcatcagataccagcacctgatgaccatcaacgccaacaacagactgctgctgaccggcacccccgtgcagaacaacctgctggagctgatgagcctgctgaacttcgtgatgccccacatgttcagcagcagcaccagcgagatcagaagaatgttcagcagcaagaccaagagcgccgacgagcagagcatctacgagaaggagagaatcgcccacgccaagcagatcatcaagcccttcatcctgagaagagtgaaggaggaggtgctgaagcagctgccccccaagaaggacagaatcgagctgtgcgccatgagcgagaagcaggagcagctgtacctgggcctgttcaacagactgaagaagagcatcaacaacctggtgaccgagaagaacaccgagatgtgcaacgtgatgatgcagctgagaaagatggccaaccaccccctgctgcacagacagtactacaccgccgagaagctgaaggagatgagccagctgatgctgaaggagcccacccactgcgaggccaaccccgacctgatcttcgaggacatggaggtgatgaccgacttcgagctgcacgtgctgtgcaagcagtacagacacatcaacaacttccagctggacatggacctgatcctggacagcggcaagttcagagtgctgggctgcatcctgagcgagctgaagcagaagggcgacagagtggtgctgttcagccagttcaccatgatgctggacatcctggaggtgctgctgaagcaccaccagcacagatacctgagactggacggcaagacccagatcagcgagagaatccacctgatcgacgagttcaacaccgacatggacatcttcgtgttcctgctgagcaccaaggccggcggcctgggcatcaacctgaccagcgccaacgtggtgatcctgcacgacatcgactgcaacccctacaacgacaagcaggccgaggacagatgccacagagtgggccagaccaaggaggtgctggtgatcaagctgatcagccagggcaccatcgaggagagcatgctgaagatcaaccagcagaagctgaagctggagcaggacatgaccaccgtggacgagggcgacgagggcagcatgcccgccgacatcgccaccctgctgaagaccagcatgggcctgtag

SEQ ID NO: 101402 - DNA, 3087 bp, Artificial Sequence; identical to SEQ ID NO: 101401
  Description of Artificial Sequence: Synthetic coding sequence

SEQ ID NO: 101403 - DNA, 957 bp, Artificial Sequence
  Description of Artificial Sequence: Synthetic coding sequence
atgaacctgttcaacctggacagattcagattcgagaagagaaacaagatcgaggaggcccccgaggccaccccccagcccagccagcccggccccagcagccccatcagcctgagcgccgaggaggagaacgccgagggcgaggtgagcagagccaacacccccgacagcgacatcaccgagaagaccgaggacagcagcgtgcccgagacccccgacaacgagagaaaggccagcatcagctacttcaagaaccagagaggcatccagtacatcgacctgagcagcgacagcgaggacgtggtgagccccaactgcagcaacaccgtgcaggagaagaccttcaacaaggacaccgtgatcatcgtgagcgagcccagcgaggacgaggagagccagggcctgcccaccatggccagaagaaacgacgacatcagcgagctggaggacctgagcgagctggaggacctgaaggacgccaagctgcagaccctgaaggagctgttcccccagagaagcgacaacgacctgctgaagctgatcgagagcaccagcaccatggacggcgccatcgccgccgccctgctgatgttcggcgacgccggcggcggccccagaaagagaaagctgagcagcagcagcgagccctacgaggaggacgagttcaacgacgaccagagcatcaagaagaccagactggaccacggcgaggagagcaacgagagcgccgagagcagcagcaactgggagaagcaggagagcatcgtgctgaagctgcagaaggagttccccaacttcgacaagcaggagctgagagaggtgctgaaggagcacgagtggatgtacaccgaggccctggagagcctgaaggtgttcgccgaggaccaggacatgcagtacgtgagccagagcgaggtgcccaacggcaagaagaaggcccagaagaagaagaagtag

SEQ ID NO: 101404 - DNA, 732 bp, Artificial Sequence
  Description of Artificial Sequence: Synthetic coding sequence
atggccgccatcgccgccagcgaggtgctggtggacagcgccgaggagggcagcctggccgccgccgccgagctggccgcccagaagagagagcagagactgagaaagttcagagagctgcacctgatgagaaacgaggccagaaagctgaaccaccaggaggtggtggaggaggacaagagactgaagctgcccgccaactgggaggccaagaaggccagactggagtgggagctgaaggaggaggagaagaagaaggagtgcgccgccagaggcgaggactacgagaaggtgaagctgctggagatcagcgccgaggacgccgagagatgggagagaaagaagaagagaaagaaccccgacctgggcttcagcgactacgccgccgcccagctgagacagtaccacagactgaccaagcagatcaagcccgacatggagacctacgagagactgagagagaagcacggcgaggagttcttccccaccagcaacagcctgctgcacggcacccacgtgcccagcaccgaggagatcgacagaatggtgatcgacctggagaagcagatcgagaagagagacaagtacagcagaagaagaccctacaacgacgacgccgacatcgactacatcaacgagagaaacgccaagttcaacaagaaggccgagagattctacggcaagtacaccgccgagatcaagcagaacctggagagaggcaccgccgtgtag

SEQ ID NO: 101405 - DNA, 606 bp, Artificial Sequence
  Description of Artificial Sequence: Synthetic coding sequence
atggccgccatcgccgccagcgaggtgctggtggacagcgccgaggagggcagcctggccgccgccgccgagctggccgcccagaagagagagcagagactgagaaagttcagagagctgcacctgatgagagagtgcgccgccagaggcgaggactacgagaaggtgaagctgctggagatcagcgccgaggacgccgagagatgggagagaaagaagaagagaaagaaccccgacctgggcttcagcgactacgccgccgcccagctgagacagtaccacagactgaccaagcagatcaagcccgacatggagacctacgagagactgagagagaagcacggcgaggagttcttccccaccagcaacagcctgctgcacggcacccacgtgcccagcaccgaggagatcgacagaatggtgatcgacctggagaagcagatcgagaagagagacaagtacagcagaagaagaccctacaacgacgacgccgacatcgactacatcaacgagagaaacgccaagttcaacaagaaggccgagagattctacggcaagtacaccgccgagatcaagcagaacctggagagaggcaccgccgtgtag

SEQ ID NO: 101406 - DNA, 777 bp, Artificial Sequence
  Description of Artificial Sequence: Synthetic coding sequence
atggacggcatcatcgagcagaagagcatgctggtgcacagcaagatcagcgacgccggcaagagaaacggcctgatcaacaccagaaacctgatggccgagagcagagacggcctggtgagcgtgtaccccgccccccagtaccagagccacagagtgggcgccagcaccgtgcccgccagcctggacagcagcagaagcgagcccatgcagcagctgctggaccccaacaccctgcagcagagcgtggagagcagatacagacccaacatcatcctgtacagcgagggcgtgctgagaagctggggcgacggcgtggccgccgactgctgcgagaccaccttcatcgaggacagaagccccaccaaggacagcctggagtaccccgacggcaagttcatcgacctgagcgccgacgacatcaagatccacaccctgagctacgacgtggaggaggaggaggagttccaggagctggagagcgactacagcagcgacaccgagagcgaggacaacttcctgatgatgccccccagagaccacctgggcctgagcgtgttcagcatgctgtgctgcttctggcccctgggcatcgccgccttctacctgagccacgagaccaacaaggccgtggccaagggcgacctgcaccaggccagcaccagcagcagaagagccctgttcctggccgtgctgagcatcaccatcggcaccggcgtgtacgtgggcgtggccgtggccctgatcgcctacctgagcaagaacaaccacctgtag

SEQ ID NO: 101407 - DNA, 717 bp, Artificial Sequence
  Description of Artificial Sequence: Synthetic coding sequence
atggagagcctgagcgagctgcagaaccccctgctgcccagaagccccgcccacctgcacggcccctacccctaccccgagaccccccccagctggagctgccaggagaagctgtacagctacctgctgggcggcgccggccccgccggcgcccaccagctgctggaccccggcagcctgcagctggccgtggaggcctggtacagacccagctgcctgctgggcagagacaaggtgaaggagcccagagccggcagctgcgagaccagcttcaccgaggacagagagccccaggagggcccccccgagcagcccaccggccccggccaggccgccgagaacgtgaccatccagaccgtgagctacggcgtgcaggaggagctgagagaccaggaggacgaccaggaggaggaggagagcgacgccaccagcaccgagagcgagagcgaggacaacttcctgaccctgccccccagagaccacctgggcctgaccctgttcagcatgctgtgctgcttctggcccctgggcatcgccgccttctacttcagccagggcaccagcaaggccatcagcaagggcgacttcagactggccagcaccaccagcagaagagccctgttcctggccaccctggccatcgccgtgggcgccggcctgtacgtggccgtggtggtggccctggccgcctacatgagccagaacggccacggctag

SEQ ID NO: 101408 - DNA, 717 bp, Artificial Sequence; identical to SEQ ID NO: 101407
  Description of Artificial Sequence: Synthetic coding sequence

SEQ ID NO: 101409 - DNA, 243 bp, Artificial Sequence
  Description of Artificial Sequence: Synthetic coding sequence
atggagagcctgagcgagctgcagaaccccctgctgcccagaagccccgcccacctgcacggcccctacccctaccccgagaccccccccagctggagctgccaggagaagctgtacagctacctgctgggcggcgccggccccgccggcgcccaccagctgctggaccccggcagcctgcagctggccgtggaggcctggtacagacccagctgcctgctgggcagagacaaggtgaagtag

SEQ ID NO: 101410 - DNA, 2118 bp, Artificial Sequence
  Description of Artificial Sequence: Synthetic coding sequence
atgaactacctgagaagaagactgagcgacagcaacttcatggccaacctgcccaacggctacatgaccgacctgcagagaccccagccccccccccccccccccggcgcccacagccccggcgccacccccggccccggcaccgccaccgccgagagaagcagcggcgtggcccccgccgccagccccgccgcccccagccccggcagcagcggcggcggcggcttcttcagcagcctgagcaacgccgtgaagcagaccaccgccgccgccgccgccaccttcagcgagcaggtgggcggcggcagcggcggcgccggcagaggcggcgccgccagcagagtgctgctggtgatcgacgagccccacaccgactgggccaagtacttcaagggcaagaagatccacggcgagatcgacatcaaggtggagcaggccgagttcagcgacctgaacctggtggcccacgccaacggcggcttcagcgtggacatggaggtgctgagaaacggcgtgaaggtggtgagaagcctgaagcccgacttcgtgctgatcagacagcacgccttcagcatggccagaaacggcgactacagaagcctggtgatcggcctgcagtacgccggcatccccagcgtgaacagcctgcacagcgtgtacaacttctgcgacaagccctgggtgttcgcccagatggtgagactgcacaagaagctgggcaccgaggagttccccctgatcgaccagaccttctaccccaaccacaaggagatgctgagcagcaccacctaccccgtggtggtgaagatgggccacgcccacagcggcatgggcaaggtgaaggtggacaaccagcacgacttccaggacatcgccagcgtggtggccctgaccaagacctacgccaccgccgagcccttcatcgacgccaagtacgacgtgagagtgcagaagatcggccagaactacaaggcctacatgagaaccagcgtgagcggcaactggaagaccaacaccggcagcgccatgctggagcagatcgccatgagcgacagatacaagctgtgggtggacacctgcagcgagatcttcggcggcctggacatctgcgccgtggaggccctgcacggcaaggacggcagagaccacatcatcgaggtggtgggcagcagcatgcccctgatcggcgaccaccaggacgaggacaagcagctgatcgtggagctggtggtgaacaagatggcccaggccctgcccagacagagacagagagacgccagccccggcagaggcagccacggccagacccccagccccggcgccctgcccctgggcagacagaccagccagcagcccgccggcccccccgcccagcagagaccccccccccagggcggccccccccagcccggccccggcccccagagacagggcccccccctgcagcagagaccccccccccagggccagcagcacctgagcggcctgggcccccccgccggcagccccctgccccagagactgcccagccccaccagcgccccccagcagcccgccagccaggccgccccccccacccagggccagggcagacagagcagacccgtggccggcggccccggcgccccccccgccgccagaccccccgccagccccagcccccagagacaggccggccccccccaggccaccagacagaccagcgtgagcggccccgccccccccaaggccagcggcgccccccccggcggccagcagagacagggccccccccagaagccccccggccccgccggccccaccagacaggccagccaggccggccccgtgcccagaaccggcccccccaccacccagcagcccagacccagcggccccggccccgccggcagacccaagccccagctggcccagaagcccagccaggacgtgcccccccccgccaccgccgccgccggcggccccccccacccccagctgaacaagagccagagcctgaccaacgccttcaacctgcccgagcccgccccccccagacccagcctgagccaggacgaggtgaaggccgagaccatcagaagcctgagaaagagcttcgccagcctgttcagcgactag

SEQ ID NO: 101411 - DNA, 2010 bp, Artificial Sequence
  Description of Artificial Sequence: Synthetic coding sequence
atgaactacctgagaagaagactgagcgacagcaacttcatggccaacctgcccaacggctacatgaccgacctgcagagaccccagccccccccccccccccccggcgcccacagccccggcgccacccccggccccggcaccgccaccgccgagagaagcagcggcgtggcccccgccgccagccccgccgcccccagccccggcagcagcggcggcggcggcttcttcagcagcctgagcaacgccgtgaagcagaccaccgccgccgccgccgccaccttcagcgagcaggtgggcggcggcagcggcggcgccggcagaggcggcgccgccagcagagtgctgctggtgatcgacgagccccacaccgactgggccaagtacttcaagggcaagaagatccacggcgagatcgacatcaaggtggagcaggccgagttcagcgacctgaacctggtggcccacgccaacggcggcttcagcgtggacatggaggtgctgagaaacggcgtgaaggtggtgagaagcctgaagcccgacttcgtgctgatcagacagcacgccttcagcatggccagaaacggcgactacagaagcctggtgatcggcctgcagtacgccggcatccccagcgtgaacagcctgcacagcgtgtacaacttctgcgacaagccctgggtgttcgcccagatggtgagactgcacaagaagctgggcaccgaggagttccccctgatcgaccagaccttctaccccaaccacaaggagatgctgagcagcaccacctaccccgtggtggtgaagatgggccacgcccacagcggcatgggcaaggtgaaggtggacaaccagcacgacttccaggacatcgccagcgtggtggccctgaccaagacctacgccaccgccgagcccttcatcgacgccaagtacgacgtgagagtgcagaagatcggccagaactacaaggcctacatgagaaccagcgtgagcggcaactggaagaccaacaccggcagcgccatgctggagcagatcgccatgagcgacagatacaagctgtgggtggacacctgcagcgagatcttcggcggcctggacatctgcgccgtggaggccctgcacggcaaggacggcagagaccacatcatcgaggtggtgggcagcagcatgcccctgatcggcgaccaccaggacgaggacaagcagctgatcgtggagctggtggtgaacaagatggcccaggccctgcccagacagagacagagagacgccagccccggcagaggcagccacggccagacccccagccccggcgccctgcccctgggcagacagaccagccagcagcccgccggcccccccgcccagcagagaccccccccccagggcggccccccccagcccggccccggcccccagagacagggcccccccctgcagcagagaccccccccccagggccagcagcacctgagcggcctgggcccccccgccggcagccccctgccccagagactgcccagccccaccagcgccccccagcagcccgccagccaggccgccccccccacccagggccagggcagacagagcagacccgtggccggcggccccggcgccccccccgccgccagaccccccgccagccccagcccccagagacaggccggccccccccaggccaccagacagaccagcgtgagcggccccgccccccccaaggccagcggcgccccccccggcggccagcagagacagggccccccccagaagccccccggccccgccggccccaccagacaggccagccaggccggccccgtgcccagaaccggcccccccaccacccagcagcccagacccagcggccccggccccgccggcagacccaagccccagctggcccagaagcccagccaggacgtgcccccccccgccaccgccgccgccggcggccccccccacccccagctgaaggccagccccgcccaggcccagccctag

SEQ ID NO: 101412 - DNA, 1743 bp, Artificial Sequence
  Description of Artificial Sequence: Synthetic coding sequence
atgaacttcctgagaagaagactgagcgacagcagcttcatggccaacctgcccaacggctacatgaccgacctgcagagacccgacagcagcaccagcagccccgccagccccgccatggagagaagacacccccagcccctggccgccagcttcagcagccccggcagcagcctgttcagcagcctgagcagcgccatgaagcaggccccccaggccaccagcggcctgatggagccccccggccccagcacccccatcgtgcagagacccagaatcctgctggtgatcgacgacgcccacaccgactggagcaagtacttccacggcaagaaggtgaacggcgagatcgagatcagagtggagcaggccgagttcagcgagctgaacctggccgcctacgtgaccggcggctgcatggtggacatgcaggtggtgagaaacggcaccaaggtggtgagcagaagcttcaagcccgacttcatcctggtgagacagcacgcctacagcatggccctgggcgaggactacagaagcctggtgatcggcctgcagtacggcggcctgcccgccgtgaacagcctgtacagcgtgtacaacttctgcagcaagccctgggtgttcagccagctgatcaagatcttccacagcctgggccccgagaagttccccctggtggagcagaccttcttccccaaccacaagcccatggtgaccgccccccacttccccgtggtggtgaagctgggccacgcccacgccggcatgggcaagatcaaggtggagaaccagctggacttccaggacatcaccagcgtggtggccatggccaagacctacgccaccaccgaggccttcatcgacagcaagtacgacatcagaatccagaagatcggcagcaactacaaggcctacatgagaaccagcatcagcggcaactggaaggccaacaccggcagcgccatgctggagcaggtggccatgaccgagagatacagactgtgggtggacagctgcagcgagatgttcggcggcctggacatctgcgccgtgaaggccgtgcacagcaaggacggcagagactacatcatcgaggtgatggacagcagcatgcccctgatcggcgagcacgtggaggaggacagacagctgatggccgacctggtggtgagcaagatgagccagctgcccatgcccggcggcaccgcccccagccccctgagaccctgggccccccagatcaagagcgccaagagccccggccaggcccagctgggcccccagctgggccagccccagcccagaccccccccccagggcggccccagacaggcccagagcccccagccccagagaagcggcagccccagccagcagagactgagcccccagggccagcagcccctgagcccccagagcggcagcccccagcagcagagaagccccggcagcccccagctgagcagagccagcagcggcagcagccccaaccaggccagcaagcccggcgccaccctggccagccagcccagaccccccgtgcagggcagaagcaccagccagcagggcgaggagagcaagaagcccgcccccccccacccccacctgaacaagagccagagcctgaccaacagcctgagcaccagcgacaccagccagagaggcacccccagcgaggacgaggccaaggccgagaccatcagaaacctgagaaagagcttcgccagcctgttcagcgactag

SEQ ID NO: 101413 - DNA, 1743 bp, Artificial Sequence; identical to SEQ ID NO: 101412
  Description of Artificial Sequence: Synthetic coding sequence

SEQ ID NO: 101414 - DNA, 1335 bp, Artificial Sequence
  Description of Artificial Sequence: Synthetic coding sequence
atgaacttcctgagaagaagactgagcgacagcagcttcatggccaacctgcccaacggctacatgaccgacctgcagagacccgacagcagcaccagcagccccgccagccccgccatggagagaagacacccccagcccctggccgccagcttcagcagccccggcagcagcctgttcagcagcctgagcagcgccatgaagcaggccccccaggccaccagcggcctgatggagccccccggccccagcacccccatcgtgcagagacccagaatcctgctggtgatcgacgacgcccacaccgactggagcaagtacttccacggcaagaaggtgaacggcgagatcgagatcagagtggagcaggccgagttcagcgagctgaacctggccgcctacgtgaccggcggctgcatggtggacatgcaggtggtgagaaacggcaccaaggtggtgagcagaagcttcaagcccgacttcatcctggtgagacagcacgcctacagcatggccctgggcgaggactacagaagcctggtgatcggcctgcagtacggcggcctgcccgccgtgaacagcctgtacagcgtgtacaacttctgcagcaagccctgggtgttcagccagctgatcaagatcttccacagcctgggccccgagaagttccccctggtggagcagaccttcttccccaaccacaagcccatggtgaccgccccccacttccccgtggtggtgaagctgggccacgcccacgccggcatgggcaagatcaaggtggagaaccagctggacttccaggacatcaccagcgtggtggccatggccaagacctacgccaccaccgaggccttcatcgacagcaagtacgacatcagaatccagaagatcggcagcaactacaaggcctacatgagaaccagcatcagcggcaactggaaggccaacaccggcagcgccatgctggagcaggtggccatgaccgagagatacagactgtgggtggacagctgcagcgagatgttcggcggcctggacatctgcgccgtgaaggccgtgcacagcaaggacggcagagactacatcatcgaggtgatggacagcagcatgcccctgatcggcgagcacgtggaggaggacagacagctgatggccgacctggtggtgagcaagatgagccagctgcccatgcccggcggcaccgcccccagccccctgagaccctgggccccccagatcaagagcgccaagagccccggccaggcccagctgggcccccagctgggccagccccagcccagaccccccccccaggtgagcttcagcccctag

SEQ ID NO: 101415 - DNA, 342 bp, Artificial Sequence
  Description of Artificial Sequence: Synthetic coding sequence
atgaacttcctgagaagaagactgagcgacagcagcttcatggccaacctgcccaacggctacatgaccgacctgcagagacccgacagcagcaccagcagccccgccagccccgccatggagagaagacacccccagcccctggccgccagcttcagcagccccggcagcagcctgttcagcagcctgagcagcgccatgaagcaggccccccaggccaccagcggcctgatggagccccccggccccagcacccccatcgtgcagagacccagaatcctgctggtgatcgacgacgcccacaccgactggagcaagtacttccacggcaagaaggtgtag

SEQ ID NO: 101416 - DNA, 372 bp, Artificial Sequence
  Description of Artificial Sequence: Synthetic coding sequence
atgaacttcctgagaagaagactgagcgacagcagcttcatggccaacctgcccaacggctacatgaccgacctgcagagacccgacagcagcaccagcagccccgccagccccgccatggagagaagacacccccagcccctggccgccagcttcagcagccccggcagcagcctgttcagcagcctgagcagcgccatgaagcaggccccccaggccaccagcggcctgatggagccccccggccccagcacccccatcgtgcagagacccagaatcctgctggtgatcgacgacgcccacaccgactggagcaagtacttccacggcaagaaggtgaacggcgagatcgagatcagagtggagcagtag

SEQ ID NO: 101417 - DNA, 561 bp, Artificial Sequence
  Description of Artificial Sequence: Synthetic coding sequence
atggacagcagcatgcccctgatcggcgagcacgtggaggaggacagacagctgatggccgacctggtggtgagcaagatgagccagctgcccatgcccggcggcaccgcccccagccccctgagaccctgggccccccagatcaagagcgccaagagccccggccaggcccagctgggcccccagctgggccagccccagcccagaccccccccccagggcggccccagacaggcccagagcccccagcagcagagaagccccggcagcccccagctgagcagagccagcagcggcagcagccccaaccaggccagcaagcccggcgccaccctggccagccagcccagaccccccgtgcagggcagaagcaccagccagcagggcgaggagagcaagaagcccgcccccccccacccccacctgaacaagagccagagcctgaccaacagcctgagcaccagcgacaccagccagagaggcacccccagcgaggacgaggccaaggccgagaccatcagaaacctgagaaagagcttcgccagcctgttcagcgactag

SEQ ID NO: 101418 - DNA, 1212 bp, Artificial Sequence
  Description of Artificial Sequence: Synthetic coding sequence
atgagccacagaaagttcagcgcccccagacacggcagcctgggcttcctgcccagaaagagaagcagcagacacagaggcaaggtgaagagcttccccaaggacgaccccagcaagcccgtgcacctgaccgccttcctgggctacaaggccggcatgacccacatcgtgagagaggtggacagacccggcagcaaggtgaacaagaaggaggtggtggaggccgtgaccatcgtggagaccccccccatggtggtggtgggcatcgtgggctacgtggagacccccagaggcctgagaaccttcaagaccgtgttcgccgagcacatcagcgacgagtgcaagagaagattctacaagaactggcacaagagcaagaagaaggccttcaccaagtactgcaagaagtggcaggacgaggacggcaagaagcagctggagaaggacttcagcagcatgaagaagtactgccaggtgatcagagtgatcgcccacacccagatgagactgctgcccctgagacagaagaaggcccacctgatggagatccaggtgaacggcggcaccgtggccgagaagctggactgggccagagagagactggagcagcaggtgcccgtgaaccaggtgttcggccaggacgagatgatcgacgtgatcggcgtgaccaagggcaagggctacaagggcgtgaccagcagatggcacaccaagaagctgcccagaaagacccacagaggcctgagaaaggtggcctgcatcggcgcctggcaccccgccagagtggccttcagcgtggccagagccggccagaagggctaccaccacagaaccgagatcaacaagaagatctacaagatcggccagggctacctgatcaaggacggcaagctgatcaagaacaacgccagcaccgactacgacctgagcgacaagagcatcaaccccctgggcggcttcgtgcactacggcgaggtgaccaacgacttcgtgatgctgaagggctgcgtggtgggcaccaagaagagagtgctgaccctgagaaagagcctgctggtgcagaccaagagaagagccctggagaagatcgacctgaagttcatcgacaccaccagcaagttcggccacggcagattccagaccatggaggagaagaaggccttcatgggccccctgaagaaggacagaatcgccaaggaggagggcgcctag

SEQ ID NO: 101419 - DNA, 576 bp, Artificial Sequence
  Description of Artificial Sequence: Synthetic coding sequence
atggagggcggcgcctacggcgccggcaaggccggcggcgccttcgacccctacaccctggtgagacagccccacaccatcctgagagtggtgagctggctgttcagcatcgtggtgttcggcagcatcgtgaacgagggctacctgaacagcgccagcgagggcgaggagttctgcatctacaacagaaaccccaacgcctgcagctacggcgtggccgtgggcgtgctggccttcctgacctgcctgctgtacctggccctggacgtgtacttcccccagatcagcagcgtgaaggacagaaagaaggccgtgctgagcgacatcggcgtgagcgccttctgggccttcctgtggttcgtgggcttctgctacctggccaaccagtggcaggtgagcaagcccaaggacaaccccctgaacgagggcaccgacgccgccagagccgccatcgccttcagcttcttcagcatcttcacctggagcctgaccgccgccctggccgtgagaagattcaaggacctgagcttccaggaggagtacagcaccctgttccccgccagcgcccagccctag

SEQ ID NO: 101420 - DNA, 702 bp, Artificial Sequence
  Description of Artificial Sequence: Synthetic coding sequence
atggagggcggcgcctacggcgccggcaaggccggcggcgccttcgacccctacaccctggtgagacagccccacaccatcctgagagtggtgagctggctgttcagcatcgtggtgttcggcagcatcgtgaacgagggctacctgaacagcgccagcgagggcgaggagttctgcatctacaacagaaaccccaacgcctgcagctacggcgtggccgtgggcgtgctggccttcctgacctgcctgctgtacctggccctggacgtgtacttcccccagatcagcagcgtgaaggacagaaagaaggccgtgctgagcgacatcggcgtgagcgccttctgggccttcctgtggttcgtgggcttctgctacctggccaaccagtggcaggtgagcaagcccaaggacaaccccctgaacgagggcaccgacgccgccagagccgccatcgccttcagcttcttcagcatcttcacctgggccggccaggccgtgctggccttccagagataccagatcggcgccgacagcgccctgttcagccaggactacatggaccccagccaggacagcagcatgccctacgccccctacgtggagcccaccggccccgaccccgccggcatgggcggcacctaccagcagcccgccaacaccttcgacaccgagccccagggctaccagagccagggctactag

SEQ ID NO: 101421 - DNA, 579 bp, Artificial Sequence
  Description of Artificial Sequence: Synthetic coding sequence
atgctgaccctggagttcggcatcctggagttcgaccccagctggatcggcagctggacccagagaagctgggtgagctggagaagcagacccggctgcgagctgttcagcatcgtggtgttcggcagcatcgtgaacgagggctacctgaacagcgccagcgagggcgaggagttctgcatctacaacagaaaccccaacgcctgcagctacggcgtggccgtgggcgtgctggccttcctgacctgcctgctgtacctggccctggacgtgtacttcccccagatcagcagcgtgaaggacagaaagaaggccgtgctgagcgacatcggcgtgagcgccttctgggccttcctgtggttcgtgggcttctgctacctggccaaccagtggcaggtgagcaagcccaaggacaaccccctgaacgagggcaccgacgccgccagagccgccatcgccttcagcttcttcagcatcttcacctggagcctgaccgccgccctggccgtgagaagattcaaggacctgagcttccaggaggagtacagcaccctgttccccgccagcgcccagccctag

SEQ ID NO: 101422 - DNA, 510 bp, Artificial Sequence
  Description of Artificial Sequence: Synthetic coding sequence
atggagggcggcgcctacggcgccggcaaggccggcggcgccttcgacccctacaccctggtgagacagccccacaccatcctgagagtggtgagctggctgttcagcatcgtggtgttcggcagcatcgtgaacgagggctacctgaacagcgccagcgagggcgaggagttctgcatctacaacagaaaccccaacgcctgcagctacggcgtggccgtgggcgtgctggccttcctgacctgcctgctgtacctggccctggacgtgtacttcccccagatcagcagcgtgaaggacagaaagaaggccgtgctgagcgacatcggcgtgagcgccttctgggccttcctgtggttcgtgggcttctgctacctggccaaccagtggcaggtgagcaagcccaaggacaaccccctgaacgagggcaccgacgccgccagagccgccatcgccttcagcttcttcagcatcttcacctggagaagcggcgccaccagccccccctag

SEQ ID NO: 101423 - DNA, 297 bp, Artificial Sequence
  Description of Artificial Sequence: Synthetic coding sequence
atggccagcggcgccggcggcagctggggcagaagccccccccagagcgccgtgcccaccccctgggtgaccttcctgcagcccctgagctgggccgtgccccccgcccccccccagcccggcagagtgaaggaggacctgctggagctgatgatgctgcagaacgcccagatgcaccagctgctgctgagcagactggtggccggcgccctgcagcccagacccgccagcccctgcccccaggagagctgcgcccccacccccaccccccagtgccacagagactgcggctgctag

SEQ ID NO: 101424 - DNA, 690 bp, Artificial Sequence
  Description of Artificial Sequence: Synthetic coding sequence
atggagggcgccagcttcggcgccggcagagccggcgccgccctggaccccgtgagcttcgccagaagaccccagaccctgctgagagtggccagctgggtgttcagcatcgccgtgttcggccccatcgtgaacgagggctacgtgaacaccgacagcggccccgagctgagatgcgtgttcaacggcaacgccggcgcctgcagattcggcgtggccctgggcctgggcgccttcctggcctgcgccgccttcctgctgctggacgtgagattccagcagatcagcagcgtgagagacagaagaagagccgtgctgctggacctgggcttcagcggcctgtggagcttcctgtggttcgtgggcttctgcttcctgaccaaccagtggcagagaaccgcccccggccccgccaccacccaggccggcgacgccgccagagccgccatcgccttcagcttcttcagcatcctgagctgggtggccctgaccgtgaaggccctgcagagattcagactgggcaccgacatgagcctgttcgccaccgagcagctgagcaccggcgccagccaggcctaccccggctaccccgtgggcagcggcgtggagggcaccgagacctaccagagcccccccttcaccgagaccctggacaccagccccaagggctaccaggtgcccgcctactag

SEQ ID NO: 101425 - DNA, 438 bp, Artificial Sequence
  Description of Artificial Sequence: Synthetic coding sequence
atggagggcgccagcttcggcgccggcagagccggcgccgccctggaccccgtgagcttcgccagaagaccccagaccctgctgagagtggccagctgggtgttcagcatcgccgtgttcggccccatcgtgaacgagggctacgtgaacaccgacagcggccccgagctgagatgcgtgttcaacggcaacgccggcgcctgcagattcggcgtggccctgggcctgggcgccttcctggcctgcgccgccttcctgctgctggacgtgagattccagcagagcggcggcagaggcaagaccccccccagcccccaggactggggcagctggcccctgttccccagccacgtgcccgtgggcagcgactgcctggtgagcgtgatggtggtgagacccgtgagaagccacagccccctgagcctgaccggctgctag

SEQ ID NO: 101426 - DNA, 705 bp, Artificial Sequence
  Description of Artificial Sequence: Synthetic coding sequence
atgcacatccccaagagcctgcaggagctggccaacagcgaggccgtgcagttcctgagaagacccaagaccatcaccagagtgttcgagggcgtgttcagcctgatcgtgttcagcagcctgctgaccgacggctaccagaacaagatggagagcccccagctgcactgcatcctgaacagcaacagcgtggcctgcagcttcgccgtgggcgccggcttcctggccttcctgagctgcctggccttcctggtgctggacacccaggagaccagaatcgccggcaccagattcaagaccgccttccagctgctggacttcatcctggccgtgctgtgggccgtggtgtggttcatgggcttctgcttcctggccaaccagtggcagcacagcccccccaaggagttcctgctgggcagcagcagcgcccaggccgccatcgccttcaccttcttcagcatcctggtgtggatcttccaggcctacctggccttccaggacctgagaaacgacgcccccgtgccctacaagagattcctggacgagggcggcatggtgctgaccaccctgcccctgcccagcgccaacagccccgtgaacatgcccaccaccggccccaacagcctgagctacgccagcagcgccctgagcccctgcctgaccgcccccaagagccccagactggccatgatgcccgacaactag

SEQ ID NO: 101427 - DNA, 4722 bp, Artificial Sequence
  Description of Artificial Sequence: Synthetic coding sequence
atggccttcagcaagggcttcagaatctaccacaagctggaccccccccccttcagcctgatcgtggagaccagacacaaggaggagtgcctgatgttcgagagcggcgccgtggccgtgctgagcagcgccgagaaggaggccatcaagggcacctacagcaaggtgctggacgcctacggcctgctgggcgtgctgagactgaacctgggcgacaccatgctgcactacctggtgctggtgaccggctgcatgagcgtgggcaagatccaggagagcgaggtgttcagagtgaccagcaccgagttcatcagcctgagaatcgacagcagcgacgaggacagaatcagcgaggtgagaaaggtgctgaacagcggcaacttctacttcgcctggagcgccagcggcatcagcctggacctgagcctgaacgcccacagaagcatgcaggagcagaccaccgacaacagattcttctggaaccagagcctgcacctgcacctgaagcactacggcgtgaactgcgacgactggctgctgagactgatgtgcggcggcgtggagatcagaaccatctacgccgcccacaagcaggccaaggcctgcctgatcagcagactgagctgcgagagagccggcaccagattcaacgtgagaggcaccaacgacgacggccacgtggccaacttcgtggagaccgagcaggtggtgtacctggacgacagcgtgagcagcttcatccagatcagaggcagcgtgcccctgttctgggagcagcccggcctgcaggtgggcagccacagagtgagaatgagcagaggcttcgaggccaacgcccccgccttcgacagacacttcagaaccctgaagaacctgtacggcaagcagatcatcgtgaacctgctgggcagcaaggagggcgagcacatgctgagcaaggccttccagagccacctgaaggccagcgagcacgccgccgacatccagatggtgaacttcgactaccaccagatggtgaagggcggcaaggccgagaagctgcacagcgtgctgaagccccaggtgcagaagttcctggactacggcttcttctacttcaacggcagcgaggtgcagagatgccagagcggcaccgtgagaaccaactgcctggactgcctggacagaaccaacagcgtgcaggccttcctgggcctggagatgctggccaagcagctggaggccctgggcctggccgagaagccccagctggtgaccagattccaggaggtgttcagaagcatgtggagcgtgaacggcgacagcatcagcaagatctacgccggcaccggcgccctggagggcaaggccaagctgaaggacggcgccagaagcgtgaccagaaccatccagaacaacttcttcgacagcagcaagcaggaggccatcgacgtgctgctgctgggcaacaccctgaacagcgacctggccgacaaggccagagccctgctgaccaccggcagcctgagagtgagcgagcagaccctgcagagcgccagcagcaaggtgctgaagagcatgtgcgagaacttctacaagtacagcaagcccaagaagatcagagtgtgcgtgggcacctggaacgtgaacggcggcaagcagttcagaagcatcgccttcaagaaccagaccctgaccgactggctgctggacgcccccaagctggccggcatccaggagttccaggacaagagaagcaagcccaccgacatcttcgccatcggcttcgaggagatggtggagctgaacgccggcaacatcgtgagcgccagcaccaccaaccagaagctgtgggccgtggagctgcagaagaccatcagcagagacaacaagtacgtgctgctggccagcgagcagctggtgggcgtgtgcctgttcgtgttcatcagaccccagcacgcccccttcatcagagacgtggccgtggacaccgtgaagaccggcatgggcggcgccaccggcaacaagggcgccgtggccatcagaatgctgttccacaccaccagcctgtgcttcgtgtgcagccacttcgccgccggccagagccaggtgaaggagagaaacgaggacttcatcgagatcgccagaaagctgagcttccccatgggcagaatgctgttcagccacgactacgtgttctggtgcggcgacttcaactacagaatcgacctgcccaacgaggaggtgaaggagctgatcagacagcagaactgggacagcctgatcgccggcgaccagctgatcaaccagaagaacgccggccaggtgttcagaggcttcctggagggcaaggtgaccttcgcccccacctacaagtacgacctgttcagcgacgactacgacaccagcgagaagtgcagaacccccgcctggaccgacagagtgctgtggagaagaagaaagtggcccttcgacagaagcgccgaggacctggacctgctgaacgccagcttccaggacgagagcaagatcctgtacacctggacccccggcaccctgctgcactacggcagagccgagctgaagaccagcgaccacagacccgtggtggccctgatcgacatcgacatcttcgaggtggaggccgaggagagacagaacatctacaaggaggtgatcgccgtgcagggcccccccgacggcaccgtgctggtgagcatcaagagcagcctgcccgagaacaacttcttcgacgacgccctgatcgacgagctgctgcagcagttcgccagcttcggcgaggtgatcctgatcagattcgtggaggacaagatgtgggtgaccttcctggagggcagcagcgccctgaacgtgctgagcctgaacggcaaggagctgctgaacagaaccatcaccatcgccctgaagagccccgactggatcaagaacctggaggaggagatgagcctggagaagatcagcatcgccctgcccagcagcaccagcagcaccctgctgggcgaggacgccgaggtggccgccgacttcgacatggagggcgacgtggacgactacagcgccgaggtggaggagctgctgccccagcacctgcagcccagcagcagcagcggcctgggcaccagccccagcagcagccccagaaccagcccctgccagagccccaccatcagcgagggccccgtgcccagcctgcccatcagacccagcagagcccccagcagaacccccggcccccccagcgcccagagcagccccatcgacgcccagcccgccacccccctgccccagaaggaccccgcccagcccctggagcccaagagaccccccccccccagacccgtggccccccccaccagacccgcccccccccagagaccccccccccccagcggcgccagaagccccgcccccaccagaaaggagttcggcggcatcggcgccccccccagccccggcgtggccagaagagagatggaggcccccaagagccccggcaccaccagaaaggacaacatcggcagaagccagcccagcccccaggccggcctggccggccccggccccgccggctacagcaccgccagacccaccatcccccccagagccggcgtgatcagcgccccccagagccacgccagagccagcgccggcagactgacccccgagagccagagcaagaccagcgagaccagcaagggcagcaccttcctgcccgagcccctgaagccccaggccgccttccccccccagagcagcctgcccccccccgcccagagactgcaggagcccctggtgcccgtggccgcccccatgccccagagcggcccccagcccaacctggagacccccccccagcccccccccagaagcagaagcagccacagcctgcccagcgaggccagcagccagccccaggtgaagaccaacggcatcagcgacggcaagagagagagccccctgaagatcgaccccttcgaggacctgagcttcaacctgctggccgtgagcaaggcccagctgagcgtgcagaccagccccgtgcccacccccgaccccaagagactgatccagctgcccagcgccacccagagcaacgtgctgagcagcgtgagctgcatgcccaccatgccccccatccccgccagaagccagagccaggagaacatgagaagcagccccaaccccttcatcaccggcctgaccagaaccaaccccttcagcgacagaaccgccgcccccggcaaccccttcagagccaagagcgaggagagcgaggccaccagctggttcagcaaggaggagcccgtgaccatcagccccttccccagcctgcagcccctgggccacaacaagagcagagccagcagcagcctggacggcttcaaggacagcttcgacctgcagggccagagcaccctgaagatcagcaaccccaagggctgggtgaccttcgaggaggaggaggacttcggcgtgaagggcaagagcaagagcgcctgcagcgacctgctgggcaaccagcccagcagcttcagcggcagcaacctgaccctgaacgacgactggaacaagggcaccaacgtgagcttctgcgtgctgcccagcagaagacccccccccccccccgtgcccctgctgccccccggcaccagcccccccgtggaccccttcaccaccctggccagcaaggccagccccaccctggacttcaccgagagatag

SEQ ID NO: 101428 - DNA, 3888 bp, Artificial Sequence
  Description of Artificial Sequence: Synthetic coding sequence
atggccttcagcaagggcttcagaatctaccacaagctggaccccccccccttcagcctgatcgtggagaccagacacaaggaggagtgcctgatgttcgagagcggcgccgtggccgtgctgagcagcgccgagaaggaggccatcaagggcacctacagcaaggtgctggacgcctacggcctgctgggcgtgctgagactgaacctgggcgacaccatgctgcactacctggtgctggtgaccggctgcatgagcgtgggcaagatccaggagagcgaggtgttcagagtgaccagcaccgagttcatcagcctgagaatcgacagcagcgacgaggacagaatcagcgaggtgagaaaggtgctgaacagcggcaacttctacttcgcctggagcgccagcggcatcagcctggacctgagcctgaacgcccacagaagcatgcaggagcagaccaccgacaacagattcttctggaaccagagcctgcacctgcacctgaagcactacggcgtgaactgcgacgactggctgctgagactgatgtgcggcggcgtggagatcagaaccatctacgccgcccacaagcaggccaaggcctgcctgatcagcagactgagctgcgagagagccggcaccagattcaacgtgagaggcaccaacgacgacggccacgtggccaacttcgtggagaccgagcaggtggtgtacctggacgacagcgtgagcagcttcatccagatcagaggcagcgtgcccctgttctgggagcagcccggcctgcaggtgggcagccacagagtgagaatgagcagaggcttcgaggccaacgcccccgccttcgacagacacttcagaaccctgaagaacctgtacggcaagcagatcatcgtgaacctgctgggcagcaaggagggcgagcacatgctgagcaaggccttccagagccacctgaaggccagcgagcacgccgccgacatccagatggtgaacttcgactaccaccagatggtgaagggcggcaaggccgagaagctgcacagcgtgctgaagccccaggtgcagaagttcctggactacggcttcttctacttcaacggcagcgaggtgcagagatgccagagcggcaccgtgagaaccaactgcctggactgcctggacagaaccaacagcgtgcaggccttcctgggcctggagatgctggccaagcagctggaggccctgggcctggccgagaagccccagctggtgaccagattccaggaggtgttcagaagcatgtggagcgtgaacggcgacagcatcagcaagatctacgccggcaccggcgccctggagggcaaggccaagctgaaggacggcgccagaagcgtgaccagaaccatccagaacaacttcttcgacagcagcaagcaggaggccatcgacgtgctgctgctgggcaacaccctgaacagcgacctggccgacaaggccagagccctgctgaccaccggcagcctgagagtgagcgagcagaccctgcagagcgccagcagcaaggtgctgaagagcatgtgcgagaacttctacaagtacagcaagcccaagaagatcagagtgtgcgtgggcacctggaacgtgaacggcggcaagcagttcagaagcatcgccttcaagaaccagaccctgaccgactggctgctggacgcccccaagctggccggcatccaggagttccaggacaagagaagcaagcccaccgacatcttcgccatcggcttcgaggagatggtggagctgaacgccggcaacatcgtgagcgccagcaccaccaaccagaagctgtgggccgtggagctgcagaagaccatcagcagagacaacaagtacgtgctgctggccagcgagcagctggtgggcgtgtgcctgttcgtgttcatcagaccccagcacgcccccttcatcagagacgtggccgtggacaccgtgaagaccggcatgggcggcgccaccggcaacaagggcgccgtggccatcagaatgctgttccacaccaccagcctgtgcttcgtgtgcagccacttcgccgccggccagagccaggtgaaggagagaaacgaggacttcatcgagatcgccagaaagctgagcttccccatgggcagaatgctgttcagccacgactacgtgttctggtgcggcgacttcaactacagaatcgacctgcccaacgaggaggtgaaggagctgatcagacagcagaactgggacagcctgatcgccggcgaccagctgatcaaccagaagaacgccggccaggtgttcagaggcttcctggagggcaaggtgaccttcgcccccacctacaagtacgacctgttcagcgacgactacgacaccagcgagaagtgcagaacccccgcctggaccgacagagtgctgtggagaagaagaaagtggcccttcgacagaagcgccgaggacctggacctgctgaacgccagcttccaggacgagagcaagatcctgtacacctggacccccggcaccctgctgcactacggcagagccgagctgaagaccagcgaccacagacccgtggtggccctgatcgacatcgacatcttcgaggtggaggccgaggagagacagaacatctacaaggaggtgatcgccgtgcagggcccccccgacggcaccgtgctggtgagcatcaagagcagcctgcccgagaacaacttcttcgacgacgccctgatcgacgagctgctgcagcagttcgccagcttcggcgaggtgatcctgatcagattcgtggaggacaagatgtgggtgaccttcctggagggcagcagcgccctgaacgtgctgagcctgaacggcaaggagctgctgaacagaaccatcaccatcgccctgaagagccccgactggatcaagaacctggaggaggagatgagcctggagaagatcagcatcgccctgcccagcagcaccagcagcaccctgctgggcgaggacgccgaggtggccgccgacttcgacatggagggcgacgtggacgactacagcgccgaggtggaggagctgctgccccagcacctgcagcccagcagcagcagcggcctgggcaccagccccagcagcagccccagaaccagcccctgccagagccccaccatcagcgagggccccgtgcccagcctgcccatcagacccagcagagcccccagcagaacccccggcccccccagcgcccagagcagccccatcgacgcccagcccgccacccccctgccccagaaggaccccgcccagcccctggagcccaagagaccccccccccccagacccgtggccccccccaccagacccgcccccccccagagaccccccccccccagcggcgccagaagccccgcccccaccagaaaggagttcggcgcccccaagagccccggcaccaccagaaaggacaacatcggcagaagccagcccagcccccaggccggcctggccggccccggccccgccggctacagcaccgccagacccaccatcccccccagagccggcgtgatcagcgccccccagagccacgccagagccagcgccggcagactgacccccgagagccagagcaagaccagcgagaccagcaagggcagcaccttcctgcccgagcccctgaagccccaggccgccttccccccccagagcagcctgcccccccccgcccagagactgcaggagcccctggtgcccgtggccgcccccatgccccagagcggcccccagcccaacctggagacccccccccagcccccccccagaagcagaagcagccacagcctgcccagcgaggccagcagccagccccagcaggagcagcccagcggctag

SEQ ID NO: 101429 - DNA, 4581 bp, Artificial Sequence
  Description of Artificial Sequence: Synthetic coding sequence
atggccttcagcaagggcttcagaatctaccacaagctggaccccccccccttcagcctgatcgtggagaccagacacaaggaggagtgcctgatgttcgagagcggcgccgtggccgtgctgagcagcgccgagaaggaggccatcaagggcacctacagcaaggtgctggacgcctacggcctgctgggcgtgctgagactgaacctgggcgacaccatgctgcactacctggtgctggtgaccggctgcatgagcgtgggcaagatccaggagagcgaggtgttcagagtgaccagcaccgagttcatcagcctgagaatcgacagcagcgacgaggacagaatcagcgaggtgagaaaggtgctgaacagcggcaacttctacttcgcctggagcgccagcggcatcagcctggacctgagcctgaacgcccacagaagcatgcaggagcagaccaccgacaacagattcttctggaaccagagcctgcacctgcacctgaagcactacggcgtgaactgcgacgactggctgctgagactgatgtgcggcggcgtggagatcagaaccatctacgccgcccacaagcaggccaaggcctgcctgatcagcagactgagctgcgagagagccggcaccagattcaacgtgagaggcaccaacgacgacggccacgtggccaacttcgtggagaccgagcaggtggtgtacctggacgacagcgtgagcagcttcatccagatcagaggcagcgtgcccctgttctgggagcagcccggcctgcaggtgggcagccacagagtgagaatgagcagaggcttcgaggccaacgcccccgccttcgacagacacttcagaaccctgaagaacctgtacggcaagcagatcatcgtgaacctgctgggcagcaaggagggcgagcacatgctgagcaaggccttccagagccacctgaaggccagcgagcacgccgccgacatccagatggtgaacttcgactaccaccagatggtgaagggcggcaaggccgagaagctgcacagcgtgctgaagccccaggtgcagaagttcctggactacggcttcttctacttcaacggcagcgaggtgcagagatgccagagcggcaccgtgagaaccaactgcctggactgcctggacagaaccaacagcgtgcaggccttcctgggcctggagatgctggccaagcagctggaggccctgggcctggccgagaagccccagctggtgaccagattccaggaggtgttcagaagcatgtggagcgtgaacggcgacagcatcagcaagatctacgccggcaccggcgccctggagggcaaggccaaggccggcaagctgaaggacggcgccagaagcgtgaccagaaccatccagaacaacttcttcgacagcagcaagcaggaggccatcgacgtgctgctgctgggcaacaccctgaacagcgacctggccgacaaggccagagccctgctgaccaccggcagcctgagagccagcagcaaggtgctgaagagcatgtgcgagaacttctacaagtacagcaagcccaagaagatcagagtgtgcgtgggcacctggaacgtgaacggcggcaagcagttcagaagcatcgccttcaagaaccagaccctgaccgactggctgctggacgcccccaagctggccggcatccaggagttccaggacaagagaagcaagcccaccgacatcttcgccatcggcttcgaggagatggtggagctgaacgccggcaacatcgtgagcgccagcaccaccaaccagaagctgtgggccgtggagctgcagaagaccatcagcagagacaacaagtacgtgctgctggccagcgagcagctggtgggcgtgtgcctgttcgtgttcatcagaccccagcacgcccccttcatcagagacgtggccgtggacaccgtgaagaccggcatgggcggcgccaccggcaacaagggcgccgtggccatcagaatgctgttccacaccaccagcctgtgcttcgtgtgcagccacttcgccgccggccagagccaggtgaaggagagaaacgaggacttcatcgagatcgccagaaagctgagcttccccatgggcagaatgctgttcagccacgactacgtgttctggtgcggcgacttcaactacagaatcgacctgcccaacgaggaggtgaaggagctgatcagacagcagaactgggacagcctgatcgccggcgaccagctgatcaaccagaagaacgccggccaggtgttcagaggcttcctggagggcaaggtgaccttcgcccccacctacaagtacgacctgttcagcgacgactacgacaccagcgagaagtgcagaacccccgcctggaccgacagagtgctgtggagaagaagaaagtggcccttcgacagaagcgccgaggacctggacctgctgaacgccagcttccaggacgagagcaagatcctgtacacctggacccccggcaccctgctgcactacggcagagccgagctgaagaccagcgaccacagacccgtggtggccctgatcgacatcgacatcttcgaggtggaggccgaggagagacagaacatctacaaggaggtgatcgccgtgcagggcccccccgacggcaccgtgctggtgagcatcaagagcagcctgcccgagaacaacttcttcgacgacgccctgatcgacgagctgctgcagcagttcgccagcttcggcgaggtgatcctgatcagattcgtggaggacaagatgtgggtgaccttcctggagggcagcagcgccctgaacgtgctgagcctgaacggcaaggagctgctgaacagaaccatcaccatcgccctgaagagccccgactggatcaagaacctggaggaggagatgagcctggagaagatcagcatcgccctgcccagcagcaccagcagcaccctgctgggcgaggacgccgaggtggccgccgacttcgacatggagggcgacgtggacgactacagcgccgaggtggaggagctgctgccccagcacctgcagcccagcagcagcagcggcctgggcaccagccccagcagcagccccagaaccagcccctgccagagccccaccatcagcgagggccccgtgcccagcctgcccatcagacccagcagagcccccagcagaacccccggcccccccagcgcccagagcagccccatcgacgcccagcccgccacccccctgccccagaaggaccccgcccagcccctggagcccaagagaccccccccccccagacccgtggccccccccaccagacccgcccccccccagagaccccccccccccagcggcagaagccagcccagcccccaggccggcctggccggccccggccccgccggctacagcaccgccagacccaccatcccccccagagccggcgtgatcagcgccccccagagccacgccagagccagcgccggcagactgacccccgagagccagagcaagaccagcgagaccagcaagggcagcaccttcctgcccgagcccctgaagccccaggccgccttccccccccagagcagcctgcccccccccgcccagagactgcaggagcccctggtgcccgtggccgcccccatgccccagagcggcccccagcccaacctggagacccccccccagcccccccccagaagcagaagcagccacagcctgcccagcgaggccagcagccagccccaggtgaagaccaacggcatcagcgacggcaagagagagagccccctgaagatcgaccccttcgaggacctgagcttcaacctgctggccgtgagcaaggcccagctgagcgtgcagaccagccccgtgcccacccccgaccccaagagactgatccagctgcccagcgccacccagagcaacgtgctgagcagcgtgagctgcatgcccaccatgccccccatccccgccagaagccagagccaggagaacatgagaagcagccccaaccccttcatcaccggcctgaccagaaccaaccccttcagcgacagaaccgccgcccccggcaaccccttcagagccaagagcgaggagagcgaggccaccagctggttcagcaaggaggagcccgtgaccatcagccccttccccagcctgcagcccctgggccacaacaagagcagagccagcagcagcctggacggcttcaaggacagcttcgacctgcagggccagagcaccctgaagatcagcaaccccaagggctgggtgaccttcgaggaggaggaggacttcggcgtgaagggcaagagcaagagcgcctgcagcgacctgctgggcaaccagcccagcagcttcagcggcagcaacctgaccctgaacgacgactggaacaagggcaccaacgtgagcttctgcgtgctgcccagcagaagacccccccccccccccgtgcccctgctgccccccggcaccagcccccccgtggaccccttcaccaccctggccagcaaggccagccccaccctggacttcaccgagagatag

SEQ ID NO: 101430 - DNA, 4053 bp, Artificial Sequence
  Description of Artificial Sequence: Synthetic coding sequence
atgagaaagagatgggcctgctggagcggcagcgacgcccccggcggctgcggcggcggctgcggcagaagaagaagaagaagcagaagaaagagagccgccagcgaggagagaagaatggccttcagcaagggcttcagaatctaccacaagctggaccccccccccttcagcctgatcgtggagaccagacacaaggaggagtgcctgatgttcgagagcggcgccgtggccgtgctgagcagcgccgagaaggaggccatcaagggcacctacagcaaggtgctggacgcctacggcctgctgggcgtgctgagactgaacctgggcgacaccatgctgcactacctggtgctggtgaccggctgcatgagcgtgggcaagatccaggagagcgaggtgttcagagtgaccagcaccgagttcatcagcctgagaatcgacagcagcgacgaggacagaatcagcgaggtgagaaaggtgctgaacagcggcaacttctacttcgcctggagcgccagcggcatcagcctggacctgagcctgaacgcccacagaagcatgcaggagcagaccaccgacaacagattcttctggaaccagagcctgcacctgcacctgaagcactacggcgtgaactgcgacgactggctgctgagactgatgtgcggcggcgtggagatcagaaccatctacgccgcccacaagcaggccaaggcctgcctgatcagcagactgagctgcgagagagccggcaccagattcaacgtgagaggcaccaacgacgacggccacgtggccaacttcgtggagaccgagcaggtggtgtacctggacgacagcgtgagcagcttcatccagatcagaggcagcgtgcccctgttctgggagcagcccggcctgcaggtgggcagccacagagtgagaatgagcagaggcttcgaggccaacgcccccgccttcgacagacacttcagaaccctgaagaacctgtacggcaagcagatcatcgtgaacctgctgggcagcaaggagggcgagcacatgctgagcaaggccttccagagccacctgaaggccagcgagcacgccgccgacatccagatggtgaacttcgactaccaccagatggtgaagggcggcaaggccgagaagctgcacagcgtgctgaagccccaggtgcagaagttcctggactacggcttcttctacttcaacggcagcgaggtgcagagatgccagagcggcaccgtgagaaccaactgcctggactgcctggacagaaccaacagcgtgcaggccttcctgggcctggagatgctggccaagcagctggaggccctgggcctggccgagaagccccagctggtgaccagattccaggaggtgttcagaagcatgtggagcgtgaacggcgacagcatcagcaagatctacgccggcaccggcgccctggagggcaaggccaagctgaaggacggcgccagaagcgtgaccagaaccatccagaacaacttcttcgacagcagcaagcaggaggccatcgacgtgctgctgctgggcaacaccctgaacagcgacctggccgacaaggccagagccctgctgaccaccggcagcctgagagtgagcgagcagaccctgcagagcgccagcagcaaggtgctgaagagcatgtgcgagaacttctacaagtacagcaagcccaagaagatcagagtgtgcgtgggcacctggaacgtgaacggcggcaagcagttcagaagcatcgccttcaagaaccagaccctgaccgactggctgctggacgcccccaagctggccggcatccaggagttccaggacaagagaagcaagcccaccgacatcttcgccatcggcttcgaggagatggtggagctgaacgccggcaacatcgtgagcgccagcaccaccaaccagaagctgtgggccgtggagctgcagaagaccatcagcagagacaacaagtacgtgctgctggccagcgagcagctggtgggcgtgtgcctgttcgtgttcatcagaccccagcacgcccccttcatcagagacgtggccgtggacaccgtgaagaccggcatgggcggcgccaccggcaacaagggcgccgtggccatcagaatgctgttccacaccaccagcctgtgcttcgtgtgcagccacttcgccgccggccagagccaggtgaaggagagaaacgaggacttcatcgagatcgccagaaagctgagcttccccatgggcagaatgctgttcagccacgactacgtgttctggtgcggcgacttcaactacagaatcgacctgcccaacgaggaggtgaaggagctgatcagacagcagaactgggacagcctgatcgccggcgaccagctgatcaaccagaagaacgccggccaggtgttcagaggcttcctggagggcaaggtgaccttcgcccccacctacaagtacgacctgttcagcgacgactacgacaccagcgagaagtgcagaacccccgcctggaccgacagagtgctgtggagaagaagaaagtggcccttcgacagaagcgccgaggacctggacctgctgaacgccagcttccaggacgagagcaagatcctgtacacctggacccccggcaccctgctgcactacggcagagccgagctgaagaccagcgaccacagacccgtggtggccctgatcgacatcgacatcttcgaggtggaggccgaggagagacagaacatctacaaggaggtgatcgccgtgcagggcccccccgacggcaccgtgctggtgagcatcaagagcagcctgcccgagaacaacttcttcgacgacgccctgatcgacgagctgctgcagcagttcgccagcttcggcgaggtgatcctgatcagattcgtggaggacaagatgtgggtgaccttcctggagggcagcagcgccctgaacgtgctgagcctgaacggcaaggagctgctgaacagaaccatcaccatcgccctgaagagccccgactggatcaagaacctggaggaggagatgagcctggagaagatcagcatcgccctgcccagcagcaccagcagcaccctgctgggcgaggacgccgaggtggccgccgacttcgacatggagggcgacgtggacgactacagcgccgaggtggaggagctgctgccccagcacctgcagcccagcagcagcagcggcctgggcaccagccccagcagcagccccagaaccagcccctgccagagccccaccatcagcgagggccccgtgcccagcctgcccatcagacccagcagagcccccagcagaacccccggcccccccagcgcccagagcagccccatcgacgcccagcccgccacccccctgccccagaaggaccccgcccagcccctggagcccaagagaccccccccccccagacccgtggccccccccaccagacccgcccccccccagagaccccccccccccagcggcgccagaagccccgcccccaccagaaaggagttcggcggcatcggcgccccccccagccccggcgtggccagaagagagatggaggcccccaagagccccggcaccaccagaaaggacaacatcggcagaagccagcccagcccccaggccggcctggccggccccggccccgccggctacagcaccgccagacccaccatcccccccagagccggcgtgatcagcgccccccagagccacgccagagccagcgccggcagactgacccccgagagccagagcaagaccagcgagaccagcaagggcagcaccttcctgcccgagcccctgaagccccaggccgccttccccccccagagcagcctgcccccccccgcccagagactgcaggagcccctggtgcccgtggccgcccccatgccccagagcggcccccagcccaacctggagacccccccccagcccccccccagaagcagaagcagccacagcctgcccagcgaggccagcagccagccccagcaggagcagcccagcggctag

SEQ ID NO: 101431 - DNA, 4839 bp, Artificial Sequence
  Description of Artificial Sequence: Synthetic coding sequence
atgagaaagagatgggcctgctggagcggcagcgacgcccccggcggctgcggcggcggctgcggcagaagaagaagaagaagcagaagaaagagagccgccagcgaggagagaagaatggccttcagcaagggcttcagaatctaccacaagctggaccccccccccttcagcctgatcgtggagaccagacacaaggaggagtgcctgatgttcgagagcggcgccgtggccgtgctgagcagcgccgagaaggaggccatcaagggcacctacagcaaggtgctggacgcctacggcctgctgggcgtgctgagactgaacctgggcgacaccatgctgcactacctggtgctggtgaccggctgcatgagcgtgggcaagatccaggagagcgaggtgttcagagtgaccagcaccgagttcatcagcctgagaatcgacagcagcgacgaggacagaatcagcgaggtgagaaaggtgctgaacagcggcaacttctacttcgcctggagcgccagcggcatcagcctggacctgagcctgaacgcccacagaagcatgcaggagcagaccaccgacaacagattcttctggaaccagagcctgcacctgcacctgaagcactacggcgtgaactgcgacgactggctgctgagactgatgtgcggcggcgtggagatcagaaccatctacgccgcccacaagcaggccaaggcctgcctgatcagcagactgagctgcgagagagccggcaccagattcaacgtgagaggcaccaacgacgacggccacgtggccaacttcgtggagaccgagcaggtggtgtacctggacgacagcgtgagcagcttcatccagatcagaggcagcgtgcccctgttctgggagcagcccggcctgcaggtgggcagccacagagtgagaatgagcagaggcttcgaggccaacgcccccgccttcgacagacacttcagaaccctgaagaacctgtacggcaagcagatcatcgtgaacctgctgggcagcaaggagggcgagcacatgctgagcaaggccttccagagccacctgaaggccagcgagcacgccgccgacatccagatggtgaacttcgactaccaccagatggtgaagggcggcaaggccgagaagctgcacagcgtgctgaagccccaggtgcagaagttcctggactacggcttcttctacttcaacggcagcgaggtgcagagatgccagagcggcaccgtgagaaccaactgcctggactgcctggacagaaccaacagcgtgcaggccttcctgggcctggagatgctggccaagcagctggaggccctgggcctggccgagaagccccagctggtgaccagattccaggaggtgttcagaagcatgtggagcgtgaacggcgacagcatcagcaagatctacgccggcaccggcgccctggagggcaaggccaagctgaaggacggcgccagaagcgtgaccagaaccatccagaacaacttcttcgacagcagcaagcaggaggccatcgacgtgctgctgctgggcaacaccctgaacagcgacctggccgacaaggccagagccctgctgaccaccggcagcctgagagtgagcgagcagaccctgcagagcgccagcagcaaggtgctgaagagcatgtgcgagaacttctacaagtacagcaagcccaagaagatcagagtgtgcgtgggcacctggaacgtgaacggcggcaagcagttcagaagcatcgccttcaagaaccagaccctgaccgactggctgctggacgcccccaagctggccggcatccaggagttccaggacaagagaagcaagcccaccgacatcttcgccatcggcttcgaggagatggtggagctgaacgccggcaacatcgtgagcgccagcaccaccaaccagaagctgtgggccgtggagctgcagaagaccatcagcagagacaacaagtacgtgctgctggccagcgagcagctggtgggcgtgtgcctgttcgtgttcatcagaccccagcacgcccccttcatcagagacgtggccgtggacaccgtgaagaccggcatgggcggcgccaccggcaacaagggcgccgtggccatcagaatgctgttccacaccaccagcctgtgcttcgtgtgcagccacttcgccgccggccagagccaggtgaaggagagaaacgaggacttcatcgagatcgccagaaagctgagcttccccatgggcagaatgctgttcagccacgactacgtgttctggtgcggcgacttcaactacagaatcgacctgcccaacgaggaggtgaaggagctgatcagacagcagaactgggacagcctgatcgccggcgaccagctgatcaaccagaagaacgccggccaggtgttcagaggcttcctggagggcaaggtgaccttcgcccccacctacaagtacgacctgttcagcgacgactacgacaccagcgagaagtgcagaacccccgcctggaccgacagagtgctgtggagaagaagaaagtggcccttcgacagaagcgccgaggacctggacctgctgaacgccagcttccaggacgagagcaagatcctgtacacctggacccccggcaccctgctgcactacggcagagccgagctgaagaccagcgaccacagacccgtggtggccctgatcgacatcgacatcttcgaggtggaggccgaggagagacagaacatctacaaggaggtgatcgccgtgcagggcccccccgacggcaccgtgctggtgagcatcaagagcagcctgcccgagaacaacttcttcgacgacgccctgatcgacgagctgctgcagcagttcgccagcttcggcgaggtgatcctgatcagattcgtggaggacaagatgtgggtgaccttcctggagggcagcagcgccctgaacgtgctgagcctgaacggcaaggagctgctgaacagaaccatcaccatcgccctgaagagccccgactggatcaagaacctggaggaggagatgagcctggagaagatcagcatcgccctgcccagcagcaccagcagcaccctgctgggcgaggacgccgaggtggccgccgacttcgacatggagggcgacgtggacgactacagcgccgaggtggaggagctgctgccccagcacctgcagcccagcagcagcagcggcctgggcaccagccccagcagcagccccagaaccagcccctgccagagccccaccatcagcgagggccccgtgcccagcctgcccatcagacccagcagagcccccagcagaacccccggcccccccagcgcccagagcagccccatcgacgcccagcccgccacccccctgccccagaaggaccccgcccagcccctggagcccaagagaccccccccccccagacccgtggccccccccaccagacccgcccccccccagagaccccccccccccagcggcgccagaagccccgcccccaccagaaaggagttcggcggcatcggcgccccccccagccccggcgtggccagaagagagatggaggcccccaagagccccggcaccaccagaaaggacaacatcggcagaagccagcccagcccccaggccggcctggccggccccggccccgccggctacagcaccgccagacccaccatcccccccagagccggcgtgatcagcgccccccagagccacgccagagccagcgccggcagactgacccccgagagccagagcaagaccagcgagaccagcaagggcagcaccttcctgcccgagcccctgaagccccaggccgccttccccccccagagcagcctgcccccccccgcccagagactgcaggagcccctggtgcccgtggccgcccccatgccccagagcggcccccagcccaacctggagacccccccccagcccccccccagaagcagaagcagccacagcctgcccagcgaggccagcagccagccccaggtgaagaccaacggcatcagcgacggcaagagagagagccccctgaagatcgaccccttcgaggacctgagcttcaacctgctggccgtgagcaaggcccagctgagcgtgcagaccagccccgtgcccacccccgaccccaagagactgatccagctgcccagcgccacccagagcaacgtgctgagcagcgtgagctgcatgcccaccatgccccccatccccgccagaagccagagccaggagaacatgagaagcagccccaaccccttcatcaccggcctgaccagaaccaaccccttcagcgacagaaccgccgcccccggcaaccccttcagagccaagagcgaggagagcgaggccaccagctggttcagcaaggaggagcccgtgaccatcagccccttccccagcctgcagcccctgggccacaacaagagcagagccagcagcagcctggacggcttcaaggacagcttcgacctgcagggccagagcaccctgaagatcagcaaccccaagggctgggtgaccttcgaggaggaggaggacttcggcgtgaagggcaagagcaagagcgcctgcagcgacctgctgggcaaccagcccagcagcttcagcggcagcaacctgaccctgaacgacgactggaacaagggcaccaacgtgagcttctgcgtgctgcccagcagaagacccccccccccccccgtgcccctgctgccccccggcaccagcccccccgtggaccccttcaccaccctggccagcaaggccagccccaccctggacttcaccgagagatag

SEQ ID NO: 101432 - DNA, 4491 bp, Artificial Sequence
  Description of Artificial Sequence: Synthetic coding sequence
atggccctgagcaagggcctgagactgctgggcagactgggcgccgagggcgactgcagcgtgctgctggaggccagaggcagagacgactgcctgctgttcgaggccggcaccgtggccaccctggcccccgaggagaaggaggtgatcaagggccagtacggcaagctgaccgacgcctacggctgcctgggcgagctgagactgaagagcggcggcaccagcctgagcttcctggtgctggtgaccggctgcaccagcgtgggcagaatccccgacgccgagatctacaagatcaccgccaccgacttctaccccctgcaggaggaggccaaggaggaggagagactgatcgccctgaagaagatcctgagcagcggcgtgttctacttcagctggcccaacgacggcagcagattcgacctgaccgtgagaacccagaagcagggcgacgacagcagcgagtggggcaacagcttcttctggaaccagctgctgcacgtgcccctgagacagcaccaggtgagctgctgcgactggctgctgaagatcatctgcggcgtggtgaccatcagaaccgtgtacgccagccacaagcaggccaaggcctgcctggtgagcagagtgagctgcgagagaaccggcaccagattccacaccagaggcgtgaacgacgacggccacgtgagcaacttcgtggagaccgagcagatgatctacatggacgacggcgtgagcagcttcgtgcagatcagaggcagcgtgcccctgttctgggagcagcccggcctgcaggtgggcagccaccacctgagactgcacagaggcctggaggccaacgcccccgccttcgacagacacatggtgctgctgaaggagcagtacggccagcaggtggtggtgaacctgctgggcagcagaggcggcgaggaggtgctgaacagagccttcaagaagctgctgtgggccagctgccacgccggcgacacccccatgatcaacttcgacttccaccagttcgccaagggcggcaagctggagaagctggagaccctgctgagaccccagctgaagctgcactgggaggacttcgacgtgttcaccaagggcgagaacgtgagccccagattccagaagggcaccctgagaatgaactgcctggactgcctggacagaaccaacaccgtgcagagcttcatcgccctggaggtgctgcacctgcagctgaagaccctgggcctgagcagcaagcccatcgtggacagattcgtggagagcttcaaggccatgtggagcctgaacggccacagcctgagcaaggtgttcaccggcagcagagccctggagggcaaggccaaggtgggcaagctgaaggacggcgccagaagcatgagcagaaccatccagagcaacttcttcgacggcgtgaagcaggaggccatcaagctgctgctggtgggcgacgtgtacggcgaggaggtggccgacaagggcggcatgctgctggacagcaccgccctgctggtgacccccagaatcctgaaggccatgaccgagagacagagcgagttcaccaacttcaagagaatcagaatcgccatgggcacctggaacgtgaacggcggcaagcagttcagaagcaacgtgctgagaaccgccgagctgaccgactggctgctggacagcccccagctgagcggcgccaccgacagccaggacgacagcagccccgccgacatcttcgccgtgggcttcgaggagatggtggagctgagcgccggcaacatcgtgaacgccagcaccaccaacaagaagatgtggggcgagcagctgcagaaggccatcagcagaagccacagatacatcctgctgaccagcgcccagctggtgggcgtgtgcctgtacatcttcgtgagaccctaccacgtgcccttcatcagagacgtggccatcgacaccgtgaagaccggcatgggcggcaaggccggcaacaagggcgccgtgggcatcagattccagttccacagcaccagcttctgcttcatctgcagccacctgaccgccggccagagccaggtgaaggagagaaacgaggactacaaggagatcacccagaagctgtgcttccccatgggcagaaacgtgttcagccacgactacgtgttctggtgcggcgacttcaactacagaatcgacctgacctacgaggaggtgttctacttcgtgaagagacaggactggaagaagctgctggagttcgaccagctgcagctgcagaagagcagcggcaagatcttcaaggacttccacgagggcgccatcaacttcggccccacctacaagtacgacgtgggcagcgccgcctacgacaccagcgacaagtgcagaacccccgcctggaccgacagagtgctgtggtggagaaagaagcaccccttcgacaagaccgccggcgagctgaacctgctggacagcgacctggacgtggacaccaaggtgagacacacctggagccccggcgccctgcagtactacggcagagccgagctgcaggccagcgaccacagacccgtgctggccatcgtggaggtggaggtgcaggaggtggacgtgggcgccagagagagagtgttccaggaggtgagcagcttccagggccccctggacgccaccgtggtggtgaacctgcagagccccaccctggaggagaagaacgagttccccgaggacctgagaaccgagctgatgcagaccctgggcagctacggcaccatcgtgctggtgagaatcaaccagggccagatgctggtgaccttcgccgacagccacagcgccctgagcgtgctggacgtggacggcatgaaggtgaagggcagagccgtgaagatcagacccaagaccaaggactggctgaagggcctgagagaggagatcatcagaaagagagacagcatggcccccgtgagccccaccgccaacagctgcctgctggaggagaacttcgacttcaccagcctggactacgagagcgagggcgacatcctggaggacgacgaggactacctggtggacgagttcaaccagcccggcgtgagcgacagcgagctgggcggcgacgacctgagcgacgtgcccggccccaccgccctggccccccccagcaagagccccgccctgaccaagaagaagcagcaccccacctacaaggacgacgccgacctggtggagctgaagagagagctggaggccgtgggcgagttcagacacagaagccccagcagaagcctgagcgtgcccaacagacccagacccccccagcccccccagagaccccccccccccaccggcctgatggtgaagaagagcgccagcgacgccagcatcagcagcggcacccacggccagtacagcatcctgcagaccgccagactgctgcccggcgccccccagcagccccccaaggccagaaccggcatcagcaagccctacaacgtgaagcagatcaagaccaccaacgcccaggaggccgaggccgccatcagatgcctgctggaggccagaggcggcgccagcgaggaggccctgagcgccgtggcccccagagacctggaggccagcagcgagcccgagcccacccccggcgccgccaagcccgagaccccccaggccccccccctgctgcccagaagacccccccccagagtgcccgccatcaagaagcccaccctgagaagaaccggcaagcccctgagccccgaggagcagttcgagcagcagaccgtgcacttcaccatcggcccccccgagaccagcgtggaggccccccccgtggtgaccgcccccagagtgccccccgtgcccaagcccagaaccttccagcccggcaaggccgccgagagacccagccacagaaagcccgccagcgacgaggccccccccggcgccggcgccagcgtgcccccccccctggaggccccccccctggtgcccaaggtgccccccagaagaaagaagagcgcccccgccgccttccacctgcaggtgctgcagagcaacagccagctgctgcagggcctgacctacaacagcagcgacagccccagcggccacccccccgccgccggcaccgtgttcccccagggcgacttcctgagcaccagcagcgccaccagccccgacagcgacggcaccaaggccatgaagcccgaggccgcccccctgctgggcgactaccaggaccccttctggaacctgctgcaccaccccaagctgctgaacaacacctggctgagcaagagcagcgaccccctggacagcggcaccagaagccccaagagagaccccatcgaccccgtgagcgccggcgccagcgccgccaaggccgagctgccccccgaccacgagcacaagaccctgggccactgggtgaccatcagcgaccaggagaagagaaccgccctgcaggtgttcgaccccctggccaagacctag

SEQ ID NO: 101433 - DNA, 1746 bp, Artificial Sequence
  Description of Artificial Sequence: Synthetic coding sequence
atgcagaccctgggcagctacggcaccatcgtgctggtgagaatcaaccagggccagatgctggtgaccttcgccgacagccacagcgccctgagcgtgctggacgtggacggcatgaaggtgaagggcagagccgtgaagatcagacccaagaccaaggactggctgaagggcctgagagaggagatcatcagaaagagagacagcatggcccccgtgagccccaccgccaacagctgcctgctggaggagaacttcgacttcaccagcctggactacgagagcgagggcgacatcctggaggacgacgaggactacctggtggacgagttcaaccagcccggcgtgagcgacagcgagctgggcggcgacgacctgagcgacgtgcccggccccaccgccctggccccccccagcaagagccccgccctgaccaagaagaagcagcaccccacctacaaggacgacgccgacctggtggagctgaagagagagctggaggccgtgggcgagttcagacacagaagccccagcagaagcctgagcgtgcccaacagacccagacccccccagcccccccagagaccccccccccccaccggcctgatggtgaagaagagcgccagcgacgccagcatcagcagcggcacccacggccagtacagcatcctgcagaccgccagactgctgcccggcgccccccagcagccccccaaggccagaaccggcatcagcaagccctacaacgtgaagcagatcaagaccaccaacgcccaggaggccgaggccgccatcagatgcctgctggaggccagaggcggcgccagcgaggaggccctgagcgccgtggcccccagagacctggaggccagcagcgagcccgagcccacccccggcgccgccaagcccgagaccccccaggccccccccctgctgcccagaagacccccccccagagtgcccgccatcaagaagcccaccctgagaagaaccggcaagcccctgagccccgaggagcagttcgagcagcagaccgtgcacttcaccatcggcccccccgagaccagcgtggaggccccccccgtggtgaccgcccccagagtgccccccgtgcccaagcccagaaccttccagcccggcaaggccgccgagagacccagccacagaaagcccgccagcgacgaggccccccccggcgccggcgccagcgtgcccccccccctggaggccccccccctggtgcccaaggtgccccccagaagaaagaagagcgcccccgccgccttccacctgcaggtgctgcagagcaacagccagctgctgcagggcctgacctacaacagcagcgacagccccagcggccacccccccgccgccggcaccgtgttcccccagggcgacttcctgagcaccagcagcgccaccagccccgacagcgacggcaccaaggccatgaagcccgaggccgcccccctgctgggcgactaccaggaccccttctggaacctgctgcaccaccccaagctgctgaacaacacctggctgagcaagagcagcgaccccctggacagcggcaccagaagccccaagagagaccccatcgaccccgtgagcgccggcgccagcgccgccaaggccgagctgccccccgaccacgagcacaagaccctgggccactgggtgaccatcagcgaccaggagaagagaaccgccctgcaggtgttcgaccccctggccaagacctag

SEQ ID NO: 101434 - DNA, 411 bp, Artificial Sequence
  Description of Artificial Sequence: Synthetic coding sequence
tgaggcagagacgactgcctgctgttcgaggccggcaccgtggccaccctggcccccgaggagaaggaggtgatcaagggccagtacggcaagctgaccgacgcctacggctgcctgggcgagctgagactgaagagcggcggcaccagcctgagcttcctggtgctggtgaccggctgcaccagcgtgggcagaatccccgacgccgagatctacaagatcaccgccaccgacttctaccccctgcaggaggaggccaaggaggaggagagactgatcgccctgaagaagatcctgagcagcggcgtgttctacttcagctggcccaacgacggcagcagattcgacctgaccgtgagaacccagaagcagggcgacgacagcagcgagtggggcaacagcttcttctag

SEQ ID NO: 101435 - DNA, 3867 bp, Artificial Sequence
  Description of Artificial Sequence: Synthetic coding sequence
atggccctgagcaagggcctgagactgctgggcagactgggcgccgagggcgactgcagcgtgctgctggaggccagaggcagagacgactgcctgctgttcgaggccggcaccgtggccaccctggcccccgaggagaaggaggtgatcaagggccagtacggcaagctgaccgacgcctacggctgcctgggcgagctgagactgaagagcggcggcaccagcctgagcttcctggtgctggtgaccggctgcaccagcgtgggcagaatccccgacgccgagatctacaagatcaccgccaccgacttctaccccctgcaggaggaggccaaggaggaggagagactgatcgccctgaagaagatcctgagcagcggcgtgttctacttcagctggcccaacgacggcagcagattcgacctgaccgtgagaacccagaagcagggcgacgacagcagcgagtggggcaacagcttcttctggaaccagctgctgcacgtgcccctgagacagcaccaggtgagctgctgcgactggctgctgaagatcatctgcggcgtggtgaccatcagaaccgtgtacgccagccacaagcaggccaaggcctgcctggtgagcagagtgagctgcgagagaaccggcaccagattccacaccagaggcgtgaacgacgacggccacgtgagcaacttcgtggagaccgagcagatgatctacatggacgacggcgtgagcagcttcgtgcagatcagaggcagcgtgcccctgttctgggagcagcccggcctgcaggtgggcagccaccacctgagactgcacagaggcctggaggccaacgcccccgccttcgacagacacatggtgctgctgaaggagcagtacggccagcaggtggtggtgaacctgctgggcagcagaggcggcgaggaggtgctgaacagagccttcaagaagctgctgtgggccagctgccacgccggcgacacccccatgatcaacttcgacttccaccagttcgccaagggcggcaagctggagaagctggagaccctgctgagaccccagctgaagctgcactgggaggacttcgacgtgttcaccaagggcgagaacgtgagccccagattccagaagggcaccctgagaatgaactgcctggactgcctggacagaaccaacaccgtgcagagcttcatcgccctggaggtgctgcacctgcagctgaagaccctgggcctgagcagcaagcccatcgtggacagattcgtggagagcttcaaggccatgtggagcctgaacggccacagcctgagcaaggtgttcaccggcagcagagccctggagggcaaggccaaggtgggcaagctgaaggacggcgccagaagcatgagcagaaccatccagagcaacttcttcgacggcgtgaagcaggaggccatcaagctgctgctggtgggcgacgtgtacggcgaggaggtggccgacaagggcggcatgctgctggacagcaccgccctgctggtgacccccagaatcctgaaggccatgaccgagagacagagcgagttcaccaacttcaagagaatcagaatcgccatgggcacctggaacgtgaacggcggcaagcagttcagaagcaacgtgctgagaaccgccgagctgaccgactggctgctggacagcccccagctgagcggcgccaccgacagccaggacgacagcagccccgccgacatcttcgccgtgggcttcgaggagatggtggagctgagcgccggcaacatcgtgaacgccagcaccaccaacaagaagatgtggggcgagcagctgcagaaggccatcagcagaagccacagatacatcctgctgaccagcgcccagctggtgggcgtgtgcctgtacatcttcgtgagaccctaccacgtgcccttcatcagagacgtggccatcgacaccgtgaagaccggcatgggcggcaaggccggcaacaagggcgccgtgggcatcagattccagttccacagcaccagcttctgcttcatctgcagccacctgaccgccggccagagccaggtgaaggagagaaacgaggactacaaggagatcacccagaagctgtgcttccccatgggcagaaacgtgttcagccacgactacgtgttctggtgcggcgacttcaactacagaatcgacctgacctacgaggaggtgttctacttcgtgaagagacaggactggaagaagctgctggagttcgaccagctgcagctgcagaagagcagcggcaagatcttcaaggacttccacgagggcgccatcaacttcggccccacctacaagtacgacgtgggcagcgccgcctacgacaccagcgacaagtgcagaacccccgcctggaccgacagagtgctgtggtggagaaagaagcaccccttcgacaagaccgccggcgagctgaacctgctggacagcgacctggacgtggacaccaaggtgagacacacctggagccccggcgccctgcagtactacggcagagccgagctgcaggccagcgaccacagacccgtgctggccatcgtggaggtggaggtgcaggaggtggacgtgggcgccagagagagagtgttccaggaggtgagcagcttccagggccccctggacgccaccgtggtggtgaacctgcagagccccaccctggaggagaagaacgagttccccgaggacctgagaaccgagctgatgcagaccctgggcagctacggcaccatcgtgctggtgagaatcaaccagggccagatgctggtgaccttcgccgacagccacagcgccctgagcgtgctggacgtggacggcatgaaggtgaagggcagagccgtgaagatcagacccaagaccaaggactggctgaagggcctgagagaggagatcatcagaaagagagacagcatggcccccgtgagccccaccgccaacagctgcctgctggaggagaacttcgacttcaccagcctggactacgagagcgagggcgacatcctggaggacgacgaggactacctggtggacgagttcaaccagcccggcgtgagcgacagcgagctgggcggcgacgacctgagcgacgtgcccggccccaccgccctggccccccccagcaagagccccgccctgaccaagaagaagcagcaccccacctacaaggacgacgccgacctggtggagctgaagagagagctggaggccgtgggcgagttcagacacagaagccccagcagaagcctgagcgtgcccaacagacccagacccccccagcccccccagagaccccccccccccaccggcctgatggtgaagaagagcgccagcgacgccagcatcagcagcggcacccacggccagtacagcatcctgcagaccgccagactgctgcccggcgccccccagcagccccccaaggccagaaccggcatcagcaagccctacaacgtgaagcagatcaagaccaccaacgcccaggaggccgaggccgccatcagatgcctgctggaggccagaggcggcgccagcgaggaggccctgagcgccgtggcccccagagacctggaggccagcagcgagcccgagcccacccccggcgccgccaagcccgagaccccccaggccccccccctgctgcccagaagacccccccccagagtgcccgccatcaagaagcccaccctgagaagaaccggcaagatcgtgttctgcagcagaagccaggccagccagccctgcctgctgctgcagagacacgagttcgtgagaaccgtggccgcccagagactggccagcgtggacaccagcggcagcagcgtgtag

SEQ ID NO: 101436 - DNA, 4356 bp, Artificial Sequence
  Description of Artificial Sequence: Synthetic coding sequence
atggccctgagcaagggcctgagactgctgggcagactgggcgccgagggcgactgcagcgtgctgctggaggccagaggcagagacgactgcctgctgttcgaggccggcaccgtggccaccctggcccccgaggagaaggaggtgatcaagggccagtacggcaagctgaccgacgcctacggctgcctgggcgagctgagactgaagagcggcggcaccagcctgagcttcctggtgctggtgaccggctgcaccagcgtgggcagaatccccgacgccgagatctacaagatcaccgccaccgacttctaccccctgcaggaggaggccaaggaggaggagagactgatcgccctgaagaagatcctgagcagcggcgtgttctacttcagctggcccaacgacggcagcagattcgacctgaccgtgagaacccagaagcagggcgacgacagcagcgagtggggcaacagcttcttctggaaccagctgctgcacgtgcccctgagacagcaccaggtgagctgctgcgactggctgctgaagatcatctgcggcgtggtgaccatcagaaccgtgtacgccagccacaagcaggccaaggcctgcctggtgagcagagtgagctgcgagagaaccggcaccagattccacaccagaggcgtgaacgacgacggccacgtgagcaacttcgtggagaccgagcagatgatctacatggacgacggcgtgagcagcttcgtgcagatcagaggcagcgtgcccctgttctgggagcagcccggcctgcaggtgggcagccaccacctgagactgcacagaggcctggaggccaacgcccccgccttcgacagacacatggtgctgctgaaggagcagtacggccagcaggtggtggtgaacctgctgggcagcagaggcggcgaggaggtgctgaacagagccttcaagaagctgctgtgggccagctgccacgccggcgacacccccatgatcaacttcgacttccaccagttcgccaagggcggcaagctggagaagctggagaccctgctgagaccccagctgaagctgcactgggaggacttcgacgtgttcaccaagggcgagaacgtgagccccagattccagaagggcaccctgagaatgaactgcctggactgcctggacagaaccaacaccgtgcagagcttcatcgccctggaggtgctgcacctgcagctgaagaccctgggcctgagcagcaagcccatcgtggacagattcgtggagagcttcaaggccatgtggagcctgaacggccacagcctgagcaaggtgttcaccggcagcagagccctggagggcaaggccaaggtgggcaagctgaaggacggcgccagaagcatgagcagaaccatccagagcaacttcttcgacggcgtgaagcaggaggccatcaagctgctgctggtgggcgacgtgtacggcgaggaggtggccgacaagggcggcatgctgctggacagcaccgccctgctggtgacccccagaatcctgaaggccatgaccgagagacagagcgagttcaccaacttcaagagaatcagaatcgccatgggcacctggaacgtgaacggcggcaagcagttcagaagcaacgtgctgagaaccgccgagctgaccgactggctgctggacagcccccagctgagcggcgccaccgacagccaggacgacagcagccccgccgacatcttcgccgtgggcttcgaggagatggtggagctgagcgccggcaacatcgtgaacgccagcaccaccaacaagaagatgtggggcgagcagctgcagaaggccatcagcagaagccacagatacatcctgctgaccagcgcccagctggtgggcgtgtgcctgtacatcttcgtgagaccctaccacgtgcccttcatcagagacgtggccatcgacaccgtgaagaccggcatgggcggcaaggccggcaacaagggcgccgtgggcatcagattccagttccacagcaccagcttctgcttcatctgcagccacctgaccgccggccagagccaggtgaaggagagaaacgaggactacaaggagatcacccagaagctgtgcttccccatgggcagaaacgtgttcagccacgactacgtgttctggtgcggcgacttcaactacagaatcgacctgacctacgaggaggtgttctacttcgtgaagagacaggactggaagaagctgctggagttcgaccagctgcagctgcagaagagcagcggcaagatcttcaaggacttccacgagggcgccatcaacttcggccccacctacaagtacgacgtgggcagcgccgcctacgacaccagcgacaagtgcagaacccccgcctggaccgacagagtgctgtggtggagaaagaagcaccccttcgacaagaccgccggcgagctgaacctgctggacagcgacctggacgtggacaccaaggtgagacacacctggagccccggcgccctgcagtactacggcagagccgagctgcaggccagcgaccacagacccgtgctggccatcgtggaggtggaggtgcaggaggtggacgtgggcgccagagagagagtgttccaggaggtgagcagcttccagggccccctggacgccaccgtggtggtgaacctgcagagccccaccctggaggagaagaacgagttccccgaggacctgagaaccgagctgatgcagaccctgggcagctacggcaccatcgtgctggtgagaatcaaccagggccagatgctggtgaccttcgccgacagccacagcgccctgagcgtgctggacgtggacggcatgaaggtgaagggcagagccgtgaagatcagacccaagaccaaggactggctgaagggcctgagagaggagatcatcagaaagagagacagcatggcccccgtgagccccaccgccaacagctgcctgctggaggagaacttcgacttcaccagcctggactacgagagcgagggcgacatcctggaggacgacgaggactacctggtggacgagttcaaccagcccggcgtgagcgacagcgagctgggcggcgacgacctgagcgacgtgcccggccccaccgccctggccccccccagcaagagccccgccctgaccaagaagaagcagcaccccacctacaaggccggcctgatggtgaagaagagcgccagcgacgccagcatcagcagcggcacccacggccagtacagcatcctgcagaccgccagactgctgcccggcgccccccagcagccccccaaggccagaaccggcatcagcaagccctacaacgtgaagcagatcaagaccaccaacgcccaggaggccgaggccgccatcagatgcctgctggaggccagaggcggcgccagcgaggaggccctgagcgccgtggcccccagagacctggaggccagcagcgagcccgagcccacccccggcgccgccaagcccgagaccccccaggccccccccctgctgcccagaagacccccccccagagtgcccgccatcaagaagcccaccctgagaagaaccggcaagcccctgagccccgaggagcagttcgagcagcagaccgtgcacttcaccatcggcccccccgagaccagcgtggaggccccccccgtggtgaccgcccccagagtgccccccgtgcccaagcccagaaccttccagcccggcaaggccgccgagagacccagccacagaaagcccgccagcgacgaggccccccccggcgccggcgccagcgtgcccccccccctggaggccccccccctggtgcccaaggtgccccccagaagaaagaagagcgcccccgccgccttccacctgcaggtgctgcagagcaacagccagctgctgcagggcctgacctacaacagcagcgacagccccagcggccacccccccgccgccggcaccgtgttcccccagggcgacttcctgagcaccagcagcgccaccagccccgacagcgacggcaccaaggccatgaagcccgaggccgcccccctgctgggcgactaccaggaccccttctggaacctgctgcaccaccccaagctgctgaacaacacctggctgagcaagagcagcgaccccctggacagcggcaccagaagccccaagagagaccccatcgaccccgtgagcgccggcgccagcgccgccaaggccgagctgccccccgaccacgagcacaagaccctgggccactgggtgaccatcagcgaccaggagaagagaaccgccctgcaggtgttcgaccccctggccaagacctag

SEQ ID NO: 101437 - DNA, 279 bp, Artificial Sequence
  Description of Artificial Sequence: Synthetic coding sequence
atgttcctgtacgccagcggccccgccccccccgccggcacctgcagatggggcggccagggcggcaccagcctgagcttcctggtgctggtgaccggctgcaccagcgtgggcagaatccccgacgccgagatctacaagatcaccgccaccgacttctaccccctgcaggaggaggccaaggaggaggagagactgatcgccctgaagaagatcctgagcagcggcgtgttctacttcagctggcccaacgacggcagcagattcgacctgacctag

SEQ ID NO: 101438 - DNA, 1551 bp, Artificial Sequence
  Description of Artificial Sequence: Synthetic coding sequence
atgttcctgtacgccagcggccccgccccccccgccggcacctgcagatggggcggccagggcggcaccagcctgagcttcctggtgctggtgaccggctgcaccagcgtgggcagaatccccgacgccgagatctacaagatcaccgccaccgacttctaccccctgcaggaggaggccaaggaggaggagagactgatcgccctgaagaagatcctgagcagcggcgtgttctacttcagctggcccaacgacggcagcagattcgacctgaccgtgagaacccagaagcagggcgacgacagcagcgagtggggcaacagcttcttctggaaccagctgctgcacgtgcccctgagacagcaccaggtgagctgctgcgactggctgctgaagatcatctgcggcgtggtgaccatcagaaccgtgtacgccagccacaagcaggccaaggcctgcctggtgagcagagtgagctgcgagagaaccggcaccagattccacaccagaggcgtgaacgacgacggccacgtgagcaacttcgtggagaccgagcagatgatctacatggacgacggcgtgagcagcttcgtgcagatcagaggcagcgtgcccctgttctgggagcagcccggcctgcaggtgggcagccaccacctgagactgcacagaggcctggaggccaacgcccccgccttcgacagacacatggtgctgctgaaggagcagtacggccagcaggtggtggtgaacctgctgggcagcagaggcggcgaggaggtgctgaacagagccttcaagttcgccaagggcggcaagctggagaagctggagaccctgctgagaccccagctgaagctgcactgggaggacttcgacgtgttcaccaagggcgagaacgtgagccccagattccagaagggcaccctgagaatgaactgcctggactgcctggacagaaccaacaccgtgcagagcttcatcgccctggaggtgctgcacctgcagctgaagaccctgggcctgagcagcaagcccatcgtggacagattcgtggagagcttcaaggccatgtggagcctgaacggccacagcctgagcaaggtgttcaccggcagcagagccctggagggcaaggccaaggtgggcaagctgaaggacggcgccagaagcatgagcagaaccatccagagcaacttcttcgacggcgtgaagcaggaggccatcaagctgctgctggtgggcgacgtgtacggcgaggaggtggccgacaagggcggcatgctgctggacagcaccgccctgctggtgacccccagaatcctgaaggccatgaccgagagacagagcgagttcaccaacttcaagagaatcagaatcgccatgggcacctggaacgtgaacggcggcaagcagttcagaagcaacgtgctgagaaccgccgagctgaccgactggctgctggacagcccccagctgagcggcgccaccgacagccagggcgagggcagcgacttcggcggcgacaagatccagctgcacctgacctag

SEQ ID NO: 101439 - DNA, 438 bp, Artificial Sequence
  Description of Artificial Sequence: Synthetic coding sequence
atgaacggcagagtggactacctggtgaccgaggaggagatcaacctgaccagaggccccagcggcctgggcttcaacatcgtgggcggcaccgaccagcagtacgtgagcaacgacagcggcatctacgtgagcagaatcaaggagaacggcgccgccgccctggacggcagactgcaggagggcgacaagatcctgagcgtgaacggccaggacctgaagaacctgctgcaccaggacgccgtggacctgttcagaaacgccggctacgccgtgagcctgagagtgcagcacagactgcaggtgcagaacggccccatcggccacagaggcgagggcgaccccagcggcatccccatcttcatggtgctggtgcccgtgttcgccctgaccatggtggccgcctgggccttcatgagatacagacagcagctgtag

SEQ ID NO: 101440 - DNA, 957 bp, Artificial Sequence
  Description of Artificial Sequence: Synthetic coding sequence
atggccggcagaagcctgaccagcaaggccgagcccaccgccggcgccgtggacagagccgagaaggccggcggccaggacaccagcagccagaagatcgaggacctgatggagatggtgcagaagctgcagaaggtgggcagcctggagcccagagtggaggtgctgatcaacagaatcaacgaggtgcagcaggccaagaagaaggccaacaaggacctgggcgaggccagaaccatctgcgaggccctgcagaaggagctggacagcctgcacggcgagaaggtgcacctgaaggagatcctgagcaagaagcaggagaccctgagaatcctgagactgcactgccaggagaaggagagcgaggcccacagaaagcacaccatgctgcaggagtgcaaggagagaatcagcgccctgaacctgcagatcgaggaggagaagaacaagcagagacagctgagactggccttcgaggagcagctggaggacctgatgggccagcacaaggacctgtgggacttccacatgcccgagagactggccaaggagatctgcgccctggacagcagcaaggagcagctgctgaaggaggagaagctggtgaaggccaccctggaggacgtgaagcaccagctgtgcagcctgtgcggcgccgagggccccagcaccctggacgagggcctgttcctgagaagccaggaggccgccgccaccgtgcagctgttccaggaggagcacagaaaggccgaggagctgctggccgccgccgcccagagacaccagcagctgcagcagaagtgccagcagcagcagcagaagagacagagactgaaggaggagctggagaagcacggcatgcaggtgcccgcccaggcccagagcacccaggaggaggaggccggccccggcgacgtggcccccagacccggcagacccgtgacctggtggagctag

SEQ ID NO: 101441 - DNA, 1056 bp, Artificial Sequence
  Description of Artificial Sequence: Synthetic coding sequence
atggccggcagaagcctgaccagcaaggccgagcccaccgccggcgccgtggacagagccgagaaggccggcggccaggacaccagcagccagaagatcgaggacctgatggagatggtgcagaagctgcagaaggtgggcagcctggagcccagagtggaggtgctgatcaacagaatcaacgaggtgcagcaggccaagaagaaggccaacaaggacctgggcgaggccagaaccatctgcgaggccctgcagaaggagctggacagcctgcacggcgagaaggtgcacctgaaggagatcctgagcaagaagcaggagaccctgagaatcctgagactgcactgccaggagaaggagagcgaggcccacagaaagcacaccatgctgcaggagtgcaaggagagaatcagcgccctgaacctgcagatcgaggaggagaagaacaagcagagacagctgagactggccttcgaggagcagctggaggacctgatgggccagcacaaggacctgtgggacttccacatgcccgagagactggccaaggagatctgcgccctggacagcagcaaggagcagctgctgaaggaggagaagctggtgaaggccaccctggaggacgtgaagcaccagctgtgcagcctgtgcggcgccgagggccccagcaccctggacgagggcctgttcctgagaagccaggaggccgccgccaccgtgcagctgttccaggaggagcacagaaaggccgaggagctgctggccgccgccgcccagagacaccagcagctgcagcagaagtgccagcagcagcagcagaagagacagagactgaaggaggagctggagaagcacggcatgcaggtgcccgcccaggcccagagcacccaggaggaggaggccggccccggcgacgtggccagccccaagcccctgaagggcgagagacccggcgccgcccaccaggccggccccgacgtgctgatcggccaggaggacaccctgcaccccgacctgagccccagaggcttccaggagatcaaggagctgttctag

SEQ ID NO: 101442 - DNA, 849 bp, Artificial Sequence
  Description of Artificial Sequence: Synthetic coding sequence
atggagatggtgcagaagctgcagaaggtgggcagcctggagcccagagtggaggtgctgatcaacagaatcaacgaggtgcagcaggccaagaagaaggccaacaaggacctgggcgaggccagaaccatctgcgaggccctgcagaaggagctggacagcctgcacggcgagaaggtgcacctgaaggagatcctgagcaagaagcaggagaccctgagaatcctgagactgcactgccaggagaaggagagcgaggcccacagaaagcacaccatgctgcaggagtgcaaggagagaatcagcgccctgaacctgcagatcgaggaggagaagaacaagcagagacagctgagactggccttcgaggagcagctggaggacctgatgggccagcacaaggacctgtgggacttccacatgcccgagagactggccaaggagatctgcgccctggacagcagcaaggagcagctgctgaaggaggagaagctggtgaaggccaccctggaggacgtgaagcaccagctgtgcagcctgtgcggcgccgagggccccagcaccctggacgagggcctgttcctgagaagccaggaggccgccgccaccgtgcagctgttccaggaggagcacagaaaggccgaggagctgctggccgccgccgcccagagacaccagcagctgcagcagaagtgccagcagcagcagcagaagagacagagactgaaggaggagctggagaagcacggcatgcaggtgcccgcccaggcccagagcacccaggaggaggaggccggccccggcgacgtggcccccagacccggcagacccgtgacctggtggagctag

SEQ ID NO: 101443 - DNA, 849 bp, Artificial Sequence; identical to SEQ ID NO: 101442
  Description of Artificial Sequence: Synthetic coding sequence

SEQ ID NO: 101444 - DNA, 657 bp, Artificial Sequence
  Description of Artificial Sequence: Synthetic coding sequence
atggagagacagggcgtggacgtgccccacgtgaagtgcaaggaccaggagccccagcccctgggcgagagcaaggagcaccccagatgggaggagaactgcgaggaggaggccggcggcggccccgccagcgccagctgccagctgaccgtgctggagggcaagagcggcctgtacttcagcagcctggacagcagcatcgacatcctgcagaagagagcccaggagctgatcgagaacatcaacaagagcagacagaaggaccacgccctgatgaccaacttcagaaacagcctgaagaccaaggtgagcgacctgaccgagaagctggaggagagaatctaccagatctacaacgaccacaacaagatcatccaggagaagctgcaggagttcacccagaagatggccaagatcagccacctggagaccgagctgaagcaggtgtgccacagcgtggagaccgtgtacaaggacctgtgcctgcagcccgagcagagcctgagactgagatggggccccgaccacagcagaggcaagagcccccccagacccggcaacagccagccccccgacgtgttcgtgagcagcgtggccgagaccaccagccaggccaccgccagcgaggtgcagaccaacagagacggcgagtgctag

SEQ ID NO: 101445 - DNA, 2931 bp, Artificial Sequence
  Description of Artificial Sequence: Synthetic coding sequence
atggagaagcagaagcccttcgccctgttcgtgccccccagaagcagcagcagccaggtgagcgccgtgaagccccagaccctgggcggcgacagcaccttcttcaagagcttcaacaagtgcaccgaggacgacttcgagttccccttcgccaagaccaacctgagcaagaacggcgagaacatcgacagcgaccccgccctgcagaaggtgaacttcctgcccgtgctggagcaggtgggcaacagcgactgccactaccaggagggcctgaaggacagcgacctggagaacagcgagggcctgagcagagtgtacagcaagctgtacaaggaggccgagaagatcaagaagtggaaggtgagcaccgaggccgagctgagacagaaggagagcaagctgcaggagaacagaaagatcatcgaggcccagagaaaggccatccaggagctgcagttcggcaacgagaaggtgagcctgaagctggaggagggcatccaggagaacaaggacctgatcaaggagaacaacgccaccagacacctgtgcaacctgctgaaggagacctgcgccagaagcgccgagaagaccaagaagtacgagtacgagagagaggagaccagacaggtgtacatggacctgaacaacaacatcgagaagatgatcaccgccttcgaggagctgagagtgcaggccgagaacagcagactggagatgcacttcaagctgaaggaggactacgagaagatccagcacctggagcaggagtacaagaaggagatcaacgacaaggagaagcaggtgagcctgctgctgatccagatcaccgagaaggagaacaagatgaaggacctgaccttcctgctggaggagagcagagacaaggtgaaccagctggaggagaagaccaagctgcagagcgagaacctgaagcagagcatcgagaagcagcaccacctgaccaaggagctggaggacatcaaggtgagcctgcagagaagcgtgagcacccagaaggccctggaggaggacctgcagatcgccaccaagaccatctgccagctgaccgaggagaaggagacccagatggaggagagcaacaaggccagagccgcccacagcttcgtggtgaccgagttcgagaccaccgtgtgcagcctggaggagctgctgagaaccgagcagcagagactggagaagaacgaggaccagctgaagatcctgaccatggagctgcagaagaagagcagcgagctggaggagatgaccaagctgaccaacaacaaggaggtggagctggaggagctgaagaaggtgctgggcgagaaggagaccctgctgtacgagaacaagcagttcgagaagatcgccgaggagctgaagggcaccgagcaggagctgatcggcctgctgcaggccagagagaaggaggtgcacgacctggagatccagctgaccgccatcaccaccagcgagcagtactacagcaaggaggtgaaggacctgaagaccgagctggagaacgagaagctgaagaacaccgagctgaccagccactgcaacaagctgagcctggagaacaaggagctgacccaggagaccagcgacatgaccctggagctgaagaaccagcaggaggacatcaacaacaacaagaagcaggaggagagaatgctgaagcagatcgagaacctgcaggagaccgagacccagctgagaaacgagctggagtacgtgagagaggagctgaagcagaagagagacgaggtgaagtgcaagctggacaagagcgaggagaactgcaacaacctgagaaagcaggtggagaacaagaacaagtacatcgaggagctgcagcaggagaacaaggccctgaagaagaagggcaccgccgagagcaagcagctgaacgtgtacgagatcaaggtgaacaagctggagctggagctggagagcgccaagcagaagttcggcgagatcaccgacacctaccagaaggagatcgaggacaagaagatcagcgaggagaacctgctggaggaggtggagaaggccaaggtgatcgccgacgaggccgtgaagctgcagaaggagatcgacaagagatgccagcacaagatcgccgagatggtggccctgatggagaagcacaagcaccagtacgacaagatcatcgaggagagagacagcgagctgggcctgtacaagagcaaggagcaggagcagagcagcctgagagccagcctggagatcgagctgagcaacctgaaggccgagctgctgagcgtgaagaagcagctggagatcgagagagaggagaaggagaagctgaagagagaggccaaggagaacaccgccaccctgaaggagaagaaggacaagaagacccagaccttcctgctggagacccccgagatctactggaagctggacagcaaggccgtgcccagccagaccgtgagcagaaacttcaccagcgtggaccacggcatcagcaaggacaagagagactacctgtggaccagcgccaagaacaccctgagcacccccctgcccaaggcctacaccgtgaagacccccaccaagcccaagctgcagcagagagagaacctgaacatccccatcgaggagagcaagaagaagagaaagatggccttcgagttcgacatcaacagcgacagcagcgagaccaccgacctgctgagcatggtgagcgaggaggagaccctgaagaccctgtacagaaacaacaacccccccgccagccacctgtgcgtgaagacccccaagaaggcccccagcagcctgaccacccccggcagcaccctgaagttcggcgccatcagaaagatgagagaggacagatgggccgtgatcgccaagatggacagaaagaagaagctgaaggaggccgagaagctgttcgtgtag

SEQ ID NO: 101446 - DNA, 2931 bp, Artificial Sequence; identical to SEQ ID NO: 101445
  Description of Artificial Sequence: Synthetic coding sequence

SEQ ID NO: 101447 - DNA, 2379 bp, Artificial Sequence
  Description of Artificial Sequence: Synthetic coding sequence
atggagaagcagaagcccttcgccctgttcgtgccccccagaagcagcagcagccaggtgagcgccgtgaagccccagaccctgggcggcgacagcaccttcttcaagagcttcaacaagtgcaccgaggacgacttcgagttccccttcgccaagaccaacctgagcaagaacggcgagaacatcgacagcgaccccgccctgcagaaggtgaacttcctgcccgtgctggagcaggtgggcaacagcgactgccactaccaggagggcctgaaggacagcgacctggagaacagcgagggcctgagcagagtgtacagcaagctgtacaaggaggccgagaagatcaagaagtggaaggtgagcaccgaggccgagctgagacagaaggagagcaagctgcaggagaacagaaagatcatcgaggcccagagaaaggccatccaggagctgcagttcggcaacgagaaggtgagcctgaagctggaggagggcatccaggagaacaaggacctgatcaaggagaacaacgccaccagacacctgtgcaacctgctgaaggagacctgcgccagaagcgccgagaagaccaagaagtacgagtacgagagagaggagaccagacaggtgtacatggacctgaacaacaacatcgagaagatgatcaccgccttcgaggagctgagagtgcaggccgagaacagcagactggagatgcacttcaagctgaaggaggactacgagaagatccagcacctggagcaggagtacaagaaggagatcaacgacaaggagaagcaggtgagcctgctgctgatccagatcaccgagaaggagaacaagatgaaggacctgaccttcctgctggaggagagcagagacaaggtgaaccagctggaggagaagaccaagctgcagagcgagaacctgaagcagagcatcgagaagcagcaccacctgaccaaggagctggaggacatcaaggtgagcctgcagagaagcgtgagcacccagaaggccctggaggaggacctgcagatcgccaccaagaccatctgccagctgaccgaggagaaggagacccagatggaggagagcaacaaggccagagccgcccacagcttcgtggtgaccgagttcgagaccaccgtgtgcagcctggaggagctgctgagaaccgagcagcagagactggagaagaacgaggaccagctgaagatcctgaccatggagctgcagaagaagagcagcgagctggaggagatgaccaagctgaccaacaacaaggaggtggagctggaggagctgaagaaggtgctgggcgagaaggagaccctgctgtacgagaacaagcagttcgagaagatcgccgaggagctgaagggcaccgagcaggagctgatcggcctgctgcaggccagagagaaggaggtgcacgacctggagatccagctgaccgccatcaccaccagcgagcagtactacagcaaggaggtgaaggacctgaagaccgagctggagaacgagaagctgaagaacaccgagctgaccagccactgcaacaagctgagcctggagaacaaggagctgacccaggagaccagcgacatgaccctggagctgaagaaccagcaggaggacatcaacaacaacaagaagcaggaggagagaatgctgaagcagatcgagaacctgcaggagaccgagacccagctgagaaacgagctggagtacgtgagagaggagctgaagcagaagagagacgaggtgaagtgcaagctggacaagagcgaggagaactgcaacaacctgagaaagcaggtggagaacaagaacaagtacatcgaggagctgcagcaggagaacaaggccctgaagaagaagggcaccgccgagagcaagcagctgaacgtgtacgagatcaaggtgaacaagctggagctggagctggagagcgccaagcagaagttcggcgagatcaccgacacctaccagaaggagatcgaggacaagaagatcagcgaggagaacctgctggaggaggtggagaaggccaaggtgatcgccgacgaggccgtgaagctgcagaaggagatcgacaagagatgccagcacaagatcgccgagatggtggccctgatggagaagcacaagcaccagtacgacaagatcatcgaggagagagacagcgagctgggcctgtacaagagcaaggagcaggagcagagcagcctgagagccagcctggagatcgagctgagcaacctgaaggccgagctgctgagcgtgaagaagcagctggagatcgagagagaggagaaggagaagctgaagagagaggccaaggagaacaccgccaccctgaaggagaagaagtag

SEQ ID NO: 101448 - DNA, 2388 bp, Artificial Sequence
  Description of Artificial Sequence: Synthetic coding sequence
atggagaagcagaagcccttcgccctgttcgtgccccccagaagcagcagcagccaggtgagcgccgtgaagccccagaccctgggcggcgacagcaccttcttcaagagcttcaacaagtgcaccgaggacgacttcgagttccccttcgccaagaccaacctgagcaagaacggcgagaacatcgacagcgaccccgccctgcagaaggtgaacttcctgcccgtgctggagcaggtgggcaacagcgactgccactaccaggagggcctgaaggacagcgacctggagaacagcgagggcctgagcagagtgtacagcaagctgtacaaggaggccgagaagatcaagaagtggaaggtgagcaccgaggccgagctgagacagaaggagagcaagctgcaggagaacagaaagatcatcgaggcccagagaaaggccatccaggagctgcagttcggcaacgagaaggtgagcctgaagctggaggagggcatccaggagaacaaggacctgatcaaggagaacaacgccaccagacacctgtgcaacctgctgaaggagacctgcgccagaagcgccgagaagaccaagaagtacgagtacgagagagaggagaccagacaggtgtacatggacctgaacaacaacatcgagaagatgatcaccgccttcgaggagctgagagtgcaggccgagaacagcagactggagatgcacttcaagctgaaggaggactacgagaagatccagcacctggagcaggagtacaagaaggagatcaacgacaaggagaagcaggtgagcctgctgctgatccagatcaccgagaaggagaacaagatgaaggacctgaccttcctgctggaggagagcagagacaaggtgaaccagctggaggagaagaccaagctgcagagcgagaacctgaagcagagcatcgagaagcagcaccacctgaccaaggagctggaggacatcaaggtgagcctgcagagaagcgtgagcacccagaaggccctggaggaggacctgcagatcgccaccaagaccatctgccagctgaccgaggagaaggagacccagatggaggagagcaacaaggccagagccgcccacagcttcgtggtgaccgagttcgagaccaccgtgtgcagcctggaggagctgctgagaaccgagcagcagagactggagaagaacgaggaccagctgaagatcctgaccatggagctgcagaagaagagcagcgagctggaggagatgaccaagctgaccaacaacaaggaggtggagctggaggagctgaagaaggtgctgggcgagaaggagaccctgctgtacgagaacaagcagttcgagaagatcgccgaggagctgaagggcaccgagcaggagctgatcggcctgctgcaggccagagagaaggaggtgcacgacctggagatccagctgaccgccatcaccaccagcgagcagtactacagcaaggaggtgaaggacctgaagaccgagctggagaacgagaagctgaagaacaccgagctgaccagccactgcaacaagctgagcctggagaacaaggagctgacccaggagaccagcgacatgaccctggagctgaagaaccagcaggaggacatcaacaacaacaagaagcaggaggagagaatgctgaagcagatcgagaacctgcaggagaccgagacccagctgagaaacgagctggagtacgtgagagaggagctgaagcagaagagagacgaggtgaagtgcaagctggacaagagcgaggagaactgcaacaacctgagaaagcaggtggagaacaagaacaagtacatcgaggagctgcagcaggagaacaaggccctgaagaagaagggcaccgccgagagcaagcagctgaacgtgtacgagatcaaggtgaacaagctggagctggagctggagagcgccaagcagaagttcggcgagatcaccgacacctaccagaaggagatcgaggacaagaagatcagcgaggagaacctgctggaggaggtggagaaggccaaggtgatcgccgacgaggccgtgaagctgcagaaggagatcgacaagagatgccagcacaagatcgccgagatggtggccctgatggagaagcacaagcaccagtacgacaagatcatcgaggagagagacagcgagctgggcctgtacaagagcaaggagcaggagcagagcagcctgagagccagcctggagatcgagctgagcaacctgaaggccgagctgctgagcgtgaagaagcagctggagatcgagagagaggagaaggagaagctgaagagagaggccaaggagaacaccgccaccctgaaggagaagaaggacaagaagtag

SEQ ID NO: 101449 - DNA, 4593 bp, Artificial Sequence
  Description of Artificial Sequence: Synthetic coding sequence
atgcccatcagacccgacctgcagcagctggagaagtgcatcgacgacgccctgagaaagaacgacttcaagcccctgaagaccctgctgcagatcgacatctgcgaggacgtgaagatcaagtgcagcaagcagttcttccacaaggtggacaacctgatctgcagagagctgaacaaggaggacatccacaacgtgagcgccatcctggtgagcgtgggcagatgcggcaagaacatcagcgtgctgggccaggccggcctgctgaccatgatcaagcagggcctgatccagaagatggtggcctggttcgagaagagcaaggacatcatccagagccagggcaacagcaaggacgaggccgtgctgaacatgatcgaggacctggtggacctgctgctggtgatccacgacgtgagcgacgagggcaagaagcaggtggtggagagcttcgtgcccagaatctgcagcctggtgatcgacagcagagtgaacatctgcatccagcaggagatcatcaagaagatgaacgccatgctggacaagatgccccaggacgccagaaagatcctgagcaaccaggagatgctgatcctgatgagcagcatgggcgagagaatcctggacgccggcgactacgacctgcaggtgggcatcgtggaggccctgtgcagaatgaccaccgagaagcagagacaggagctggcccaccagtggttcagcatggacttcatcgccaaggccttcaagagaatcaaggacagcgagttcgagaccgactgcagaatcttcctgaacctggtgaacggcatgctgggcgacaagagaagagtgttcaccttcccctgcctgagcgccttcctggacaagtacgagctgcagatccccagcgacgagaagctggaggagttctggatcgacttcaacctgggcagccagaccctgagcttctacatcgccggcgacaacgacgaccaccagtgggaggccgtgaccgtgcccgaggagaaggtgcagatctacagcatcgaggtgagagagagcaagaagctgctgaccatcatcctgaagaacaccgtgaagatcagcaagagagagggcaaggagctgctgctgtacttcgacgccagcctggagatcaccaacgtgacccagaagatcttcggcgccaccaagcacagagagagcatcagaaagcagggcatcagcgtggccaagaccagcctgcacatcctgttcgacgccagcggcagccagatcctggtgcccgagagccagatcagccccgtgggcgaggagctggtgagcctgaaggagaagagcaagagccccaaggagttcgccaagcccagcaagtacatcaagaacagcgacaagggcaacagaaacaacagccagctggagaagaccacccccagcaagagaaagatgagcgaggccagcatgatcgtgagcggcgccgacagatacaccatgagaagccccgtgctgttcagcaacaccagcatcccccccagaagaagaagaatcaagccccccctgcagatgaccagcagcgccgagaagcccagcgtgagccagaccagcgagaacagagtggacaacgccgccagcctgaagagcagaagcagcgagggcagacacagaagagacaacatcgacaagcacatcaagaccgccaagtgcgtggagaacaccgagaacaagaacgtggagttccccaaccagaacttcagcgagctgcaggacgtgatccccgacagccaggccgccgagaagagagaccacaccatcctgcccggcgtgctggacaacatctgcggcaacaagatccacagcaagtgggcctgctggacccccgtgaccaacatcgagctgtgcaacaaccagagagccagcaccagcagcggcgacaccctgaaccaggacatcgtgatcaacaagaagctgaccaagcagaagagcagcagcagcatcagcgaccacaacagcgagggcaccggcaaggtgaagtacaagaaggagcagaccgaccacatcaagatcgacaaggccgaggtggaggtgtgcaagaagcacaaccagcagcagaaccaccccaagtacagcggccagaagaacaccgagaacgccaagcagagcgactggcccgtggagagcgagaccaccttcaagagcgtgctgctgaacaagaccatcgaggagagcctgatctacagaaagaagtacatcctgagcaaggacgtgaacaccgccacctgcgacaagaaccccagcgccagcaagaacgtgcagagccacagaaaggccgagaaggagctgaccagcgagctgaacagctgggacagcaagcagaagaagatgagagagaagagcaagggcaaggagttcaccaacgtggccgagagcctgatcagccagatcaacaagagatacaagaccaaggacgacatcaagagcaccagaaagctgaaggagagcctgatcaacagcggcttcagcaacaagcccgtggtgcagctgagcaaggagaaggtgcagaagaagagctacagaaagctgaagaccaccttcgtgaacgtgaccagcgagtgccccgtgaacgacgtgtacaacttcaacctgaacggcgccgacgaccccatcatcaagctgggcatccaggagttccaggccaccgccaaggaggcctgcgccgacagaagcatcagactggtgggccccagaaaccacgacgagctgaagagcagcgtgaagaccaaggacaagaagatcatcaccaaccaccagaagaagaacctgttcagcgacaccgagaccgagtacagatgcgacgacagcaagaccgacatcagctggctgagagagcccaagagcaagccccagctgatcgactacagcagaaacaagaacgtgaagaaccacaagagcggcaagagcagaagcagcctggagaagggccagcccagcagcaagatgacccccagcaagaacatcaccaagaagatggacaagaccatccccgagggcagaatcagactgcccagaaaggccaccaagaccaagaagaactacaaggacctgagcaacagcgagagcgagtgcgagcaggagttcagccacagcttcaaggagaacatccccgtgaaggaggagaacatccacagcagaatgaagaccgtgaagctgcccaagaagcagcagaaggtgttctgcgccgagaccgagaaggagctgagcaagcagtggaagaacagcagcctgctgaaggacgccatcagagacaactgcctggacctgagccccagaagcctgagcggcagccccagcagcatcgaggtgaccagatgcatcgagaagatcaccgagaaggacttcacccaggactacgactgcatcaccaagagcatcagcccctaccccaagaccagcagcctggagagcctgaacagcaacagcggcgtgggcggcaccatcaagagccccaagaacaacgagaagaacttcctgtgcgccagcgagagctgcagccccatccccagacccctgttcctgcccagacacacccccaccaagagcaacaccatcgtgaacagaaagaagatcagcagcctggtgctgacccaggagacccagaacagcaacagctacagcgacgtgagcagctacagcagcgaggagagattcatggagatcgagagcccccacatcaacgagaactacatccagagcaagagagaggagagccacctggccagcagcctgagcaagagcagcgagggcagagagaagacctggttcgacatgccctgcgacgccacccacgtgagcggccccacccagcacctgagcagaaagagaatctacatcgaggacaacctgagcaacagcaacgaggtggagatggaggagaagggcgagagaagagccaacctgctgcccaagaagctgtgcaagatcgaggacgccgaccaccacatccacaagatgagcgagagcgtgagcagcctgagcaccaacgacttcagcatcccctgggagacctggcagaacgagttcgccggcatcgagatgacctacgagacctacgagagactgaacagcgagttcaagagaagaaacaacatcagacacaagatgctgagctacttcaccacccagagctggaagaccgcccagcagcacctgagaaccatgaaccaccagagccaggacagcagaatcaagaagctggacaagttccagttcatcatcatcgaggagctggagaacttcgagaaggacagccagagcctgaaggacctggagaaggagttcgtggacttctgggagaagatcttccagaagttcagcgcctaccagaagagcgagcagcagagactgcacctgctgaagaccagcctggccaagagcgtgttctgcaacaccgacagcgaggagaccgtgttcaccagcgagatgtgcctgatgaaggaggacatgaaggtgctgcaggacagactgctgaaggacatgctggaggaggagctgctgaacgtgagaagagagctgatgagcgtgttcatgagccacgagagaaacgccaacgtgtag

SEQ ID NO: 101450 - DNA, 4593 bp, Artificial Sequence; identical to SEQ ID NO: 101449
  Description of Artificial Sequence: Synthetic coding sequence

SEQ ID NO: 101451 - DNA, 3072 bp, Artificial Sequence
  Description of Artificial Sequence: Synthetic coding sequence
atgcccatcagacccgacctgcagcagctggagaagtgcatcgacgacgccctgagaaagaacgacttcaagcccctgaagaccctgctgcagatcgacatctgcgaggacgtgaagatcaagtgcagcaagcagttcttccacaaggtggacaacctgatctgcagagagctgaacaaggaggacatccacaacgtgagcgccatcctggtgagcgtgggcagatgcggcaagaacatcagcgtgctgggccaggccggcctgctgaccatgatcaagcagggcctgatccagaagatggtggcctggttcgagaagagcaaggacatcatccagagccagggcaacagcaaggacgaggccgtgctgaacatgatcgaggacctggtggacctgctgctggtgatccacgacgtgagcgacgagggcaagaagcaggtggtggagagcttcgtgcccagaatctgcagcctggtgatcgacagcagagtgaacatctgcatccagcaggagatcatcaagaagatgaacgccatgctggacaagatgccccaggacgccagaaagatcctgagcaaccaggagatgctgatcctgatgagcagcatgggcgagagaatcctggacgccggcgactacgacctgcaggtgggcatcgtggaggccctgtgcagaatgaccaccgagaagcagagacaggagctggcccaccagtggttcagcatggacttcatcgccaaggccttcaagagaatcaaggacagcgagttcgagaccgactgcagaatcttcctgaacctggtgaacggcatgctgggcgacaagagaagagtgttcaccttcccctgcctgagcgccttcctggacaagtacgagctgcagatccccagcgacgagaagctggaggagttctggatcgacttcaacctgggcagccagaccctgagcttctacatcgccggcgacaacgacgaccaccagtgggaggccgtgaccgtgcccgaggagaaggtgcagatctacagcatcgaggtgagagagagcaagaagctgctgaccatcatcctgaagaacaccgtgaagatcagcaagagagagggcaaggagctgctgctgtacttcgacgccagcctggagatcaccaacgtgacccagaagatcttcggcgccaccaagcacagagagagcatcagaaagcagggcatcagcgtggccaagaccagcctgcacatcctgttcgacgccagcggcagccagatcctggtgcccgagagccagatcagccccgtgggcgaggagctggtgagcctgaaggagaagagcaagagccccaaggagttcgccaagcccagcaagtacatcaagaacagcgacaagggcaacagaaacaacagccagctggagaagaccacccccagcaagagaaagatgagcgaggccagcatgatcgtgagcggcgccgacagatacaccatgagaagccccgtgctgttcagcaacaccagcatcccccccagaagaagaagaatcaagccccccctgcagatgaccagcagcgccgagaagcccagcgtgagccagaccagcgagaacagagtggacaacgccgccagcctgaagagcagaagcagcgagggcagacacagaagagacaacatcgacaagcacatcaagaccgccaagtgcgtggagaacaccgagaacaagaacgtggagttccccaaccagaacttcagcgagctgcaggacgtgatccccgacagccaggccgccgagaagagagaccacaccatcctgcccggcgtgctggacaacatctgcggcaacaagatccacagcaagtgggcctgctggacccccgtgaccaacatcgagctgtgcaacaaccagagagccagcaccagcagcggcgacaccctgaaccaggacatcgtgatcaacaagaagctgaccaagcagaagagcagcagcagcatcagcgaccacaacagcgagggcaccggcaaggtgaagtacaagaaggagcagaccgaccacatcaagatcgacaaggccgaggtggaggtgtgcaagaagcacaaccagcagcagaaccaccccaagtacagcggccagaagaacaccgagaacgccaagcagagcgactggcccgtggagagcgagaccaccttcaagagcgtgctgctgaacaagaccatcgaggagagcctgatctacagaaagaagtacatcctgagcaaggacgtgaacaccgccacctgcgacaagaaccccagcgccagcaagaacgtgcagagccacagaaaggccgagaaggagctgaccagcgagctgaacagctgggacagcaagcagaagaagatgagagagaagagcaagggcaaggagttcaccaacgtggccgagagcctgatcagccagatcaacaagagatacaagaccaaggacgacatcaagagcaccagaaagctgaaggagagcctgatcaacagcggcttcagcaacaagcccgtggtgcagctgagcaaggagaaggtgcagaagaagagctacagaaagctgaagaccaccttcgtgaacgtgaccagcgagtgccccgtgaacgacgtgtacaacttcaacctgaacggcgccgacgaccccatcatcaagctgggcatccaggagttccaggccaccgccaaggaggcctgcgccgacagaagcatcagactggtgggccccagaaaccacgacgagctgaagagcagcgtgaagaccaaggacaagaagatcatcaccaaccaccagaagaagaacctgttcagcgacaccgagaccgagtacagatgcgacgacagcaagaccgacatcagctggctgagagagcccaagagcaagccccagctgatcgactacagcagaaacaagaacgtgaagaaccacaagagcggcaagagcagaagcagcctggagaagggccagcccagcagcaagatgacccccagcaagaacatcaccaagaagatggacaagaccatccccgagggcagaatcagactgcccagaaaggccaccaagaccaagaagtag

SEQ ID NO: 101452 - DNA, 711 bp, Artificial Sequence
  Description of Artificial Sequence: Synthetic coding sequence
atggtgagcagcggcaagaagtacagcagaaagagcggcaagcccagcgtggaggaccagttcaccagagcctacgacttcgagaccgaggacaagaaggacctgagcggcagcgaggaggacgtgatcgagggcaagaccgccgtgatcgagaagagaagaaagaagagaagcagcgccggcgtggtggaggacatgggcggcgaggtgcagaacatgctggagggcgtgggcgtggacatcaacaaggccctgctggccaagagaaagagactggagatgtacaccaaggccagcctgaagaccagcaaccagaagatcgagcacgtgtggaagacccagcaggaccagagacagaagctgaaccaggagtacagccagcagttcctgaccctgttccagcagtgggacctggacatgcagaaggccgaggagcaggaggagaagatcctgaacatgttcagacagcagcagaagatcctgcagcagagcagaatcgtgcagagccagagactgaagaccatcaagcagctgtacgagcagttcatcaagagcatggaggagctggagaagaaccacgacaacctgctgaccggcgcccagaacgagttcaagaaggagatggccatgctgcagaagaagatcatgatggagacccagcagcaggagatcgccagcgtgagaaagagcctgcagagcatgctgttctag

SEQ ID NO: 101453 - DNA, 711 bp, Artificial Sequence; identical to SEQ ID NO: 101452
  Description of Artificial Sequence: Synthetic coding sequence

SEQ ID NO: 101454 - DNA, 711 bp, Artificial Sequence; identical to SEQ ID NO: 101452
  Description of Artificial Sequence: Synthetic coding sequence

SEQ ID NO: 101455 - DNA, 942 bp, Artificial Sequence
  Description of Artificial Sequence: Synthetic coding sequence
atgctgctgctggccgacatggacgtggtgaaccagctggtggccggcggccagttcagagtggtgaaggagcccctgggcttcgtgaaggtgctgcagtgggtgttcgccatcttcgccttcgccacctgcggcagctacagcggcgagctgcagctgagcgtggactgcgccaacaagaccgagagcgacctgagcatcgaggtggagttcgagtaccccttcagactgcaccaggtgtacttcgacgcccccacctgcagaggcggcaccaccaaggtgttcctggtgggcgactacagcagcagcgccgagttcttcgtgaccgtggccgtgttcgccttcctgtacagcatgggcgccctggccacctacatcttcctgcagaacaagtacagagagaacaacaagggccccatgctggacttcctggccaccgccgtgttcgccttcatgtggctggtgagcagcagcgcctgggccaagggcctgagcgacgtgaagatggccaccgaccccgagaacatcatcaaggagatgcccgtgtgcagacagaccggcaacacctgcaaggagctgagagaccccgtgaccagcggcctgaacaccagcgtggtgttcggcttcctgaacctggtgctgtgggtgggcaacctgtggttcgtgttcaaggagaccggctgggccgcccccttcctgagagccccccccggcgcccccgagaagcagcccgcccccggcgacgcctacggcgacgccggctacggccagggccccggcggctacggcccccaggacagctacggcccccagggcggctaccagcccgactacggccagcccgccggcagcggcggcagcggctacggcccccagggcgactacggccagcagggctacggcccccagggcgcccccaccagcttcagcaaccagatgtag

SEQ ID NO: 101456 - DNA, 942 bp, Artificial Sequence; identical to SEQ ID NO: 101455
  Description of Artificial Sequence: Synthetic coding sequence

SEQ ID NO: 101457 - DNA, 588 bp, Artificial Sequence
  Description of Artificial Sequence: Synthetic coding sequence
atgggcgccctggccacctacatcttcctgcagaacaagtacagagagaacaacaagggccccatgctggacttcctggccaccgccgtgttcgccttcatgtggctggtgagcagcagcgcctgggccaagggcctgagcgacgtgaagatggccaccgaccccgagaacatcatcaaggagatgcccgtgtgcagacagaccggcaacacctgcaaggagctgagagaccccgtgaccagcggcctgaacaccagcgtggtgttcggcttcctgaacctggtgctgtgggtgggcaacctgtggttcgtgttcaaggagaccggctgggccgcccccttcctgagagccccccccggcgcccccgagaagcagcccgcccccggcgacgcctacggcgacgccggctacggccagggccccggcggctacggcccccaggacagctacggcccccagggcggctaccagcccgactacggccagcccgccggcagcggcggcagcggctacggcccccagggcgactacggccagcagggctacggcccccagggcgcccccaccagcttcagcaaccagatgtag

SEQ ID NO: 101458 - DNA, 2712 bp, Artificial Sequence
  Description of Artificial Sequence: Synthetic coding sequence
atggagggctacagcgaggaggccagcctgctgagacacctggagaaggtggccagcgaggaggaggaggtgcccctggtggtgtacctgaaggagaacgccgccctgctgaccgccaacggcctgcacctgagccagaacagagaggcccagcagagcagccccgcccccccccccgccgaggtgcacagccccgccgccgacgtgaaccagaacctggccagccccagcgccaccctgaccacccccaccagcaacagcagccacaacccccccgccaccgacgtgaaccagaacccccccgccaccgtggtgccccagagcctgcccctgagcagcatccagcagaacagcagcgaggcccagctgcccagcaacggcaccggccccgccagcaagcccagcaccctgtgcgccgacggccagccccaggcccccgccgaggaggtgagatgcagcaccctgctgatcgacaaggtgagcacccccgccaccaccaccagcaccttcagcagagaggccaccctgatccccagcagcagaccccccgccagcgacttcatgagcagcagcctgctgatcgacatccagcccaacaccctggtggtgagcgccgaccaggagatgagcggcagagccgccgccaccacccccaccaaggtgtacagcgaggtgcacttcaccctggccaagccccccagcgtggtgaacagaaccgccagacccttcggcatccaggcccccggcggcaccagccagatggagagaagccccatgctggagagaagacacttcggcgagaaggcccccgccccccagccccccagcctgcccgacagaagccccagaccccagagacacatcatgagcagaagccccatggtggagagaagaatgatgggccagagaagccccgccagcgagagaagacccctgggcaacttcaccgccccccccacctacaccgagaccctgagcaccgcccccctggccagctgggtgagaagcccccccagctacagcgtgctgtaccccagcagcgaccccaagagcagccacctgaagggccaggccgtgcccgccagcaagaccggcatcctggaggagagcatggccagaagaggcagcagaaagagcatgttcaccttcgtggagaagcccaaggtgacccccaaccccgacctgctggacctggtgcagaccgccgacgagaagagaagacagagagaccagggcgaggtgggcgtggaggaggagcccttcgccctgggcgccgaggccagcaacttccagcaggagcccgcccccagagacagagccagccccgccgccgccgaggaggtggtgcccgagtgggccagctgcctgaagagccccagaatccaggccaagcccaagcccaagcccaaccagaacctgagcgaggccagcggcaagggcgccgagctgtacgccagaagacagagcagaatggagaagtacgtgatcgagagcagcagccacacccccgagctggccagatgccccagccccaccatgagcctgcccagcagctggaagtaccccaccaacgcccccggcgccttcagagtggccagcagaagccccgccagaaccccccccgccagcctgtaccacggctacctgcccgagaacggcgtgctgagacccgagcccaccaagcagcccccctaccagctgagacccagcctgttcgtgctgagccccatcaaggagcccgccaaggtgagccccagagccgccagccccgccaagcccagcagcctggacctggtgcccaacctgcccaagggcgccctgccccccagccccgccctgcccagacccagcagaagcagccccggcctgtacaccagccccggccaggacagcctgcagcccaccgccgtgagccccccctacggcggcgacatcagccccgtgagccccagcagagcctggagccccagagccaagcaggcccccagacccagcttcagcaccagaaacgccggcatcgaggcccaggacagaagagagagcctgcccaccagccccccctggacccccggcgccagcagaccccccagcagcctggacggctgggtgagccccggcccctgggagcccggcagaggcagcagcatgagcagccccccccccctgcccccccccccccccatgagccccagctggagcgagagaagcgtgagccccctgagacccgagaccgaggccagaccccccagcagacagctgcaggccctgctggccagaaacatcatcaacgccgccagaagaaagagcgccagccccagaagcgccggcgccgagaaccccagacccttcagcccccccagagccccccccccccccccccccccccccccccccccccccagaatgagaagcccccagcccgccagacccggcagcgccgccgtgcccggcgccgccttcgcccccatccccagaagccccctgcccgccggccccagcagctgcaccagccccagaagccccctgcccgccccccccagacccttcctgtacagaagaagccccaccgacagcgacgtgagcctggacagcgaggacagcggcgccaagagccccggcatcctgggctacaacatctgccccagaggctggaacggcagcctgagactgaagagaggcagcctgcccgccgaggccagctgcaccacctag

SEQ ID NO: 101459 - DNA, 2790 bp, Artificial Sequence
  Description of Artificial Sequence: Synthetic coding sequence
atgctgggcccccacctgccccccccccccctggcccccagcgagggcagacccaccccctgcgccttccagatccccgacggcagctacagatgcctggccctggaggccgaggagagcagcggcgaggagggcctgcagggcgaggtgggccccaccgacctggaggaggacgagggcgtgagcagaagcggcgacgacagcgcctgcagagtgacccagggcaccccccagctgcccaaggccctgggcatccagccccccagctgcagcagagaggagcagggcgccagccagcacgacgacagagccagccaggactgggacgtggtgaaggccggccagatgatgaccgccagccccagccccggccccggccccagagtggcccagaagcccgccctgggcagaagcaccagcctgaccgagaaggacctgaaggaggccaaggccagaagccagcagatcgccgcccagctgaccaccccccccagcagcaacagcagaggcgtgcagctgttcaacagaagaagacagagagtgaacgagttcaccctggagagccacggccagagaggccagaagcccagccaggagagcctgagagtgctgcccagcagcctgcccggccacgcccccggcctgagcctgagcagcaccagcctgcccgagcccggcccccccagacaccccagcccccagagccccgacagaggcgtgcccggccacagcatggagggctacagcgaggaggccagcctgctgagacacctggagaaggtggccagcgaggaggaggaggtgcccctggtggtgtacctgaaggagaacgccgccctgctgaccgccaacggcctgcacctgagccagaacagagaggcccagcagagcagccccgcccccccccccgccgaggtgcacagccccgccgccgacgtgaaccagaacctggccagccccagcgccaccctgaccacccccaccagcaacagcagccacaacccccccgccaccgacgtgaaccagaacccccccgccaccgtggtgccccagagcctgcccctgagcagcatccagcagaacagcagcgaggcccagctgcccagcaacggcaccggccccgccagcaagcccagcaccctgtgcgccgacggccagccccaggcccccgccgaggaggtgagatgcagcaccctgctgatcgacaaggtgagcacccccgccaccaccaccagcaccttcagcagagaggccaccctgatccccagcagcagaccccccgccagcgacttcatgagcagcagcctgctgatcgacatccagcccaacaccctggtggtgagcgccgaccaggagatgagcggcagagccgccgccaccacccccaccaaggtgtacagcgaggtgcacttcaccctggccaagccccccagcgtggtgaacagaaccgccagacccttcggcatccaggcccccggcggcaccagccagatggagagaagccccatgctggagagaagacacttcggcgagaaggcccccgccccccagccccccagcctgcccgacagaagccccagaccccagagacacatcatgagcagaagccccatggtggagagaagaatgatgggccagagaagccccgccagcgagagaagacccctgggcaacttcaccgccccccccacctacaccgagaccctgagcaccgcccccctggccagctgggtgagaagcccccccagctacagcgtgctgtaccccagcagcgaccccaagagcagccacctgaagggccaggccgtgcccgccagcaagaccggcatcctggaggagagcatggccagaagaggcagcagaaagagcatgttcaccttcgtggagaagcccaaggtgacccccaaccccgacctgctggacctggtgcagaccgccgacgagaagagaagacagagagaccagggcgaggtgggcgtggaggaggagcccttcgccctgggcgccgaggccagcaacttccagcaggagcccgcccccagagacagagccagccccgccgccgccgaggaggtggtgcccgagtgggccagctgcctgaagagccccagaatccaggccaagcccaagcccaagcccaaccagaacctgagcgaggccagcggcaagggcgccgagctgtacgccagaagacagagcagaatggagaagtacgtgatcgagagcagcagccacacccccgagctggccagatgccccagccccaccatgagcctgcccagcagctggaagtaccccaccaacgcccccggcgccttcagagtggccagcagaagccccgccagaaccccccccgccagcctgtaccacggctacctgcccgagaacggcgtgctgagacccgagcccaccaagcagcccccctaccagctgagacccagcctgttcgtgctgagccccatcaaggagcccgccaaggtgagccccagagccgccagccccgccaagcccagcagcctggacctggtgcccaacctgcccaagggcgccctgccccccagccccgccctgcccagacccagcagaagcagccccggcctgtacaccagccccggccaggacagcctgcagcccaccgccgtgagccccccctacggcggcgacatcagccccgtgagccccagcagagcctggagccccagagccaagcaggcccccagacccagcttcagcaccagaaacgccggcatcgaggcccaggtgtggaagcccagcttctgcttcaagtag

SEQ ID NO: 101460 - DNA, 2058 bp, Artificial Sequence
  Description of Artificial Sequence: Synthetic coding sequence
atggagggctacagcgaggaggccagcctgctgagacacctggagaaggtggccagcgaggaggaggaggtgcccctggtggtgtacctgaaggagaacgccgccctgctgaccgccaacggcctgcacctgagccagaacagagaggcccagcagagcagccccgcccccccccccgccgaggtgcacagccccgccgccgacgtgaaccagaacctggccagccccagcgccaccctgaccacccccaccagcaacagcagccacaacccccccgccaccgacgtgaaccagaacccccccgccaccgtggtgccccagagcctgcccctgagcagcatccagcagaacagcagcgaggcccagctgcccagcaacggcaccggccccgccagcaagcccagcaccctgtgcgccgacggccagccccaggcccccgccgaggaggtgagatgcagcaccctgctgatcgacaaggtgagcacccccgccaccaccaccagcaccttcagcagagaggccaccctgatccccagcagcagaccccccgccagcgacttcatgagcagcagcctgctgatcgacatccagcccaacaccctggtggtgagcgccgaccaggagatgagcggcagagccgccgccaccacccccaccaaggtgtacagcgaggtgcacttcaccctggccaagccccccagcgtggtgaacagaaccgccagacccttcggcatccaggcccccggcggcaccagccagatggagagaagccccatgctggagagaagacacttcggcgagaaggcccccgccccccagccccccagcctgcccgacagaagccccagaccccagagacacatcatgagcagaagccccatggtggagagaagaatgatgggccagagaagccccgccagcgagagaagacccctgggcaacttcaccgccccccccacctacaccgagaccctgagcaccgcccccctggccagctgggtgagaagcccccccagctacagcgtgctgtaccccagcagcgaccccaagagcagccacctgaagggccaggccgtgcccgccagcaagaccggcatcctggaggagagcatggccagaagaggcagcagaaagagcatgttcaccttcgtggagaagcccaaggtgacccccaaccccgacctgctggacctggtgcagaccgccgacgagaagagaagacagagagaccagggcgaggtgggcgtggaggaggagcccttcgccctgggcgccgaggccagcaacttccagcaggagcccgcccccagagacagagccagccccgccgccgccgaggaggtggtgcccgagtgggccagctgcctgaagagccccagaatccaggccaagcccaagcccaagcccaaccagaacctgagcgaggccagcggcaagggcgccgagctgtacgccagaagacagagcagaatggagaagtacgtgatcgagagcagcagccacacccccgagctggccagatgccccagccccaccatgagcctgcccagcagctggaagtaccccaccaacgcccccggcgccttcagagtggccagcagaagccccgccagaaccccccccgccagcctgtaccacggctacctgcccgagaacggcgtgctgagacccgagcccaccaagcagcccccctaccagctgagacccagcctgttcgtgctgagccccatcaaggagcccgccaaggtgagccccagagccgccagccccgccaagcccagcagcctggacctggtgcccaacctgcccaagggcgccctgccccccagccccgccctgcccagacccagcagaagcagccccggcctgtacaccagccccggccaggacagcctgcagcccaccgccgtgagccccccctacggcggcgacatcagccccgtgagccccagcagagcctggagccccagagccaagcaggcccccagacccagcttcagcaccagaaacgccggcatcgaggcccaggtgtggaagcccagcttctgcttcaagtag

SEQ ID NO: 101461 - DNA, 2790 bp, Artificial Sequence; identical to SEQ ID NO: 101459
  Description of Artificial Sequence: Synthetic coding sequence

SEQ ID NO: 101462 - DNA, 636 bp, Artificial Sequence
  Description of Artificial Sequence: Synthetic coding sequence
atggacaacctgagcagcgaggagatccagcagagagcccaccagatcaccgacgagagcctggagagcaccagaagaatcctgggcctggccatcgagagccaggacgccggcatcaagaccatcaccatgctggacgagcagaaggagcagctgaacagaatcgaggagggcctggaccagatcaacaaggacatgagagagaccgagaagaccctgaccgagctgaacaagtgctgcggcctgtgcgtgtgcccctgcaacagaaccaagaacttcgagagcggcaaggcctacaagaccacctggggcgacggcggcgagaacagcccctgcaacgtggtgagcaagcagcccggccccgtgaccaacggccagctgcagcagcccaccaccggcgccgccagcggcggctacatcaagagaatcaccaacgacgccagagaggacgagatggaggagaacctgacccaggtgggcagcatcctgggcaacctgaaggacatggccctgaacatcggcaacgagatcgacgcccagaacccccagatcaagagaatcaccgacaaggccgacaccaacagagacagaatcgacatcgccaacgccagagccaagaagctgatcgacagctag

SEQ ID NO: 101463 - DNA, 477 bp, Artificial Sequence
  Description of Artificial Sequence: Synthetic coding sequence
atggacaacctgagcagcgaggagatccagcagagagcccaccagatcaccgacgagagcctggagagcaccagaagaatcctgggcctggccatcgagagccaggacgccggcatcaagaccatcaccatgctggacgagcagaaggagcagctgaacagaatcgaggagggcctggaccagatcaacaaggacatgagagagaccgagaagaccctgaccgagctgaacaagtgctgcggcctgtgcgtgtgcccctgcaacagcatcaccaacgacgccagagaggacgagatggaggagaacctgacccaggtgggcagcatcctgggcaacctgaaggacatggccctgaacatcggcaacgagatcgacgcccagaacccccagatcaagagaatcaccgacaaggccgacaccaacagagacagaatcgacatcgccaacgccagagccaagaagctgatcgacagctag

SEQ ID NO: 101464 - DNA, 477 bp, Artificial Sequence; identical to SEQ ID NO: 101463
  Description of Artificial Sequence: Synthetic coding sequence

SEQ ID NO: 101465 - DNA, 621 bp, Artificial Sequence
  Description of Artificial Sequence: Synthetic coding sequence
atggccgaggacgccgacatgagaaacgagctggaggagatgcagagaagagccgaccagctggccgacgagagcctggagagcaccagaagaatgctgcagctggtggaggagagcaaggacgccggcatcagaaccctggtgatgctggacgagcagggcgagcagctggagagaatcgaggagggcatggaccagatcaacaaggacatgaaggaggccgagaagaacctgaccgacctgggcaagttctgcggcctgtgcgtgtgcccctgcaacaagctgaagagcagcgacgcctacaagaaggcctggggcaacaaccaggacggcgtggtggccagccagcccgccagagtggtggacgagagagagcagatggccatcagcggcggcttcatcagaagagtgaccaacgacgccagagagaacgagatggacgagaacctggagcaggtgagcggcatcatcggcaacctgagacacatggccctggacatgggcaacgagatcgacacccagaacagacagatcgacagaatcatggagaaggccgacagcaacaagaccagaatcgacgaggccaaccagagagccaccaagatgctgggcagcggctag

SEQ ID NO: 101466 - DNA, 621 bp, Artificial Sequence
  Description of Artificial Sequence: Synthetic coding sequence
atggccgaggacgccgacatgagaaacgagctggaggagatgcagagaagagccgaccagctggccgacgagagcctggagagcaccagaagaatgctgcagctggtggaggagagcaaggacgccggcatcagaaccctggtgatgctggacgagcagggcgagcagctggacagagtggaggagggcatgaaccacatcaaccaggacatgaaggaggccgagaagaacctgaaggacctgggcaagtgctgcggcctgttcatctgcccctgcaacaagctgaagagcagcgacgcctacaagaaggcctggggcaacaaccaggacggcgtggtggccagccagcccgccagagtggtggacgagagagagcagatggccatcagcggcggcttcatcagaagagtgaccaacgacgccagagagaacgagatggacgagaacctggagcaggtgagcggcatcatcggcaacctgagacacatggccctggacatgggcaacgagatcgacacccagaacagacagatcgacagaatcatggagaaggccgacagcaacaagaccagaatcgacgaggccaaccagagagccaccaagatgctgggcagcggctag

SEQ ID NO: 101467 - DNA, 282 bp, Artificial Sequence
  Description of Artificial Sequence: Synthetic coding sequence
atggccgaggacgccgacatgagaaacgagctggaggagatgcagagaagagccgaccagctggccgacgagagcctggagagcaccagaagaatgctgcagctggtggaggagagcaaggacgccggcatcagaaccctggtgatgctggacgagcagggcgagcagctggagagaatcgaggagggcatggaccagatcaacaaggacatgaaggaggccgagaagaacctgaccgacctgggcaagttctgcggcctgtgcgtgtgcccctgcaactag

SEQ ID NO: 101468 - DNA, 1500 bp, Artificial Sequence; identical to SEQ ID NO: 98618
  Description of Artificial Sequence: Synthetic coding sequence

SEQ ID NO: 101469 - DNA, 1269 bp, Artificial Sequence
  Description of Artificial Sequence: Synthetic coding sequence
atggtgagcgagagccaccacgaggccctggccgccccccccgtgaccaccgtggccaccgtgctgcccagcaacgccaccgagcccgccagccccggcgagggcaaggaggacgccttcagcaagctgaaggagaagttcatgaacgagctgcacaagatccccctgcccccctgggccctgatcgccatcgccatcgtggccgtgctgctggtgctgacctgctgcttctgcatctgcaagaagtgcctgttcaagaagaagaacaagaagaagggcaaggagaagggcggcaagaacgccatcaacatgaaggacgtgaaggacctgggcaagaccatgaaggaccaggccctgaaggacgacgacgccgagaccggcctgaccgacggcgaggagaaggaggagcccaaggaggaggagaagctgggcaagctgcagtacagcctggactacgacttccagaacaaccagctgctggtgggcatcatccaggccgccgagctgcccgccctggacatgggcggcaccagcgacccctacgtgaaggtgttcctgctgcccgacaagaagaagaagttcgagaccaaggtgcacagaaagaccctgaaccccgtgttcaacgagcagttcaccttcaaggtgccctacagcgagctgggcggcaagaccctggtgatggccgtgtacgacttcgacagattcagcaagcacgacatcatcggcgagttcaaggtgcccatgaacaccgtggacttcggccacgtgaccgaggagtggagagacctgcagagcgccgagaaggaggagcaggagaagctgggcgacatctgcttcagcctgagatacgtgcccaccgccggcaagctgaccgtggtgatcctggaggccaagaacctgaagaagatggacgtgggcggcctgagcgacccctacgtgaagatccacctgatgcagaacggcaagagactgaagaagaagaagaccaccatcaagaagaacaccctgaacccctactacaacgagagcttcagcttcgaggtgcccttcgagcagatccagaaggtgcaggtggtggtgaccgtgctggactacgacaagatcggcaagaacgacgccatcggcaaggtgttcgtgggctacaacagcaccggcgccgagctgagacactggagcgacatgctggccaaccccagaagacccatcgcccagtggcacaccctgcaggtggaggaggaggtggacgccatgctggccgtgaagaagtag

SEQ ID NO: 101470 - DNA, 1269 bp, Artificial Sequence; identical to SEQ ID NO: 101469
  Description of Artificial Sequence: Synthetic coding sequence

SEQ ID NO: 101471 - DNA, 549 bp, Artificial Sequence
  Description of Artificial Sequence: Synthetic coding sequence
atggtgagcgagagccaccacgaggccctggccgccccccccgtgaccaccgtggccaccgtgctgcccagcaacgccaccgagcccgccagccccggcgagggcaaggaggacgccttcagcaagctgaaggagaagttcatgaacgagctgcacaagatccccctgcccccctgggccctgatcgccatcgccatcgtggccgtgctgctggtgctgacctgctgcttctgcatctgcaagaagtgcctgttcaagaagaagaacaagaagaagggcaaggagaagggcggcaagaacgccatcaacatgaaggacgtgaaggacctgggcaagaccatgaaggaccaggccctgaaggacgacgacgccgagaccggcctgaccgacggcgaggagaaggaggagcccaaggaggaggagaagctgggcaagctgcagtacagcctggactacgacttccagaacaaccagctgctggtgggcatcatccaggccgccgagctgcccgccctggacatgggcggcaccagcgacccctacgtgtag

SEQ ID NO: 101472 - DNA, 177 bp, Artificial Sequence
  Description of Artificial Sequence: Synthetic coding sequence
atggtgagcgagagccaccacgaggccctggccgccccccccgtgaccaccgtggccaccgtgctgcccagcaacgccaccgagcccgccagccccggcgagggcaaggaggacgccttcagcaagctgaaggagaagttcatgaacgagctgcacaagatccccctgcccccctag

SEQ ID NO: 101473 - DNA, 219 bp, Artificial Sequence
  Description of Artificial Sequence: Synthetic coding sequence
atggtgagcgagagccaccacgaggccctggccgccccccccgtgaccaccgtggccaccgtgctgcccagcaacgccaccgagcccgccagccccggcgagggcaaggaggacgccttcagcaagctgaaggagaagttcatgaacgagctgcacaagatccccctgcccccctgggccctgatcgccatcgccatcgtggccgtgctgctggtgtag

SEQ ID NO: 101474 - DNA, 222 bp, Artificial Sequence
  Description of Artificial Sequence: Synthetic coding sequence
atggtgagcgagagccaccacgaggccctggccgccccccccgtgaccaccgtggccaccgtgctgcccagcaacgccaccgagcccgccagccccggcgagggcaaggaggacgccttcagcaagctgaaggagaagttcatgaacgagctgcacaagatccccctgcccccctgggccctgatcgccatcgccatcgtggccgtgctgctggtgctgtag

SEQ ID NO: 101475 - DNA, 285 bp, Artificial Sequence
  Description of Artificial Sequence: Synthetic coding sequence
atggtgagcgagagccaccacgaggccctggccgccccccccgtgaccaccgtggccaccgtgctgcccagcaacgccaccgagcccgccagccccggcgagggcaaggaggacgccttcagcaagctgaaggagaagttcatgaacgagctgcacaagatccccctgcccccctgggccctgatcgccatcgccatcgtggccgtgctgctggtgctgacctgctgcttctgcatctgcaagaagtgcctgttcaagaagaagaacaagaagaagggcaagtag

SEQ ID NO: 101476 - DNA, 1269 bp, Artificial Sequence; identical to SEQ ID NO: 101469
  Description of Artificial Sequence: Synthetic coding sequence

SEQ ID NO: 101477 - DNA, 1773 bp, Artificial Sequence
  Description of Artificial Sequence: Synthetic coding sequence
atgagcggcgactacgaggacgacctgtgcagaagagccctgatcctggtgagcgacctgtgcgccagagtgagagacgccgacaccaacgacagatgccaggagttcaacgacagaatcagaggctaccccagaggccccgacgccgacatcagcgtgagcctgctgagcgtgatcgtgaccttctgcggcatcgtgctgctgggcgtgagcctgttcgtgagctggaagctgtgctgggtgccctggagagacaagggcggcagcgccgtgggcggcggccccctgagaaaggacctgggccccggcgtgggcctggccggcctggtgggcggcggcggccaccacctggccgccggcctgggcggccaccccctgctgggcggcccccaccaccacgcccacgccgcccaccacccccccttcgccgagctgctggagcccggcagcctgggcggcagcgacacccccgagcccagctacctggacatggacagctaccccgaggccgccgccgccgccgtggccgccggcgtgaagcccagccagaccagccccgagctgcccagcgagggcggcgccggcagcggcctgctgctgctgccccccagcggcggcggcctgcccagcgcccagagccaccagcaggtgaccagcctggcccccaccaccagataccccgccctgcccagacccctgacccagcagaccctgaccagccagcccgaccccagcagcgaggagagaccccccgccctgcccctgcccctgcccggcggcgaggagaaggccaagctgatcggccagatcaagcccgagctgtaccagggcaccggccccggcggcagaagaagcggcggcggccccggcagcggcgaggccggcaccggcgccccctgcggcagaatcagcttcgccctgagatacctgtacggcagcgaccagctggtggtgagaatcctgcaggccctggacctgcccgccaaggacagcaacggcttcagcgacccctacgtgaagatctacctgctgcccgacagaaagaagaagttccagaccaaggtgcacagaaagaccctgaaccccgtgttcaacgagaccttccagttcagcgtgcccctggccgagctggcccagagaaagctgcacttcagcgtgtacgacttcgacagattcagcagacacgacctgatcggccaggtggtgctggacaacctgctggagctggccgagcagccccccgacagacccctgtggagagacatcgtggagggcggcagcgagaaggccgacctgggcgagctgaacttcagcctgtgctacctgcccaccgccggcagactgaccgtgaccatcatcaaggccagcaacctgaaggccatggacctgaccggcttcagcgacccctacgtgaaggccagcctgatcagcgagggcagaagactgaagaagagaaagaccagcatcaagaagaacaccctgaaccccacctacaacgaggccctggtgttcgacgtggcccccgagagcgtggagaacgtgggcctgagcatcgccgtggtggactacgactgcatcggccacaacgaggtgatcggcgtgtgcagagtgggccccgacgccgccgacccccacggcagagagcactgggccgagatgctggccaaccccagaaagcccgtggagcactggcaccagctggtggaggagaagaccgtgaccagcttcaccaagggcagcaagggcctgagcgagaaggagaacagcgagtag

SEQ ID NO: 101478 - DNA, 1773 bp, Artificial Sequence; identical to SEQ ID NO: 101477
  Description of Artificial Sequence: Synthetic coding sequence

SEQ ID NO: 101479 - DNA, 1773 bp, Artificial Sequence; identical to SEQ ID NO: 101477
  Description of Artificial Sequence: Synthetic coding sequence

SEQ ID NO: 101480 - DNA, 1773 bp, Artificial Sequence; identical to SEQ ID NO: 101477
  Description of Artificial Sequence: Synthetic coding sequence

SEQ ID NO: 101481 - DNA, 1278 bp, Artificial Sequence
  Description of Artificial Sequence: Synthetic coding sequence
atggcccccatcaccaccagcagagaggagttcgacgagatccccaccgtggtgggcatcttcagcgccttcggcctggtgttcaccgtgagcctgttcgcctggatctgctgccagagaaagagcagcaagagcaacaagacccccccctacaagttcgtgcacgtgctgaagggcgtggacatctaccccgagaacctgaacagcaagaagaagttcggcgccgacgacaagaacgaggtgaagaacaagcccgccgtgcccaagaacagcctgcacctggacctggagaagagagacctgaacggcaacttccccaagaccaacctgaagcccggcagccccagcgacctggagaacgccacccccaagctgttcctggagggcgagaaggagagcgtgagccccgagagcctgaagagcagcaccagcctgaccagcgaggagaagcaggagaagctgggcaccctgttcttcagcctggagtacaacttcgagagaaaggccttcgtggtgaacatcaaggaggccagaggcctgcccgccatggacgagcagagcatgaccagcgacccctacatcaagatgaccatcctgcccgagaagaagcacaaggtgaagaccagagtgctgagaaagaccctggaccccgccttcgacgagaccttcaccttctacggcatcccctacacccagatccaggagctggccctgcacttcaccatcctgagcttcgacagattcagcagagacgacatcatcggcgaggtgctgatccccctgagcggcatcgagctgagcgagggcaagatgctgatgaacagagagatcatcaagagaaacgtgagaaagagcagcggcagaggcgagctgctgatcagcctgtgctaccagagcaccaccaacaccctgaccgtggtggtgctgaaggccagacacctgcccaagagcgacgtgagcggcctgagcgacccctacgtgaaggtgaacctgtaccacgccaagaagagaatcagcaagaagaagacccacgtgaagaagtgcacccccaacgccgtgttcaacgagctgttcgtgttcgacatcccctgcgagggcctggaggacatcagcgtggagttcctggtgctggacagcgagagaggcagcagaaacgaggtgatcggccagctggtgctgggcgccgccgccgagggcaccggcggcgagcactggaaggagatctgcgactaccccagaagacagatcgccaagtggcacgtgctgtgcgacggctag

SEQ ID NO: 101482 - DNA, 693 bp, Artificial Sequence
  Description of Artificial Sequence: Synthetic coding sequence
atggacctgctgagcgagaagaagcacaaggtgaagaccagagtgctgagaaagaccctggaccccgccttcgacgagaccttcaccttctacggcatcccctacacccagatccaggagctggccctgcacttcaccatcctgagcttcgacagattcagcagagacgacatcatcggcgaggtgctgatccccctgagcggcatcgagctgagcgagggcaagatgctgatgaacagagagatcatcaagagaaacgtgagaaagagcagcggcagaggcgagctgctgatcagcctgtgctaccagagcaccaccaacaccctgaccgtggtggtgctgaaggccagacacctgcccaagagcgacgtgagcggcctgagcgacccctacgtgaaggtgaacctgtaccacgccaagaagagaatcagcaagaagaagacccacgtgaagaagtgcacccccaacgccgtgttcaacgagctgttcgtgttcgacatcccctgcgagggcctggaggacatcagcgtggagttcctggtgctggacagcgagagaggcagcagaaacgaggtgatcggccagctggtgctgggcgccgccgccgagggcaccggcggcgagcactggaaggagatctgcgactaccccagaagacagatcgccaagtggcacgtgctgtgcgacggctag

SEQ ID NO: 101483 - DNA, 1476 bp, Artificial Sequence
  Description of Artificial Sequence: Synthetic coding sequence
atgcccggcgccagagacgccctgtgccaccaggccctgcagctgctggccgagctgtgcgccagaggcgccctggagcacgacagctgccaggacttcatctaccacctgagagacagagccagacccagactgagagaccccgacatcagcgtgagcctgctgaccctggtggtgaccgcctgcggcctggccctgttcggcgtgagcctgttcgtgagctggaagctgtgctgggtgccctggagagagagaggcctgcccagcggcagcaaggacaacaaccaggagcccctgaactacatggacaccgagaccaacgagcaggagaacagcgaggacttcctggacccccccaccccctgccccgacagcagcatgaagatcagccacaccagccccgacatccccctgagcacccagaccggcatccaggagaactgcgcccacggcgtgagagtgcagagacaggtgaccgagcccaccagcagcgccagacacaacagcatcagaagacagctgaacctgagcaaccccgacttcaacatccagcagctgcagaagcaggagcagctgaccggcatcggcagaatcaagcccgagctgtacaagcagagaagcctggacaacgacgacggcagaagaagcaacagcaaggcctgcggcaagctgaacttcatcctgaagtacgactgcgacctggagcagctgatcgtgaagatccacaaggccgtgaacctgcccgccaaggacttcagcggcaccagcgacccctacgtgaagatctacctgctgcccgacagaaagaccaagcaccagaccaaggtgcacagaaagaccctgaaccccgtgttcgacgaggtgttcctgttccccgtgccctacaacgacctggaggccagaaagctgcacttcagcgtgtacgacttcgacagattcagcagacacgacctgatcggccaggtggtggtggaccacttcctggacctggccgacttccccagagagtgcatcctgtggaaggacatcgagtacgtgaccaacgacaacgtggacctgggcgagctgatgttcagcctgtgctacctgcccaccgccggcagactgaccatcaccatcatcaaggccagaaacctgaaggccatggacatcaccggcgccagcgacccctacgtgaaggtgagcctgatgtgcgacggcagaagactgaagaagagaaagaccagcaccaagagaaacaccctgaaccccgtgtacaacgaggccatcgtgttcgacgtgccccccgagaacatcgaccagatccacctgagcatcgccgtgatggactacgacagagtgggccacaacgagatcatcggcgtgtgccaggtgggcaacgaggccgagagactgggcagagaccactggagcgagatgctgagctaccccagaaagcccatcgcccactggcacagcctggtggagaagagatag

SEQ ID NO: 101484 - DNA, 960 bp, Artificial Sequence
  Description of Artificial Sequence: Synthetic coding sequence
atgctggccaaggtggtggagggcgacctggccttcaagggcggcagagacatcagcgtgagcctgctgaccctggtggtgaccgcctgcggcctggccctgttcggcgtgagcctgttcgtgagctggaagctgtgctgggtgccctggagagagagaggcctgcccagcggcagcaaggacaacaaccaggagcccctgaactacatggacaccgagaccaacgagcaggagaacagcgaggacttcctggacccccccaccccctgccccgacagcagcatgaagatcagccacaccagccccgacatccccctgagcacccagaccggcatccaggagaactgcgcccacggcgtgagagtgcagagacaggtgaccgagcccaccagcagcgccagacacaacagcatcagaagacagctgaacctgagcaaccccgacttcaacatccagcagctgcagaagcaggagcagctgaccggcatcggcagaatcaagcccgagctgtacaagcagagaagcctggacaacgacgacggcagaagaagcaacagcaaggcctgcggcaagctgaacttcatcctgaagtacgactgcgacctggagcagctgatcgtgaagatccacaaggccgtgaacctgcccgccaaggacttcagcggcaccagcgacccctacgtgaagatctacctgctgcccgacagaaagaccaagcaccagaccaaggtgcacagaaagaccctgaaccccgtgttcgacgaggtgttcctgttccccgtgccctacaacgacctggaggccagaaagctgcacttcagcgtgtacgacttcgacagattcagcagacacgacctgatcggccaggtggtggtggaccacttcctggacctggccgacttccccagagagtgcatcctgtggaaggacatcgagtacgtgaccaacatcctgagctag

SEQ ID NO: 101485 - DNA, 1161 bp, Artificial Sequence
  Description of Artificial Sequence: Synthetic coding sequence
atgttccccgagccccccacccccggcccccccagccccgacaccccccccgacagcagcagaatcagccacggccccgtgcccccctgggccctggccaccatcgtgctggtgagcggcctgctgatcttcagctgctgcttctgcctgtacagaaagagctgcagaagaagaaccggcaagaagagccaggcccaggcccaggtgcacctgcaggaggtgaagggcctgggccagagctacatcgacaaggtgcagcccgaggtggaggagctggagcccgcccccagcggccccggccagcaggtggccgacaagcacgagctgggcagactgcagtacagcctggactacgacttccagagcggccagctgctggtgggcatcctgcaggccatgggcctggccgccctggacctgggcggcagcagcgacccctacgtgagagtgtacctgctgcccgacaagagaagaagatacgagaccaaggtgcacagacagaccctgaacccccacttcggcgagaccttcgccttcaaggtgccctacgtggagctgggcggcagagtgctggtgatggccgtgtacgacttcgacagattcagcagaaacgacgccatcggcgaggtgagagtgcccatgagcagcgtggacctgggcagacccgtgcaggcctggagagagctgcaggccgcccccagagaggagcaggagaagctgggcgacatctgcttcagcctgagatacgtgcccaccgccggcaagctgaccgtgatcgtgctggaggccaagaacctgaagaagatggacgtgggcggcctgagcgacccctacgtgaaggtgcacctgctgcagggcggcaagaaggtgagaaagaagaagaccaccatcaagaagaacaccctgaacccctactacaacgaggccttcagcttcgaggtgccctgcgaccaggtgcagaaggtgcaggtggagctgaccgtgctggactacgacaagctgggcaagaacgaggccatcggcagagtggccgtgggcgccgccgccggcggcgccggcctgagacactgggccgacatgctggccaaccccagaagacccatcgcccagtggcacagcctgagaccccccgacagagtgagactgctgcccgccccctag

SEQ ID NO: 101486 - DNA, 1161 bp, Artificial Sequence; identical to SEQ ID NO: 101485
  Description of Artificial Sequence: Synthetic coding sequence

SEQ ID NO: 101487 - DNA, 1149 bp, Artificial Sequence
  Description of Artificial Sequence: Synthetic coding sequence
atgaccagaggcggctgccccgtgagcgccagactgttcgcccagagaccccacggcagctggagcagcctgctgtgcgtgggcctgaagggcagactgggctgggagtggggcaccagagtgctggagtgcctgtgcagaaaggacagcagaaccccccccccctgcagcagaagcccccagcccagaggcctgcacagacccaccagactgcccacccccgtggccagcgccaccgcccaggtgcagcccgaggtggaggagctggagcccgcccccagcggccccggccagcaggtggccgacaagcacgagctgggcagactgcagtacagcctggactacgacttccagagcggccagctgctggtgggcatcctgcaggccatgggcctggccgccctggacctgggcggcagcagcgacccctacgtgagagtgtacctgctgcccgacaagagaagaagatacgagaccaaggtgcacagacagaccctgaacccccacttcggcgagaccttcgccttcaaggtgccctacgtggagctgggcggcagagtgctggtgatggccgtgtacgacttcgacagattcagcagaaacgacgccatcggcgaggtgagagtgcccatgagcagcgtggacctgggcagacccgtgcaggcctggagagagctgcaggccgcccccagagaggaggagaagctgggcgacatctgcttcagcctgagatacgtgcccaccgccggcaagctgaccgtgatcgtgctggaggccaagaacctgaagaagatggacgtgggcggcctgagcgacccctacgtgaaggtgcacctgctgcagggcggcaagaaggtgagaaagaagaagaccaccatcaagaagaacaccctgaacccctactacaacgaggccttcagcttcgaggtgccctgcgaccaggtgcagaaggtgcaggtggagctgaccgtgctggactacgacaagctgggcaagaacgaggccatcggcagagtggccgtgggcgccgccgccggcggcgccggcctgagacactgggccgacatgctggccaaccccagaagacccatcgcccagtggcacagcctgagaccccccgacagagtgagactgctgcccgccccctag

SEQ ID NO: 101488 - DNA, 1533 bp, Artificial Sequence
  Description of Artificial Sequence: Synthetic coding sequence
atgagcggcgtgtggggcgccggcggccccagatgccaggaggccctggccgtgctggccagcctgtgcagagccagacccccccccctgggcctggacgtggagacctgcagaagcttcgagctgcagccccccgagagaagccccagcgccgccggcgccggcaccagcgtgagcctgctggccgtggtggtgatcgtgtgcggcgtggccctggtggccgtgttcctgttcctgttctggaagctgtgctggatgccctggagaaacaaggaggccagcagccccagcagcgccaacccccccctggaggccctgcagagccccagcttcagaggcaacatggccgacaagctgaaggaccccagcaccctgggcttcctggaggccgccgtgaagatcagccacaccagccccgacatccccgccgaggtgcagatgagcgtgaaggagcacatcatgagacacaccagactgcagagacagaccaccgagcccgccagcagcaccagacacaccagcttcaagagacacctgcccagacagatgcacgtgagcagcgtggactacggcaacgagctgccccccgccgccgagcagcccaccagcatcggcagaatcaagcccgagctgtacaagcagaagagcgtggacggcgaggacgccaagagcgaggccaccaagagctgcggcaagatcaacttcagcctgagatacgactacgagaccgagaccctgatcgtgagaatcctgaaggccttcgacctgcccgccaaggacttctgcggcagcagcgacccctacgtgaagatctacctgctgcccgacagaaagtgcaagctgcagaccagagtgcacagaaagaccctgaaccccaccttcgacgagaacttccacttccccgtgccctacgaggagctggccgacagaaagctgcacctgagcgtgttcgacttcgacagattcagcagacacgacatgatcggcgaggtgatcctggacaacctgttcgaggccagcgacctgagcagagagaccagcatctggaaggacatccagtacgccaccagcgagagcgtggacctgggcgagatcatgttcagcctgtgctacctgcccaccgccggcagactgaccctgaccgtgatcaagtgcagaaacctgaaggccatggacatcaccggctacagcgacccctacgtgaaggtgagcctgctgtgcgacggcagaagactgaagaagaagaagaccaccatcaagaagaacaccctgaaccccgtgtacaacgaggccatcatcttcgacatcccccccgagaacatggaccaggtgagcctgctgatcagcgtgatggactacgacagagtgggccacaacgagatcatcggcgtgtgcagagtgggcatcaccgccgagggcctgggcagagaccactggaacgagatgctggcctaccccagaaagcccatcgcccactggcacagcctggtggaggtgaagaagagcttcaaggagggcaaccccagactgtag

SEQ ID NO: 101489 - DNA, 1278 bp, Artificial Sequence
  Description of Artificial Sequence: Synthetic coding sequence
atgccctggagaaacaaggaggccagcagccccagcagcgccaacccccccctggaggccctgcagagccccagcttcagaggcaacatggccgacaagctgaaggaccccagcaccctgggcttcctggaggccgccgtgaagatcagccacaccagccccgacatccccgccgaggtgcagatgagcgtgaaggagcacatcatgagacacaccagactgcagagacagaccaccgagcccgccagcagcaccagacacaccagcttcaagagacacctgcccagacagatgcacgtgagcagcgtggactacggcaacgagctgccccccgccgccgagcagcccaccagcatcggcagaatcaagcccgagctgtacaagcagaagagcgtggacggcgaggacgccaagagcgaggccaccaagagctgcggcaagatcaacttcagcctgagatacgactacgagaccgagaccctgatcgtgagaatcctgaaggccttcgacctgcccgccaaggacttctgcggcagcagcgacccctacgtgaagatctacctgctgcccgacagaaagtgcaagctgcagaccagagtgcacagaaagaccctgaaccccaccttcgacgagaacttccacttccccgtgccctacgaggagctggccgacagaaagctgcacctgagcgtgttcgacttcgacagattcagcagacacgacatgatcggcgaggtgatcctggacaacctgttcgaggccagcgacctgagcagagagaccagcatctggaaggacatccagtacgccaccagcgagagcgtggacctgggcgagatcatgttcagcctgtgctacctgcccaccgccggcagactgaccctgaccgtgatcaagtgcagaaacctgaaggccatggacatcaccggctacagcgacccctacgtgaaggtgagcctgctgtgcgacggcagaagactgaagaagaagaagaccaccatcaagaagaacaccctgaaccccgtgtacaacgaggccatcatcttcgacatcccccccgagaacatggaccaggtgagcctgctgatcagcgtgatggactacgacagagtgggccacaacgagatcatcggcgtgtgcagagtgggcatcaccgccgagggcctgggcagagaccactggaacgagatgctggcctaccccagaaagcccatcgcccactggcacagcctggtggaggtgaagaagagcttcaaggagggcaaccccagactgtag

SEQ ID NO: 101490 - DNA, 1278 bp, Artificial Sequence; identical to SEQ ID NO: 101489
  Description of Artificial Sequence: Synthetic coding sequence

SEQ ID NO: 101491 - DNA, 1533 bp, Artificial Sequence; identical to SEQ ID NO: 101488
  Description of Artificial Sequence: Synthetic coding sequence

SEQ ID NO: 101492 - DNA, 288 bp, Artificial Sequence
  Description of Artificial Sequence: Synthetic coding sequence
atgccctggagaaacaaggaggccagcagccccagcagcgccaacccccccctggaggccctgcagagccccagcttcagaggcaacatggccgacaagctgaaggaccccagcaccctgggcttcctggaggccgccgtgaagatcagccacaccagccccgacatccccgccgaggtgcagatgagcgtgaaggagcacatcatgagacacaccagactgcagagacagaccaccgagcccgccagcagcaccagacacaccagcttcaagagacacctgccctag

SEQ ID NO: 101493 - DNA, 261 bp, Artificial Sequence
  Description of Artificial Sequence: Synthetic coding sequence
atgccctggagaaacaaggaggccagcagccccagcagcgccaacccccccctggaggccctgcagagccccagcttcagaggcaacatggccgacaagctgaaggaccccagcaccctgggcttcctggaggccgccgtgaagatcagccacaccagccccgacatccccgccgaggtgcagatgagcgtgaaggagcacatcatgagacacaccagactgcagagacagaccaccgagcccgccagcagcaccagatag

SEQ ID NO: 101494 - DNA, 1212 bp, Artificial Sequence
  Description of Artificial Sequence: Synthetic coding sequence
atgtacagagaccccgaggccgccagccccggcgcccccagcagagacgtgctgctggtgagcgccatcatcaccgtgagcctgagcgtgaccgtggtgctgtgcggcctgtgccactggtgccagagaaagctgggcaagagatacaagaacagcctggagaccgtgggcacccccgacagcggcagaggcagaagcgagaagaaggccatcaagctgcccgccggcggcaaggccgtgaacaccgcccccgtgcccggccagaccccccacgacgagagcgacagaagaaccgagcccagaagcagcgtgagcgacctggtgaacagcctgaccagcgagatgctgatgctgagccccggcagcgaggaggacgaggcccacgagggctgcagcagagagaacctgggcagaatccagttcagcgtgggctacaacttccaggagagcaccctgaccgtgaagatcatgaaggcccaggagctgcccgccaaggacttcagcggcaccagcgaccccttcgtgaagatctacctgctgcccgacaagaagcacaagctggagaccaaggtgaagagaaagaacctgaacccccactggaacgagaccttcctgttcgagggcttcccctacgagaaggtggtgcagagaatcctgtacctgcaggtgctggactacgacagattcagcagaaacgaccccatcggcgaggtgagcatccccctgaacaaggtggacctgacccagatgcagaccttctggaaggacctgaagccctgcagcgacggcagcggcagcagaggcgagctgctgctgagcctgtgctacaaccccagcgccaacagcatcatcgtgaacatcatcaaggccagaaacctgaaggccatggacatcggcggcaccagcgacccctacgtgaaggtgtggctgatgtacaaggacaagagagtggagaagaagaagaccgtgaccatgaagagaaacctgaaccccatcttcaacgagagcttcgccttcgacatccccaccgagaagctgagagagaccaccatcatcatcaccgtgatggacaaggacaagctgagcagaaacgacgtgatcggcaagatctacctgagctggaagagcggccccggcgaggtgaagcactggaaggacatgatcgccagacccagacagcccgtggcccagtggcaccagctgaaggcctag

SEQ ID NO: 101495 - DNA, 1266 bp, Artificial Sequence
  Description of Artificial Sequence: Synthetic coding sequence
atggccgtggacgtggccgagtaccacctgagcgtgatcaagagcccccccggctgggaggtgggcgtgtacgccgccggcgccctggccctgctgggcatcgccgccgtgagcctgtggaagctgtggaccagcggcagcttccccagccccagccccttccccaactacgactacagatacctgcagcagaagtacggcgagagctgcgccgaggccagagagaagagagtgcccgcctggaacgcccagagagccagcaccagaggcccccccagcagaaagggcagcctgagcatcgaggacaccttcgagagcatcagcgagctgggccccctggagctgatgggcagagagctggacctggccccctacggcaccctgagaaagagccagagcgccgacagcctgaacagcatcagcagcgtgagcaacaccttcggccaggacttcaccctgggccaggtggaggtgagcatggagtacgacaccgccagccacaccctgaacgtggccgtgatgcagggcaaggacctgctggagagagaggaggccagcttcgagagctgcttcatgagagtgagcctgctgcccgacgagcagatcgtgggcatcagcagaatccagagaaacgcctacagcatcttcttcgacgagaagttcagcatccccctggaccccaccgccctggaggagaagagcctgagattcagcgtgttcggcatcgacgaggacgagagaaacgtgagcaccggcgtggtggagctgaagctgagcgtgctggacctgcccctgcagcccttcagcggctggctgtacctgcaggaccagaacaaggccgccgacgccgtgggcgagatcctgctgagcctgagctacctgcccaccgccgagagactgaccgtggtggtggtgaaggccaagaacctgatctggaccaacgacaagaccaccgccgaccccttcgtgaaggtgtacctgctgcaggacggcagaaagatgagcaagaagaagaccgccgtgaagagagacgaccccaaccccgtgttcaacgaggccatgatcttcagcgtgcccgccatcgtgctgcaggacctgagcctgagagtgaccgtggccgagagcagcagcgacggcagaggcgacaacgtgggccacgtgatcatcggccccagcgccagcggcatgggcaccacccactggaaccagatgctggccaccctgagaagacccgtgagcatgtggcacgccgtgagaagaaactag

SEQ ID NO: 101496 - DNA, 1266 bp, Artificial Sequence; identical to SEQ ID NO: 101495
  Description of Artificial Sequence: Synthetic coding sequence

SEQ ID NO: 101497 - DNA, 1266 bp, Artificial Sequence; identical to SEQ ID NO: 101495
  Description of Artificial Sequence: Synthetic coding sequence

SEQ ID NO: 101498 - DNA, 1281 bp, Artificial Sequence
  Description of Artificial Sequence: Synthetic coding sequence
atggtgctgagcgtgcccgtgatcgccctgggcgccaccctgggcaccgccaccagcatcctggccctgtgcggcgtgacctgcctgtgcagacacatgcaccccaagaagggcctgctgcccagagaccaggaccccgacctggagaaggccaagcccagcctgctgggcagcgcccagcagttcaacgtgaagaagagcaccgagcccgtgcagcccagagccctgctgaagttccccgacatctacggccccagacccgccgtgaccgcccccgaggtgatcaactacgccgactacagcctgagaagcaccgaggagcccaccgcccccgccagcccccagccccccaacgacagcagactgaagagacaggtgaccgaggagctgttcatcctgccccagaacggcgtggtggaggacgtgtgcgtgatggagacctggaaccccgagaaggccgccagctggaaccaggcccccaagctgcactactgcctggactacgactgccagaaggccgagctgttcgtgaccagactggaggccgtgaccagcaaccacgacggcggctgcgactgctacgtgcagggcagcgtggccaacagaaccggcagcgtggaggcccagaccgccctgaagaagagacagctgcacaccacctgggaggagggcctggtgctgcccctggccgaggaggagctgcccaccgccaccctgaccctgaccctgagaacctgcgacagattcagcagacacagcgtggccggcgagctgagactgggcctggacggcaccagcgtgcccctgggcgccgcccagtggggcgagctgaagaccagcgccaaggagcccagcgccggcgccggcgaggtgctgctgagcatcagctacctgcccgccgccaacagactgctggtggtgctgatcaaggccaagaacctgcacagcaaccagagcaaggagctgctgggcaaggacgtgagcgtgaaggtgaccctgaagcaccaggccagaaagctgaagaagaagcagaccaagagagccaagcacaagatcaaccccgtgtggaacgagatgatcatgttcgagctgcccgacgacctgctgcaggccagcagcgtggagctggaggtgctgggccaggacgacagcggccagagctgcgccctgggccactgcagcctgggcctgcacaccagcggcagcgagagaagccactgggaggagatgctgaagaaccccagaagacagatcgccatgtggcaccagctgcacctgtag

SEQ ID NO: 101499 - DNA, 1554 bp, Artificial Sequence
  Description of Artificial Sequence: Synthetic coding sequence
atgctgctgctgttcctgtacatcaacaagaagttctgcttcgagaacgtgggcggcttccccgacctgggcagcgagtacagcaccagaaagaacagccaggacaagatctacaacagctacatggacaaggacgagcacggcagcagcagcgagagcgaggacgaggccctgggcaagtaccacgaggccctgagcagaacccacaacagcagactgcccctggccgacagcagacagagaaactacgcctgggagaccagacagaagtacagccccctgagcgccgagtacgacggctacagcagcgaggccagcatcgacgagggcaactgcatccagagaatgagaagaaccccccccctggacgagctgcagccccccccctaccaggacgacagcggcagcccccacctgagctgcacccccagcgagatcggcgacagcaagtgcgagttcagccactgcagcaacagccccagatgcagctacaacaagtgccccagcgagggcagcaccggccacgagatcgagagcttccacaacaagggctacgaggaggacgtgcccagcgacagcaccgccgtgctgagccccgaggacatgagcgcccagggcagcagcagccagctgcccaagcccttcgaccccgagcccgaggccaagtacggcaccctggacgtgaccttcgactacgacagccaggagcagaagctgctggtgaccgtgaccgccgtgaccgacatccccacctacaacagaaccggcggcaacagctggcaggtgcacctggtgctgctgcccatcaagaagcagagagccaagaccagcatccagagaggcccctgccccgtgttcaccgagaccttcaagttcaaccacgtggagagcgagatgatcggcaactacgccgtgagattcagactgtacggcgtgcacagaatgaagaaggagaagatcgtgggcgagaagatcttctacctgaccaagctgaacctgcagggcaagatgagcctgcccgtgatcctggagcccagctacaaccacagcggctgcgacagccagatgagcgtgagcgagatgagctgcagcgagagcaccagcagctgccagagcctggagcacggcagcgtgcccgagatcctgatcggcctgctgtacaacgccaccaccggcagactgagcgccgaggtgatcaagggcagccacttcaagaacctggccgccaacagaccccccaacacctacgtgaagctgaccctgctgaacagcatgggccaggagatgagcaagtgcaagaccagcatcagaagaggccagcccaaccccgtgtacaaggagaccttcgtgttccaggtggccctgttccagctgagcgacgtgaccctgatcctgagcgtgtacaacaagagaagcatgaagagaaaggagatgatcggctggatcagcctgggcctgaacagcagcggcgaggaggagctgaaccactggaccgagatgaaggagagcaagggccagcaggtgtgcagatggcacgccctgctggagagctag

SEQ ID NO: 101500 - DNA, 1725 bp, Artificial Sequence
  Description of Artificial Sequence: Synthetic coding sequence
atggccatcgagggcggcgagagaacctgcggcgtgcacgagctgatctgcatcagaaaggtgagccccgaggccgtgggcttcctgagcgccgtgggcgtgttcatcatcctgatgctgctgctgttcctgtacatcaacaagaagttctgcttcgagaacgtgggcggcttccccgacctgggcagcgagtacagcaccagaaagaacagccaggacaagatctacaacagctacatggacaaggacgagcacggcagcagcagcgagagcgaggacgaggccctgggcaagtaccacgaggccctgagcagaacccacaacagcagactgcccctggccgacagcagacagagaaactacgcctgggagaccagacagaagtacagccccctgagcgccgagtacgacggctacagcagcgaggccagcatcgacgagggcaactgcatccagagaatgagaagaaccccccccctggacgagctgcagccccccccctaccaggacgacagcggcagcccccacctgagctgcacccccagcgagatcggcgacagcaagtgcgagttcagccactgcagcaacagccccagatgcagctacaacaagtgccccagcgagggcagcaccggccacgagatcgagagcttccacaacaagggctacgaggaggacgtgcccagcgacagcaccgccgtgctgagccccgaggacatgagcgcccagggcagcagcagccagctgcccaagcccttcgaccccgagcccgaggccaagtacggcaccctggacgtgaccttcgactacgacagccaggagcagaagctgctggtgaccgtgaccgccgtgaccgacatccccacctacaacagaaccggcggcaacagctggcaggtgcacctggtgctgctgcccatcaagaagcagagagccaagaccagcatccagagaggcccctgccccgtgttcaccgagaccttcaagttcaaccacgtggagagcgagatgatcggcaactacgccgtgagattcagactgtacggcgtgcacagaatgaagaaggagaagatcgtgggcgagaagatcttctacctgaccaagctgaacctgcagggcaagatgagcctgcccgtgatcctggagcccagctacaaccacagcggctgcgacagccagatgagcgtgagcgagatgagctgcagcgagagcaccagcagctgccagagcctggagcacggcagcgtgcccgagatcctgatcggcctgctgtacaacgccaccaccggcagactgagcgccgaggtgatcaagggcagccacttcaagaacctggccgccaacagaccccccaacggcctgttctgctgcctgaagcacctgatcggcggccaggtgtacatcatcagagacacctacgtgaagctgaccctgctgaacagcatgggccaggagatgagcaagtgcaagaccagcatcagaagaggccagcccaaccccgtgtacaaggagaccttcgtgttccaggtggccctgttccagctgagcgacgtgaccctgatcctgagcgtgtacaacaagagaagcatgaagagaaaggagatgatcggctggatcagcctgggcctgaacagcagcggcgaggaggagctgaaccactggaccgagatgaaggagagcaagggccagcaggtgtgcagatggcacgccctgctggagagctag

SEQ ID NO: 101501 - DNA, 1377 bp, Artificial Sequence
  Description of Artificial Sequence: Synthetic coding sequence
atggccatcgagggcggcgagagaacctgcggcgtgcacgagctgatctgcatcagaaaggtgagccccgaggccgtgggcttcctgagcgccgtgggcgtgttcatcatcctgatgctgctgctgttcctgtacatcaacaagaagttctgcttcgagaacgtgggcggcttccccgacctgggcagcgagtacagcaccagaaagaacagccaggacaagatctacaacagctacatggacaaggacgagcacggcagcagcagcgagagcgaggacgaggccctgggcaagtaccacgaggccctgagcagaacccacaacagcagactgcccctggccgacagcagacagagaaactacgcctgggagaccagacagaagtacagccccctgagcgccgagtacgacggctacagcagcgaggccagcatcgacgagggcaactgcatccagagaatgagaagaaccccccccctggacgagctgcagccccccccctaccaggacgacagcggcagcccccacctgagctgcacccccagcgagatcggcgacagcaagtgcgagttcagccactgcagcaacagccccagatgcagctacaacaagtgccccagcgagggcagcaccggccacgagatcgagagcttccacaacaagggctacgaggaggacgtgcccagcgacagcaccgccgtgctgagccccgaggacatgagcgcccagggcagcagcagccagctgcccaagcccttcgaccccgagcccgaggccaagtacggcaccctggacgtgaccttcgactacgacagccaggagcagaagctgctggtgaccgtgaccgccgtgaccgacatccccacctacaacagaaccggcggcaacagctggcaggtgcacctggtgctgctgcccatcaagaagcagagagccaagaccagcatccagagaggcccctgccccgtgttcaccgagaccttcaagttcaaccacgtggagagcgagatgatcggcaactacgccgtgagattcagactgtacggcgtgcacagaatgaagaaggagaagatcgtgggcgagaagatcttctacctgaccaagctgaacctgcagggcaagatgagcctgcccgtgatcctggagcccagctacaaccacagcggctgcgacagccagatgagcgtgagcgagatgagctgcagcgagagcaccagcagctgccagagcctggagcacggcagcgtgcccgagatcctgatcggcctgctgtacaacgccaccaccggcagactgagcgccgaggtgatcaagggcagccacttcaagaacctggccgccaacagaccccccaagatggactgcagcgtggtgtag

SEQ ID NO: 101502 - DNA, 1860 bp, Artificial Sequence
  Description of Artificial Sequence: Synthetic coding sequence
atggccagcgccagctggagactgaaggtggagagagagcccgtggagtacatgaacctgagcgtgctggagaagatcggctacttcagcgtggccagactggagtacagcggcaccatcctggcccactgcaacttcagactgctgggcagcaacgacagcagcgccagcgccagccaggtgaccggcaccaccgtgagccccgaggccgtgggcttcctgagcgccgtgggcgtgttcatcatcctgatgctgctgctgttcctgtacatcaacaagaagttctgcttcgagaacgtgggcggcttccccgacctgggcagcgagtacagcaccagaaagaacagccaggacaagatctacaacagctacatggacaaggacgagcacggcagcagcagcgagagcgaggacgaggccctgggcaagtaccacgaggccctgagcagaacccacaacagcagactgcccctggccgacagcagacagagaaactacgcctgggagaccagacagaagtacagccccctgagcgccgagtacgacggctacagcagcgaggccagcatcgacgagggcaactgcatccagagaatgagaagaaccccccccctggacgagctgcagccccccccctaccaggacgacagcggcagcccccacctgagctgcacccccagcgagatcggcgacagcaagtgcgagttcagccactgcagcaacagccccagatgcagctacaacaagtgccccagcgagggcagcaccggccacgagatcgagagcttccacaacaagggctacgaggaggacgtgcccagcgacagcaccgccgtgctgagccccgaggacatgagcgcccagggcagcagcagccagctgcccaagcccttcgaccccgagcccgaggccaagtacggcaccctggacgtgaccttcgactacgacagccaggagcagaagctgctggtgaccgtgaccgccgtgaccgacatccccacctacaacagaaccggcggcaacagctggcaggtgcacctggtgctgctgcccatcaagaagcagagagccaagaccagcatccagagaggcccctgccccgtgttcaccgagaccttcaagttcaaccacgtggagagcgagatgatcggcaactacgccgtgagattcagactgtacggcgtgcacagaatgaagaaggagaagatcgtgggcgagaagatcttctacctgaccaagctgaacctgcagggcaagatgagcctgcccgtgatcctggagcccagctacaaccacagcggctgcgacagccagatgagcgtgagcgagatgagctgcagcgagagcaccagcagctgccagagcctggagcacggcagcgtgcccgagatcctgatcggcctgctgtacaacgccaccaccggcagactgagcgccgaggtgatcaagggcagccacttcaagaacctggccgccaacagaccccccaacggcctgttctgctgcctgaagcacctgatcggcggccaggtgtacatcatcagagacacctacgtgaagctgaccctgctgaacagcatgggccaggagatgagcaagtgcaagaccagcatcagaagaggccagcccaaccccgtgtacaaggagaccttcgtgttccaggtggccctgttccagctgagcgacgtgaccctgatcctgagcgtgtacaacaagagaagcatgaagagaaaggagatgatcggctggatcagcctgggcctgaacagcagcggcgaggaggagctgaaccactggaccgagatgaaggagagcaagggccagcaggtgtgcagatggcacgccctgctggagagctag

SEQ ID NO: 101503 - DNA, 1668 bp, Artificial Sequence
  Description of Artificial Sequence: Synthetic coding sequence
atggccatcgagggcggcgagagaacctgcggcgtgcacgagctgatctgcatcagaaaggtgagccccgaggccgtgggcttcctgagcgccgtgggcgtgttcatcatcctgatgctgctgctgttcctgtacatcaacaagaagttctgcttcgagaacgtgggcggcttccccgacctgggcagcgagtacagcaccagaaagaacagccaggacaagatctacaacagctacatggacaaggacgagcacggcagcagcagcgagagcgaggacgaggccctgggcaagtaccacgaggccctgagcagaacccacaacagcagactgcccctggccgacagcagacagagaaactacgcctgggagaccagacagaagtacagccccctgagcgccgagtacgacggctacagcagcgaggccagcatcgacgagggcaactgcatccagagaatgagaagaaccccccccctggacgagctgcagccccccccctaccaggacgacagcggcagcccccacctgagctgcacccccagcgagatcggcgacagcaagtgcgagttcagccactgcagcaacagccccagatgcagctacaacaagtgccccagcgagggcagcaccggccacgagatcgagagcttccacaacaagggctacgaggaggacgtgcccagcgacagcaccgccgtgctgagccccgaggacatgagcgcccagggcagcagcagccagctgcccaagcccttcgaccccgagcccgaggccaagtacggcaccctggacgtgaccttcgactacgacagccaggagcagaagctgctggtgaccgtgaccgccgtgaccgacatccccacctacaacagaaccggcggcaacagctggcaggtgcacctggtgctgctgcccatcaagaagcagagagccaagaccagcatccagagaggcccctgccccgtgttcaccgagaccttcaagttcaaccacgtggagagcgagatgatcggcaactacgccgtgagattcagactgtacggcgtgcacagaatgaagaaggagaagatcgtgggcgagaagatcttctacctgaccaagctgaacctgcagggcaagatgagcctgcccgtgatcctggagcccagctacaaccacagcggctgcgacagccagatgagcgtgagcgagatgagctgcagcgagagcaccagcagctgccagagcctggagcacggcagcgtgcccgagatcctgatcggcctgctgtacaacgccaccaccggcagactgagcgccgaggtgatcaagggcagccacttcaagaacctggccgccaacagaccccccaacacctacgtgaagctgaccctgctgaacagcatgggccaggagatgagcaagtgcaagaccagcatcagaagaggccagcccaaccccgtgtacaaggagaccttcgtgttccaggtggccctgttccagctgagcgacgtgaccctgatcctgagcgtgtacaacaagagaagcatgaagagaaaggagatgatcggctggatcagcctgggcctgaacagcagcggcgaggaggagctgaaccactggaccgagatgaaggagagcaagggccagcaggtgtgcagatggcacgccctgctggagagctag

SEQ ID NO: 101504 - DNA, 1746 bp, Artificial Sequence
  Description of Artificial Sequence: Synthetic coding sequence
atggccatcgagggcggcgagagaacctgcggcgtgcacgagctgatctgcatcagaaaggtgagccccgaggccgtgggcttcctgagcgccgtgggcgtgttcatcatcctgatgctgctgctgttcctgtacatcaacaagaagttctgcttcgagaacgtgggcggcttccccgacctgggcagcgagtacagcaccagaaagaacagccaggacaagatctacaacagctacatggacaaggacgagcacggcagcagcagcgagagcgaggacgaggccctgggcaagtaccacgaggccctgagcagaacccacaacagcagactgcccctggccgacagcagacagagaaactacgcctgggagaccagacagaagtacagccccctgagcgccgagtacgacggctacagcagcgaggccagcatcgacgagggcaactgcatccagagaatgagaagaaccccccccctggacgagctgcagccccccccctaccaggacgacagcggcagcccccacctgagctgcacccccagcgagatcggcgacagcaagtgcgagttcagccactgcagcaacagccccagatgcagctacaacaagtgccccagcgagggcagcaccggccacgagatcgagagcttccacaacaagggctacgaggaggacgtgcccagcgacagcaccgccgtgctgagccccgaggacatgagcgcccagggcagcagcagccagctgcccaagcccttcgaccccgagcccgaggccaagtacggcaccctggacgtgaccttcgactacgacagccaggagcagaagctgctggtgaccgtgaccgccgtgaccgacatccccacctacaacagaaccggcggcaacagctggcaggtgcacctggtgctgctgcccatcaagaagcagagagccaagaccagcatccagagaggcccctgccccgtgttcaccgagaccttcaagttcaaccacgtggagagcgagatgatcggcaactacgccgtgagattcagactgtacggcgtgcacagaatgaagaaggagaagatcgtgggcgagaagatcttctacctgaccaagctgaacctgcagggcaagatgagcctgcccgtgatcctggagcccagctacaaccacagcggctgcgacagccagatgagcgtgagcgagatgagctgcagcgagagcaccagcagctgccagagcctggagcacggcagcgtgcccgagatcctgatcggcctgctgtacaacgccaccaccggcagactgagcgccgaggtgatcaagggcagccacttcaagaacctggccgccaacagaccccccaccttccaccccctgctgagcgacggcctgttctgctgcctgaagcacctgatcggcggccaggtgtacatcatcagagacacctacgtgaagctgaccctgctgaacagcatgggccaggagatgagcaagtgcaagaccagcatcagaagaggccagcccaaccccgtgtacaaggagaccttcgtgttccaggtggccctgttccagctgagcgacgtgaccctgatcctgagcgtgtacaacaagagaagcatgaagagaaaggagatgatcggctggatcagcctgggcctgaacagcagcggcgaggaggagctgaaccactggaccgagatgaaggagagcaagggccagcaggtgtgcagatggcacgccctgctggagagctag

SEQ ID NO: 101505 - DNA, 1554 bp, Artificial Sequence; identical to SEQ ID NO: 101499
  Description of Artificial Sequence: Synthetic coding sequence

SEQ ID NO: 101506 - DNA, 1266 bp, Artificial Sequence
  Description of Artificial Sequence: Synthetic coding sequence
atggccgagcagctggccctggtgatcggcggcaccatcggcggcctgctgctgctgctgctgatcggcgccagctgctgcctgtggagaagattctgcgccaccctgacctacgaggagctgcccggcacccccgccatggccaccaccgccgccagcagcggccagagagacagaccctgccagccccacgccagaacccagctgagcagaccccccgccgtgcccttcgtggtgccccccaccctgcagggcagagactgggtgcccctgcacagcggcgagtgggccgacgccccctgggacccctgccccgccagcgagctgctgccccacaccagcagcggcggcctgggcgacgcctgcatggtgggcgccatcaaccccgagctgtacaagttccccgaggacaagagcgagaccgacttccccgacggctgcctgggcagactgtggttcagcgtggagtacgagcaggaggccgagagactgctggtgggcctgatcaaggcccagcacctgcaggcccccagcgagacctgcagccccctggtgaagctgtacctgctgcccgacgagagaagattcctgcagagcaagaccaagagaaagaccagcaacccccagttcgacgagcacttcatcttccaggtgagcagcaagaccatcacccagagagtgctgaagttcagcgtgtaccacgtggacagacagagaaagcaccagctgctgggccaggtgctgttccccctgaagaacgagaccctggtgggcgactgcagaagagtgatctggagagacctggaggccgagagcctggagccccccagcgagttcggcgacctgcagttctgcctgagctacaacgactacctgagcagactgaccgtggtggtgctgagagccaagggcctgagactgcaggaggacagaggcatcgtgagcgtgttcgtgaaggtgagcctgatgaaccacaacaagttcgtgaagtgcaagaagaccagcgccgtgctgggcagcatcaaccccgtgtacaacgagaccttcagcttcaaggccgacgccaccgagctggacaccgccagcctgagcctgaccgtggtgcagaacatggagggcgacaagagccagcagctgggcagagtggtggtgggcccctacatgtacaccagaggcagagagctggagcactgggacgagatgctgagcaagcccaaggagctggtgaagagatggcacgccctgtgcagaaccaccgagccctag

SEQ ID NO: 101507 - DNA, 1425 bp, Artificial Sequence
  Description of Artificial Sequence: Synthetic coding sequence
atgggcgtggtgctgagcccccaccccgcccccagcagaagagagcccctggcccccctggcccccggcaccagacccggctggagccccgccgtgagcggcagcagcagaagcgccctgagacccagcaccgccggccccggccccggccccggcaccggctggggcggcaccgccgccagcggcagatgggtgcccgcccccgccgtgcactgcgccgcccccagagccgccgccggccaccagcagcaccacggcccccccctgtgcagccccgacggcgcccccagaagattcaagagaagacccggcagccccgcccccgccgcccagaccggcgagaccagcctgagagagcagccccacggcggcccccccgccgtgcccttcgtggtgccccccaccctgcagggcagagactgggtgcccctgcacagcggcgagtgggccgacgccccctgggacccctgccccgccagcgagctgctgccccacaccagcagcggcggcctgggcgacgcctgcatggtgggcgccatcaaccccgagctgtacaagttccccgaggacaagagcgagaccgacttccccgacggctgcctgggcagactgtggttcagcgtggagtacgagcaggaggccgagagactgctggtgggcctgatcaaggcccagcacctgcaggcccccagcgagacctgcagccccctggtgaagctgtacctgctgcccgacgagagaagattcctgcagagcaagaccaagagaaagaccagcaacccccagttcgacgagcacttcatcttccaggtgagcagcaagaccatcacccagagagtgctgaagttcagcgtgtaccacgtggacagacagagaaagcaccagctgctgggccaggtgctgttccccctgaagaacgagaccctggtgggcgactgcagaagagtgatctggagagacctggaggccgagagcctggagccccccagcgagttcggcgacctgcagttctgcctgagctacaacgactacctgagcagactgaccgtggtggtgctgagagccaagggcctgagactgcaggaggacagaggcatcgtgagcgtgttcgtgaaggtgagcctgatgaaccacaacaagttcgtgaagtgcaagaagaccagcgccgtgctgggcagcatcaaccccgtgtacaacgagaccttcagcttcaaggccgacgccaccgagctggacaccgccagcctgagcctgaccgtggtgcagaacatggagggcgacaagagccagcagctgggcagagtggtggtgggcccctacatgtacaccagaggcagagagctggagcactgggacgagatgctgagcaagcccaaggagctggtgaagagatggcacgccctgtgcagaaccaccgagccctag

SEQ ID NO: 101508 - DNA, 1173 bp, Artificial Sequence
  Description of Artificial Sequence: Synthetic coding sequence
atggccgagcagctggccctggtgatcggcggcaccatcggcggcctgctgctgctgctgctgatcggcgccagctgctgcctgtggagaagattctgcgccaccctgacctacgaggagctgcccggcacccccgccatggccaccaccgccgccagcagcggccagagagacagaccctgccagccccacgccagaacccagctgagcagaccccccgccgtgcccttcgtggtgccccccaccctgcagggcagagactgggtgcccctgcacagcggcgagtgggccgacgccccctgggacccctgccccgccagcgagctgctgccccacaccagcagcggcggcctgggcgacgcctgcatggtgggcgccatcaaccccgagctgtacaagttccccgaggacaagagcgagaccgacttccccgacggctgcctgggcagactgtggttcagcgtggagtacgagcaggaggccgagagactgctggtgggcctgatcaaggcccagcacctgcaggcccccagcgagacctgcagccccctggtgaagctgtacctgctgcccgacgagagaagattcctgcagagcaagaccaagagaaagaccagcaacccccagttcgacgagcacttcatcttccaggtgagcagcaagaccatcacccagagagtgctgaagttcagcgtgtaccacgtggacagacagagaaagcaccagctgctgggccaggtgctgttccccctgaagaacgagaccctggtgggcgactgcagaagagtgatctggagagacctggaggccgagagcctggagccccccagcgagttcggcgacctgcagttctgcctgagctacaacgactacctgagcagactgaccgtggtggtgctgagagccaagggcctgagactgcaggaggacagaggcatcgtgagcgtgttcgtgaaggtgagcctgatgaaccacaacaagttcgtgaagtgcaagaagaccagcgccgtgctgggcagcatcaaccccgtgtacaacgagaccttcagcttcaaggccgacgccaccgagctggacaccgccagcctgagcctgaccgtggtgcagaacatggagggcgacaagcaggccaccaccgtggagctgttcctgttccacctgaccagcggctag

SEQ ID NO: 101509 - DNA, 543 bp, Artificial Sequence
  Description of Artificial Sequence: Synthetic coding sequence
gacgagcacttcatcttccaggtgagcagcaagaccatcacccagagagtgctgaagttcagcgtgtaccacgtggacagacagagaaagcaccagctgctgggccaggtgctgttccccctgaagaacgagaccctggtgggcgactgcagaagagtgatctggagagacctggaggccgagagcctggagccccccagcgagttcggcgacctgcagttctgcctgagctacaacgactacctgagcagactgaccgtggtggtgctgagagccaagggcctgagactgcaggaggacagaggcatcgtgagcgtgttcgtgaaggtgagcctgatgaaccacaacaagttcgtgaagtgcaagaagaccagcgccgtgctgggcagcatcaaccccgtgtacaacgagaccttcagcttcaaggccgacgccaccgagctggacaccgccagcctgagcctgaccgtggtgcagaacatggagggcgacaagcaggccaccaccgtggagctgttcctgttccacctgaccagcggctag

SEQ ID NO: 101510 - DNA, 783 bp, Artificial Sequence
  Description of Artificial Sequence: Synthetic coding sequence
atggtgggcgccatcaaccccgagctgtacaagttccccgaggacaagagcgagacctgcagccccctggtgaagctgtacctgctgcccgacgagagaagattcctgcagagcaagaccaagagaaagaccagcaacccccagttcgacgagcacttcatcttccaggtgagcagcaagaccatcacccagagagtgctgaagttcagcgtgtaccacgtggacagacagagaaagcaccagctgctgggccaggtgctgttccccctgaagaacgagaccctggtgggcgactgcagaagagtgatctggagagacctggaggccgagagcctggagccccccagcgagttcggcgacctgcagttctgcctgagctacaacgactacctgagcagactgaccgtggtggtgctgagagccaagggcctgagactgcaggaggacagaggcatcgtgagcgtgttcgtgaaggtgagcctgatgaaccacaacaagttcgtgaagtgcaagaagaccagcgccgtgctgggcagcatcaaccccgtgtacaacgagaccttcagcttcaaggccgacgccaccgagctggacaccgccagcctgagcctgaccgtggtgcagaacatggagggcgacaagagccagcagctgggcagagtggtggtgggcccctacatgtacaccagaggcagagagctggagcactgggacgagatgctgagcaagcccaaggagctggtgaagagatggcacgccctgtgcagaaccaccgagccctag

SEQ ID NO: 101511 - DNA, 1047 bp, Artificial Sequence
  Description of Artificial Sequence: Synthetic coding sequence
atggccgagcagctggccctggtgatcggcggcaccatcggcggcctgctgctgctgctgctgatcggcgccagctgctgcctgtggagaagattctgcgccaccctgacctacgaggagctgcccggcacccccgccatggccaccaccgccgccagcagcggccagagagacagaccctgccagccccacgccagaacccagctgagcagaccccccgccgtgcccttcgtggtgccccccaccctgcagggcagagactgggtgcccctgcacagcggcgagtgggccgacgccccctgggacccctgccccgccagcgagctgctgccccacaccagcagcggcggcctgggcgacgcctgcatggtgggcgccatcaaccccgagctgtacaagttccccgaggacaagagcgagaccgacttccccgacggctgcctgggcagactgtggttcagcgtggagtacgagcaggaggccgagagactgctggtgggcctgatcaaggcccagcacctgcaggcccccagcgagacctgcagccccctggtgaagctgtacctgctgcccgacgagagaagattcctgcagagcaagaccaagagaaagaccagcaacccccagttcgacgagcacttcatcttccaggtgagcagcaagaccatcacccagagagtgctgaagttcagcgtgtaccacgtggacagacagagaaagcaccagctgctgggccaggtgctgttccccctgaagaacgagaccctggtgggcgactgcagaagagtgatctggagagacctggaggccgagagcctggagccccccagcgagttcggcgacctgcagttctgcctgagctacaacgactacctgagcagactgaccgtggtggtgctgagagccaagggcctgagactgcaggaggacagaggcatcgtgagcgtgttcgtgaaggtgagcctgatgaaccacaacaagttcgccaagtgcaagcccggccccgacctgggcgaggagagcagaggcagcctgaacctgaagtag

SEQ ID NO: 101512 - DNA, 1173 bp, Artificial Sequence; identical to SEQ ID NO: 101508
  Description of Artificial Sequence: Synthetic coding sequence

SEQ ID NO: 101513 - DNA, 1152 bp, Artificial Sequence
  Description of Artificial Sequence: Synthetic coding sequence
atggtgctggccatggccagccaggacgtgcagaacttcttccagcccttcagcagctggatcagcagagtgtacgaggccctgcagcaggccggcgacatgctgagcgccagcctggtgaacatcagcaagcaggacagcaagctgagcgacaagctggaccaggacctggacaacatccagatccaggagacctacttcgaggacgaggagcaggacaacgactggagccaggaggacgccaacagcctgttcctggaggtggaccacttcagctgctgcaacagcgacctgcaggacagcgcccagaacagcagccccagcctgagccagcacgccaaggacagctgcagcaccatgagccagtggcccaactgggccagcgacgacagaaagctgccccacgtgctgagcagcatcgccgaggaggagcaccacctggagaagcagagaagcggcctgcagcacggcttcgacagccagctgcccggcaccctggagaccgtgaacggcaagaagcaggtgaacagcttcggcgacgacgaggagctgagcaccagcagcgacagcgacgaggaggtgatcaagcagttcgagatcagcgtgagcagaagccagagcttcagaagcgtgaccagcgagaagggcaagcagaccggcctggagcagaagcccaagttcagcagaagcctgctgacccacggcgaggacggcaccgaggtgagcgcctgcgaggacctggacggcgccagccagagaagatacagcgagaacctgagctacggcgaggacgaccacatccccgcccacagccagagcccctgcgagagaggcgacgccaagcaccacggcaccagccaccaggagagcagcgtggtgcagagcctgagaagacagagcaccgagggcagcctggagatggagaccgccttcaacagcagaggcttcgaggacagctacgccaccgacagcagcagcatgtggagccccgaggccaacctgaacctgaagagaaagggctacctgctggacgtgtactgcctgagcagccccctgctgttcaccaccagcctgcacagaagaaacagaaccggccccatctgcagatgccaccccggcagccagagccccagccagagcgtggtgacctag

SEQ ID NO: 101514 - DNA, 1938 bp, Artificial Sequence
  Description of Artificial Sequence: Synthetic coding sequence
atggtgctggccatggccagccaggacgtgcagaacttcttccagcccttcagcagctggatcagcagagtgtacgaggccctgcagcaggccggcgacatgctgagcgccagcctggtgaacatcagcaagcaggacagcaagctgagcgacaagctggaccaggacctggacaacatccagatccaggagacctacttcgaggacgaggagcaggacaacgactggagccaggaggacgccaacagcctgttcctggaggtggaccacttcagctgctgcaacagcgacctgcaggacagcgcccagaacagcagccccagcctgagccagcacgccaaggacagctgcagcaccatgagccagtggcccaactgggccagcgacgacagaaagctgccccacgtgctgagcagcatcgccgaggaggagcaccacctggagaagcagagaagcggcctgcagcacggcttcgacagccagctgcccggcaccctggagaccgtgaacggcaagaagcaggtgaacagcttcggcgacgacgaggagctgagcaccagcagcgacagcgacgaggaggtgatcaagcagttcgagatcagcgtgagcagaagccagagcttcagaagcgtgaccagcgagaagggcaagcagaccggcctggagcagaagcccaagttcagcagaagcctgctgacccacggcgaggacggcaccgaggtgagcgcctgcgaggacctggacggcgccagccagagaagatacagcgagaacctgagctacggcgaggacgaccacatccccgcccacagccagagcccctgcgagagaggcgacgccaagcaccacggcaccagccaccaggagagcagcgtggtgcagagcctgagaagacagagcaccgagggcagcctggagatggagaccgccttcaacagcagaggcttcgaggacagctacgccaccgacagcagcagcatgtggagccccgaggagcaggacagaaccaacctgcaggtgcccagcggcgtgagcgagcccatcagcaagtgcggcgacctggacgtgatcttcgagtacagagccgccagccagaagctgaccgtgaccatcgtgagagcccagggcctgcccgacaaggacagaagcggcgtgaacagctggcaggtgcacgtggtgctgctgcccggcaagaagcacagaggcagaaccaacatccagagaggccccaaccccgtgttcagagagaaggtgaccttcgccaagctggagcccagagacgtggccgcctgcgccgtgagattcagactgtacgccgccagaaagatgaccagagagagaatgatgggcgagaagctgttctacctgagccacctgcaccccgagggcgagatgaaggtgaccctggtgctggagcccagaagcaacatcagcagcggcggcagccccctgagccccagcgccgtgagccacagcgacagcaccagcagcacccagagcctgagccacggcggcgcccccgagctgctggtgggcctgagctacaacgccaccaccggcagactgagcgtggagatgatcaagggcagccacttcagaaacctggccgtgaacagagcccccgacacctacggcaagctgttcctgctgaacagcgtgggccaggagatgagcagatgcaagaccagcatcagaagaggccagcccaaccccgtgtacaaggagaccttcgtgttccaggtggccctgttccagctgagcgacgtgaccctgatgatcagcgtgtacaacagaagaaccatgaagagaaaggagatgatcggctggatcgccctgggccagaacagcagcggcgaggaggagcaggaccactgggaggagatgaaggagaccaagggccagcagatctgcagatggcacaccctgctggagagctag

SEQ ID NO: 101515 - DNA, 1653 bp, Artificial Sequence
  Description of Artificial Sequence: Synthetic coding sequence
atgccccagagaggccaccccagccaggagggcctgtgggccctgcccagcctgcccatggcccacggccccaagcccgagaccgagggcctgctggacctgagcttcctgaccgaggaggagcaggaggccatcgccggcgtgctgcagagagacgccagactgagacagctggaggagggcagagtgagcaagctgagagccagcgtggccgaccccggccagctgaagatcctgaccggcgactggttccaggaggccagaagccagagacaccacaacgcccacttcggcagcgacctggtgagagccagcatgagaagaaagaagagcaccagaggcgaccaggcccccggccacgacagagaggccgaggccgccgtgaaggagaaggaggagggccccgagcccagactgaccatcgacgaggccccccaggagagactgagagagaccgaggccagcgaccccgaggaggccagccaggcccaggaggaccccggccagggcgaccagcaggtgtgcgccgaggaggccgaccccgagctggagcccgccagcggcggcgagcaggagcccagaccccagcaggcccagaccaaggccgccagccagatcctggagaacggcgaggaggcccccggccccgaccccagcctggacagaatgctgagcagcagcagcagcgtgagcagcctgaacagcagcaccctgagcggcagccagatgagcctgagcggcgacgccgaggccgtgcaggtgagaggcagcgtgcacttcgccctgcactacgagcccggcgccgccgagctgagagtgcacgtgatccagtgccagggcctggccgccgccagaagaagaagaagcgacccctacgtgaagagctacctgctgcccgacaagcagagcaagagaaagaccgccgtgaagaagagaaacctgaaccccgtgttcaacgagaccctgagatacagcgtgccccaggccgagctgcagggcagagtgctgagcctgagcgtgtggcacagagagagcctgggcagaaacatcttcctgggcgaggtggaggtgcccctggacacctgggactggggcagcgagcccacctggctgcccctgcagcccagagtgccccccagccccgacgacctgcccagcagaggcctgctggccctgagcctgaagtacgtgcccgccggcagcgagggcgccggcctgccccccagcggcgagctgcacttctgggtgaaggaggccagagacctgctgcccctgagagccggcagcctggacacctacgtgcagtgcttcgtgctgcccgacgacagccaggccagcagacagagaaccagagtggtgagaagaagcctgagccccgtgttcaaccacaccatggtgtacgacggcttcggccccgccgacctgagacaggcctgcgccgagctgagcctgtgggaccacggcgccctggccaacagacagctgggcggcaccagactgagcctgggcaccggcagcagctacggcctgcaggtgccctggatggacagcacccccgaggagaagcagctgtggcaggccctgctggagcagccctgcgagtgggtggacggcctgctgcccctgagaaccaacctggcccccagaacctag

SEQ ID NO: 101516 - DNA, 231 bp, Artificial Sequence
  Description of Artificial Sequence: Synthetic coding sequence
atgccccagagaggccaccccagccaggagggcctgtgggccctgcccagcctgcccatggcccacggccccaagcccgagaccgagggcctgctggacctgagcttcctgaccgaggaggagcaggaggccatcgccggcgtgctgcagagagacgccagactgagacagctggaggagggcagagtgagcaagctgagagccagcgtggccgaccccggccagctgtag

SEQ ID NO: 101517 - DNA, 1065 bp, Artificial Sequence
  Description of Artificial Sequence: Synthetic coding sequence
atgccccagagaggccaccccagccaggagggcctgtgggccctgcccagcctgcccatggcccacggccccaagcccgagaccgagggcctgctggacctgagcttcctgaccgaggaggagcaggaggccatcgccggcgtgctgcagagagacgccagactgagacagctggaggagggcagagtgagcaagctgagagccagcgtggccgaccccggccagctgaagatcctgaccggcgactggttccaggaggccagaagccagagacaccacaacgcccacttcggcagcgacctggtgagagccagcatgagaagaaagaagagcaccagaggcgaccaggcccccggccacgacagagaggccgaggccgccgtgaaggagaaggaggagggccccgagcccagactgaccatcgacgaggccccccaggagagactgagagagaccgagggccccgacttccccagccccagcgtgcccctgaaggccagcgaccccgaggaggccagccaggcccaggaggaccccggccagggcgaccagcaggtgtgcgccgaggaggccgaccccgagctggagcccgccagcggcggcgagcaggagcccagaccccagcaggcccaggtgggcggcagcggcccctggctgctgagcaccagcggcgccgacagcggcagaggcgccctgctgcccagagccgccagcagacccagacccagagccctgggcgccggcgtgggcaaggagggcgcccccagacacctgccccccctgcagaccaaggccgccagccagatcctggagaacggcgaggaggcccccggccccgaccccagcctggacagaatgctgagcagcagcagcagcgtgagcagcctgaacagcagcaccctgagcggcagccagatgagcctgagcggcgacgccgaggccgtgcaggtgagaggcagcgtgcacttcgccctgcactacgagcccggcgccgccgagctgagagtgcacgtgatccagtgccagggcctggccgccgccagaagaagaagaagcgacccctag

SEQ ID NO: 101518 - DNA, 606 bp, Artificial Sequence
  Description of Artificial Sequence: Synthetic coding sequence
atgggcaccaccgccctgctgggcggcgtgagactgagcgagaccatccccgtgaagagactggccagaggcctggccagagtgagagacggcggctggggcagcccccaggccggcgagaaggccctgggcggccccctgctgaccagcggcagccacctgcccagctacgtgaagagctacctgctgcccgacaagcagagcaagagaaagaccgccgtgaagaagagaaacctgaaccccgtgttcaacgagaccctgagatacagcgtgccccaggccgagctgcagggcagagtgctgagcctgagcgtgtggcacagagagagcctgggcagaaacatcttcctgggcgaggtggaggtgcccctggacacctgggactggggcagcgagcccacctggctgcccctgcagcccagagtgccccccagccccgacgacctgcccagcagaggcctgctggccctgagcctgaagtacgtgcccgccggcagcgagggcgccggcctgccccccagcggcgagctgcacttctgggtgaaggaggccagagacctgctgcccctgagagccggcagcctggacacctacgtgcagtggtag

SEQ ID NO: 101519 - DNA, 1083 bp, Artificial Sequence
  Description of Artificial Sequence: Synthetic coding sequence
atgccccagagaggccaccccagccaggagggcctgtgggccctgcccagcctgcccatggcccacggccccaagcccgagaccgagggcctgctggacctgagcttcctgaccgaggaggagcaggaggccatcgccggcgtgctgcagagagacgccagactgagacagctggaggagggcagagtgagcaagctgagagccagcgtggccgaccccggccagctgaagatcctgaccggcgactggttccaggaggccagaagccagagacaccacaacgcccacttcggcagcgacctggtgagagccagcatgagaagaaagaagagcaccagaggcgaccaggcccccggccacgacagagaggccgaggccgccgtgaaggagaaggaggagggccccgagcccagactgaccatcgacgaggccccccaggagagactgagagagaccgagggccccgacttccccagccccagcgtgcccctgaaggccagcgaccccgaggaggccagccaggcccaggaggaccccggccagggcgaccagcaggtgtgcgccgaggaggccgaccccgagctggagcccgccagcggcggcgagcaggagcccagaccccagcaggcccaggtgggcggcagcggcccctggctgctgagcaccagcggcgccgacagcggcagaggcgccctgctgcccagagccgccagcagacccagacccagagccctgggcgccggcgtgggcaaggagggcgcccccagacacctgccccccctgcagaccaaggccgccagccagatcctggagaacggcgaggaggcccccggccccgaccccagcctggacagaatgctgagcagcagcagcagcgtgagcagcctgaacagcagcaccgtgagaagagagggcggcgaccccggcggcagaggcgtggaccccttcagatgcgtggcccccgcctgccccagcctggccgccggccccaccgccgccgccccccagcccgccacctacgaccccggcctgaagccccccagatgccccagacccagaagagagccctgcgagagaccctag

SEQ ID NO: 101520 - DNA, 879 bp, Artificial Sequence
  Description of Artificial Sequence: Synthetic coding sequence
tgacccagaccccagcaggcccaggtgggcggcagcggcccctggctgctgagcaccagcggcgccgacagcggcagaggcgccctgctgcccagagccgccagcagacccagacccagagccctgggcgccggcgtgggcaaggagggcgcccccagacacctgccccccctgcagaccaaggccgccagccagatcctggagaacggcgaggaggcccccggccccgaccccagcctggacagaatgctgagcagcagcagcagcgtgagcagcctgaacagcagcaccctgagcggcagccagatgagcctgagcggcgacgccgaggccgtgcaggtgagaggcagcgtgcacttcgccctgcactacgagcccggcgccgccgagctgagagtgcacgtgatccagtgccagggcctggccgccgccagaagaagaagaagcgacccctacgtgaagagctacctgctgcccgacaagcagagcaagagaaagaccgccgtgaagaagagaaacctgaaccccgtgttcaacgagaccctgagatacagcgtgccccaggccgagctgcagggcagagtgctgagcctgagcgtgtggcacagagagagcctgggcagaaacatcttcctgggcgaggtggaggtgcccctggacacctgggactggggcagcgagcccacctggctgcccctgcagcccagagtgccccccagccccgacgacctgcccagcagaggcctgctggccctgagcctgaagtacgtgcccgccggcagcgagggcgccggcctgccccccagcggcgagctgcacttctgggtgaaggaggccagagacctgctgcccctgagagccggcagcctggacacctag

SEQ ID NO: 101521 - DNA, 1689 bp, Artificial Sequence
  Description of Artificial Sequence: Synthetic coding sequence
atgccccagagaggccaccccagccaggagggcctgtgggccctgcccagcctgcccatggcccacggccccaagcccgagaccgagggcctgctggacctgagcttcctgaccgaggaggagcaggaggccatcgccggcgtgctgcagagagacgccagactgagacagctggaggagggcagagtgagcaagctgagagccagcgtggccgaccccggccagctgaagatcctgaccggcgactggttccaggaggccagaagccagagacaccacaacgcccacttcggcagcgacctggtgagagccagcatgagaagaaagaagagcaccagaggcgaccaggcccccggccacgacagagaggccgaggccgccgtgaaggagaaggaggagggccccgagcccagactgaccatcgacgaggccccccaggagagactgagagagaccgagggccccgacttccccagccccagcgtgcccctgaaggccagcgaccccgaggaggccagccaggcccaggaggaccccggccagggcgaccagcaggtgtgcgccgaggaggccgaccccgagctggagcccgccagcggcggcgagcaggagcccagaccccagcaggcccagaccaaggccgccagccagatcctggagaacggcgaggaggcccccggccccgaccccagcctggacagaatgctgagcagcagcagcagcgtgagcagcctgaacagcagcaccctgagcggcagccagatgagcctgagcggcgacgccgaggccgtgcaggtgagaggcagcgtgcacttcgccctgcactacgagcccggcgccgccgagctgagagtgcacgtgatccagtgccagggcctggccgccgccagaagaagaagaagcgacccctacgtgaagagctacctgctgcccgacaagcagagcaagagaaagaccgccgtgaagaagagaaacctgaaccccgtgttcaacgagaccctgagatacagcgtgccccaggccgagctgcagggcagagtgctgagcctgagcgtgtggcacagagagagcctgggcagaaacatcttcctgggcgaggtggaggtgcccctggacacctgggactggggcagcgagcccacctggctgcccctgcagcccagagtgccccccagccccgacgacctgcccagcagaggcctgctggccctgagcctgaagtacgtgcccgccggcagcgagggcgccggcctgccccccagcggcgagctgcacttctgggtgaaggaggccagagacctgctgcccctgagagccggcagcctggacacctacgtgcagtgcttcgtgctgcccgacgacagccaggccagcagacagagaaccagagtggtgagaagaagcctgagccccgtgttcaaccacaccatggtgtacgacggcttcggccccgccgacctgagacaggcctgcgccgagctgagcctgtgggaccacggcgccctggccaacagacagctgggcggcaccagactgagcctgggcaccggcagcagctacggcctgcaggtgccctggatggacagcacccccgaggagaagcagctgtggcaggccctgctggagcagccctgcgagtgggtggacggcctgctgcccctgagaaccaacctggcccccagaacctag

SEQ ID NO: 101522 - DNA, 2808 bp, Artificial Sequence
  Description of Artificial Sequence: Synthetic coding sequence
atgatcgacctgagcttcctgaccgaggaggagcaggaggccatcatgaaggtgctgcagagagacgccgccctgaagagagccgaggaggagagagtgagacacctgcccgagaagatcaaggacgaccagcagctgaagaacatgagcggccagtggttctacgaggccaaggccaagagacacagagacaagatccacggcgccgacatcatcagagccagcatgagaaagaagagaccccagatcgccgccgagcagagcaaggacagagagaacggcgccaaggagagctgggtgaacaacgtgaacaaggacgccttcctgccccccgagctggccggcgtggtggaggagcccgaggaggacgccgcccccgccagccccagcagcagcgtggtgaaccccgccagcagcgtgatcgacatgagccaggagaacaccagaaagcccaacgtgagccccgagaagcagagaaagaaccccttcaacagcagcaagctgcccgagggccacagcagccagcagaccaagaacgagcagagcaagaacggcagaaccggcctgttccagaccagcaaggaggacgagctgagcgagagcaaggagaagagcaccgtggccgacaccagcatccagaagctggagaagagcaagcagaccctgcccggcctgagcaacggcagccagatcaaggcccccatccccaaggccagaaagatgatctacaagagcaccgacctgaacaaggacgacaaccagagcttccccagacagagaaccgacagcctgaaggccagaggcgcccccagaggcatcctgaagagaaacagcagcagcagcagcaccgacagcgagaccctgagatacaaccacaacttcgagcccaagagcaagatcgtgagccccggcctgaccatccacgagagaatcagcgagaaggagcacagcctggaggacaacagcagccccaacagcctggagcccctgaagcacgtgagattcagcgccgtgaaggacgagctgccccagagccccggcctgatccacggcagagaggtgggcgagttcagcgtgctggagagcgacagactgaagaacggcatggaggacgccggcgacaccgaggagttccagagcgaccccaagcccagccagtacagaaagcccagcctgttccaccagagcaccagcagcccctacgtgagcaagagcgagacccaccagcccatgaccagcggcagcttccccatcaacggcctgcacagccacagcgaggtgctgaccgccagaccccagagcatggagaacagccccaccatcaacgagcccaaggacaagagcagcgagctgaccagactggagagcgtgctgcccagaagccccgccgacgagctgagccactgcgtggagcccgagcccagccaggtgcccggcggcagcagcagagacagacagcagggcagcgaggaggagcccagccccgtgctgaagaccctggagagaagcgccgccagaaagatgcccagcaagagcctggaggacatcagcagcgacagcagcaaccaggccaaggtggacaaccagcccgaggagctggtgagaagcgccgaggacgtgagcaccgtgcccacccagcccgacaaccccttcagccaccccgacaagctgaagagaatgagcaagagcgtgcccgccttcctgcaggacgagagcgacgacagagagaccgacaccgccagcgagagcagctaccagctgagcagacacaagaagagccccagcagcctgaccaacctgagcagcagcagcggcatgaccagcctgagcagcgtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagaagcagagaagcgacccctacgtgaaggcctacctgctgcccgacaagggcaagatgggcaagaagaagaccctggtggtgaagaagaccctgaaccccgtgtacaacgagatcctgagatacaagatcgagaagcagatcctgaagacccagaagctgaacctgagcatctggcacagagacaccttcaagagaaacagcttcctgggcgaggtggagctggacctggagacctgggactgggacaacaagcagaacaagcagctgagatggtaccccctgaagagaaagaccgcccccgtggccctggaggccgagaacagaggcgagatgaagctggccctgcagtacgtgcccgagcccgtgcccggcaagaagctgcccaccaccggcgaggtgcacatctgggtgaaggagtgcctggacctgcccctgctgagaggcagccacctgaacagcttcgtgaagtgcaccatcctgcccgacaccagcagaaagagcagacagaagaccagagccgtgggcaagaccaccaaccccatcttcaaccacaccatggtgtacgacggcttcagacccgaggacctgatggaggcctgcgtggagctgaccgtgtgggaccactacaagctgaccaaccagttcctgggcggcctgagaatcggcttcggcaccggcaagagctacggcaccgaggtggactggatggacagcaccagcgaggaggtggccctgtgggagaagatggtgaacagccccaacacctggatcgaggccaccctgcccctgagaatgctgctgatcgccaagatcagcaagtag

SEQ ID NO: 101523 - DNA, 3819 bp, Artificial Sequence
  Description of Artificial Sequence: Synthetic coding sequence
atggacgagcccaacgccgagcaggtgtacaaccccagccagttcgagaacctgagaaagttctgggacctggaggccaacagcaacagcaaggacaacgacaagaacatcaccaccaccagccagaagaacagcgcccccttcaacagacagaagcacaaggagttcagcgacatcaagctgagcggcaagaacacccacgaggccgaggtgctgctgagccccaagaaggtgatggccagagaggagatggagaagctgaacagcaagggcatcctgcaggtgctgcccgacgagatcaccttccccctgagccccctgagaaagtacacctaccagctgcccggcaacgagagcagcaaggagaacgtggagaagaacaccgagggcatcgtgacccccgtgttcaaggaggagaaggactacagcgagcaggagatccaggagagcatcatcaagaccaacgtgctgagcaaggactgcaaggacaccttcaacgacagcctgcagaagctgctgagcgagaccagcacccccgccatccagcccagcggcggcaaggtgcacggcaagcaggtgctggagcccagcgtgagcgagaacagaacctggccccagaagaccgacttcgccgacaccgaggaggaggtgaagggccccgagaagatcatcaacgagcacgtggacaagaccgtggtgcaccccaaggtgaagagaaacagcctgaccgccagcctggacaagctgctgaaggaggccaccggcaccagccccagccccctgcaggccaagctggcccccgtgatcaccggcaccaacagcaagctggaggagggcagattcttcggcaagggcatcgagcagagccacaacaccagcgccgacaagagagagatcctggcccccttccccgtgagagacgagaccttcggcaacaccgccctgctgaagaaggccgagagcggcgagtgccagctgagcacccagaacctgatccagatggccgccgaggacagccaccccctggaccccaccagccagctgagcagaaagggcagcttcggcgacgtggccagccccccccaggacatgctgttcccccaggacgcccacctggtgccccaggccagagtgcaccccagccagaccgagatcagcgagaccgtggagaaggtgatcctgccccccagacccgtgctgaacgacgtgagcgccgccctgcagaagctgtgcggcgaggtgtggctgagctaccccgccggcagagaggtgggccccggcgaggtgaaccccgagttccccgaggccgtgcagcccgtgtgcagccccctgaacccccccggcgtgatcagcccctgggccaccatggacaccatcgtgcccgacagaaaggacttctacagcagcaacgtggtgcccgacaagacccacgaggtgggcagctacctggccgcccagatgagccccagcgaccagaccctgagcagcttcgccagcatcgtggcccagtacggcaagggcctgccccaggaggtggaggagatcgtgagagagaccatcgtgcagcccaagagcgagttcctggagttcagcgccggcctggagaagctgctgaaggaggagaccgagaccttccccagcaagtacgagagcgacaccggcaacctgagccccagcaagctgatcggcagcaccgaggagcccagaagagccaccagcgagtgccaccccgaggagctgaaggagaccgtggagaaggccgaggcccccctgatcaccgagagcgccttcgacgccggcttcgagaagctgctgaaggagatcaccgaggcccccccctaccagccccaggtgagcgtgagagaggagacccacgagaaggagagcagccagagcgagcagaccagattcctgggcaccgtgccccacttctacagagccgccagccagaccagcgagatgaaggacaagagcaacggcctggagagccaggtgaaccagtgcgacaagatgctgggcggcgacgccctggtgaccgacctgctggtggacttctgcggcagcagaagcggcgtggagatccccagaaccccccagctgtacgtggcccacgagatcggcaccatcaagaccgtgaccccccccgaggacagagacagcgagagcggcgtggccggcggccagggcaccctgcaggagcccggcttcggcgaggccagcgaggccatcagcgtgagcagaaacagacagcccatccccctgctgatgaacaaggagaacagcaccaagaccagcaaggtggagctgaccctggccagcccctacatgaagcaggagaaggaggaggagaaggagggcttcagcgagagcgacttcagcgacggcaacaccagcagcaacgccgagagctggagaaaccccagcagcagcgaggaggagcccagccccgtgctgaagaccctggagagaagcgccgccagaaagatgcccagcaagagcctggaggacatcagcagcgacagcagcaaccaggccaaggtggacaaccagcccgaggagctggtgagaagcgccgaggacgacgagaagcccgaccagaagcccgtgaccaacgagtgcgtgcccagaatcagcaccgtgcccacccagcccgacaaccccttcagccaccccgacaagctgaagagaatgagcaagagcgtgcccgccttcctgcaggacgagagcgacgacagagagaccgacaccgccagcgagagcagctaccagctgagcagacacaagaagagccccagcagcctgaccaacctgagcagcagcagcggcatgaccagcctgagcagcgtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagaagcagagaagcgacccctacgtgaaggcctacctgctgcccgacaagggcaagatgggcaagaagaagaccctggtggtgaagaagaccctgaaccccgtgtacaacgagatcctgagatacaagatcgagaagcagatcctgaagacccagaagctgaacctgagcatctggcacagagacaccttcaagagaaacagcttcctgggcgaggtggagctggacctggagacctgggactgggacaacaagcagaacaagcagctgagatggtaccccctgaagagaaagaccgcccccgtggccctggaggccgagaacagaggcgagatgaagctggccctgcagtacgtgcccgagcccgtgcccggcaagaagctgcccaccaccggcgaggtgcacatctgggtgaaggagtgcctggacctgcccctgctgagaggcagccacctgaacagcttcgtgaagtgcaccatcctgcccgacaccagcagaaagagcagacagaagaccagagccgtgggcaagaccaccaaccccatcttcaaccacaccatggtgtacgacggcttcagacccgaggacctgatggaggcctgcgtggagctgaccgtgtgggaccactacaagctgaccaaccagttcctgggcggcctgagaatcggcttcggcaccggcaagagctacggcaccgaggtggactggatggacagcaccagcgaggaggtggccctgtgggagaagatggtgaacagccccaacacctggatcgaggccaccctgcccctgagaatgctgctgatcgccaagatcagcaagtag

SEQ ID NO: 101524 - DNA, 5343 bp, Artificial Sequence
  Description of Artificial Sequence: Synthetic coding sequence
atgatcaacagcagcctgagcatgctgttcagctacctggagaagtacttctacgtggccgacgagctgagccactgcgtggagcccgagcccagccaggtgcccggcggcagcagcagagacagacagcagggcaagcccccccccctgcccgccctgaaggccaagaccagcagcagaagcggcccctacgccaccgagatcaagaagagcaccgacgacagcatcttcaaggtgctggactggttcaacagaagcagctacagcgacgacaacaagagcttcctgcagcaccccagaggcatcgagagcaaggagaagaccgacagcaagagccaggtggccgtggacctggtgaccgacgacaccaccctgagagagaacggcagcaagaccctgagccccagcaagatcgagctgaagcccgtgagaagcgacagccccttccaggccgagggcgacatgctggtgagcgagagctgccaggacaacaacgtgaacatcaagagcaagttcatgaacctgagccagaagggcacccccaaggagggccccggcatcctgcagcccttcgagagctacggcacccccagccagggcagcaagaacatggactacagccaggacagcaagagccccggcaagggcaacggcgccagccccagcaacagcaactacagctacagcgtgctgaaggagagcgacgccgagaaccaggtgccctgcaacaccaacaacatcggcaacctgggcgaggaggagcccaagttccacgcccacgaggagaacagaggccacagcgaggtgaacttcgacagcagcaccgtggtgaaggagcccggcctgaaggacaacatgaacgccgagagaaagagcaaggtgggcaacacctacatcctgaaggccagcctggagcccgagaacatcaagagcacccccggcgtggccaacaacggcagcccctggaagaagcccgaggtgcagttccagcaggaggccggcgaggtgcccaagaaccaggtgcagagagagaagtacaagagagtgagcgacagaatcagcttctgggagggcgagaaggccggcgccaagatcacccacgagaagcccaccagcagctgcagccaggagcagcccagcgccaaggcctaccagcccgtgaagaagagccagggcgtgagcagcatggacagcctgagcaccgaccagagcgagtacaaccaggccatccccaagagagtggtgctggacgaggacgaccaggccagccagctgagcaacagctacagcagcaacaagagcaaggagaccaagccccagatcgccggccccagcagatactacctgagcgccgagcagagcgacaaggtgagcctgttccagaacaagaagaacgagcccatcaagagaagccaggtggccgacagcctgcccagcagaagaaacatcaccctgcccgccctgcagccccccagcaacgtgggcagcgagagacacgcccccctggagaaggacagacccctggtgagagagagcaacgccaacttcaaggtgatgagcctgaaggagagaatggacgagcccaacgccgagcaggtgtacaaccccagccagttcgagaacctgagaaagttctgggacctggaggccaacagcaacagcaaggacaacgacaagaacatcaccaccaccagccagaagaacagcgcccccttcaacagacagaagcacaaggagttcagcgacatcaagctgagcggcaagaacacccacgaggccgaggtgctgctgagccccaagaaggtgatggccagagaggagatggagaagctgaacagcaagggcatcctgcaggtgctgcccgacgagatcaccttccccctgagccccctgagaaagtacacctaccagctgcccggcaacgagagcagcaaggagaacgtggagaagaacaccgagggcatcgtgacccccgtgttcaaggaggagaaggactacagcgagcaggagatccaggagagcatcatcaagaccaacgtgctgagcaaggactgcaaggacaccttcaacgacagcctgcagaagctgctgagcgagaccagcacccccgccatccagcccagcggcggcaaggtgcacggcaagcaggtgctggagcccagcgtgagcgagaacagaacctggccccagaagaccgacttcgccgacaccgaggaggaggtgaagggccccgagaagatcatcaacgagcacgtggacaagaccgtggtgcaccccaaggtgaagagaaacagcctgaccgccagcctggacaagctgctgaaggaggccaccggcaccagccccagccccctgcaggccaagctggcccccgtgatcaccggcaccaacagcaagctggaggagggcagattcttcggcaagggcatcgagcagagccacaacaccagcgccgacaagagagagatcctggcccccttccccgtgagagacgagaccttcggcaacaccgccctgctgaagaaggccgagagcggcgagtgccagctgagcacccagaacctgatccagatggccgccgaggacagccaccccctggaccccaccagccagctgagcagaaagggcagcttcggcgacgtggccagccccccccaggacatgctgttcccccaggacgcccacctggtgccccaggccagagtgcaccccagccagaccgagatcagcgagaccgtggagaaggtgatcctgccccccagacccgtgctgaacgacgtgagcgccgccctgcagaagctgtgcggcgaggtgtggctgagctaccccgccggcagagaggtgggccccggcgaggtgaaccccgagttccccgaggccgtgcagcccgtgtgcagccccctgaacccccccggcgtgatcagcccctgggccaccatggacaccatcgtgcccgacagaaaggacttctacagcagcaacgtggtgcccgacaagacccacgaggtgggcagctacctggccgcccagatgagccccagcgaccagaccctgagcagcttcgccagcatcgtggcccagtacggcaagggcctgccccaggaggtggaggagatcgtgagagagaccatcgtgcagcccaagagcgagttcctggagttcagcgccggcctggagaagctgctgaaggaggagaccgagaccttccccagcaagtacgagagcgacaccggcaacctgagccccagcaagctgatcggcagcaccgaggagcccagaagagccaccagcgagtgccaccccgaggagctgaaggagaccgtggagaaggccgaggcccccctgatcaccgagagcgccttcgacgccggcttcgagaagctgctgaaggagatcaccgaggcccccccctaccagccccaggtgagcgtgagagaggagacccacgagaaggagagcagccagagcgagcagaccagattcctgggcaccgtgccccacttctacagagccgccagccagaccagcgagatgaaggacaagagcaacggcctggagagccaggtgaaccagtgcgacaagatgctgggcggcgacgccctggtgaccgacctgctggtggacttctgcggcagcagaagcggcgtggagatccccagaaccccccagctgtacgtggcccacgagatcggcaccatcaagaccgtgaccccccccgaggacagagacagcgagagcggcgtggccggcggccagggcaccctgcaggagcccggcttcggcgaggccagcgaggccatcagcgtgagcagaaacagacagcccatccccctgctgatgaacaaggagaacagcaccaagaccagcaaggtggagctgaccctggccagcccctacatgaagcaggagaaggaggaggagaaggagggcttcagcgagagcgacttcagcgacggcaacaccagcagcaacgccgagagctggagaaaccccagcagcagcgaggaggagcccagccccgtgctgaagaccctggagagaagcgccgccagaaagatgcccagcaagagcctggaggacatcagcagcgacagcagcaaccaggccaaggtggacaaccagcccgaggagctggtgagaagcgccgaggacgtgagcaccgtgcccacccagcccgacaaccccttcagccaccccgacaagctgaagagaatgagcaagagcgtgcccgccttcctgcaggacgagagcgacgacagagagaccgacaccgccagcgagagcagctaccagctgagcagacacaagaagagccccagcagcctgaccaacctgagcagcagcagcggcatgaccagcctgagcagcgtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagaagcagagaagcgacccctacgtgaaggcctacctgctgcccgacaagggcaagatgggcaagaagaagaccctggtggtgaagaagaccctgaaccccgtgtacaacgagatcctgagatacaagatcgagaagcagatcctgaagacccagaagctgaacctgagcatctggcacagagacaccttcaagagaaacagcttcctgggcgaggtggagctggacctggagacctgggactgggacaacaagcagaacaagcagctgagatggtaccccctgaagagaaagaccgcccccgtggccctggaggccgagaacagaggcgagatgaagctggccctgcagtacgtgcccgagcccgtgcccggcaagaagctgcccaccaccggcgaggtgcacatctgggtgaaggagtgcctggacctgcccctgctgagaggcagccacctgaacagcttcgtgaagtgcaccatcctgcccgacaccagcagaaagagcagacagaagaccagagccgtgggcaagaccaccaaccccatcttcaaccacaccatggtgtacgacggcttcagacccgaggacctgatggaggcctgcgtggagctgaccgtgtgggaccactacaagctgaccaaccagttcctgggcggcctgagaatcggcttcggcaccggcaagagctacggcaccgaggtggactggatggacagcaccagcgaggaggtggccctgtgggagaagatggtgaacagccccaacacctggatcgaggccaccctgcccctgagaatgctgctgatcgccaagatcagcaagtag

SEQ ID NO: 101525 - DNA, 1098 bp, Artificial Sequence
  Description of Artificial Sequence: Synthetic coding sequence
atgagcgacgacagagagaccgacaccgccagcgagagcagctaccagctgagcagacacaagaagagccccagcagcctgaccaacctgagcagcagcagcggcatgaccagcctgagcagcgtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagaagcagagaagcgacccctacgtgaaggcctacctgctgcccgacaagggcaagatgggcaagaagaagaccctggtggtgaagaagaccctgaaccccgtgtacaacgagatcctgagatacaagatcgagaagcagatcctgaagacccagaagctgaacctgagcatctggcacagagacaccttcaagagaaacagcttcctgggcgaggtggagctggacctggagacctgggactgggacaacaagcagaacaagcagctgagatggtaccccctgaagagaaagaccgcccccgtggccctggaggccgagaacagaggcgagatgaagctggccctgcagtacgtgcccgagcccgtgcccggcaagaagctgcccaccaccggcgaggtgcacatctgggtgaaggagtgcctggacctgcccctgctgagaggcagccacctgaacagcttcgtgaagtgcaccatcctgcccgacaccagcagaaagagcagacagaagaccagagccgtgggcaagaccaccaaccccatcttcaaccacaccatggtgtacgacggcttcagacccgaggacctgatggaggcctgcgtggagctgaccgtgtgggaccactacaagctgaccaaccagttcctgggcggcctgagaatcggcttcggcaccggcaagagctacggcaccgaggtggactggatggacagcaccagcgaggaggtggccctgtgggagaagatggtgaacagccccaacacctggatcgaggccaccctgcccctgagaatgctgctgatcgccaagatcagcaagtag

SEQ ID NO: 101526 - DNA, 2733 bp, Artificial Sequence
  Description of Artificial Sequence: Synthetic coding sequence
atgatcgacctgagcttcctgaccgaggaggagcaggaggccatcatgaaggtgctgcagagagacgccgccctgaagagagccgaggaggagagagtgagacacctgcccgagaagatcaaggacgaccagcagctgaagaacatgagcggccagtggttctacgaggccaaggccaagagacacagagacaagatccacggcgccgacatcatcagagccagcatgagaaagaagagaccccagatcgccgccgagcagagcaaggacagagagaacggcgccaaggagagctgggtgaacaacgtgaacaaggacgccttcctgccccccgagctggccggcgtggtggaggagcccgaggaggacgccgcccccgccagccccagcagcagcgtggtgaaccccgccagcagcgtgatcgacatgagccaggagaacaccagaaagcccaacgtgagccccgagaagagaaagaaccccttcaacagcagcaagctgcccgagggccacagcagccagcagaccaagaacgagcagagcaagaacggcagaaccggcctgttccagaccagcaaggaggacgagctgagcgagagcaaggagaagagcaccgtggccgacaccagcatccagaagctggagaagagcaagcagaccctgcccggcctgagcaacggcagccagatcaaggcccccatccccaaggccagaaagatgatctacaagagcaccgacctgaacaaggacgacaaccagagcttccccagacagagaaccgacagcctgaaggccagaggcgcccccagaggcatcctgaagagaaacagcagcagcagcagcaccgacagcgagaccctgagatacaaccacaacttcgagcccaagagcaagatcgtgagccccggcctgaccatccacgagagaatcagcgagaaggagcacagcctggaggacaacagcagccccaacagcctggagcccctgaagcacgtgagattcagcgccgtgaaggacgagctgccccagagccccggcctgatccacggcagagaggtgggcgagttcagcgtgctggagagcgacagactgaagaacggcatggaggacgccggcgacaccgaggagttccagagcgaccccaagcccagccagtacagaaagcccagcctgttccaccagagcaccagcagcccctacgtgagcaagagcgagacccaccagcccatgaccagcggcagcttccccatcaacggcctgcacagccacagcgaggtgctgaccgccagaccccagagcatggagaacagccccaccatcaacgagcccaaggacaagagcagcgagctgaccagactggagagcgtgctgcccagaagccccgccgacgagctgagccactgcgtggagcccgagcccagccaggtgcccggcggcagcagcagagacagacagcagggcagcgaggaggagcccagccccgtgctgaagaccctggagagaagcgccgccagaaagatgcccagcaagagcctggaggacatcagcagcgacagcagcaaccaggccaaggtggacaaccagcccgaggagctggtgagaagcgccgaggacgacgagaagcccgaccagaagcccgtgaccaacgagtgcgtgcccagaatcagcaccgtgcccacccagcccgacaaccccttcagccaccccgacaagctgaagagaatgagcaagagcgtgcccgccttcctgcaggacgaggtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagaagcagagaagcgacccctacgtgaaggcctacctgctgcccgacaagggcaagatgggcaagaagaagaccctggtggtgaagaagaccctgaaccccgtgtacaacgagatcctgagatacaagatcgagaagcagatcctgaagacccagaagctgaacctgagcatctggcacagagacaccttcaagagaaacagcttcctgggcgaggtggagctggacctggagacctgggactgggacaacaagcagaacaagcagctgagatggtaccccctgaagagaaagaccgcccccgtggccctggaggccgagaacagaggcgagatgaagctggccctgcagtacgtgcccgagcccgtgcccggcaagaagctgcccaccaccggcgaggtgcacatctgggtgaaggagtgcctggacctgcccctgctgagaggcagccacctgaacagcttcgtgaagtgcaccatcctgcccgacaccagcagaaagagcagacagaagaccagagccgtgggcaagaccaccaaccccatcttcaaccacaccatggtgtacgacggcttcagacccgaggacctgatggaggcctgcgtggagctgaccgtgtgggaccactacaagctgaccaaccagttcctgggcggcctgagaatcggcttcggcaccggcaagagctacggcaccgaggtggactggatggacagcaccagcgaggaggtggccctgtgggagaagatggtgaacagccccaacacctggatcgaggccaccctgcccctgagaatgctgctgatcgccaagatcagcaagtag

SEQ ID NO: 101527 - DNA, 2733 bp, Artificial Sequence; identical to SEQ ID NO: 101526
  Description of Artificial Sequence: Synthetic coding sequence

SEQ ID NO: 101528 - DNA, 192 bp, Artificial Sequence
  Description of Artificial Sequence: Synthetic coding sequence
atgagcaagagcgtgcccgccttcctgcaggacgagagcgacgacagagagaccgacaccgccagcgagagcagctaccagctgagcagacacaagaagagccccagcagcctgaccaacctgagcagcagcagcggcatgaccagcctgagcagcgtgagcggcagcgtgatgagcgtgtacagcggctag

SEQ ID NO: 101529 - DNA, 3771 bp, Artificial Sequence
  Description of Artificial Sequence: Synthetic coding sequence
atggacgagcccaacgccgagcaggtgtacaaccccagccagttcgagaacctgagaaagttctgggacctggaggccaacagcaacagcaaggacaacgacaagaacatcaccaccaccagccagaagaacagcgcccccttcaacagacagaagcacaaggagttcagcgacatcaagctgagcggcaagaacacccacgaggccgaggtgctgctgagccccaagaaggtgatggccagagaggagatggagaagctgaacagcaagggcatcctgcaggtgctgcccgacgagatcaccttccccctgagccccctgagaaagtacacctaccagctgcccggcaacgagagcagcaaggagaacgtggagaagaacaccgagggcatcgtgacccccgtgttcaaggaggagaaggactacagcgagcaggagatccaggagagcatcatcaagaccaacgtgctgagcaaggactgcaaggacaccttcaacgacagcctgcagaagctgctgagcgagaccagcacccccgccatccagcccagcggcggcaaggtgcacggcaagcaggtgctggagcccagcgtgagcgagaacagaacctggccccagaagaccgacttcgccgacaccgaggaggaggtgaagggccccgagaagatcatcaacgagcacgtggacaagaccgtggtgcaccccaaggtgaagagaaacagcctgaccgccagcctggacaagctgctgaaggaggccaccggcaccagccccagccccctgcaggccaagctggcccccgtgatcaccggcaccaacagcaagctggaggagggcagattcttcggcaagggcatcgagcagagccacaacaccagcgccgacaagagagagatcctggcccccttccccgtgagagacgagaccttcggcaacaccgccctgctgaagaaggccgagagcggcgagtgccagctgagcacccagaacctgatccagatggccgccgaggacagccaccccctggaccccaccagccagctgagcagaaagggcagcttcggcgacgtggccagccccccccaggacatgctgttcccccaggacgcccacctggtgccccaggccagagtgcaccccagccagaccgagatcagcgagaccgtggagaaggtgatcctgccccccagacccgtgctgaacgacgtgagcgccgccctgcagaagctgtgcggcgaggtgtggctgagctaccccgccggcagagaggtgggccccggcgaggtgaaccccgagttccccgaggccgtgcagcccgtgtgcagccccctgaacccccccggcgtgatcagcccctgggccaccatggacaccatcgtgcccgacagaaaggacttctacagcagcaacgtggtgcccgacaagacccacgaggtgggcagctacctggccgcccagatgagccccagcgaccagaccctgagcagcttcgccagcatcgtggcccagtacggcaagggcctgccccaggaggtggaggagatcgtgagagagaccatcgtgcagcccaagagcgagttcctggagttcagcgccggcctggagaagctgctgaaggaggagaccgagaccttccccagcaagtacgagagcgacaccggcaacctgagccccagcaagctgatcggcagcaccgaggagcccagaagagccaccagcgagtgccaccccgaggagctgaaggagaccgtggagaaggccgaggcccccctgatcaccgagagcgccttcgacgccggcttcgagaagctgctgaaggagatcaccgaggcccccccctaccagccccaggtgagcgtgagagaggagacccacgagaaggagagcagccagagcgagcagaccagattcctgggcaccgtgccccacttctacagagccgccagccagaccagcgagatgaaggacaagagcaacggcctggagagccaggtgaaccagtgcgacaagatgctgggcggcgacgccctggtgaccgacctgctggtggacttctgcggcagcagaagcggcgtggagatccccagaaccccccagctgtacgtggcccacgagatcggcaccatcaagaccgtgaccccccccgaggacagagacagcgagagcggcgtggccggcggccagggcaccctgcaggagcccggcttcggcgaggccagcgaggccatcagcgtgagcagaaacagacagcccatccccctgctgatgaacaaggagaacagcaccaagaccagcaaggtggagctgaccctggccagcccctacatgaagcaggagaaggaggaggagaaggagggcttcagcgagagcgacttcagcgacggcaacaccagcagcaacgccgagagctggagaaaccccagcagcagcgaggaggagcccagccccgtgctgaagaccctggagagaagcgccgccagaaagatgcccagcaagagcctggaggacatcagcagcgacagcagcaaccaggccaaggtggacaaccagcccgaggagctggtgagaagcgccgaggacgtgagcaccgtgcccacccagcccgacaaccccttcagccaccccgacaagctgaagagaatgagcaagagcgtgcccgccttcctgcaggacgagagcgacgacagagagaccgacaccgccagcgagagcagctaccagctgagcagacacaagaagagccccagcagcctgaccaacctgagcagcagcagcggcatgaccagcctgagcagcgtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagaagcagagaagcgacccctacgtgaaggcctacctgctgcccgacaagggcaagatgggcaagaagaagaccctggtggtgaagaagaccctgaaccccgtgtacaacgagatcctgagatacaagatcgagaagcagatcctgaagacccagaagctgaacctgagcatctggcacagagacaccttcaagagaaacagcttcctgggcgaggtggagctggacctggagacctgggactgggacaacaagcagaacaagcagctgagatggtaccccctgaagagaaagaccgcccccgtggccctggaggccgagaacagaggcgagatgaagctggccctgcagtacgtgcccgagcccgtgcccggcaagaagctgcccaccaccggcgaggtgcacatctgggtgaaggagtgcctggacctgcccctgctgagaggcagccacctgaacagcttcgtgaagtgcaccatcctgcccgacaccagcagaaagagcagacagaagaccagagccgtgggcaagaccaccaaccccatcttcaaccacaccatggtgtacgacggcttcagacccgaggacctgatggaggcctgcgtggagctgaccgtgtgggaccactacaagctgaccaaccagttcctgggcggcctgagaatcggcttcggcaccggcaagagctacggcaccgaggtggactggatggacagcaccagcgaggaggtggccctgtgggagaagatggtgaacagccccaacacctggatcgaggccaccctgcccctgagaatgctgctgatcgccaagatcagcaagtag

SEQ ID NO: 101530 - DNA, 1131 bp, Artificial Sequence
  Description of Artificial Sequence: Synthetic coding sequence
atgagcaagagcgtgcccgccttcctgcaggacgagagcgacgacagagagaccgacaccgccagcgagagcagctaccagctgagcagacacaagaagagccccagcagcctgaccaacctgagcagcagcagcggcatgaccagcctgagcagcgtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagaagcagagaagcgacccctacgtgaaggcctacctgctgcccgacaagggcaagatgggcaagaagaagaccctggtggtgaagaagaccctgaaccccgtgtacaacgagatcctgagatacaagatcgagaagcagatcctgaagacccagaagctgaacctgagcatctggcacagagacaccttcaagagaaacagcttcctgggcgaggtggagctggacctggagacctgggactgggacaacaagcagaacaagcagctgagatggtaccccctgaagagaaagaccgcccccgtggccctggaggccgagaacagaggcgagatgaagctggccctgcagtacgtgcccgagcccgtgcccggcaagaagctgcccaccaccggcgaggtgcacatctgggtgaaggagtgcctggacctgcccctgctgagaggcagccacctgaacagcttcgtgaagtgcaccatcctgcccgacaccagcagaaagagcagacagaagaccagagccgtgggcaagaccaccaaccccatcttcaaccacaccatggtgtacgacggcttcagacccgaggacctgatggaggcctgcgtggagctgaccgtgtgggaccactacaagctgaccaaccagttcctgggcggcctgagaatcggcttcggcaccggcaagagctacggcaccgaggtggactggatggacagcaccagcgaggaggtggccctgtgggagaagatggtgaacagccccaacacctggatcgaggccaccctgcccctgagaatgctgctgatcgccaagatcagcaagtag

SEQ ID NO: 101531 - DNA, 312 bp, Artificial Sequence
  Description of Artificial Sequence: Synthetic coding sequence
atgagcaagagcgtgcccgccttcctgcaggacgagagcgacgacagagagaccgacaccgccagcgagagcagctaccagctgagcagacacaagaagagccccagcagcctgaccaacctgagcagcagcagcggcatgaccagcctgagcagcgtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagtag

SEQ ID NO: 101532 - DNA, 2709 bp, Artificial Sequence
  Description of Artificial Sequence: Synthetic coding sequence
atgagcggccagtggttctacgaggccaaggccaagagacacagagacaagatccacggcgccgacatcatcagagccagcatgagaaagaagagaccccagatcgccgccgagcagagcaaggacagagagaacggcgccaaggagagctgggtgaacaacgtgaacaaggacgccttcctgccccccgagctggccggcgtggtggaggagcccgaggaggacgccgcccccgccagccccagcagcagcgtggtgaaccccgccagcagcgtgatcgacatgagccaggagaacaccagaaagcccaacgtgagccccgagaagagaaagaaccccttcaacagcagcaagctgcccgagggccacagcagccagcagaccaagaacgagcagagcaagaacggcagaaccggcctgttccagaccagcaaggaggacgagctgagcgagagcaaggagaagagcaccgtggccgacaccagcatccagaagctggagaagagcaagcagaccctgcccggcctgagcaacggcagccagatcaaggcccccatccccaaggccagaaagatgatctacaagagcaccgacctgaacaaggacgacaaccagagcttccccagacagagaaccgacagcctgaaggccagaggcgcccccagaggcatcctgaagagaaacagcagcagcagcagcaccgacagcgagaccctgagatacaaccacaacttcgagcccaagagcaagatcgtgagccccggcctgaccatccacgagagaatcagcgagaaggagcacagcctggaggacaacagcagccccaacagcctggagcccctgaagcacgtgagattcagcgccgtgaaggacgagctgccccagagccccggcctgatccacggcagagaggtgggcgagttcagcgtgctggagagcgacagactgaagaacggcatggaggacgccggcgacaccgaggagttccagagcgaccccaagcccagccagtacagaaagcccagcctgttccaccagagcaccagcagcccctacgtgagcaagagcgagacccaccagcccatgaccagcggcagcttccccatcaacggcctgcacagccacagcgaggtgctgaccgccagaccccagagcatggagaacagccccaccatcaacgagcccaaggacaagagcagcgagctgaccagactggagagcgtgctgcccagaagccccgccgacgagctgagccactgcgtggagcccgagcccagccaggtgcccggcggcagcagcagagacagacagcagggcagcgaggaggagcccagccccgtgctgaagaccctggagagaagcgccgccagaaagatgcccagcaagagcctggaggacatcagcagcgacagcagcaaccaggccaaggtggacaaccagcccgaggagctggtgagaagcgccgaggacgacgagaagcccgaccagaagcccgtgaccaacgagtgcgtgcccagaatcagcaccgtgcccacccagcccgacaaccccttcagccaccccgacaagctgaagagaatgagcaagagcgtgcccgccttcctgcaggacgagagcgacgacagagagaccgacaccgccagcgagagcagctaccagctgagcagacacaagaagagccccagcagcctgaccaacctgagcagcagcagcggcatgaccagcctgagcagcgtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagaagcagagaagcgacccctacgtgaaggcctacctgctgcccgacaagggcaagatgggcaagaagaagaccctggtggtgaagaagaccctgaaccccgtgtacaacgagatcctgagatacaagatcgagaagcagatcctgaagacccagaagctgaacctgagcatctggcacagagacaccttcaagagaaacagcttcctgggcgaggtggagctggacctggagacctgggactgggacaacaagcagaacaagcagctgagatggtaccccctgaagagaaagaccgcccccgtggccctggaggccgagaacagaggcgagatgaagctggccctgcagtacgtgcccgagcccgtgcccggcaagaagctgcccaccaccggcgaggtgcacatctgggtgaaggagtgcctggacctgcccctgctgagaggcagccacctgaacagcttcgtgaagtgcaccatcctgcccgacaccagcagaaagagcagacagaagaccagagccgtgggcaagaccaccaaccccatcttcaaccacaccatggtgtacgacggcttcagacccgaggacctgatggaggcctgcgtggagctgaccgtgtgggaccactacaagctgaccaaccagttcctgggcggcctgagaatcggcttcggcaccggcaagagctacggcaccgaggtggactggatggacagcaccagcgaggaggtggccctgtgggagaagatggtgaacagccccaacacctggatcgaggccaccctgcccctgagaatgctgctgatcgccaagatcagcaagtag

SEQ ID NO: 101533 - DNA, 483 bp, Artificial Sequence
  Description of Artificial Sequence: Synthetic coding sequence
atgagcaagagcgtgcccgccttcctgcaggacgaggtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagaagcagagaagcgacccctacgtgaaggcctacctgctgcccgacaagggcaagatgggcaagaagaagaccctggtggtgaagaagaccctgaaccccgtgtacaacgagatcctgagatacaagatcgagaagcagatcctgaagacccagaagctgaacctgagcatctggcacagagacaccttcaagagaaacagcttcctgggcgaggtggagctggacctggagacctgggactgggacaacaagcagaacaagcagctgagatggtaccccctgaagagaaagtag

SEQ ID NO: 101534 - DNA, 2805 bp, Artificial Sequence
  Description of Artificial Sequence: Synthetic coding sequence
atgatcgacctgagcttcctgaccgaggaggagcaggaggccatcatgaaggtgctgcagagagacgccgccctgaagagagccgaggaggagagagtgagacacctgcccgagaagatcaaggacgaccagcagctgaagaacatgagcggccagtggttctacgaggccaaggccaagagacacagagacaagatccacggcgccgacatcatcagagccagcatgagaaagaagagaccccagatcgccgccgagcagagcaaggacagagagaacggcgccaaggagagctgggtgaacaacgtgaacaaggacgccttcctgccccccgagctggccggcgtggtggaggagcccgaggaggacgccgcccccgccagccccagcagcagcgtggtgaaccccgccagcagcgtgatcgacatgagccaggagaacaccagaaagcccaacgtgagccccgagaagagaaagaaccccttcaacagcagcaagctgcccgagggccacagcagccagcagaccaagaacgagcagagcaagaacggcagaaccggcctgttccagaccagcaaggaggacgagctgagcgagagcaaggagaagagcaccgtggccgacaccagcatccagaagctggagaagagcaagcagaccctgcccggcctgagcaacggcagccagatcaaggcccccatccccaaggccagaaagatgatctacaagagcaccgacctgaacaaggacgacaaccagagcttccccagacagagaaccgacagcctgaaggccagaggcgcccccagaggcatcctgaagagaaacagcagcagcagcagcaccgacagcgagaccctgagatacaaccacaacttcgagcccaagagcaagatcgtgagccccggcctgaccatccacgagagaatcagcgagaaggagcacagcctggaggacaacagcagccccaacagcctggagcccctgaagcacgtgagattcagcgccgtgaaggacgagctgccccagagccccggcctgatccacggcagagaggtgggcgagttcagcgtgctggagagcgacagactgaagaacggcatggaggacgccggcgacaccgaggagttccagagcgaccccaagcccagccagtacagaaagcccagcctgttccaccagagcaccagcagcccctacgtgagcaagagcgagacccaccagcccatgaccagcggcagcttccccatcaacggcctgcacagccacagcgaggtgctgaccgccagaccccagagcatggagaacagccccaccatcaacgagcccaaggacaagagcagcgagctgaccagactggagagcgtgctgcccagaagccccgccgacgagctgagccactgcgtggagcccgagcccagccaggtgcccggcggcagcagcagagacagacagcagggcagcgaggaggagcccagccccgtgctgaagaccctggagagaagcgccgccagaaagatgcccagcaagagcctggaggacatcagcagcgacagcagcaaccaggccaaggtggacaaccagcccgaggagctggtgagaagcgccgaggacgtgagcaccgtgcccacccagcccgacaaccccttcagccaccccgacaagctgaagagaatgagcaagagcgtgcccgccttcctgcaggacgagagcgacgacagagagaccgacaccgccagcgagagcagctaccagctgagcagacacaagaagagccccagcagcctgaccaacctgagcagcagcagcggcatgaccagcctgagcagcgtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagaagcagagaagcgacccctacgtgaaggcctacctgctgcccgacaagggcaagatgggcaagaagaagaccctggtggtgaagaagaccctgaaccccgtgtacaacgagatcctgagatacaagatcgagaagcagatcctgaagacccagaagctgaacctgagcatctggcacagagacaccttcaagagaaacagcttcctgggcgaggtggagctggacctggagacctgggactgggacaacaagcagaacaagcagctgagatggtaccccctgaagagaaagaccgcccccgtggccctggaggccgagaacagaggcgagatgaagctggccctgcagtacgtgcccgagcccgtgcccggcaagaagctgcccaccaccggcgaggtgcacatctgggtgaaggagtgcctggacctgcccctgctgagaggcagccacctgaacagcttcgtgaagtgcaccatcctgcccgacaccagcagaaagagcagacagaagaccagagccgtgggcaagaccaccaaccccatcttcaaccacaccatggtgtacgacggcttcagacccgaggacctgatggaggcctgcgtggagctgaccgtgtgggaccactacaagctgaccaaccagttcctgggcggcctgagaatcggcttcggcaccggcaagagctacggcaccgaggtggactggatggacagcaccagcgaggaggtggccctgtgggagaagatggtgaacagccccaacacctggatcgaggccaccctgcccctgagaatgctgctgatcgccaagatcagcaagtag

SEQ ID NO: 101535 - DNA, 468 bp, Artificial Sequence
  Description of Artificial Sequence: Synthetic coding sequence
atgagcaagagcgtgcccgccttcctgcaggacgagagcgacgacagagagaccgacaccgccagcgagagcagctaccagctgagcagacacaagaagagccccagcagcctgaccaacctgagcagcagcagcggcatgaccagcctgagcagcgtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagaagcagagaagcgacccctacgtgaaggcctacctgctgcccgacaagggcaagatgggcaagaagaagaccctggtggtgaagaagaccctgaaccccgtgtacaacgagatcctgagatacaagatcgagaagcagatcctgaagacccagaagtag

SEQ ID NO: 101536 - DNA, 1131 bp, Artificial Sequence; identical to SEQ ID NO: 101530
  Description of Artificial Sequence: Synthetic coding sequence

SEQ ID NO: 101537 - DNA, 1956 bp, Artificial Sequence
  Description of Artificial Sequence: Synthetic coding sequence
gagaccgtggagaaggccgaggcccccctgatcaccgagagcgccttcgacgccggcttcgagaagctgctgaaggagatcaccgaggcccccccctaccagccccaggtgagcgtgagagaggagacccacgagaaggagagcagccagagcgagcagaccagattcctgggcaccgtgccccacttctacagagccgccagccagaccagcgagatgaaggacaagagcaacggcctggagagccaggtgaaccagtgcgacaagatgctgggcggcgacgccctggtgaccgacctgctggtggacttctgcggcagcagaagcggcgtggagatccccagaaccccccagctgtacgtggcccacgagatcggcaccatcaagaccgtgaccccccccgaggacagagacagcgagagcggcgtggccggcggccagggcaccctgcaggagcccggcttcggcgaggccagcgaggccatcagcgtgagcagaaacagacagcccatccccctgctgatgaacaaggagaacagcaccaagaccagcaaggtggagctgaccctggccagcccctacatgaagcaggagaaggaggaggagaaggagggcttcagcgagagcgacttcagcgacggcaacaccagcagcaacgccgagagctggagaaaccccagcagcagcgaggaggagcccagccccgtgctgaagaccctggagagaagcgccgccagaaagatgcccagcaagagcctggaggacatcagcagcgacagcagcaaccaggccaaggtggacaaccagcccgaggagctggtgagaagcgccgaggacgacgagaagcccgaccagaagcccgtgaccaacgagtgcgtgcccagaatcagcaccgtgcccacccagcccgacaaccccttcagccaccccgacaagctgaagagaatgagcaagagcgtgcccgccttcctgcaggacgaggtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagaagcagagaagcgacccctacgtgaaggcctacctgctgcccgacaagggcaagatgggcaagaagaagaccctggtggtgaagaagaccctgaaccccgtgtacaacgagatcctgagatacaagatcgagaagcagatcctgaagacccagaagctgaacctgagcatctggcacagagacaccttcaagagaaacagcttcctgggcgaggtggagctggacctggagacctgggactgggacaacaagcagaacaagcagctgagatggtaccccctgaagagaaagaccgcccccgtggccctggaggccgagaacagaggcgagatgaagctggccctgcagtacgtgcccgagcccgtgcccggcaagaagctgcccaccaccggcgaggtgcacatctgggtgaaggagtgcctggacctgcccctgctgagaggcagccacctgaacagcttcgtgaagtgcaccatcctgcccgacaccagcagaaagagcagacagaagaccagagccgtgggcaagaccaccaaccccatcttcaaccacaccatggtgtacgacggcttcagacccgaggacctgatggaggcctgcgtggagctgaccgtgtgggaccactacaagctgaccaaccagttcctgggcggcctgagaatcggcttcggcaccggcaagagctacggcaccgaggtggactggatggacagcaccagcgaggaggtggccctgtgggagaagatggtgaacagccccaacacctggatcgaggccaccctgcccctgagaatgctgctgatcgccaagatcagcaagtag

SEQ ID NO: 101538 - DNA, 213 bp, Artificial Sequence
  Description of Artificial Sequence: Synthetic coding sequence
atgagcaagagcgtgcccgccttcctgcaggacgagagcgacgacagagagaccgacaccgccagcgagagcagctaccagctgagcagacacaagaagagccccagcagcctgaccaacctgagcagcagcagcggcatgaccagcctgagcagcgtgagcggcagcgtgatgagcgtgtacagcggcgacttcggcaacctggaggtgtag

SEQ ID NO: 101539 - DNA, 1011 bp, Artificial Sequence
  Description of Artificial Sequence: Synthetic coding sequence
atgagcaagagcgtgcccgccttcctgcaggacgaggtgagcggcagcgtgatgagcgtgtacagcggcgacttcggcaacctggaggtgaagggcaacatccagttcgccatcgagtacgtggagagcctgaaggagctgcacgtgttcgtggcccagtgcaaggacctggccgccgccgacgtgaagaagcagagaagcgacccctacgtgaaggcctacctgctgcccgacaagggcaagatgggcaagaagaagaccctggtggtgaagaagaccctgaaccccgtgtacaacgagatcctgagatacaagatcgagaagcagatcctgaagacccagaagctgaacctgagcatctggcacagagacaccttcaagagaaacagcttcctgggcgaggtggagctggacctggagacctgggactgggacaacaagcagaacaagcagctgagatggtaccccctgaagagaaagaccgcccccgtggccctggaggccgagaacagaggcgagatgaagctggccctgcagtacgtgcccgagcccgtgcccggcaagaagctgcccaccaccggcgaggtgcacatctgggtgaaggagtgcctggacctgcccctgctgagaggcagccacctgaacagcttcgtgaagtgcaccatcctgcccgacaccagcagaaagagcagacagaagaccagagccgtgggcaagaccaccaaccccatcttcaaccacaccatggtgtacgacggcttcagacccgaggacctgatggaggcctgcgtggagctgaccgtgtgggaccactacaagctgaccaaccagttcctgggcggcctgagaatcggcttcggcaccggcaagagctacggcaccgaggtggactggatggacagcaccagcgaggaggtggccctgtgggagaagatggtgaacagccccaacacctggatcgaggccaccctgcccctgagaatgctgctgatcgccaagatcagcaagtag

SEQ ID NO: 101540 - DNA, 2016 bp, Artificial Sequence
  Description of Artificial Sequence: Synthetic coding sequence
atgagcgagctgctggacctgagcttcctgagcgaggaggagaaggacctgatcctgagcgtgctgcagagagacgaggaggtgagaaaggccgacgagaagagaatcagaagactgaagaacgagctgctggagatcaagagaaagggcgccaagagaggcagccagcactacagcgacagaacctgcgccagatgccaggagagcctgggcagactgagccccaagaccaacacctgcagaggctgcaaccacctggtgtgcagagactgcagaatccaggagagcaacggcacctggagatgcaaggtgtgcgccaaggagatcgagctgaagaaggccaccggcgactggttctacgaccagaaggtgaacagattcgcctacagaaccggcagcgagatcatcagaatgagcctgagacacaagcccgccgtgagcaagagagagaccgtgggccagagcctgctgcaccagacccagatgggcgacatctggcccggcagaaagatcatccaggagagacagaaggagcccagcgtgctgttcgaggtgcccaagctgaagagcggcaagagcgccctggaggccgagagcgagagcctggacagcttcaccgccgacagcgacagcaccagcagaagagacagcctggacaagagcggcctgttccccgagtggaagaagatgagcgcccccaagagccaggtggagaaggagacccagcccggcggccagaacgtggtgttcgtggacgagggcgagatgatcttcaagaagaacaccagaaagatcctgagacccagcgagtacaccaagagcgtgatcgacctgagacccgaggacgtggtgcacgagagcggcagcctgggcgacagaagcaagagcgtgcccggcctgaacgtggacatggaggaggaggaggaggaggaggacatcgaccacctggtgaagctgcacagacagaagctggccagaagcagcatgcagagcggcagcagcatgagcaccatcggcagcatgatgagcatctacagcgaggccggcgacttcggcaacatcttcgtgaccggcagaatcgccttcagcctgaagtacgagcagcagacccagagcctggtggtgcacgtgaaggagtgccaccagctggcctacgccgacgaggccaagaagagaagcaacccctacgtgaagacctacctgctgcccgacaagagcagacagggcaagagaaagaccagcatcaagagagacaccatcaaccccctgtacgacgagaccctgagatacgagatccccgagagcctgctggcccagagaaccctgcagttcagcgtgtggcaccacggcagattcggcagaaacaccttcctgggcgaggccgagatccagatggacagctggaagctggacaagaagctggaccactgcctgcccctgcacggcaagatcagcgccgagagccccaccggcctgcccagccacaagggcgagctggtggtgagcctgaagtacatccccgccagcaagacccccgtgggcggcgacagaaagaagagcaagggcggcgagggcggcgagctgcaggtgtggatcaaggaggccaagaacctgaccgccgccaaggccggcggcaccagcgacagcttcgtgaagggctacctgctgcccatgagaaacaaggccagcaagagaaagacccccgtgatgaagaagaccctgaacccccactacaaccacaccttcgtgtacaacggcgtgagactggaggacctgcagcacatgtgcctggagctgaccgtgtgggacagagagcccctggccagcaacgacttcctgggcggcgtgagactgggcgtgggcaccggcatcagcaacggcgaggtggtggactggatggacagcaccggcgaggaggtgagcctgtggcagaagatgagacagtaccccggcagctgggccgagggcaccctgcagctgagaagcagcatggccaagcagaagctgggcctgtag

SEQ ID NO: 101541 - DNA, 2016 bp, Artificial Sequence; identical to SEQ ID NO: 101540
  Description of Artificial Sequence: Synthetic coding sequence

SEQ ID NO: 101542 - DNA, 1050 bp, Artificial Sequence
  Description of Artificial Sequence: Synthetic coding sequence
atgagcgagctgctggacctgagcttcctgagcgaggaggagaaggacctgatcctgagcgtgctgcagagagacgaggaggtgagaaaggccgacgagaagagaatcagaagactgaagaacgagctgctggagatcaagagaaagggcgccaagagaggcagccagcactacagcgacagaacctgcgccagatgccaggagagcctgggcagactgagccccaagaccaacacctgcagaggctgcaaccacctggtgtgcagagactgcagaatccaggagagcaacggcacctggagatgcaaggtgtgcgccaaggagatcgagctgaagaaggccaccggcgactggttctacgaccagaaggtgaacagattcgcctacagaaccggcagcgagatcatcagaatgagcctgagacacaagcccgccgtgagcaagagagagaccgtgggccagagcctgctgcaccagacccagatgggcgacatctggcccggcagaaagatcatccaggagagacagaaggagcccagcgtgctgttcgaggtgcccaagctgaagagcggcaagagcgccctggaggccgagagcgagagcctggacagcttcaccgccgacagcgacagcaccagcagaagagacagcctggacaagagcggcctgttccccgagtggaagaagatgagcgcccccaagagccaggtggagaaggagacccagcccggcggccagaacgtggtgttcgtggacgagggcgagatgatcttcaagaagaacaccagaaagatcctgagacccagcgagtacaccaagagcgtgatcgacctgagacccgaggacgtggtgcacgagagcggcagcctgggcgacagaagcaagagcgtgcccggcctgaacgtggacatggaggaggaggaggaggaggaggacatcgaccacctggtgaagctgcacagacagaagctggccagaagcagcatgcagagcggcagcagcatggtgagcagcatcagaagcgtggtgaccggcatgctgggctactag

SEQ ID NO: 101543 - DNA, 2016 bp, Artificial Sequence; identical to SEQ ID NO: 101540
  Description of Artificial Sequence: Synthetic coding sequence

SEQ ID NO: 101544 - DNA, 2022 bp, Artificial Sequence
  Description of Artificial Sequence: Synthetic coding sequence
atgagcgagctgctggacctgagcttcctgagcgaggaggagaaggacctgatcctgagcgtgctgcagagagacgaggaggtgagaaaggccgacgagaagagaatcagaagactgaagaacgagctgctggagatcaagagaaagggcgccaagagaggcagccagcactacagcgacagaacctgcgccagatgccaggagagcctgggcagactgagccccaagaccaacacctgcagaggctgcaaccacctggtgtgcagagactgcagaatccaggagagcaacggcacctggagatgcaaggtgtgcgccaaggagatcgagctgaagaaggccaccggcgactggttctacgaccagaaggtgaacagattcgcctacagaaccggcagcgagatcatcagaatgagcctgagacacaagcccgccgtgagcaagagagagaccgtgggccagagcctgctgcaccagacccagatgggcgacatctggcccggcagaaagatcatccaggagagacagaaggagcccagcagcgtgctgttcgaggtgcccaagctgaagagcggcaagagcgccctggaggccgagagcgagagcctggacagcttcaccgccgacagcgacagcaccagcagaagagacagcctggacaagagcggcctgttccccgagtggaagaagatgagcgcccccaagagccaggtggagaaggagacccagcccggcggccagaacgtggtgttcgtggacgagggcgagatgatcttcaagaagaacaccagaaagatcctgagacccagcgagtacaccaagagcgtgatcgacctgagacccgaggacgtggtgcacgagagcggcagcctgggcgacagaagcaagagcgtgcccggcctgaacgtggacatggtggaggaggaggaggaggaggaggacatcgaccacctggtgaagctgcacagacagaagctggccagaagcagcatgcagagcggcagcagcatgagcaccatcggcagcatgatgagcatctacagcgaggccggcgacttcggcaacatcttcgtgaccggcagaatcgccttcagcctgaagtacgagcagcagacccagagcctggtggtgcacgtgaaggagtgccaccagctggcctacgccgacgaggccaagaagagaagcaacccctacgtgaagacctacctgctgcccgacaagagcagacagggcaagagaaagaccagcatcaagagagacaccatcaaccccctgtacgacgagaccctgagatacgagatccccgagagcctgctggcccagagaaccctgcagttcagcgtgtggcaccacggcagattcggcagaaacaccttcctgggcgaggccgagatccagatggacagctggaagctggacaagaagctggaccactgcctgcccctgcacggcaagatcagcgccgagagccccaccggcctgcccagccacaagggcgagctggtggtgagcctgaagtacatccccgccagcaagacccccgtgggcggcgacagaaagaagagcaagggcggcgagggcggcgagctgcaggtgtggatcaaggaggccaagaacctgaccgccgccaaggccggcggcaccagcgacagcttcgtgaagggctacctgctgcccatgagaaacaaggccagcaagagaaagacccccgtgatgaagaagaccctgaacccccactacaaccacaccttcgtgtacaacggcgtgagactggaggacctgcagcacatgtgcctggagctgaccgtgtgggacagagagcccctggccagcaacgacttcctgggcggcgtgagactgggcgtgggcaccggcatcagcaacggcgaggtggtggactggatggacagcaccggcgaggaggtgagcctgtggcagaagatgagacagtaccccggcagctgggccgagggcaccctgcagctgagaagcagcatggccaagcagaagctgggcctgtag

SEQ ID NO: 101545 - DNA, 2016 bp, Artificial Sequence; identical to SEQ ID NO: 101540
  Description of Artificial Sequence: Synthetic coding sequence

SEQ ID NO: 101546 - DNA, 933 bp, Artificial Sequence
  Description of Artificial Sequence: Synthetic coding sequence
atgagaagagccgccctgtggctgtggctgtgcgccctggccctgagcctgcagcccgccctgccccagatcgtggccaccaacctgccccccgaggaccaggacggcagcggcgacgacagcgacaacttcagcggcagcggcgccggcgccctgcaggacatcaccctgagccagcagacccccagcacctggaaggacacccagctgctgaccgccatccccaccagccccgagcccaccggcctggaggccaccgccgccagcaccagcaccctgcccgccggcgagggccccaaggagggcgaggccgtggtgctgcccgaggtggagcccggcctgaccgccagagagcaggaggccacccccagacccagagagaccacccagctgcccaccacccacctggccagcaccaccaccgccaccaccgcccaggagcccgccaccagccacccccacagagacatgcagcccggccaccacgagaccagcacccccgccggccccagccaggccgacctgcacaccccccacaccgaggacggcggccccagcgccaccgagagagccgccgaggacggcgccagcagccagctgcccgccgccgagggcagcggcgagcaggacttcaccttcgagaccagcggcgagaacaccgccgtggtggccgtggagcccgacagaagaaaccagagccccgtggaccagggcgccaccggcgccagccagggcctgctggacagaaaggaggtgctgggcggcgtgatcgccggcggcctggtgggcctgatcttcgccgtgtgcctggtgggcttcatgctgtacagaatgaagaagaaggacgagggcagctacagcctggaggagcccaagcaggccaacggcggcgcctaccagaagcccaccaagcaggaggagttctacgcctag

SEQ ID NO: 101547 - DNA, 933 bp, Artificial Sequence; identical to SEQ ID NO: 101546
  Description of Artificial Sequence: Synthetic coding sequence

SEQ ID NO: 101548 - DNA, 606 bp, Artificial Sequence
  Description of Artificial Sequence: Synthetic coding sequence
atgagaagagcctggatcctgctgaccctgggcctggtggcctgcgtgagcgccgagagcagagccgagctgaccagcgacaaggacatgtacctggacaacagcagcatcgaggaggccagcggcgtgtaccccatcgacgacgacgactacgccagcgccagcggcagcggcgccgacgaggacgtggagagccccgagctgaccaccagcagacccctgcccaagatcctgctgaccagcgccgcccccaaggtggagaccaccaccctgaacatccagaacaagatccccgcccagaccaagagccccgaggagaccgacaaggagaaggtgcacctgagcgacagcgagagaaagatggaccccgccgaggaggacaccaacgtgtacaccgagaagcacagcgacagcctgttcaagagaaccgaggtgctggccgccgtgatcgccggcggcgtgatcggcttcctgttcgccatcttcctgatcctgctgctggtgtacagaatgagaaagaaggacgagggcagctacgacctgggcgagagaaagcccagcagcgccgcctaccagaaggcccccaccaaggagttctacgcctag

SEQ ID NO: 101549 - DNA, 498 bp, Artificial Sequence
  Description of Artificial Sequence: Synthetic coding sequence
atgagaagagcctggatcctgctgaccctgggcctggtggcctgcgtgagcgccgagagcgtgagagccgacgaggacgtggagagccccgagctgaccaccagcagacccctgcccaagatcctgctgaccagcgccgcccccaaggtggagaccaccaccctgaacatccagaacaagatccccgcccagaccaagagccccgaggagaccgacaaggagaaggtgcacctgagcgacagcgagagaaagatggaccccgccgaggaggacaccaacgtgtacaccgagaagcacagcgacagcctgttcaagagaaccgaggtgctggccgccgtgatcgccggcggcgtgatcggcttcctgttcgccatcttcctgatcctgctgctggtgtacagaatgagaaagaaggacgagggcagctacgacctgggcgagagaaagcccagcagcgccgcctaccagaaggcccccaccaaggagttctacgcctag

SEQ ID NO: 101550 - DNA, 519 bp, Artificial Sequence
  Description of Artificial Sequence: Synthetic coding sequence
atgtacctggacaacagcagcatcgaggaggccagcggcgtgtaccccatcgacgacgacgactacgccagcgccagcggcagcggcgccgacgaggacgtggagagccccgagctgaccaccagcagacccctgcccaagatcctgctgaccagcgccgcccccaaggtggagaccaccaccctgaacatccagaacaagatccccgcccagaccaagagccccgaggagaccgacaaggagaaggtgcacctgagcgacagcgagagaaagatggaccccgccgaggaggacaccaacgtgtacaccgagaagcacagcgacagcctgttcaagagaaccgaggtgctggccgccgtgatcgccggcggcgtgatcggcttcctgttcgccatcttcctgatcctgctgctggtgtacagaatgagaaagaaggacgagggcagctacgacctgggcgagagaaagcccagcagcgccgcctaccagaaggcccccaccaaggagttctacgcctag

SEQ ID NO: 101551 - DNA, 519 bp, Artificial Sequence; identical to SEQ ID NO: 101550
  Description of Artificial Sequence: Synthetic coding sequence

SEQ ID NO: 101552 - DNA, 606 bp, Artificial Sequence; identical to SEQ ID NO: 101548
  Description of Artificial Sequence: Synthetic coding sequence

SEQ ID NO: 101553 - DNA, 576 bp, Artificial Sequence
  Description of Artificial Sequence: Synthetic coding sequence
atgagagtggcctgcgtgagcgccgagagcagagccgagctgaccagcgacaaggacatgtacctggacaacagcagcatcgaggaggccagcggcgtgtaccccatcgacgacgacgactacgccagcgccagcggcagcggcgccgacgaggacgtggagagccccgagctgaccaccagcagacccctgcccaagatcctgctgaccagcgccgcccccaaggtggagaccaccaccctgaacatccagaacaagatccccgcccagaccaagagccccgaggagaccgacaaggagaaggtgcacctgagcgacagcgagagaaagatggaccccgccgaggaggacaccaacgtgtacaccgagaagcacagcgacagcctgttcaagagaaccgaggtgctggccgccgtgatcgccggcggcgtgatcggcttcctgttcgccatcttcctgatcctgctgctggtgtacagaatgagaaagaaggacgagggcagctacgacctgggcgagagaaagcccagcagcgccgcctaccagaaggcccccaccaaggagttctacgcctag

SEQ ID NO: 101554 - DNA, 1155 bp, Artificial Sequence
  Description of Artificial Sequence: Synthetic coding sequence
atggccatcgcctacctgggcagcagctgccccagccagccccccagcagcctggccctgagcctgagccccacccccagcgacttcgagcaggagagcggcatcgagaccgccatgagattcagccccgacgtggccctggccgtgagcaccacccccgccgtgctgcccaccaccaacatccagcccgtgggcacccccttcgaggagctgcccagcgagagacccaccctggagcccgccaccagccccctggtggtgaccgaggtgcccgaggagcccagccagagagccaccaccgtgagcaccaccatggccaccaccgccgccaccagcaccggcgaccccaccgtggccaccgtgcccgccaccgtggccaccgccacccccagcacccccgccgccccccccttcaccgccaccaccgccgtgatcagaaccaccggcgtgagaagactgctgcccctgcccctgaccaccgtggccaccgccagagccaccacccccgaggcccccagcccccccaccaccgccgccgtgctggacaccgaggcccccacccccagactggtgagcaccgccaccagcagacccagagccctgcccagacccgccaccacccaggagcccgacatccccgagagaagcaccctgcccctgggcaccaccgcccccggccccaccgaggtggcccagacccccacccccgagaccttcctgaccaccatcagagacgagcccgaggtgcccgtgagcggcggccccagcggcgacttcgagctgcccgaggaggagaccacccagcccgacaccgccaacgaggtggtggccgtgggcggcgccgccgccaaggccagcagcccccccggcaccctgcccaagggcgccagacccggccccggcctgctggacaacgccatcgacagcggcagcagcgccgcccagctgccccagaagagcatcctggagagaaaggaggtgctggtggccgtgatcgtgggcggcgtggtgggcgccctgttcgccgccttcctggtgaccctgctgatctacagaatgaagaagaaggacgagggcagctacaccctggaggagcccaagcaggccagcgtgacctaccagaagcccgacaagcaggaggagttctacgcctag

SEQ ID NO: 101555 - DNA, 1329 bp, Artificial Sequence
  Description of Artificial Sequence: Synthetic coding sequence
atgaagcccggccccccccacagagccggcgccgcccacggcgccggcgccggcgccggcgccgccgccggccccggcgccagaggcctgctgctgccccccctgctgctgctgctgctggccggcagagccgccggcgcccagagatggagaagcgagaacttcgagagacccgtggacctggagggcagcggcgacgacgacagcttccccgacgacgagctggacgacctgtacagcggcagcggcagcggctacttcgagcaggagagcggcatcgagaccgccatgagattcagccccgacgtggccctggccgtgagcaccacccccgccgtgctgcccaccaccaacatccagcccgtgggcacccccttcgaggagctgcccagcgagagacccaccctggagcccgccaccagccccctggtggtgaccgaggtgcccgaggagcccagccagagagccaccaccgtgagcaccaccatggccaccaccgccgccaccagcaccggcgaccccaccgtggccaccgtgcccgccaccgtggccaccgccacccccagcacccccgccgccccccccttcaccgccaccaccgccgtgatcagaaccaccggcgtgagaagactgctgcccctgcccctgaccaccgtggccaccgccagagccaccacccccgaggcccccagcccccccaccaccgccgccgtgctggacaccgaggcccccacccccagactggtgagcaccgccaccagcagacccagagccctgcccagacccgccaccacccaggagcccgacatccccgagagaagcaccctgcccctgggcaccaccgcccccggccccaccgaggtggcccagacccccacccccgagaccttcctgaccaccatcagagacgagcccgaggtgcccgtgagcggcggccccagcggcgacttcgagctgcccgaggaggagaccacccagcccgacaccgccaacgaggtggtggccgtgggcggcgccgccgccaaggccagcagcccccccggcaccctgcccaagggcgccagacccggccccggcctgctggacaacgccatcgacagcggcagcagcgccgcccagctgccccagaagagcatcctggagagaaaggaggtgctggtggccgtgatcgtgggcggcgtggtgggcgccctgttcgccgccttcctggtgaccctgctgatctacagaatgaagaagaaggacgagggcagctacaccctggaggagcccaagcaggccagcgtgacctaccagaagcccgacaagcaggaggagttctacgcctag

SEQ ID NO: 101556 - DNA, 597 bp, Artificial Sequence
  Description of Artificial Sequence: Synthetic coding sequence
atggcccccgccagactgttcgccctgctgctgttcttcgtgggcggcgtggccgagagcatcagagagaccgaggtgatcgacccccaggacctgctggagggcagatacttcagcggcgccctgcccgacgacgaggacgtggtgggccccggccaggagagcgacgacttcgagctgagcggcagcggcgacctggacgacctggaggacagcatgatcggccccgaggtggtgcaccccctggtgcccctggacaaccacatccccgagagagccggcagcggcagccaggtgcccaccgagcccaagaagctggaggagaacgaggtgatccccaagagaatcagccccgtggaggagagcgaggacgtgagcaacaaggtgagcatgagcagcaccgtgcagggcagcaacatcttcgagagaaccgaggtgctggccgccctgatcgtgggcggcatcgtgggcatcctgttcgccgtgttcctgatcctgctgctgatgtacagaatgaagaagaaggacgagggcagctacgacctgggcaagaagcccatctacaagaaggcccccaccaacgagttctacgcctag

SEQ ID NO: 101557 - DNA, 381 bp, Artificial Sequence
  Description of Artificial Sequence: Synthetic coding sequence
atgatcggccccgaggtggtgcaccccctggtgcccctggacaaccacatccccgagagagccggcagcggcagccaggtgcccaccgagcccaagaagctggaggagaacgaggtgatccccaagagaatcagccccgtggaggagagcgaggacgtgagcaacaaggtgagcatgagcagcaccgtgcagggcagcaacatcttcgagagaaccgaggtgctggccgccctgatcgtgggcggcatcgtgggcatcctgttcgccgtgttcctgatcctgctgctgatgtacagaatgaagaagaaggacgagggcagctacgacctgggcaagaagcccatctacaagaaggcccccaccaacgagttctacgcctag

SEQ ID NO: 101558 - DNA, 1851 bp, Artificial Sequence
  Description of Artificial Sequence: Synthetic coding sequence
atgttcagaaccgccgtgatgatggccgccagcctggccctgaccggcgccgtggtggcccacgcctactacctgaagcaccagttctaccccaccgtggtgtacctgaccaagagcagccccagcatggccgtgctgtacatccaggccttcgtgctggtgttcctgctgggcaaggtgatgggcaaggtgttcttcggccagctgagagccgccgagatggagcacctgctggagagaagctggtacgccgtgaccgagacctgcctggccttcaccgtgttcagagacgacttcagccccagattcgtggccctgttcaccctgctgctgttcctgaagtgcttccactggctggccgaggacagagtggacttcatggagagaagccccaacatcagctggctgttccactgcagaatcgtgagcctgatgttcctgctgggcatcctggacttcctgttcgtgagccacgcctaccacagcatcctgaccagaggcgccagcgtgcagctggtgttcggcttcgagtacgccatcctgatgaccatggtgctgaccatcttcatcaagtacgtgctgcacagcgtggacctgcagagcgagaacccctgggacaacaaggccgtgtacatgctgtacaccgagctgttcaccggcttcatcaaggtgctgctgtacatggccttcatgaccatcatgatcaaggtgcacaccttccccctgttcgccatcagacccatgtacctggccatgagacagttcaagaaggccgtgaccgacgccatcatgagcagaagagccatcagaaacatgaacaccctgtaccccgacgccacccccgaggagctgcaggccatggacaacgtgtgcatcatctgcagagaggagatggtgaccggcgccaagagactgccctgcaaccacatcttccacaccagctgcctgagaagctggttccagagacagcagacctgccccacctgcagaatggacgtgctgagagccagcctgcccgcccagagcccccccccccccgagcccgccgaccagggccccccccccgccccccaccccccccccctgctgccccagccccccaacttcccccagggcctgctgccccccttcccccccggcatgttccccctgtggccccccatgggccccttcccccccgtgccccccccccccagcagcggcgaggccgtggccccccccagcaccagcgccgccctgagcagacccagcggcgccgccaccaccaccgccgccggcaccagcgccaccgccgccagcgccaccgccagcggccccggcagcggcagcgcccccgaggccggccccgcccccggcttccccttcccccccccctggatgggcatgcccctgcccccccccttcgccttcccccccatgcccgtgccccccgccggcttcgccggcctgacccccgaggagctgagagccctggagggccacgagagacagcacctggaggccagactgcagagcctgagaaacatccacaccctgctggacgccgccatgctgcagatcaaccagtacctgaccgtgctggccagcctgggcccccccagacccgccaccagcgtgaacagcaccgaggagaccgccaccaccgtggtggccgccgccagcagcaccagcatccccagcagcgaggccaccacccccacccccggcgccagcccccccgcccccgagatggagagaccccccgcccccgagagcgtgggcaccgaggagatgcccgaggacggcgagcccgacgccgccgagctgagaagaagaagactgcagaagctggagagccccgtggcccactag

SEQ ID NO: 101559 - DNA, 1698 bp, Artificial Sequence
  Description of Artificial Sequence: Synthetic coding sequence
atgttcagaaccgccgtgatgatggccgccagcctggccctgaccggcgccgtggtggcccacgcctactacctgaagcaccagttctaccccaccgtggtgtacctgaccaagagcagccccagcatggccgtgctgtacatccaggccttcgtgctggtgttcctgctgggcaaggtgatgggcaaggtgttcttcggccagctgagagccgccgagatggagcacctgctggagagaagctggtacgccgtgaccgagacctgcctggccttcaccgtgttcagagacgacttcagccccagattcgtggccctgttcaccctgctgctgttcctgaagtgcttccactggctggccgaggacagagtggacttctacgccatcctgatgaccatggtgctgaccatcttcatcaagtacgtgctgcacagcgtggacctgcagagcgagaacccctgggacaacaaggccgtgtacatgctgtacaccgagctgttcaccggcttcatcaaggtgctgctgtacatggccttcatgaccatcatgatcaaggtgcacaccttccccctgttcgccatcagacccatgtacctggccatgagacagttcaagaaggccgtgaccgacgccatcatgagcagaagagccatcagaaacatgaacaccctgtaccccgacgccacccccgaggagctgcaggccatggacaacgtgtgcatcatctgcagagaggagatggtgaccggcgccaagagactgccctgcaaccacatcttccacaccagctgcctgagaagctggttccagagacagcagacctgccccacctgcagaatggacgtgctgagagccagcctgcccgcccagagcccccccccccccgagcccgccgaccagggccccccccccgccccccaccccccccccctgctgccccagccccccaacttcccccagggcctgctgccccccttcccccccggcatgttccccctgtggccccccatgggccccttcccccccgtgccccccccccccagcagcggcgaggccgtggccccccccagcaccagcgccgccctgagcagacccagcggcgccgccaccaccaccgccgccggcaccagcgccaccgccgccagcgccaccgccagcggccccggcagcggcagcgcccccgaggccggccccgcccccggcttccccttcccccccccctggatgggcatgcccctgcccccccccttcgccttcccccccatgcccgtgccccccgccggcttcgccggcctgacccccgaggagctgagagccctggagggccacgagagacagcacctggaggccagactgcagagcctgagaaacatccacaccctgctggacgccgccatgctgcagatcaaccagtacctgaccgtgctggccagcctgggcccccccagacccgccaccagcgtgaacagcaccgaggagaccgccaccaccgtggtggccgccgccagcagcaccagcatccccagcagcgaggccaccacccccacccccggcgccagcccccccgcccccgagatggagagaccccccgcccccgagagcgtgggcaccgaggagatgcccgaggacggcgagcccgacgccgccgagctgagaagaagaagactgcagaagctggagagccccgtggcccactag

SEQ ID NO: 101560 - DNA, 1854 bp, Artificial Sequence
  Description of Artificial Sequence: Synthetic coding sequence
atgttcagaaccgccgtgatgatggccgccagcctggccctgaccggcgccgtggtggcccacgcctactacctgaagcaccagttctaccccaccgtggtgtacctgaccaagagcagccccagcatggccgtgctgtacatccaggccttcgtgctggtgttcctgctgggcaaggtgatgggcaaggtgttcttcggccagctgagagccgccgagatggagcacctgctggagagaagctggtacgccgtgaccgagacctgcctggccttcaccgtgttcagagacgacttcagccccagattcgtggccctgttcaccctgctgctgttcctgaagtgcttccactggctggccgaggacagagtggacttcatggagagaagccccaacatcagctggctgttccactgcagaatcgtgagcctgatgttcctgctgggcatcctggacttcctgttcgtgagccacgcctaccacagcatcctgaccagaggcgccagcgtgcagctggtgttcggcttcgagtacgccatcctgatgaccatggtgctgaccatcttcatcaagtacgtgctgcacagcgtggacctgcagagcgagaacccctgggacaacaaggccgtgtacatgctgtacaccgagctgttcaccggcttcatcaaggtgctgctgtacatggccttcatgaccatcatgatcaaggtgcacaccttccccctgttcgccatcagacccatgtacctggccatgagacagttcaagaaggccgtgaccgacgccatcatgagcagaagagccatcagaaacatgaacaccctgtaccccgacgccacccccgaggagctgcaggccatggacaacgtgtgcatcatctgcagagaggagatggtgaccggcgccaagagactgccctgcaaccacatcttccacaccagctgcctgagaagctggttccagagacagcagacctgccccacctgcagaatggacgtgctgagagccagcctgcccgcccagagcccccccccccccgagcccgccgaccagggccccccccccgccccccaccccccccccctgctgccccagccccccaacttcccccagggcctgctgccccccttcccccccggcatgttccccctgtggccccccatgggccccttcccccccgtgccccccccccccagcagcggcgaggccgtggccccccccagcaccagcgccgccgccctgagcagacccagcggcgccgccaccaccaccgccgccggcaccagcgccaccgccgccagcgccaccgccagcggccccggcagcggcagcgcccccgaggccggccccgcccccggcttccccttcccccccccctggatgggcatgcccctgcccccccccttcgccttcccccccatgcccgtgccccccgccggcttcgccggcctgacccccgaggagctgagagccctggagggccacgagagacagcacctggaggccagactgcagagcctgagaaacatccacaccctgctggacgccgccatgctgcagatcaaccagtacctgaccgtgctggccagcctgggcccccccagacccgccaccagcgtgaacagcaccgaggagaccgccaccaccgtggtggccgccgccagcagcaccagcatccccagcagcgaggccaccacccccacccccggcgccagcccccccgcccccgagatggagagaccccccgcccccgagagcgtgggcaccgaggagatgcccgaggacggcgagcccgacgccgccgagctgagaagaagaagactgcagaagctggagagccccgtggcccactag

SEQ ID NO: 101561 - DNA, 1890 bp, Artificial Sequence
  Description of Artificial Sequence: Synthetic coding sequence
atgttcagaaccgccgtgatgatggccgccagcctggccctgaccggcgccgtggtggcccacgcctactacctgaagcaccagttctaccccaccgtggtgtacctgaccaagagcagccccagcatggccgtgctgtacatccaggccttcgtgctggtgttcctgctgggcaaggtgatgggcaaggtgttcttcggccagctgagagccgccgagatggagcacctgctggagagaagctggtacgccgtgaccgagacctgcctggccttcaccgtgttcagagacgacttcagccccagattcgtggccctgttcaccctgctgctgttcctgaagtgcttccactggctggccgaggacagagtggacttcatggagagaagccccaacatcagctggctgttccactgcagaatcgtgagcctgatgttcctgctgggcatcctggacttcctgttcgtgagccacgcctaccacagcatcctgaccagaggcgccagcgtgcagctggtgttcggcttcgagtacgccatcctgatgaccatggtgctgaccatcttcatcaagtacgtgctgcacagcgtggacctgcagagcgagaacccctgggacaacaaggccgtgtacatgctgtacaccgagctgttcaccggcttcatcaaggtgctgctgtacatggccttcatgaccatcatgatcaaggtgcacaccttccccctgttcgccatcagacccatgtacctggccatgagacagttcaagaaggccgtgaccgacgccatcatgagcagaagagccatcagaaacatgaacaccctgtaccccgacgccacccccgaggagctgcaggccatggacaacgtgtgcatcatctgcagagaggagatggtgaccggcgccaagagactgccctgcaaccacatcttccacaccagctgcctgagaagctggttccagagacagcagacctgccccacctgcagaatggacgtgctgagagccagcctgcccgcccagagcccccccccccccgagcccgccgaccagggccccccccccgccccccaccccccccccctgctgccccagccccccaacttcccccagggcctgctgccccccttcccccccggcatgttccccctgtggccccccatgggccccttcccccccgtgccccccccccccagcagcggcgaggccgtggccccccccagcaccagcgccgccgccctgagcagacccagcggcgccgccaccaccaccgccgccggcaccagcgccaccgccgccagcgccaccgccagcggccccggcagcggcagcgcccccgaggccggccccgcccccggcttccccttcccccccccctggatgggcatgcccctgcccccccccttcgccttcccccccatgcccgtgccccccgccggcttcgccggcctgacccccgaggagctgagagccctggagggccacgagagacagcacctggaggccagactgcagagcctgagaaacatccacaccctgctggacgccgccatgctgcagatcaaccagtacctgaccgtgctggccagcctgggcccccccggcctgcccctgcagagcacccccctgagaagactgcccctgcagctgctgctgctgccccccccccccgccagcctggcccagagacccagaccccagccccaggagcccccccaccagcccctgaagtggaagggcctgcagctgctgagccagtgggcccagagaagatgcctgagaatggagagccccatgcagcagagcagcgccggcgccgcctgcagaagctggagcctgctgctgcccaccgacaccgcccccgcccagccccagcccctgctgttctag

SEQ ID NO: 101562 - DNA, 1851 bp, Artificial Sequence; identical to SEQ ID NO: 101558
  Description of Artificial Sequence: Synthetic coding sequence

SEQ ID NO: 101563 - DNA, 1191 bp, Artificial Sequence
  Description of Artificial Sequence: Synthetic coding sequence
atgagcgtggccttcgccagcgccagacccagaggcaagggcgaggtgacccagcagaccatccagaagatgctggacgagaaccaccacctgatccagtgcatcctggagtaccagagcaagggcaagaccgccgagtgcacccagtaccagcagatcctgcacagaaacctggtgtacctggccaccatcgccgacagcaaccagaacatgcagagcctgctgcccgccccccccacccagaacatgaacctgggccccggcgccctgacccagagcggcagcagccagggcctgcacagccagggcagcctgagcgacgccatcagcaccggcctgccccccagcagcctgctgcagggccagatcggcaacggccccagccacgtgagcatgcagcagaccgcccccaacaccctgcccaccaccagcatgagcatcagcggccccggctacagccacgccggccccgccagccagggcgtgcccatgcagggccagggcaccatcggcaactacgtgagcagaaccaacatcaacatgcagagcaaccccgtgagcatgatgcagcagcaggccgccaccagccactacagcagcgcccagggcggcagccagcactaccagggccagagcagcatcgccatgatgggccagggcagccagggcagcagcatgatgggccagagacccatggccccctacagacccagccagcagggcagcagccagcagtacctgggccaggaggagtactacggcgagcagtacagccacagccagggcgccgccgagcccatgggccagcagtactaccccgacggccacggcgactacgcctaccagcagagcagctacaccgagcagagctacgacagaagcttcgaggagagcacccagcactactacgagggcggcaacagccagtacagccagcagcaggccggctaccagcagggcgccgcccagcagcagacctacagccagcagcagtaccccagccagcagagctaccccggccagcagcagggctacggcagcgcccagggcgcccccagccagtaccccggctaccagcagggccagggccagcagtacggcagctacagagccccccagaccgcccccagcgcccagcagcagagaccctacggctacgagcagggccagtacggcaactaccagcagtag

SEQ ID NO: 101564 - DNA, 1200 bp, Artificial Sequence
  Description of Artificial Sequence: Synthetic coding sequence
atgcagagcctgagcaccgaggccagatacgtgcccagagtgccccagcacagagaccagatcagccccagaagcccccagcacggcggccagatctgccccagaagccccctgcacagaggccagatctgccccagaagcccccccgccagaagataccagcagatcctgcacagaaacctggtgtacctggccaccatcgccgacagcaaccagaacatgcagagcctgctgcccgccccccccacccagaacatgaacctgggccccggcgccctgacccagagcggcagcagccagggcctgcacagccagggcagcctgagcgacgccatcagcaccggcctgccccccagcagcctgctgcagggccagatcggcaacggccccagccacgtgagcatgcagcagaccgcccccaacaccctgcccaccaccagcatgagcatcagcggccccggctacagccacgccggccccgccagccagggcgtgcccatgcagggccagggcaccatcggcaactacgtgagcagaaccaacatcaacatgcagagcaaccccgtgagcatgatgcagcagcaggccgccaccagccactacagcagcgcccagggcggcagccagcactaccagggccagagcagcatcgccatgatgggccagggcagccagggcagcagcatgatgggccagagacccatggccccctacagacccagccagcagggcagcagccagcagtacctgggccaggaggagtactacggcgagcagtacagccacagccagggcgccgccgagcccatgggccagcagtactaccccgacggccacggcgactacgcctaccagcagagcagctacaccgagcagagctacgacagaagcttcgaggagagcacccagcactactacgagggcggcaacagccagtacagccagcagcaggccggctaccagcagggcgccgcccagcagcagacctacagccagcagcagtaccccagccagcagagctaccccggccagcagcagggctacggcagcgcccagggcgcccccagccagtaccccggctaccagcagggccagggccagcagtacggcagctacagagccccccagaccgcccccagcgcccagcagcagagaccctacggctacgagcagggccagtacggcaactaccagcagtag

SEQ ID NO: 101565 - DNA, 1191 bp, Artificial Sequence; identical to SEQ ID NO: 101563
  Description of Artificial Sequence: Synthetic coding sequence

SEQ ID NO: 101566 - DNA, 387 bp, Artificial Sequence
  Description of Artificial Sequence: Synthetic coding sequence
atgcagagcctgagcaccgaggccagatacgtgcccagagtgccccagcacagagaccagatcagccccagaagcccccagcacggcggccagatctgccccagaagccccctgcacagaggccagatctgccccagaagcccccccgccagaagataccagcagatcctgcacagaaacctggtgtacctggccaccatcgccgacagcaaccagaacatgcagagcctgctgcccgccccccccacccagaacatgaacctgggccccggcgccctgacccagagcggcagcagccagggcctgcacagccagggcagcctgagcgacgccatcagcaccggcctgccccccagcagcctgctgcagggccagatcggcaactag

SEQ ID NO: 101567 - DNA, 234 bp, Artificial Sequence
  Description of Artificial Sequence: Synthetic coding sequence
atgagcgtggccttcgtgcccgactggctgagaggcaaggccgaggtgaaccaggagaccatccagagactgctggaggagaacgaccagctgatcagatgcatcgtggagtaccagaacaagggcagaggcaacgagtgcgtgcagtaccagcacgtgctgcacagaaacctgatctacctggccaccatcgccgacgccagccccaccagcaccagcaaggccatggagtag

SEQ ID NO: 101568 - DNA, 234 bp, Artificial Sequence; identical to SEQ ID NO: 101567
  Description of Artificial Sequence: Synthetic coding sequence

SEQ ID NO: 101569 - DNA, 1164 bp, Artificial Sequence
  Description of Artificial Sequence: Synthetic coding sequence
atgagcgtggccttcgccgcccccagacagagaggcaagggcgagatcacccccgccgccatccagaagatgctggacgacaacaaccacctgatccagtgcatcatggacagccagaacaagggcaagaccagcgagtgcagccagtaccagcagatgctgcacaccaacctggtgtacctggccaccatcgccgacagcaaccagaacatgcagagcctgctgcccgccccccccacccagaacatgcccatgggccccggcggcatgaaccagagcggccccccccccccccccagaagccacaacatgcccagcgacggcatggtgggcggcggcccccccgccccccacatgcagaaccagatgaacggccagatgcccggccccaaccacatgcccatgcagggccccggccccaaccagctgaacatgaccaacagcagcatgaacatgcccagcagcagccacggcagcatgggcggctacaaccacagcgtgcccagcagccagagcatgcccgtgcagaaccagatgaccatgagccagggccagcccatgggcaactacggccccagacccaacatgagcatgcagcccaaccagggccccatgatgcaccagcagccccccagccagcagtacaacatgccccagggcggcggccagcactaccagggccagcagccccccatgggcatgatgggccaggtgaaccagggcaaccacatgatgggccagagacagatccccccctacagacccccccagcagggccccccccagcagtacagcggccaggaggactactacggcgaccagtacagccacggcggccagggcccccccgagggcatgaaccagcagtactaccccgacggcaacagccagtacggccagcagcaggacgcctaccagggcccccccccccagcagggctaccccccccagcagcagcagtaccccggccagcagggctaccccggccagcagcagggctacggccccagccagggcggccccggcccccagtaccccaactacccccagggccagggccagcagtacggcggctacagacccacccagcccggccccccccagcccccccagcagagaccctacggctacgaccagggccagtacggcaactaccagcagtag

SEQ ID NO: 101570 - DNA, 1257 bp, Artificial Sequence
  Description of Artificial Sequence: Synthetic coding sequence
atgagcgtggccttcgccgcccccagacagagaggcaagggcgagatcacccccgccgccatccagaagatgctggacgacaacaaccacctgatccagtgcatcatggacagccagaacaagggcaagaccagcgagtgcagccagtaccagcagatgctgcacaccaacctggtgtacctggccaccatcgccgacagcaaccagaacatgcagagcctgctgcccgccccccccacccagaacatgcccatgggccccggcggcatgaaccagagcggccccccccccccccccagaagccacaacatgcccagcgacggcatggtgggcggcggcccccccgccccccacatgcagaaccagatgaacggccagatgcccggccccaaccacatgcccatgcagggccccggccccaaccagctgaacatgaccaacagcagcatgaacatgcccagcagcagccacggcagcatgggcggctacaaccacagcgtgcccagcagccagagcatgcccgtgcagaaccagatgaccatgagccagggccagcccatgggcaactacggccccagacccaacatgagcatgcagcccaaccagggccccatgatgcaccagcagccccccagccagcagtacaacatgccccagggcggcggccagcactaccagggccagcagccccccatgggcatgatgggccaggtgaaccagggcaaccacatgatgggccagagacagatccccccctacagacccccccagcagggccccccccagcagtacagcggccaggaggactactacggcgaccagtacagccacggcggccagggcccccccgagggcatgaaccagcagtactaccccgacggccacaacgactacggctaccagcagcccagctaccccgagcagggctacgacagaccctacgaggacagcagccagcactactacgagggcggcaacagccagtacggccagcagcaggacgcctaccagggcccccccccccagcagggctaccccccccagcagcagcagtaccccggccagcagggctaccccggccagcagcagggctacggccccagccagggcggccccggcccccagtaccccaactacccccagggccagggccagcagtacggcggctacagacccacccagcccggccccccccagcccccccagcagagaccctacggctacgaccagggccagtacggcaactaccagcagtag

SEQ ID NO: 101571 - DNA, 1266 bp, Artificial Sequence
  Description of Artificial Sequence: Synthetic coding sequence
ggcggcaacatgagcgtggccttcgccgcccccagacagagaggcaagggcgagatcacccccgccgccatccagaagatgctggacgacaacaaccacctgatccagtgcatcatggacagccagaacaagggcaagaccagcgagtgcagccagtaccagcagatgctgcacaccaacctggtgtacctggccaccatcgccgacagcaaccagaacatgcagagcctgctgcccgccccccccacccagaacatgcccatgggccccggcggcatgaaccagagcggccccccccccccccccagaagccacaacatgcccagcgacggcatggtgggcggcggcccccccgccccccacatgcagaaccagatgaacggccagatgcccggccccaaccacatgcccatgcagggccccggccccaaccagctgaacatgaccaacagcagcatgaacatgcccagcagcagccacggcagcatgggcggctacaaccacagcgtgcccagcagccagagcatgcccgtgcagaaccagatgaccatgagccagggccagcccatgggcaactacggccccagacccaacatgagcatgcagcccaaccagggccccatgatgcaccagcagccccccagccagcagtacaacatgccccagggcggcggccagcactaccagggccagcagccccccatgggcatgatgggccaggtgaaccagggcaaccacatgatgggccagagacagatccccccctacagacccccccagcagggccccccccagcagtacagcggccaggaggactactacggcgaccagtacagccacggcggccagggcccccccgagggcatgaaccagcagtactaccccgacggccacaacgactacggctaccagcagcccagctaccccgagcagggctacgacagaccctacgaggacagcagccagcactactacgagggcggcaacagccagtacggccagcagcaggacgcctaccagggcccccccccccagcagggctaccccccccagcagcagcagtaccccggccagcagggctaccccggccagcagcagggctacggccccagccagggcggccccggcccccagtaccccaactacccccagggccagggccagcagtacggcggctacagacccacccagcccggccccccccagcccccccagcagagaccctacggctacgaccagggccagtacggcaactaccagcagtag

SEQ ID NO: 101572 - DNA, 399 bp, Artificial Sequence
  Description of Artificial Sequence: Synthetic coding sequence
atgaaccagcagtactaccccgacggccacaacgactacggctaccagcagcccagctaccccgagcagggctacgacagaccctacgaggacagcagccagcactactacgagggcggcaacagccagtacggccagcagcaggacgcctaccagggcccccccccccagcagggctaccccccccagcagcagcagtaccccggccagcagggctaccccggccagcagcagggctacggccccagccagggcggccccggcccccagtaccccaactacccccagggccagggccagcagtacggcggctacagacccacccagcccggccccccccagcccccccagcagagaccctacggctacgaccagaacagcagatggaccgtgtgctag

SEQ ID NO: 101573 - DNA, 1011 bp, Artificial Sequence
  Description of Artificial Sequence: Synthetic coding sequence
atgcccatgggccccggcggcatgaaccagagcggccccccccccccccccagaagccacaacatgcccagcgacggcatggtgggcggcggcccccccgccccccacatgcagaaccagatgaacggccagatgcccggccccaaccacatgcccatgcagggccccggccccaaccagctgaacatgaccaacagcagcatgaacatgcccagcagcagccacggcagcatgggcggctacaaccacagcgtgcccagcagccagagcatgcccgtgcagaaccagatgaccatgagccagggccagcccatgggcaactacggccccagacccaacatgagcatgcagcccaaccagggccccatgatgcaccagcagccccccagccagcagtacaacatgccccagggcggcggccagcactaccagggccagcagccccccatgggcatgatgggccaggtgaaccagggcaaccacatgatgggccagagacagatccccccctacagacccccccagcagggccccccccagcagtacagcggccaggaggactactacggcgaccagtacagccacggcggccagggcccccccgagggcatgaaccagcagtactaccccgacggccacaacgactacggctaccagcagcccagctaccccgagcagggctacgacagaccctacgaggacagcagccagcactactacgagggcggcaacagccagtacggccagcagcaggacgcctaccagggcccccccccccagcagggctaccccccccagcagcagcagtaccccggccagcagggctaccccggccagcagcagggctacggccccagccagggcggccccggcccccagtaccccaactacccccagggccagggccagcagtacggcggctacagacccacccagcccggccccccccagcccccccagcagagaccctacggctacgaccagggccagtacggcaactaccagcagtag

SEQ ID NO: 101574 - DNA, 1188 bp, Artificial Sequence
  Description of Artificial Sequence: Synthetic coding sequence
atgctggacgacaacaaccacctgatccagtgcatcatggacagccagaacaagggcaagaccagcgagtgcagccagtaccagcagatgctgcacaccaacctggtgtacctggccaccatcgccgacagcaaccagaacatgcagagcctgctgcccgccccccccacccagaacatgcccatgggccccggcggcatgaaccagagcggccccccccccccccccagaagccacaacatgcccagcgacggcatggtgggcggcggcccccccgccccccacatgcagaaccagatgaacggccagatgcccggccccaaccacatgcccatgcagggccccggccccaaccagctgaacatgaccaacagcagcatgaacatgcccagcagcagccacggcagcatgggcggctacaaccacagcgtgcccagcagccagagcatgcccgtgcagaaccagatgaccatgagccagggccagcccatgggcaactacggccccagacccaacatgagcatgcagcccaaccagggccccatgatgcaccagcagccccccagccagcagtacaacatgccccagggcggcggccagcactaccagggccagcagccccccatgggcatgatgggccaggtgaaccagggcaaccacatgatgggccagagacagatccccccctacagacccccccagcagggccccccccagcagtacagcggccaggaggactactacggcgaccagtacagccacggcggccagggcccccccgagggcatgaaccagcagtactaccccgacggccacaacgactacggctaccagcagcccagctaccccgagcagggctacgacagaccctacgaggacagcagccagcactactacgagggcggcaacagccagtacggccagcagcaggacgcctaccagggcccccccccccagcagggctaccccccccagcagcagcagtaccccggccagcagggctaccccggccagcagcagggctacggccccagccagggcggccccggcccccagtaccccaactacccccagggccagggccagcagtacggcggctacagacccacccagcccggccccccccagcccccccagcagagaccctacggctacgaccagggccagtacggcaactaccagcagtag

SEQ ID NO: 101575 - DNA, 1008 bp, Artificial Sequence
  Description of Artificial Sequence: Synthetic coding sequence
atgctgcacaccaacctggtgtacctggccaccatcgccgacagcaaccagaacatgcagagcctgctgcccgccccccccacccagaacatgcccatgggccccggcggcatgaaccagagcggccccccccccccccccagaagccacaacatgcccagcgacggcatggtgggcggcggcccccccgccccccacatgcagaaccagatgaacggccagatgcccggccccaaccacatgcccatgcagggccccggccccaaccagctgaacatgaccaacagcagcatgaacatgcccagcagcagccacggcagcatgggcggctacaaccacagcgtgcccagcagccagagcatgcccgtgcagaaccagatgaccatgagccagggccagcccatgggcaactacggccccagacccaacatgagcatgcagcccaaccagggccccatgatgcaccagcagccccccagccagcagtacaacatgccccagggcggcggccagcactaccagggccagcagccccccatgggcatgatgggccaggtgaaccagggcaaccacatgatgggccagagacagatccccccctacagacccccccagcagggccccccccagcagtacagcggccaggaggactactacggcgaccagtacagccacggcggccagggcccccccgagggcatgaaccagcagtactaccccgacggcaacagccagtacggccagcagcaggacgcctaccagggcccccccccccagcagggctaccccccccagcagcagcagtaccccggccagcagggctaccccggccagcagcagggctacggccccagccagggcggccccggcccccagtaccccaactacccccagggccagggccagcagtacggcggctacagacccacccagcccggccccccccagcccccccagcagagaccctacggctacgaccagggccagtacggcaactaccagcagtag

SEQ ID NO: 101576 - DNA, 1008 bp, Artificial Sequence; identical to SEQ ID NO: 101575
  Description of Artificial Sequence: Synthetic coding sequence

SEQ ID NO: 101577 - DNA, 567 bp, Artificial Sequence
  Description of Artificial Sequence: Synthetic coding sequence
atgaacggcgacgacaccttcgccaagagacccagagacgacgccaaggccagcgagaagagaagcaaggccttcgacgacatcgccacctacttcagcaagaaggagtggaagaagatgaagtacagcgagaagatcagctacgtgtacatgaagagaaactacaaggccatgaccaagctgggcttcaaggtgaccctgccccccttcatgtgcaacaagcaggccaccgacttccagggcaacgacttcgacaacgaccacaacagaagaatccaggtggagcacccccagatgaccttcggcagactgcacagaatcatccccaagatcatgcccaagaagcccgccgaggacgagaacgacagcaagggcgtgagcgaggccagcggcccccagaacgacggcaagcagctgcacccccccggcaaggccaacatcagcgagaagatcaacaagagaagcggccccaagagaggcaagcacgcctggacccacagactgagagagagaaagcagctggtgatctacgaggagatcagcgaccccgaggaggacgacgagtag

SEQ ID NO: 101578 - DNA, 672 bp, Artificial Sequence
  Description of Artificial Sequence: Synthetic coding sequence
atgaacggcgacgacgccttcgccagaagacccaccgtgggcgcccagatccccgagaagatccagaaggccttcgacgacatcgccaagtacttcagcaaggaggagtgggagaagatgaaggccagcgagaagatcttctacgtgtacatgaagagaaagtacgaggccatgaccaagctgggcttcaaggccaccctgccccccttcatgtgcaacaagagagccgaggacttccagggcaacgacctggacaacgaccccaacagaggcaaccaggtggagagaccccagatgaccttcggcagactgcagggcatcagccccaagatcatgcccaagaagcccgccgaggagggcaacgacagcgaggaggtgcccgaggccagcggcccccagaacgacggcaaggagctgtgcccccccggcaagcccaccaccagcgagaagatccacgagagaagcggcaacagagaggcccaggagaaggaggagagaagaggcaccgcccacagatggagcagccagaacacccacaacatcggcagattcagcctgagcaccagcatgggcgccgtgcacggcacccccaagaccatcacccacaacagagaccccaagggcggcaacatgcccggccccaccgactgcgtgagagagaacagctggtag

SEQ ID NO: 101579 - DNA, 567 bp, Artificial Sequence
  Description of Artificial Sequence: Synthetic coding sequence
atgaacggcgacgacgccttcgccagaagacccaccgtgggcgcccagatccccgagaagatccagaaggccttcgacgacatcgccaagtacttcagcaaggaggagtgggagaagatgaaggccagcgagaagatcttctacgtgtacatgaagagaaagtacgaggccatgaccaagctgggcttcaaggccaccctgccccccttcatgtgcaacaagagagccgaggacttccagggcaacgacctggacaacgaccccaacagaggcaaccaggtggagagaccccagatgaccttcggcagactgcagggcatcagccccaagatcatgcccaagaagcccgccgaggagggcaacgacagcgaggaggtgcccgaggccagcggcccccagaacgacggcaaggagctgtgcccccccggcaagcccaccaccagcgagaagatccacgagagaagcggccccaagagaggcgagcacgcctggacccacagactgagagagagaaagcagctggtgatctacgaggagatcagcgaccccgaggaggacgacgagtag

SEQ ID NO: 101580 - DNA, 567 bp, Artificial Sequence
  Description of Artificial Sequence: Synthetic coding sequence
atgaacggcgacgacaccttcgccagaagacccaccgtgggcgcccagatccccgagaagatccagaaggccttcgacgacatcgccaagtacttcagcaaggaggagtgggagaagatgaaggtgagcgagaagatcgtgtacgtgtacatgaagagaaagtacgaggccatgaccaagctgggcttcaaggccatcctgcccagcttcatgagaaacaagagagtgaccgacttccagggcaacgacttcgacaacgaccccaacagaggcaaccaggtgcagagaccccagatgaccttcggcagactgcagggcatcttccccaagatcatgcccaagaagcccgccgaggagggcaacgtgagcaaggaggtgcccgaggccagcggcccccagaacgacggcaagcagctgtgcccccccggcaagcccaccaccagcgagaagatcaacatgatcagcggccccaagagaggcgagcacgcctggacccacagactgagagagagaaagcagctggtgatctacgaggagatcagcgaccccgaggaggacgacgagtag

SEQ ID NO: 101581 - DNA, 513 bp, Artificial Sequence
  Description of Artificial Sequence: Synthetic coding sequence
atgaacggcgacgacaccttcgccagaagacccaccgtgggcgcccagatccccgagaagatccagaaggccttcgacgacatcgccaagtacttcagcaaggaggagtgggagaagatgaaggtgagcgagaagatcgtgtacgtgtacatgaagagaaagtacgaggccatgaccaagctgggcttcaaggccatcctgcccagcttcatgagaaacaagagagtgaccgacttccagggcaacgacttcgacaacgaccccaacagaggcaaccaggtgcagagaccccagatgaccttcggcagactgcagggcatcttccccaagatcatgcccaagaagcccgccgaggagggcaacgtgagcaaggaggtgcccgaggccagcggcccccagaacgacggcaagcagctgtgcccccccggcaagcccaccaccagcgagaagatcaacatgatcagcggcgtgctgcagagatactgcagattcggcagcagacccctgcagtag

SEQ ID NO: 101582 - DNA, 303 bp, Artificial Sequence
  Description of Artificial Sequence: Synthetic coding sequence
atgtacagcctgagcgtgcagagaccccagatgaccttcggcagactgcagggcatcttccccaagatcatgcccaagaagcccgccgaggagggcaacgtgagcaaggaggtgcccgaggccagcggcccccagaacgacggcaagcagctgtgcccccccggcaagcccaccaccagcgagaagatcaacatgatcagcggccccaagagaggcgagcacgcctggacccacagactgagagagagaaagcagctggtgatctacgaggagatcagcgaccccgaggaggacgacgagtag

SEQ ID NO: 101583 - DNA, 462 bp, Artificial Sequence
  Description of Artificial Sequence: Synthetic coding sequence
atgaacggcgacgacgccttcgccagaagacccagagacgacgcccagatcagcgagaagctgagaaaggccttcgacgacatcgccaagtacttcagcaagaaggagtgggagaagatgaagagcagcgagaagatcgtgtacgtgtacatgaagctgaactacgaggtgatgaccaagctgggcttcaaggtgaccctgccccccttcatgagaagcaagagagccgccgacttccacggcaacgacttcggcaacgacagaaaccacagaaaccaggtggagagaccccagatgaccttcggcagcctgcagagaatcttccccaaggaccccaagggcggcaacatgcccggccccaccgactgcgtgagagagagcagctggtggttcatgaagagaagcgccaccctgagaaagatgaccagcaacagccccagaggctacgacacctgcccctag

SEQ ID NO: 101584 - DNA, 567 bp, Artificial Sequence
  Description of Artificial Sequence: Synthetic coding sequence
atgaacggcgacgacgccttcgccagaagacccagagacgacgcccagatcagcgagaagctgagaaaggccttcgacgacatcgccaagtacttcagcaagaaggagtgggagaagatgaagagcagcgagaagatcgtgtacgtgtacatgaagctgaactacgaggtgatgaccaagctgggcttcaaggtgaccctgccccccttcatgagaagcaagagagccgccgacttccacggcaacgacttcggcaacgacagaaaccacagaaaccaggtggagagaccccagatgaccttcggcagcctgcagagaatcttccccaagatcatgcccaagaagcccgccgaggaggagaacggcctgaaggaggtgcccgaggccagcggcccccagaacgacggcaagcagctgtgcccccccggcaaccccagcaccctggagaagatcaacaagaccagcggccccaagagaggcaagcacgcctggacccacagactgagagagagaaagcagctggtggtgtacgaggagatcagcgaccccgaggaggacgacgagtag

SEQ ID NO: 101585 - DNA, 1992 bp, Artificial Sequence
  Description of Artificial Sequence: Synthetic coding sequence
atgggccccctgagagagagcaagaaggagcacagagtgcagcaccacgacaaggagatcagcagaagcagaatccccagactgatcctgagaccccacatgccccagcagcagcacaaggtgagccccgccagcgagagccccttcagcgaggaggagagcagagagttcaaccccagcagcagcggcagaagcgccagaaccgtgagcagcaacagcttctgcagcgacgacaccggctgccccagcagccagagcgtgagccccgtgaagacccccagcgacgccggcaacagccccatcggcttctgccccggcagcgacgagggcttcaccagaaagaagtgcaccatcggcatggtgggcgagggcagcatccagagcagcagatacaagaaggagagcaagagcggcctggtgaagcccggcagcgaggccgacttcagcagcagcagcagcaccggcagcatcagcgcccccgaggtgcacatgagcaccgccggcagcaagagaagcagcagcagcagaaacagaggcccccacggcagaagcaacggcgccagcagccacaagcccggcagcagccccagcagccccagagagaaggacctgctgagcatgctgtgcagaaaccagctgagccccgtgaacatccaccccagctacgcccccagcagccccagcagcagcaacagcggcagctacaagggcagcgactgcagccccatcatgagaagaagcggcagatacatgagctgcggcgagaaccacggcgtgagaccccccaaccccgagcagtacctgacccccctgcagcagaaggaggtgaccgtgagacacctgaagaccaagctgaaggagagcgagagaagactgcacgagagagagagcgagatcgtggagctgaagagccagctggccagaatgagagaggactggatcgaggaggagtgccacagagtggaggcccagctggccctgaaggaggccagaaaggagatcaagcagctgaagcaggtgatcgagaccatgagaagcagcctggccgacaaggacaagggcatccagaagtacttcgtggacatcaacatccagaacaagaagctggagagcctgctgcagagcatggagatggcccacagcggcagcctgagagacgagctgtgcctggacttcccctgcgacagccccgagaagagcctgaccctgaacccccccctggacaccatggccgacggcctgagcctggaggagcaggtgaccggcgagggcgccgacagagagctgctggtgggcgacagcatcgccaacagcaccgacctgttcgacgagatcgtgaccgccaccaccaccgagagcggcgacctggagctggtgcacagcacccccggcgccaacgtgctggagctgctgcccatcgtgatgggccaggaggagggcagcgtggtggtggagagagccgtgcagaccgacgtggtgccctacagccccgccatcagcgagctgatccagagcgtgctgcagaagctgcaggacccctgccccagcagcctggccagccccgacgagagcgagcccgacagcatggagagcttccccgagagcctgagcgccctggtggtggacctgacccccagaaaccccaacagcgccatcctgctgagccccgtggagaccccctacgccaacgtggacgccgaggtgcacgccaacagactgatgagagagctggacttcgccgcctgcgtggaggagagactggacggcgtgatccccctggccagaggcggcgtggtgagacagtactggagcagcagcttcctggtggacctgctggccgtggccgcccccgtggtgcccaccgtgctgtgggccttcagcacccagagaggcggcaccgaccccgtgtacaacatcggcgccctgctgagaggctgctgcgtggtggccctgcacagcctgagaagaaccgccttcagaatcaagacctag

SEQ ID NO: 101586 - DNA, 1983 bp, Artificial Sequence
  Description of Artificial Sequence: Synthetic coding sequence
atgagcaacttcgagaaggagcacagagtgcagcaccacgacaaggagatcagcagaagcagaatccccagactgatcctgagaccccacatgccccagcagcagcacaaggtgagccccgccagcgagagccccttcagcgaggaggagagcagagagttcaaccccagcagcagcggcagaagcgccagaaccgtgagcagcaacagcttctgcagcgacgacaccggctgccccagcagccagagcgtgagccccgtgaagacccccagcgacgccggcaacagccccatcggcttctgccccggcagcgacgagggcttcaccagaaagaagtgcaccatcggcatggtgggcgagggcagcatccagagcagcagatacaagaaggagagcaagagcggcctggtgaagcccggcagcgaggccgacttcagcagcagcagcagcaccggcagcatcagcgcccccgaggtgcacatgagcaccgccggcagcaagagaagcagcagcagcagaaacagaggcccccacggcagaagcaacggcgccagcagccacaagcccggcagcagccccagcagccccagagagaaggacctgctgagcatgctgtgcagaaaccagctgagccccgtgaacatccaccccagctacgcccccagcagccccagcagcagcaacagcggcagctacaagggcagcgactgcagccccatcatgagaagaagcggcagatacatgagctgcggcgagaaccacggcgtgagaccccccaaccccgagcagtacctgacccccctgcagcagaaggaggtgaccgtgagacacctgaagaccaagctgaaggagagcgagagaagactgcacgagagagagagcgagatcgtggagctgaagagccagctggccagaatgagagaggactggatcgaggaggagtgccacagagtggaggcccagctggccctgaaggaggccagaaaggagatcaagcagctgaagcaggtgatcgagaccatgagaagcagcctggccgacaaggacaagggcatccagaagtacttcgtggacatcaacatccagaacaagaagctggagagcctgctgcagagcatggagatggcccacagcggcagcctgagagacgagctgtgcctggacttcccctgcgacagccccgagaagagcctgaccctgaacccccccctggacaccatggccgacggcctgagcctggaggagcaggtgaccggcgagggcgccgacagagagctgctggtgggcgacagcatcgccaacagcaccgacctgttcgacgagatcgtgaccgccaccaccaccgagagcggcgacctggagctggtgcacagcacccccggcgccaacgtgctggagctgctgcccatcgtgatgggccaggaggagggcagcgtggtggtggagagagccgtgcagaccgacgtggtgccctacagccccgccatcagcgagctgatccagagcgtgctgcagaagctgcaggacccctgccccagcagcctggccagccccgacgagagcgagcccgacagcatggagagcttccccgagagcctgagcgccctggtggtggacctgacccccagaaaccccaacagcgccatcctgctgagccccgtggagaccccctacgccaacgtggacgccgaggtgcacgccaacagactgatgagagagctggacttcgccgcctgcgtggaggagagactggacggcgtgatccccctggccagaggcggcgtggtgagacagtactggagcagcagcttcctggtggacctgctggccgtggccgcccccgtggtgcccaccgtgctgtgggccttcagcacccagagaggcggcaccgaccccgtgtacaacatcggcgccctgctgagaggctgctgcgtggtggccctgcacagcctgagaagaaccgccttcagaatcaagacctag

SEQ ID NO: 101587 - DNA, 1635 bp, Artificial Sequence
  Description of Artificial Sequence: Synthetic coding sequence
atggtgggcgagggcagcatccagagcagcagatacaagaaggagagcaagagcggcctggtgaagcccggcagcgaggccgacttcagcagcagcagcagcaccggcagcatcagcgcccccgaggtgcacatgagcaccgccggcagcaagagaagcagcagcagcagaaacagaggcccccacggcagaagcaacggcgccagcagccacaagcccggcagcagccccagcagccccagagagaaggacctgctgagcatgctgtgcagaaaccagctgagccccgtgaacatccaccccagctacgcccccagcagccccagcagcagcaacagcggcagctacaagggcagcgactgcagccccatcatgagaagaagcggcagatacatgagctgcggcgagaaccacggcgtgagaccccccaaccccgagcagtacctgacccccctgcagcagaaggaggtgaccgtgagacacctgaagaccaagctgaaggagagcgagagaagactgcacgagagagagagcgagatcgtggagctgaagagccagctggccagaatgagagaggactggatcgaggaggagtgccacagagtggaggcccagctggccctgaaggaggccagaaaggagatcaagcagctgaagcaggtgatcgagaccatgagaagcagcctggccgacaaggacaagggcatccagaagtacttcgtggacatcaacatccagaacaagaagctggagagcctgctgcagagcatggagatggcccacagcggcagcctgagagacgagctgtgcctggacttcccctgcgacagccccgagaagagcctgaccctgaacccccccctggacaccatggccgacggcctgagcctggaggagcaggtgaccggcgagggcgccgacagagagctgctggtgggcgacagcatcgccaacagcaccgacctgttcgacgagatcgtgaccgccaccaccaccgagagcggcgacctggagctggtgcacagcacccccggcgccaacgtgctggagctgctgcccatcgtgatgggccaggaggagggcagcgtggtggtggagagagccgtgcagaccgacgtggtgccctacagccccgccatcagcgagctgatccagagcgtgctgcagaagctgcaggacccctgccccagcagcctggccagccccgacgagagcgagcccgacagcatggagagcttccccgagagcctgagcgccctggtggtggacctgacccccagaaaccccaacagcgccatcctgctgagccccgtggagaccccctacgccaacgtggacgccgaggtgcacgccaacagactgatgagagagctggacttcgccgcctgcgtggaggagagactggacggcgtgatccccctggccagaggcggcgtggtgagacagtactggagcagcagcttcctggtggacctgctggccgtggccgcccccgtggtgcccaccgtgctgtgggccttcagcacccagagaggcggcaccgaccccgtgtacaacatcggcgccctgctgagaggctgctgcgtggtggccctgcacagcctgagaagaaccgccttcagaatcaagacctag

SEQ ID NO: 101588 - DNA, 1992 bp, Artificial Sequence; identical to SEQ ID NO: 101585
  Description of Artificial Sequence: Synthetic coding sequence

SEQ ID NO: 101589 - DNA, 1989 bp, Artificial Sequence
  Description of Artificial Sequence: Synthetic coding sequence
atgggccccctgagagagagcaaggagcacagagtgcagcaccacgacaaggagatcagcagaagcagaatccccagactgatcctgagaccccacatgccccagcagcagcacaaggtgagccccgccagcgagagccccttcagcgaggaggagagcagagagttcaaccccagcagcagcggcagaagcgccagaaccgtgagcagcaacagcttctgcagcgacgacaccggctgccccagcagccagagcgtgagccccgtgaagacccccagcgacgccggcaacagccccatcggcttctgccccggcagcgacgagggcttcaccagaaagaagtgcaccatcggcatggtgggcgagggcagcatccagagcagcagatacaagaaggagagcaagagcggcctggtgaagcccggcagcgaggccgacttcagcagcagcagcagcaccggcagcatcagcgcccccgaggtgcacatgagcaccgccggcagcaagagaagcagcagcagcagaaacagaggcccccacggcagaagcaacggcgccagcagccacaagcccggcagcagccccagcagccccagagagaaggacctgctgagcatgctgtgcagaaaccagctgagccccgtgaacatccaccccagctacgcccccagcagccccagcagcagcaacagcggcagctacaagggcagcgactgcagccccatcatgagaagaagcggcagatacatgagctgcggcgagaaccacggcgtgagaccccccaaccccgagcagtacctgacccccctgcagcagaaggaggtgaccgtgagacacctgaagaccaagctgaaggagagcgagagaagactgcacgagagagagagcgagatcgtggagctgaagagccagctggccagaatgagagaggactggatcgaggaggagtgccacagagtggaggcccagctggccctgaaggaggccagaaaggagatcaagcagctgaagcaggtgatcgagaccatgagaagcagcctggccgacaaggacaagggcatccagaagtacttcgtggacatcaacatccagaacaagaagctggagagcctgctgcagagcatggagatggcccacagcggcagcctgagagacgagctgtgcctggacttcccctgcgacagccccgagaagagcctgaccctgaacccccccctggacaccatggccgacggcctgagcctggaggagcaggtgaccggcgagggcgccgacagagagctgctggtgggcgacagcatcgccaacagcaccgacctgttcgacgagatcgtgaccgccaccaccaccgagagcggcgacctggagctggtgcacagcacccccggcgccaacgtgctggagctgctgcccatcgtgatgggccaggaggagggcagcgtggtggtggagagagccgtgcagaccgacgtggtgccctacagccccgccatcagcgagctgatccagagcgtgctgcagaagctgcaggacccctgccccagcagcctggccagccccgacgagagcgagcccgacagcatggagagcttccccgagagcctgagcgccctggtggtggacctgacccccagaaaccccaacagcgccatcctgctgagccccgtggagaccccctacgccaacgtggacgccgaggtgcacgccaacagactgatgagagagctggacttcgccgcctgcgtggaggagagactggacggcgtgatccccctggccagaggcggcgtggtgagacagtactggagcagcagcttcctggtggacctgctggccgtggccgcccccgtggtgcccaccgtgctgtgggccttcagcacccagagaggcggcaccgaccccgtgtacaacatcggcgccctgctgagaggctgctgcgtggtggccctgcacagcctgagaagaaccgccttcagaatcaagacctag

SEQ ID NO: 101590 - DNA, 1992 bp, Artificial Sequence; identical to SEQ ID NO: 101585
  Description of Artificial Sequence: Synthetic coding sequence

SEQ ID NO: 101591 - DNA, 1992 bp, Artificial Sequence; identical to SEQ ID NO: 101585
  Description of Artificial Sequence: Synthetic coding sequence

SEQ ID NO: 101592 - DNA, 1992 bp, Artificial Sequence; identical to SEQ ID NO: 101585
  Description of Artificial Sequence: Synthetic coding sequence

SEQ ID NO: 101593 - DNA, 1989 bp, Artificial Sequence; identical to SEQ ID NO: 101589
  Description of Artificial Sequence: Synthetic coding sequence

SEQ ID NO: 101594 - DNA, 414 bp, Artificial Sequence
  Description of Artificial Sequence: Synthetic coding sequence
atgggccccctgagagagagcaagaaggagcacagagtgcagcaccacgacaaggagatcagcagaagcagaatccccagactgatcctgagaccccacatgccccagcagcagcacaaggtgagccccgccagcgagagccccttcagcgaggaggagagcagagagttcaaccccagcagcagcggcagaagcgccagaaccgtgagcagcaacagcttctgcagcgacgacaccggctgccccagcagccagagcgtgagccccgtgaagacccccagcgacgccggcaacagccccatcggcttctgccccggcagcgacgagggcttcaccagaaagaagtgcaccatcggcatggtgggcgagggcagcatccagagcagcagatacaagaaggagagcaagagctag

SEQ ID NO: 101595 - DNA, 231 bp, Artificial Sequence
  Description of Artificial Sequence: Synthetic coding sequence
atgggccccctgagagagagcaagaaggagcacagagtgcagcaccacgacaaggagatcagcagaagcagaatccccagactgatcctgagaccccacatgccccagcagcagcacaaggtgagccccgccagcgagagccccttcagcgaggaggagagcagagagttcaaccccagcagcagcggcagaagcgccagaaccgtgagcagcaacagcttctgcagctag

SEQ ID NO: 101596 - DNA, 222 bp, Artificial Sequence
  Description of Artificial Sequence: Synthetic coding sequence
atgggccccctgagagagagcaagaaggagcacagagtgcagcaccacgacaaggagatcagcagaagcagaatccccagactgatcctgagaccccacatgccccagcagcagcacaaggtgagccccgccagcgagagccccttcagcgaggaggagagcagagagttcaaccccagcagcagcggcagaagcgccagaaccgtgagcagcaacagctag

SEQ ID NO: 101597 - DNA, 378 bp, Artificial Sequence
  Description of Artificial Sequence: Synthetic coding sequence
atggtgggcgagggcagcatccagagcagcagatacaagaaggagagcaagagcggcctggtgaagcccggcagcgaggccgacttcagcagcagcagcagcaccggcagcatcagcgcccccgaggtgcacatgagcaccgccggcagcaagagaagcagcagcagcagaaacagaggcccccacggcagaagcaacggcgccagcagccacaagcccggcagcagccccagcagccccagagagaaggacctgctgagcatgctgtgcagaaaccagctgagccccgtgaacatccaccccagctacgcccccagcagccccagcagcagcaacagcggcagctacaagggcagcgactgcagccccatcatgtag

SEQ ID NO: 101598 - DNA, 1635 bp, Artificial Sequence; identical to SEQ ID NO: 101587
  Description of Artificial Sequence: Synthetic coding sequence

SEQ ID NO: 101599 - DNA, 243 bp, Artificial Sequence
  Description of Artificial Sequence: Synthetic coding sequence
atggtgggcgagggcagcatccagagcagcagatacaagaaggagagcaagagcggcctggtgaagcccggcagcgaggccgacttcagcagcagcagcagcaccggcagcatcagcgcccccgaggtgcacatgagcaccgccggcagcaagagaagcagcagcagcagaaacagaggcccccacggcagaagcaacggcgccagcagccacaagcccggcagcagccccagcagcccctag

SEQ ID NO: 101600 - DNA, 1989 bp, Artificial Sequence; identical to SEQ ID NO: 101589
  Description of Artificial Sequence: Synthetic coding sequence

SEQ ID NO: 101601 - DNA, 288 bp, Artificial Sequence
  Description of Artificial Sequence: Synthetic coding sequence
atgggccccctgagagagagcaagaaggagcacagagtgcagcaccacgacaaggagatcagcagaagcagaatccccagactgatcctgagaccccacatgccccagcagcagcacaaggtgagccccgccagcgagagccccttcagcgaggaggagagcagagagttcaaccccagcagcagcggcagaagcgccagaaccgtgagcagcaacagcttctgcagcgacgacaccggctgccccagcagccagagcgtgagccccgtgaagacccccagcgactag

SEQ ID NO: 101602 - DNA, 615 bp, Artificial Sequence
  Description of Artificial Sequence: Synthetic coding sequence
atgggccccctgagagagagcaaggagcacagagtgcagcaccacgacaaggagatcagcagaagcagaatccccagactgatcctgagaccccacatgccccagcagcagcacaaggtgagccccgccagcgagagccccttcagcgaggaggagagcagagagttcaaccccagcagcagcggcagaagcgccagaaccgtgagcagcaacagcttctgcagcgacgacaccggctgccccagcagccagagcgtgagccccgtgaagacccccagcgacgccggcaacagccccatcggcttctgccccggcagcgacgagggcttcaccagaaagaagtgcaccatcggcatggtgggcgagggcagcatccagagcagcagatacaagaaggagagcaagagcggcctggtgaagcccggcagcgaggccgacttcagcagcagcagcagcaccggcagcatcagcgcccccgaggtgcacatgagcaccgccggcagcaagagaagcagcagcagcagaaacagaggcccccacggcagaagcaacggcgccagcagccacaagcccggcagcagccccagcagccccagagagaaggacctgctgtag

SEQ ID NO: 101603 - DNA, 108 bp, Artificial Sequence
  Description of Artificial Sequence: Synthetic coding sequence
atggtgggcgagggcagcatccagagcagcagatacaagaaggagagcaagagcggcctggtgaagcccggcagcgaggccgacttcagcagcagcagcagcacctag

SEQ ID NO: 101604 - DNA, 105 bp, Artificial Sequence
  Description of Artificial Sequence: Synthetic coding sequence
atggtgggcgagggcagcatccagagcagcagatacaagaaggagagcaagagcggcctggtgaagcccggcagcgaggccgacttcagcagcagcagcagctag

SEQ ID NO: 101605 - DNA, 243 bp, Artificial Sequence; identical to SEQ ID NO: 101599
  Description of Artificial Sequence: Synthetic coding sequence

SEQ ID NO: 101606 - DNA, 1788 bp, Artificial Sequence
  Description of Artificial Sequence: Synthetic coding sequence
atgggccccttctgggccagaaaggacgacaccggctgccccagcagccagagcgtgagccccgtgaagacccccagcgacgccggcaacagccccatcggcttctgccccggcagcgacgagggcttcaccagaaagaagtgcaccatcggcatggtgggcgagggcagcatccagagcagcagatacaagaaggagagcaagagcggcctggtgaagcccggcagcgaggccgacttcagcagcagcagcagcaccggcagcatcagcgcccccgaggtgcacatgagcaccgccggcagcaagagaagcagcagcagcagaaacagaggcccccacggcagaagcaacggcgccagcagccacaagcccggcagcagccccagcagccccagagagaaggacctgctgagcatgctgtgcagaaaccagctgagccccgtgaacatccaccccagctacgcccccagcagccccagcagcagcaacagcggcagctacaagggcagcgactgcagccccatcatgagaagaagcggcagatacatgagctgcggcgagaaccacggcgtgagaccccccaaccccgagcagtacctgacccccctgcagcagaaggaggtgaccgtgagacacctgaagaccaagctgaaggagagcgagagaagactgcacgagagagagagcgagatcgtggagctgaagagccagctggccagaatgagagaggactggatcgaggaggagtgccacagagtggaggcccagctggccctgaaggaggccagaaaggagatcaagcagctgaagcaggtgatcgagaccatgagaagcagcctggccgacaaggacaagggcatccagaagtacttcgtggacatcaacatccagaacaagaagctggagagcctgctgcagagcatggagatggcccacagcggcagcctgagagacgagctgtgcctggacttcccctgcgacagccccgagaagagcctgaccctgaacccccccctggacaccatggccgacggcctgagcctggaggagcaggtgaccggcgagggcgccgacagagagctgctggtgggcgacagcatcgccaacagcaccgacctgttcgacgagatcgtgaccgccaccaccaccgagagcggcgacctggagctggtgcacagcacccccggcgccaacgtgctggagctgctgcccatcgtgatgggccaggaggagggcagcgtggtggtggagagagccgtgcagaccgacgtggtgccctacagccccgccatcagcgagctgatccagagcgtgctgcagaagctgcaggacccctgccccagcagcctggccagccccgacgagagcgagcccgacagcatggagagcttccccgagagcctgagcgccctggtggtggacctgacccccagaaaccccaacagcgccatcctgctgagccccgtggagaccccctacgccaacgtggacgccgaggtgcacgccaacagactgatgagagagctggacttcgccgcctgcgtggaggagagactggacggcgtgatccccctggccagaggcggcgtggtgagacagtactggagcagcagcttcctggtggacctgctggccgtggccgcccccgtggtgcccaccgtgctgtgggccttcagcacccagagaggcggcaccgaccccgtgtacaacatcggcgccctgctgagaggctgctgcgtggtggccctgcacagcctgagaagaaccgccttcagaatcaagacctag

SEQ ID NO: 101607 - DNA, 1635 bp, Artificial Sequence; identical to SEQ ID NO: 101587
  Description of Artificial Sequence: Synthetic coding sequence

SEQ ID NO: 101608 - DNA, 1992 bp, Artificial Sequence; identical to SEQ ID NO: 101585
  Description of Artificial Sequence: Synthetic coding sequence

SEQ ID NO: 101609 - DNA, 489 bp, Artificial Sequence
  Description of Artificial Sequence: Synthetic coding sequence
atgggccccctgagagagagcaaggagcacagagtgcagcaccacgacaaggagatcagcagaagcagaatccccagactgatcctgagaccccacatgccccagcagcagcacaaggtgagccccgccagcgagagccccttcagcgaggaggagagcagagagttcaaccccagcagcagcggcagaagcgccagaaccgtgagcagcaacagcttctgcagcgacgacaccggctgccccagcagccagagcgtgagccccgtgaagacccccagcgacgccggcaacagccccatcggcttctgccccggcagcgacgagggcttcaccagaaagaagtgcaccatcggcatggtgggcgagggcagcatccagagcagcagatacaagaaggagagcaagagcggcctggtgaagcccggcagcgaggccgacttcagcagcagcagcagcaccggcagcatcagcgcccccgaggtgcactag

SEQ ID NO: 101610 - DNA, 1989 bp, Artificial Sequence; identical to SEQ ID NO: 101589
  Description of Artificial Sequence: Synthetic coding sequence

SEQ ID NO: 101611 - DNA, 315 bp, Artificial Sequence
  Description of Artificial Sequence: Synthetic coding sequence
atgggccccctgagagagagcaaggagcacagagtgcagcaccacgacaaggagatcagcagaagcagaatccccagactgatcctgagaccccacatgccccagcagcagcacaaggtgagccccgccagcgagagccccttcagcgaggaggagagcagagagttcaaccccagcagcagcggcagaagcgccagaaccgtgagcagcaacagcttctgcagcgacgacaccggctgccccagcagccagagcgtgagccccgtgaagacccccagcgacgccggcaacagccccatcggcttctgcccctag

SEQ ID NO: 101612 - DNA, 456 bp, Artificial Sequence
  Description of Artificial Sequence: Synthetic coding sequence
atgggccccctgagagagagcaagaaggagcacagagtgcagcaccacgacaaggagatcagcagaagcagaatccccagactgatcctgagaccccacatgccccagcagcagcacaaggtgagccccgccagcgagagccccttcagcgaggaggagagcagagagttcaaccccagcagcagcggcagaagcgccagaaccgtgagcagcaacagcttctgcagcgacgacaccggctgccccagcagccagagcgtgagccccgtgaagacccccagcgacgccggcaacagccccatcggcttctgccccggcagcgacgagggcttcaccagaaagaagtgcaccatcggcatggtgggcgagggcagcatccagagcagcagatacaagaaggagagcaagagcggcctggtgaagcccggcagcgaggccgacttcagcagcagctag

SEQ ID NO: 101613 - DNA, 231 bp, Artificial Sequence; identical to SEQ ID NO: 101595
  Description of Artificial Sequence: Synthetic coding sequence

SEQ ID NO: 101614 - DNA, 1617 bp, Artificial Sequence
  Description of Artificial Sequence: Synthetic coding sequence
atgcccggcagcggccccagcgagagaatgacctggcccggccccgccctgagcgccggcccccccaccagacccctgagcagcgcccccggcatcccccccatcccccccctgaccagaacccacagcctgatggccatgagcctgcccggcagcagaagaaccagcgccggcagcagaagaagaaccagcccccccgtgagcgtgagagacgcctacggcaccagcagcctgagcagcagcagcaacagcggcagctacaagggcagcgacagcagccccacccccagaagaagcatgaagtacaccctgtgcagcgacaaccacggcatcaagccccccacccccgagcagtacctgacccccctgcagcagaaggaggtgtgcatcagacacctgaaggccagactgaaggacacccaggacagactgcaggacagagacaccgagatcgacgacctgaagacccagctgagcagaatgcaggaggactggatcgaggaggagtgccacagagtggaggcccagctggccctgaaggaggccagaaaggagatcaagcagctgaagcaggtgatcgacaccgtgaagaacaacctgatcgacaaggacaagggcctgcagaagtacttcgtggacatcaacatccagaacaagaagctggagaccctgctgcacagcatggaggtggcccagaacggcatggccaaggaggacggcaccggcgagagcgccggcggcagccccgccagaagcctgaccagaagcagcacctacaccaagctgagcgaccccgccgtgtgcggcgacagacagcccggcgaccccagcagcggcagcgccgaggacggcgccgacagcggcttcgccgccgccgacgacaccctgagcagaaccgacgccctggaggccagcagcctgctgagcagcggcgtggactgcggcaccgaggagaccagcctgcacagcagcttcggcctgggccccagattccccgccagcaacacctacgagaagctgctgtgcggcatggaggccggcgtgcaggccagctgcatgcaggagagagccatccagaccgacttcgtgcagtaccagcccgacctggacaccatcctggagaaggtgacccaggcccaggtgtgcggcaccgaccccgagagcggcgacagatgccccgagctggacgcccaccccagcggccccagagaccccaacagcgccgtggtggtgaccgtgggcgacgagctggaggcccccgagcccatcaccagaggccccaccccccagagacccggcgccaaccccaaccccggccagagcgtgagcgtggtgtgccccatggaggaggaggaggaggccgccgtggccgagaaggagcccaagagctactggagcagacactacatcgtggacctgctggccgtggtggtgcccgccgtgcccaccgtggcctggctgtgcagaagccagagaagacagggccagcccatctacaacatcagcagcctgctgagaggctgctgcaccgtggccctgcacagcatcagaagaatcagctgcagaagcctgagccagcccagccccagccccgccggcggcggcagccagctgtag

SEQ ID NO: 101615 - DNA, 1485 bp, Artificial Sequence
  Description of Artificial Sequence: Synthetic coding sequence
atggccatgagcctgcccggcagcagaagaaccagcgccggcagcagaagaagaaccagcccccccgtgagcgtgagagacgcctacggcaccagcagcctgagcagcagcagcaacagcggcagctacaagggcagcgacagcagccccacccccagaagaagcatgaagtacaccctgtgcagcgacaaccacggcatcaagccccccacccccgagcagtacctgacccccctgcagcagaaggaggtgtgcatcagacacctgaaggccagactgaaggacacccaggacagactgcaggacagagacaccgagatcgacgacctgaagacccagctgagcagaatgcaggaggactggatcgaggaggagtgccacagagtggaggcccagctggccctgaaggaggccagaaaggagatcaagcagctgaagcaggtgatcgacaccgtgaagaacaacctgatcgacaaggacaagggcctgcagaagtacttcgtggacatcaacatccagaacaagaagctggagaccctgctgcacagcatggaggtggcccagaacggcatggccaaggaggacggcaccggcgagagcgccggcggcagccccgccagaagcctgaccagaagcagcacctacaccaagctgagcgaccccgccgtgtgcggcgacagacagcccggcgaccccagcagcggcagcgccgaggacggcgccgacagcggcttcgccgccgccgacgacaccctgagcagaaccgacgccctggaggccagcagcctgctgagcagcggcgtggactgcggcaccgaggagaccagcctgcacagcagcttcggcctgggccccagattccccgccagcaacacctacgagaagctgctgtgcggcatggaggccggcgtgcaggccagctgcatgcaggagagagccatccagaccgacttcgtgcagtaccagcccgacctggacaccatcctggagaaggtgacccaggcccaggtgtgcggcaccgaccccgagagcggcgacagatgccccgagctggacgcccaccccagcggccccagagaccccaacagcgccgtggtggtgaccgtgggcgacgagctggaggcccccgagcccatcaccagaggccccaccccccagagacccggcgccaaccccaaccccggccagagcgtgagcgtggtgtgccccatggaggaggaggaggaggccgccgtggccgagaaggagcccaagagctactggagcagacactacatcgtggacctgctggccgtggtggtgcccgccgtgcccaccgtggcctggctgtgcagaagccagagaagacagggccagcccatctacaacatcagcagcctgctgagaggctgctgcaccgtggccctgcacagcatcagaagaatcagctgcagaagcctgagccagcccagccccagccccgccggcggcggcagccagctgtag

SEQ ID NO: 101616 - DNA, 864 bp, Artificial Sequence
  Description of Artificial Sequence: Synthetic coding sequence
atgaaggacagactggccgagctgctggacctgagcaagcagtacgaccagcagttccccgacggcgacgacgagttcgacagcccccacgaggacatcgtgttcgagaccgaccacatcctggagagcctgtacagagacatcagagacatccaggacgagaaccagctgctggtggccgacgtgaagagactgggcaagcagaacgccagattcctgaccagcatgagaagactgagcagcatcaagagagacaccaacagcatcgccaaggccatcaaggccagaggcgaggtgatccactgcaagctgagagccatgaaggagctgagcgaggccgccgaggcccagcacggcccccacagcgccgtggccagaatcagcagagcccagtacaacgccctgaccctgaccttccagagagccatgcacgactacaaccaggccgagatgaagcagagagacaactgcaagatcagaatccagagacagctggagatcatgggcaaggaggtgagcggcgaccagatcgaggacatgttcgagcagggcaagtgggacgtgttcagcgagaacctgctggccgacgtgaagggcgccagagccgccctgaacgagatcgagagcagacacagagagctgctgagactggagagcagaatcagagacgtgcacgagctgttcctgcagatggccgtgctggtggagaagcaggccgacaccctgaacgtgatcgagctgaacgtgcagaagaccgtggactacaccggccaggccaaggcccaggtgagaaaggccgtgcagtacgaggagaagaacccctgcagaaccctgtgctgcttctgctgcccctgcctgaagtag

SEQ ID NO: 101617 - DNA, 615 bp, Artificial Sequence
  Description of Artificial Sequence: Synthetic coding sequence
atggccctggtgagcggcatcagcctggaccccgaggccgccatcggcgtgaccaagagacccccccccaagtgggtggacggcgtggacgagatccagtacgacgtgggcagaatcaagcagaagatgaaggagctggccagcctgcacgacaagcacctgaacagacccaccctggacgacagcagcgaggaggagcacgccatcgagatcaccacccaggagatcacccagctgttccacagatgccagagagccgtgcaggccctgcccagcagagccagagcctgcagcgagcaggagggcagactgctgggcaacgtggtggccagcctggcccaggccctgcaggagctgagcaccagcttcagacacgcccagagcggctacctgaagagaatgaagaacagagaggagagaagccagcacttcttcgacaccagcgtgcccctgatggacgacggcgacgacaacaccctgtaccacagaggcttcaccgaggaccagctggtgctggtggagcagaacaccctgatggtggaggagagagagagagagatcagacagatcgtgcagagcatcagcgacctgaacgagatcttcagagacctgtag

SEQ ID NO: 101618 - DNA, 927 bp, Artificial Sequence
  Description of Artificial Sequence: Synthetic coding sequence
atggccaccagaagactgaccgacgccttcctgctgctgagaaacaacagcatccagaacagacagctgctggccgagcaggagctggacgagctggccgacgacagaatggccctggtgagcggcatcagcctggaccccgaggccgccatcggcgtgaccaagagacccccccccaagtgggtggacggcgtggacgagatccagtacgacgtgggcagaatcaagcagaagatgaaggagctggccagcctgcacgacaagcacctgaacagacccaccctggacgacagcagcgaggaggagcacgccatcgagatcaccacccaggagatcacccagctgttccacagatgccagagagccgtgcaggccctgcccagcagagccagagcctgcagcgagcaggagggcagactgctgggcaacgtggtggccagcctggcccaggccctgcaggagctgagcaccagcttcagacacgcccagagcggctacctgaagagaatgaagaacagagaggagagaagccagcacttcttcgacaccagcgtgcccctgatggacgacggcgacgacaacaccctgtaccacagaggcttcaccgaggaccagctggtgctggtggagcagaacaccctgatggtggaggagagagagagagagatcagacagatcgtgcagagcatcagcgacctgaacgagatcttcagagacctgggcgccatgatcgtggagcagggcaccgtgctggacagaatcgactacaacgtggagcagagctgcatcaagaccgaggacggcctgaagcagctgcacaaggccgagcagtaccagaagaagaacagaaagatgctggtgatcctgatcctgttcgtgatcatcatcgtgctgatcgtggtgctggtgggcgtgaagagcagatag

SEQ ID NO: 101619 - DNA, 966 bp, Artificial Sequence
  Description of Artificial Sequence: Synthetic coding sequence
atggccaccagaagactgaccgacgccttcctgctgctgagaaacaacagcatccagaacagacagctgctggccgagcaggtgagcagccacatcaccagcagccccctgcacagcagaagcatcgccgccctggccgacgacagaatggccctggtgagcggcatcagcctggaccccgaggccgccatcggcgtgaccaagagacccccccccaagtgggtggacggcgtggacgagatccagtacgacgtgggcagaatcaagcagaagatgaaggagctggccagcctgcacgacaagcacctgaacagacccaccctggacgacagcagcgaggaggagcacgccatcgagatcaccacccaggagatcacccagctgttccacagatgccagagagccgtgcaggccctgcccagcagagccagagcctgcagcgagcaggagggcagactgctgggcaacgtggtggccagcctggcccaggccctgcaggagctgagcaccagcttcagacacgcccagagcggctacctgaagagaatgaagaacagagaggagagaagccagcacttcttcgacaccagcgtgcccctgatggacgacggcgacgacaacaccctgtaccacagaggcttcaccgaggaccagctggtgctggtggagcagaacaccctgatggtggaggagagagagagagagatcagacagatcgtgcagagcatcagcgacctgaacgagatcttcagagacctgggcgccatgatcgtggagcagggcaccgtgctggacagaatcgactacaacgtggagcagagctgcatcaagaccgaggacggcctgaagcagctgcacaaggccgagcagtaccagaagaagaacagaaagatgctggtgatcctgatcctgttcgtgatcatcatcgtgctgatcgtggtgctggtgggcgtgaagagcagatag

SEQ ID NO: 101620 - DNA, 756 bp, Artificial Sequence
  Description of Artificial Sequence: Synthetic coding sequence
atggccctggtgagcggcatcagcctggaccccgaggccgccatcggcgtgaccaagagacccccccccaagtgggtggacggcgtggacgagatccagtacgacgtgggcagaatcaagcagaagatgaaggagctggccagcctgcacgacaagcacctgaacagacccaccctggacgacagcagcgaggaggagcacgccatcgagatcaccacccaggagatcacccagctgttccacagatgccagagagccgtgcaggccctgcccagcagagccagagcctgcagcgagcaggagggcagactgctgggcaacgtggtggccagcctggcccaggccctgcaggagctgagcaccagcttcagacacgcccagagcggctacctgaagagaatgaagaacagagaggagagaagccagcacttcttcgacaccagcgtgcccctgatggacgacggcgacgacaacaccctgtaccacagaggcttcaccgaggaccagctggtgctggtggagcagaacaccctgatggtggaggagagagagagagagatcagacagatcgtgcagagcatcagcgacctgaacgagatcttcagagacctgggcgccatgatcgtggagcagggcaccgtgctggacagaatcgactacaacgtggagcagagctgcatcaagaccgaggacggcctgaagcagctgcacaaggccgagcagtaccagaagaagaacagaaagatgctggtgtag

SEQ ID NO: 101621 - DNA, 927 bp, Artificial Sequence
  Description of Artificial Sequence: Synthetic coding sequence
atggccaccagaagactgaccgacgccttcctgctgctgagaaacaacagcatccagaacagacagctgctggccgagcagcagctgagcaagctggccgacgacagaatggccctggtgagcggcatcagcctggaccccgaggccgccatcggcgtgaccaagagacccccccccaagtgggtggacggcgtggacgagatccagtacgacgtgggcagaatcaagcagaagatgaaggagctggccagcctgcacgacaagcacctgaacagacccaccctggacgacagcagcgaggaggagcacgccatcgagatcaccacccaggagatcacccagctgttccacagatgccagagagccgtgcaggccctgcccagcagagccagagcctgcagcgagcaggagggcagactgctgggcaacgtggtggccagcctggcccaggccctgcaggagctgagcaccagcttcagacacgcccagagcggctacctgaagagaatgaagaacagagaggagagaagccagcacttcttcgacaccagcgtgcccctgatggacgacggcgacgacaacaccctgtaccacagaggcttcaccgaggaccagctggtgctggtggagcagaacaccctgatggtggaggagagagagagagagatcagacagatcgtgcagagcatcagcgacctgaacgagatcttcagagacctgggcgccatgatcgtggagcagggcaccgtgctggacagaatcgactacaacgtggagcagagctgcatcaagaccgaggacggcctgaagcagctgcacaaggccgagcagtaccagaagaagaacagaaagatgctggtgatcctgatcctgttcgtgatcatcatcgtgctgatcgtggtgctggtgggcgtgaagagcagatag

SEQ ID NO: 101622 - DNA, 978 bp, Artificial Sequence
  Description of Artificial Sequence: Synthetic coding sequence
atggccaccagaagactgaccgacgccttcctgctgctgagaaacaacagcatccagaacagacagctgctggccgagcaggtgagcagccacatcaccagcagccccctgcacagcagaagcatcgccgccgccctggacgagctggccgacgacagaatggccctggtgagcggcatcagcctggaccccgaggccgccatcggcgtgaccaagagacccccccccaagtgggtggacggcgtggacgagatccagtacgacgtgggcagaatcaagcagaagatgaaggagctggccagcctgcacgacaagcacctgaacagacccaccctggacgacagcagcgaggaggagcacgccatcgagatcaccacccaggagatcacccagctgttccacagatgccagagagccgtgcaggccctgcccagcagagccagagcctgcagcgagcaggagggcagactgctgggcaacgtggtggccagcctggcccaggccctgcaggagctgagcaccagcttcagacacgcccagagcggctacctgaagagaatgaagaacagagaggagagaagccagcacttcttcgacaccagcgtgcccctgatggacgacggcgacgacaacaccctgtaccacagaggcttcaccgaggaccagctggtgctggtggagcagaacaccctgatggtggaggagagagagagagagatcagacagatcgtgcagagcatcagcgacctgaacgagatcttcagagacctgggcgccatgatcgtggagcagggcaccgtgctggacagaatcgactacaacgtggagcagagctgcatcaagaccgaggacggcctgaagcagctgcacaaggccgagcagtaccagaagaagaacagaaagatgctggtgatcctgatcctgttcgtgatcatcatcgtgctgatcgtggtgctggtgggcgtgaagagcagatag

SEQ ID NO: 101623 - DNA, 915 bp, Artificial Sequence
  Description of Artificial Sequence: Synthetic coding sequence
atggccaccagaagactgaccgacgccttcctgctgctgagaaacaacagcatccagaacagacagctgctggccgagcagctggccgacgacagaatggccctggtgagcggcatcagcctggaccccgaggccgccatcggcgtgaccaagagacccccccccaagtgggtggacggcgtggacgagatccagtacgacgtgggcagaatcaagcagaagatgaaggagctggccagcctgcacgacaagcacctgaacagacccaccctggacgacagcagcgaggaggagcacgccatcgagatcaccacccaggagatcacccagctgttccacagatgccagagagccgtgcaggccctgcccagcagagccagagcctgcagcgagcaggagggcagactgctgggcaacgtggtggccagcctggcccaggccctgcaggagctgagcaccagcttcagacacgcccagagcggctacctgaagagaatgaagaacagagaggagagaagccagcacttcttcgacaccagcgtgcccctgatggacgacggcgacgacaacaccctgtaccacagaggcttcaccgaggaccagctggtgctggtggagcagaacaccctgatggtggaggagagagagagagagatcagacagatcgtgcagagcatcagcgacctgaacgagatcttcagagacctgggcgccatgatcgtggagcagggcaccgtgctggacagaatcgactacaacgtggagcagagctgcatcaagaccgaggacggcctgaagcagctgcacaaggccgagcagtaccagaagaagaacagaaagatgctggtgatcctgatcctgttcgtgatcatcatcgtgctgatcgtggtgctggtgggcgtgaagagcagatag

SEQ ID NO: 101624 - DNA, 819 bp, Artificial Sequence
  Description of Artificial Sequence: Synthetic coding sequence
atggccctggtgagcggcatcagcctggaccccgaggccgccatcggcgtgaccaagagacccccccccaagtgggtggacggcgtggacgagatccagtacgacgtgggcagaatcaagcagaagatgaaggagctggccagcctgcacgacaagcacctgaacagacccaccctggacgacagcagcgaggaggagcacgccatcgagatcaccacccaggagatcacccagctgttccacagatgccagagagccgtgcaggccctgcccagcagagccagagcctgcagcgagcaggagggcagactgctgggcaacgtggtggccagcctggcccaggccctgcaggagctgagcaccagcttcagacacgcccagagcggctacctgaagagaatgaagaacagagaggagagaagccagcacttcttcgacaccagcgtgcccctgatggacgacggcgacgacaacaccctgtaccacagaggcttcaccgaggaccagctggtgctggtggagcagaacaccctgatggtggaggagagagagagagagatcagacagatcgtgcagagcatcagcgacctgaacgagatcttcagagacctgggcgccatgatcgtggagcagggcaccgtgctggacagaatcgactacaacgtggagcagagctgcatcaagaccgaggacggcctgaagcagctgcacaaggccgagcagtaccagaagaagaacagaaagatgctggtgatcctgatcctgttcgtgatcatcatcgtgctgatcgtggtgctggtgggcgtgaagagcagatag

SEQ ID NO: 101625 - DNA, 978 bp, Artificial Sequence
  Description of Artificial Sequence: Synthetic coding sequence
atggccaccagaagactgaccgacgccttcctgctgctgagaaacaacagcatccagaacagacagctgctggccgagcaggtgagcagccacatcaccagcagccccctgcacagcagaagcatcgccgccgagctggacgagctggccgacgacagaatggccctggtgagcggcatcagcctggaccccgaggccgccatcggcgtgaccaagagacccccccccaagtgggtggacggcgtggacgagatccagtacgacgtgggcagaatcaagcagaagatgaaggagctggccagcctgcacgacaagcacctgaacagacccaccctggacgacagcagcgaggaggagcacgccatcgagatcaccacccaggagatcacccagctgttccacagatgccagagagccgtgcaggccctgcccagcagagccagagcctgcagcgagcaggagggcagactgctgggcaacgtggtggccagcctggcccaggccctgcaggagctgagcaccagcttcagacacgcccagagcggctacctgaagagaatgaagaacagagaggagagaagccagcacttcttcgacaccagcgtgcccctgatggacgacggcgacgacaacaccctgtaccacagaggcttcaccgaggaccagctggtgctggtggagcagaacaccctgatggtggaggagagagagagagagatcagacagatcgtgcagagcatcagcgacctgaacgagatcttcagagacctgggcgccatgatcgtggagcagggcaccgtgctggacagaatcgactacaacgtggagcagagctgcatcaagaccgaggacggcctgaagcagctgcacaaggccgagcagtaccagaagaagaacagaaagatgctggtgatcctgatcctgttcgtgatcatcatcgtgctgatcgtggtgctggtgggcgtgaagagcagatag

SEQ ID NO: 101626 - DNA, 366 bp, Artificial Sequence
  Description of Artificial Sequence: Synthetic coding sequence
atggccctggtgagcggcatcagcctggaccccgaggccgccatcggcgtgaccaagagacccccccccaagtgggtggacggcgtggacgagatccagtacgacgtgggcagaatcaagcagaagatgaaggagctggccagcctgcacgacaagcacctgaacagacccaccctggacgacagcagcgaggaggagcacgccatcgagatcaccacccaggagatcacccagctgttccacagatgccagagagccgtgcaggccctgcccagcagagccagagcctgcagcgagcaggagggcagactgctgggcaacgtggtggccagcctggcccaggccctgcaggagctgagcacctag

SEQ ID NO: 101627 - DNA, 420 bp, Artificial Sequence
  Description of Artificial Sequence: Synthetic coding sequence
atgaagaacagagaggagagaagccagcacttcttcgacaccagcgtgcccctgatggacgacggcgacgacaacaccctgtaccacagaggcttcaccgaggaccagctggtgctggtggagcagaacaccctgatggtggaggagagagagagagagatcagacagatcgtgcagagcatcagcgacctgaacgagatcttcagagacctgggcgccatgatcgtggagcagggcaccgtgctggacagaatcgactacaacgtggagcagagctgcatcaagaccgaggacggcctgaagcagctgcacaaggccgagcagtaccagaagaagaacagaaagatgctggtgatcctgatcctgttcgtgatcatcatcgtgctgatcgtggtgctggtgggcgtgaagagcagatag

SEQ ID NO: 101628 - DNA, 660 bp, Artificial Sequence
  Description of Artificial Sequence: Synthetic coding sequence
ggcatcagcctggaccccgaggccgccatcggcgtgaccaagagacccccccccaagtgggtggacggcgtggacgagatccagtacgacgtgggcagaatcaagcagaagatgaaggagctggccagcctgcacgacaagcacctgaacagacccaccctggacgacagcagcgaggaggagcacgccatcgagatcaccacccaggagatcacccagctgttccacagatgccagagagccgtgcaggccctgcccagcagagccagagcctgcagcgagcaggagggcagactgctgggcaacgtggtggccagcctggcccaggccctgcaggagctgagcaccagcttcagacacgcccagagcggctacctgaagagaatgaagaacagagaggagagaagccagcacttcttcgacaccagcgtgcccctgatggacgacggcgacgacaacaccctgtaccacagaggcaccgtgctggacagaatcgactacaacgtggagcagagctgcatcaagaccgaggacggcctgaagcagctgcacaaggccgagcagtaccagaagaagaacagaaagatgctggtgatcctgatcctgttcgtgatcatcatcgtgctgatcgtggtgctggtgggcgtgaagagcagatag

SEQ ID NO: 101629 - DNA, 369 bp, Artificial Sequence
  Description of Artificial Sequence: Synthetic coding sequence
atggccctggtgagcggcatcagcctggaccccgaggccgccatcggcgtgaccaagagacccccccccaagtgggtggacggcgtggacgagatccagtacgacgtgggcagaatcaagcagaagatgaaggagctggccagcctgcacgacaagcacctgaacagacccaccctggacgacagcagcgaggaggagcacgccatcgagatcaccacccaggagatcacccagctgttccacagatgccagagagccgtgcaggccctgcccagcagagccagagcctgcagcgagcaggagggcagactgctgggcaacgtggtggccagcctggcccaggccctgcaggagctgagcaccagctag

SEQ ID NO: 101630 - DNA, 609 bp, Artificial Sequence
  Description of Artificial Sequence: Synthetic coding sequence
atggccaccagaagactgaccgacgccttcctgctgctgagaaacaacagcatccagaacagacagctgctggccgagcaggagctggacgagctggccgacgacagaatggccctggtgagcggcatcagcctggaccccgaggccgccatcggcgtgaccaagagacccccccccaagtgggtggacggcgtggacgagatccagtacgacgtgggcagaatcaagcagaagatgaaggagctggccagcctgcacgacaagcacctgaacagacccaccctggacgacagcagcgaggaggagcacgccatcgagatcaccacccaggagatcacccagctgttccacagatgccagagagccgtgcaggccctgcccagcagagccagagcctgcagcgagcaggagggcagactgctgggcaacgtggtggccagcctggcccaggccctgcaggagctgagcaccagcttcagacacgcccagagcggctacctgaagagaatgaagaacagagaggagagaagccagcacttcttcgacaccagcgtgcccctgatggacgacggcgacgacaacaccctgtaccacagaagaaccagctag

SEQ ID NO: 101631 - DNA, 909 bp, Artificial Sequence
  Description of Artificial Sequence: Synthetic coding sequence
atgagcgaggacgaggagaaggtgaagctgagaagactggagcccgccatccagaagttcatcaagatcgtgatccccaccgacctggagagactgagaaagcaccagatcaacatcgagaagtaccagagatgcagaatctgggacaagctgcacgaggagcacatcaacgccggcagaaccgtgcagcagctgagaagcaacatcagagagatcgagaagctgtgcctgaaggtgagaaaggacgacctggtgctgctgaagagaatgatcgaccccgtgaaggaggaggccagcgccgccaccgccgagttcctgcagctgcacctggagagcgtggaggagctgaagaagcagttcaacgacgaggagaccctgctgcagccccccctgaccagaagcatgaccgtgggcggcgccttccacaccaccgaggccgaggccagcagccagagcctgacccagatctacgccctgcccgagatcccccaggaccagaacgccgccgagagctgggagaccctggaggccgacctgatcgagctgagccagctggtgaccgacttcagcctgctggtgaacagccagcaggagaagatcgacagcatcgccgaccacgtgaacagcgccgccgtgaacgtggaggagggcaccaagaacctgggcaaggccgccaagtacaagctggccgccctgcccgtggccggcgccctgatcggcggcatggtgggcggccccatcggcctgctggccggcttcaaggtggccggcatcgccgccgccctgggcggcggcgtgctgggcttcaccggcggcaagctgatccagagaaagaagcagaagatgatggagaagctgaccagcagctgccccgacctgcccagccagaccgacaagaagtgcagctag

SEQ ID NO: 101632 - DNA, 909 bp, Artificial Sequence; identical to SEQ ID NO: 101631
  Description of Artificial Sequence: Synthetic coding sequence

SEQ ID NO: 101633 - DNA, 126 bp, Artificial Sequence
  Description of Artificial Sequence: Synthetic coding sequence
atgagcgaggacgaggagaaggtgaagctgagaagactggagcccgccatccagaagttcatcaagatcgtgatccccaccgacctggagagactgagaaagcaccagatcaacatcgagaagtag

SEQ ID NO: 101634 - DNA, 126 bp, Artificial Sequence; identical to SEQ ID NO: 101633
  Description of Artificial Sequence: Synthetic coding sequence

SEQ ID NO: 101635 - DNA, 909 bp, Artificial Sequence; identical to SEQ ID NO: 101631
  Description of Artificial Sequence: Synthetic coding sequence

SEQ ID NO: 101636 - DNA, 636 bp, Artificial Sequence
  Description of Artificial Sequence: Synthetic coding sequence
atgagactgttcctgtggaacgccgtgctgaccctgttcgtgaccagcctgatcggcgccctgatccccgagcccgaggtgaagatcgaggtgctgcagaagcccttcatctgccacagaaagaccaagggcggcgacctgatgctggtgcactacgagggctacctggagaaggacggcagcctgttccacagcacccacaagcacaacaacggccagcccatctggttcaccctgggcatcctggaggccctgaagggctgggaccagggcctgaagggcatgtgcgtgggcgagaagagaaagctgatcatcccccccgccctgggctacggcaaggagggcaagggcaagatcccccccgagagcaccctgatcttcaacatcgacctgctggagatcagaaacggccccagaagccacgagagcttccaggagatggacctgaacgacgactggaagctgagcaaggacgaggtgaaggcctacctgaagaaggagttcgagaagcacggcgccgtggtgaacgagagccaccacgacgccctggtggaggacatcttcgacaaggaggacgaggacaaggacggcttcatcagcgccagagagttcacctacaagcacgacgagctgtag

SEQ ID NO: 101637 - DNA, 783 bp, Artificial Sequence
  Description of Artificial Sequence: Synthetic coding sequence
atgaaggacagaacccaggagctgagaaccgccaaggacagcgacgacgacgacgacgtggccgtgaccgtggacagagacagattcatggacgagttcttcgagcaggtggaggagatcagaggcttcatcgacaagatcgccgagaacgtggaggaggtgaagagaaagcacagcgccatcctggccagccccaaccccgacgagaagaccaaggaggagctggaggagctgatgagcgacatcaagaagaccgccaacaaggtgagaagcaagctgaagagcatcgagcagagcatcgagcaggaggagggcctgaacagaagcagcgccgacctgagaatcagaaagacccagcacagcaccctgagcagaaagttcgtggaggtgatgagcgagtacaacgccacccagagcgactacagagagagatgcaagggcagaatccagagacagctggagatcaccggcagaaccaccaccagcgaggagctggaggacatgctggagagcggcaaccccgccatcttcgccagcggcatcatcatggacagcagcatcagcaagcaggccctgagcgagatcgagaccagacacagcgagatcatcaagctggagaacagcatcagagagctgcacgacatgttcatggacatggccatgctggtggagagccagccccagggcgccttcctgaagagctgccccgagccccagcccaaccccgaggagggcgccctgtggagcagcggcgcccccggccccgccggcagagacgactag

SEQ ID NO: 101638 - DNA, 516 bp, Artificial Sequence
  Description of Artificial Sequence: Synthetic coding sequence
atgaaggacagaacccaggagctgagaaccgccaaggacagcgacgacgacgacgacgtggccgtgaccgtggacagagacagattcatggacgagttcttcgagcaggtggaggtgatgagcgagtacaacgccacccagagcgactacagagagagatgcaagggcagaatccagagacagctggagatcaccggcagaaccaccaccagcgaggagctggaggacatgctggagagcggcaaccccgccatcttcgccagcggcatcatcatggacagcagcatcagcaagcaggccctgagcgagatcgagaccagacacagcgagatcatcaagctggagatcgagtacaacgtggagcacgccgtggactacgtggagagagccgtgagcgacaccaagaaggccgtgaagtaccagagcaaggccagaagaaagaagatcatgatcatcatctgctgcgtgatcctgggcatcgtgatcgccagcaccgtgggcggcatcttcgcctag

SEQ ID NO: 101639 - DNA, 756 bp, Artificial Sequence
  Description of Artificial Sequence: Synthetic coding sequence
atgaaggacagaacccaggagctgagaaccgccaaggacagcgacgacgacgacgacgtggccgtgaccgtggacagagacagattcatggacgagttcttcgagcaggtggaggagatcagaggcttcatcgacaagatcgccgagaacgtggaggaggtgaagagaaagcacagcgccatcctggccagccccaaccccgacgagaagaccaaggaggagctggaggagctgatgagcgacatcaagaagaccgccaacaaggtgagaagcaagctgaagagcatcgagcagagcatcgagcaggaggagggcctgaacagaagcagcgccgacctgagaatcagaaagacccagcacagcaccctgagcagaaagttcgtggaggtgatgagcgagtacaacgccacccagagcgactacagagagagatgcaagggcagaatccagagacagctggagatcaccggcagaaccaccaccagcgaggagctggaggacatgctggagagcggcaaccccgccatcttcgccagcggcatcatcatggacagcagcatcagcaagcaggccctgagcgagatcgagaccagacacagcgagatcatcaagctggagaacagcatcagagagctgcacgacatgttcatggacatggccatgctggtggagagccagaccatgtggagaggcccctgcctgacccccagaagacccagcagcaccagagccagaagagccggcagaaagagctag

SEQ ID NO: 101640 - DNA, 1053 bp, Artificial Sequence
  Description of Artificial Sequence: Synthetic coding sequence
atgttcatcaagggcagagcccccagagccccccccagagagagaagaagagccaccagaggcggcctgagacaggtggtggccccccccagagccctgggcagcaccagcagaccccacttcagaagagccagcgtgtgcagaagaagatgcagaaagagcggcggcctgctggccgccagcagaaagatggccgccgccgccgtgaacggcgccgccggcttcagcagcagcggccccgccgccaccagcggcgccgtgctgcaggccgccaccggcatgtacgagcagctgaagggcgagtggaacagaaagagccccaacctgagcaagtgcggcgaggagctgggcagactgaagctggtgctgctggagctgaacttcctgcccaccaccggcaccaagctgaccaagcagcagctgatcctggccagagacatcctggagatcggcgcccagtggagcatcctgagaaaggacatccccagcttcgagagatacatggcccagctgaagtgctactacttcgactacaaggagcagctgcccgagagcgcctacatgcaccagctgctgggcctgaacctgctgttcctgctgagccagaacagagtggccgagttccacaccgagctggagagactgcccgccaaggacatccagaccaacgtgtacatcaagcaccccgtgagcctggagcagtacctgatggagggcagctacaacaaggtgttcctggccaagggcaacatccccgccgagagctacaccttcttcatcgacatcctgctggacaccatcagagacgagatcgccggctgcatcgagaaggcctacgagaagatcctgttcaccgaggccaccagaatcctgttcttcaacacccccaagaagatgaccgactacgccaagaagagaggctgggtgctgggccccaacaactactacagcttcgccagccagcagcagaagcccgaggacaccaccatccccagcaccgagctggccaagcaggtgatcgagtacgccagacagctggagatgatcgtgtag

SEQ ID NO: 101641 - DNA, 864 bp, Artificial Sequence
  Description of Artificial Sequence: Synthetic coding sequence
atgagagacagactgcccgacctgaccgcctgcagaaagaacgacgacggcgacaccgtggtggtggtggagaaggaccacttcatggacgacttcttccaccaggtggaggagatcagaaacagcatcgacaagatcacccagtacgtggaggaggtgaagaagaaccacagcatcatcctgagcgcccccaaccccgagggcaagatcaaggaggagctggaggacctgaacaaggagatcaagaagaccgccaacaagatcagagccaagctgaaggccatcgagcagagcttcgaccaggacgagagcggcaacagaaccagcgtggacctgagaatcagaagaacccagcacagcgtgctgagcagaaagttcgtggaggccatggccgagtacaacgaggcccagaccctgttcagagagagaagcaagggcagaatccagagacagctggagatcaccggcagaaccaccaccgacgacgagctggaggagatgctggagagcggcaagcccagcatcttcaccagcgacatcatcagcgacagccagatcaccagacaggccctgaacgagatcgagagcagacacaaggacatcatgaagctggagaccagcatcagagagctgcacgagatgttcatggacatggccatgttcgtggagacccagggcgagatgatcaacaacatcgagagaaacgtgatgaacgccaccgactacgtggagcacgccaaggaggagaccaagaaggccatcaagtaccagagcaaggccagaagaaagctgatgttcatcatcatctgcgtgatcgtgctgctggtgatcctgggcatcatcctggccaccaccctgagctag

SEQ ID NO: 101642 - DNA, 867 bp, Artificial Sequence
  Description of Artificial Sequence: Synthetic coding sequence
atgagagacagactgcccgacctgaccgcctgcagaaagaacgacgacggcgacaccgtggtggtggtggagaaggaccacttcatggacgacttcttccaccaggtggaggagatcagaaacagcatcgacaagatcacccagtacgtggaggaggtgaagaagaaccacagcatcatcctgagcgcccccaaccccgagggcaagatcaaggaggagctggaggacctgaacaaggagatcaagaagaccgccaacaagatcagagccaagctgaaggccatcgagcagagcttcgaccaggacgagagcggcaacagaaccagcgtggacctgagaatcagaagaacccagcacagcgtgctgagcagaaagttcgtggaggccatggccgagtacaacgaggcccagaccctgttcagagagagaagcaagggcagaatccagagacagctggagatcaccggcagaaccaccaccgacgacgagctggaggagatgctggagagcggcaagcccagcatcttcaccagcgacatcatcagcgacagccagatcaccagacaggccctgaacgagatcgagagcagacacaaggacatcatgaagctggagaccagcatcagagagctgcacgagatgttcatggacatggccatgttcgtggagacccagggcgagatgatcaacaacatcgagagaaacgtgatgaacgccaccgactacgtggagcacgccaaggaggagaccaagaaggccatcaagtaccagagcaaggccagaagaaagaagtggatcatcatcgccgtgagcgtggtgctggtggccatcatcgccctgatcatcggcctgagcgtgggcaagtag

SEQ ID NO: 101643 - DNA, 777 bp, Artificial Sequence
  Description of Artificial Sequence: Synthetic coding sequence
atggacgagttcttcagcgagatcgaggagaccagactgaacatcgacaagatcagcgagcacgtggaggaggccaagaagctgtacagcatcatcctgagcgcccccatccccgagcccaagaccaaggacgacctggagcagctgaccaccgagatcaagaagagagccaacaacgtgagaaacaagctgaagagcatggagaagcacatcgaggaggacgaggtgagaagcagcgccgacctgagaatcagaaagagccagcacagcgtgctgagcagaaagttcgtggaggtgatgaccaagtacaacgaggcccaggtggacttcagagagagaagcaagggcagaatccagagacagctggagatcaccggcaagaagaccaccgacgaggagctggaggagatgctggagagcggcaaccccgccatcttcaccagcggcatcatcgacagccagatcagcaagcaggccctgagcgagatcgagggcagacacaaggacatcgtgagactggagagcagcatcaaggagctgcacgacatgttcatggacatcgccatgctggtggagaaccagggcgagatgctggacaacatcgagctgaacgtgatgcacaccgtggaccacgtggagaaggccagagacgagaccaagaaggccgtgaagtaccagagccaggccagaaagaagctgatcatcatcatcgtgctggtggtggtgctgctgggcatcctggccctgatcatcggcctgagcgtgggcctgaactag

SEQ ID NO: 101644 - DNA, 870 bp, Artificial Sequence
  Description of Artificial Sequence: Synthetic coding sequence
atgaaggacagactggagcagctgaaggccaagcagctgacccaggacgacgacaccgacgccgtggagatcgccatcgacaacaccgccttcatggacgagttcttcagcgagatcgaggagaccagactgaacatcgacaagatcagcgagcacgtggaggaggccaagaagctgtacagcatcatcctgagcgcccccatccccgagcccaagaccaaggacgacctggagcagctgaccaccgagatcaagaagagagccaacaacgtgagaaacaagctgaagagcatggagaagcacatcgaggaggacgaggtgagaagcagcgccgacctgagaatcagaaagagccagcacagcgtgctgagcagaaagttcgtggaggtgatgaccaagtacaacgaggcccaggtggacttcagagagagaagcaagggcagaatccagagacagctggagatcaccggcaagaagaccaccgacgaggagctggaggagatgctggagagcggcaaccccgccatcttcaccagcggcatcatcgacagccagatcagcaagcaggccctgagcgagatcgagggcagacacaaggacatcgtgagactggagagcagcatcaaggagctgcacgacatgttcatggacatcgccatgctggtggagaaccagggcgagatgctggacaacatcgagctgaacgtgatgcacaccgtggaccacgtggagaaggccagagacgagaccaagaaggccgtgaagtaccagagccaggccagaaagaagctgatcatcatcatcgtgctggtggtggtgctgctgggcatcctggccctgatcatcggcctgagcgtgggcctgaactag

SEQ ID NO: 101645 - DNA, 543 bp, Artificial Sequence
  Description of Artificial Sequence: Synthetic coding sequence
atggagaagcacatcgaggaggacgaggtgagaagcagcgccgacctgagaatcagaaagagccagcacagcgtgctgagcagaaagttcgtggaggtgatgaccaagtacaacgaggcccaggtggacttcagagagagaagcaagggcagaatccagagacagctggagatcaccggcaagaagaccaccgacgaggagctggaggagatgctggagagcggcaaccccgccatcttcaccagcggcatcatcgacagccagatcagcaagcaggccctgagcgagatcgagggcagacacaaggacatcgtgagactggagagcagcatcaaggagctgcacgacatgttcatggacatcgccatgctggtggagaaccagggcagcatgatcgacagaatcgagaacaacatggaccagagcgtgggcttcgtggagagagccgtggccgacaccaagaaggccgtgaagtaccagagcgaggccagaagaaagctgatcagcctgcagaccggcgtggccaccctggtgttcagatag

SEQ ID NO: 101646 - DNA, 834 bp, Artificial Sequence
  Description of Artificial Sequence: Synthetic coding sequence
atgaaggacagactggagcagctgaaggccaagcagctgacccaggacgacgacaccgacgccgtggagatcgccatcgacaacaccgccttcatggacgagttcttcagcgagatcgaggagaccagactgaacatcgacaagatcagcgagcacgtggaggaggccaagaagctgtacagcatcatcctgagcgcccccatccccgagcccaagaccaaggacgacctggagcagctgaccaccgagatcaagaagagagccaacaacgtgagaaacaagctgaagagcatggagaagcacatcgaggaggacgaggtgagaagcagcgccgacctgagaatcagaaagagccagcacagcgtgctgagcagaaagttcgtggaggtgatgaccaagtacaacgaggcccaggtggacttcagagagagaagcaagggcagaatccagagacagctggagatcaccggcaagaagaccaccgacgaggagctggaggagatgctggagagcggcaaccccgccatcttcaccagcggcatcatcgacagccagatcagcaagcaggccctgagcgagatcgagggcagacacaaggacatcgtgagactggagagcagcatcaaggagctgcacgacatgttcatggacatcgccatgctggtggagaaccagggcgagatgctggacaacatcgagctgaacgtgatgcacaccgtggaccacgtggagaaggccagagacgagaccaagaaggccgtgaagtaccagagccaggccagaaagaagctgatcagcctgcagaccggcgtggccaccctggtgttcagatag

SEQ ID NO: 101647 - DNA, 231 bp, Artificial Sequence
  Description of Artificial Sequence: Synthetic coding sequence
atgttcatggacatcgccatgctggtggagaaccagggcgagatgctggacaacatcgagctgaacgtgatgcacaccgtggaccacgtggagaaggccagagacgagaccaagaaggccgtgaagtaccagagccaggccagaaagaagctgatcatcatcatcgtgctggtggtggtgctgctgggcatcctggccctgatcatcggcctgagcgtgggcctgaactag

SEQ ID NO: 101648 - DNA, 759 bp, Artificial Sequence
  Description of Artificial Sequence: Synthetic coding sequence
atgaaggacagactggagcagctgaaggccaagcagctgacccaggacgacgacaccgacgccgtggagatcgccatcgacaacaccgccttcatggacgagttcttcagcgagatcgaggagaccagactgaacatcgacaagatcagcgagcacgtggaggaggccaagaagctgtacagcatcatcctgagcgcccccatccccgagcccaagaccaaggacgacctggagcagctgaccaccgagatcaagaagagagccaacaacgtgagaaacaagctgaagagcatggagaagcacatcgaggaggacgaggtgagaagcagcgccgacctgagaatcagaaagagccagcacagcgtgctgagcagaaagttcgtggaggtgatgaccaagtacaacgaggcccaggtggacttcagagagagaagcaagggcagaatccagagacagctggagatcaccggcaagaagaccaccgacgaggagctggaggagatgctggagagcggcaaccccgccatcttcaccagcggcatcatcgacagccagatcagcaagcaggccctgagcgagatcgagggcagacacaaggacatcgtgagactggagagcagcatcaaggagctgcacgacatgttcatggacatcgccatgctggtggagaaccagaagctgatcatcatcatcgtgctggtggtggtgctgctgggcatcctggccctgatcatcggcctgagcgtgggcctgaactag

SEQ ID NO: 101649 - DNA, 894 bp, Artificial Sequence
  Description of Artificial Sequence: Synthetic coding sequence
atgagagacagaacccacgagctgagacagggcgacgacagcagcgacgaggaggacaaggagagagtggccctggtggtgcaccccggcaccgccagactgggcagccccgacgaggagttcttccacaaggtgagaaccatcagacagaccatcgtgaagctgggcaacaaggtgcaggagctggagaagcagcaggtgaccatcctggccacccccctgcccgaggagagcatgaagcaggagctgcagaacctgagagacgagatcaagcagctgggcagagagatcagactgcagctgaaggccatcgagccccagaaggaggaggccgacgagaactacaacagcgtgaacaccagaatgagaaagacccagcacggcgtgctgagccagcagttcgtggagctgatcaacaagtgcaacagcatgcagagcgagtacagagagaagaacgtggagagaatcagaagacagctgaagatcaccaacgccggcatggtgagcgacgaggagctggagcagatgctggacagcggccagagcgaggtgttcgtgagcaacatcctgaaggacacccaggtgaccagacaggccctgaacgagatcagcgccagacacagcgagatccagcagctggagagaagcatcagagagctgcacgacatcttcaccttcctggccaccgaggtggagatgcagggcgagatgatcaacagaatcgagaagaacatcctgagcagcgccgactacgtggagagaggccaggagcacgtgaagaccgccctggagaaccagaagaaggccagaaagaagaaggtgctgatcgccatctgcgtgagcatcaccgtggtgctgctggccgtgatcatcggcgtgaccgtggtgggctag

SEQ ID NO: 101650 - DNA, 888 bp, Artificial Sequence
  Description of Artificial Sequence: Synthetic coding sequence
atgggcatgaccgccagaaccaagagaaccagaagcggcagcagatggtggtgcaccagagccagacacggctggggcgccagaaccagaagcagcagcaccagccccctgggccaccccccccaggtgagaaccatcagacagaccatcgtgaagctgggcaacaaggtgcaggagctggagaagcagcaggtgaccatcctggccacccccctgcccgaggagagcatgaagcaggagctgcagaacctgagagacgagatcaagcagctgggcagagagatcagactgcagctgaaggccatcgagccccagaaggaggaggccgacgagaactacaacagcgtgaacaccagaatgagaaagacccagcacggcgtgctgagccagcagttcgtggagctgatcaacaagtgcaacagcatgcagagcgagtacagagagaagaacgtggagagaatcagaagacagctgaagatcaccaacgccggcatggtgagcgacgaggagctggagcagatgctggacagcggccagagcgaggtgttcgtgagcaacatcctgaaggacacccaggtgaccagacaggccctgaacgagatcagcgccagacacagcgagatccagcagctggagagaagcatcagagagctgcacgacatcttcaccttcctggccaccgaggtggagatgcagggcgagatgatcaacagaatcgagaagaacatcctgagcagcgccgactacgtggagagaggccaggagcacgtgaagaccgccctggagaaccagaagaaggccagaaagaagaaggtgctgatcgccatctgcgtgagcatcaccgtggtgctgctggccgtgatcatcggcgtgaccgtggtgggctag

SEQ ID NO: 101651 - DNA, 1068 bp, Artificial Sequence
  Description of Artificial Sequence: Synthetic coding sequence
atgatccccagaaagagatacggcagcaagaacaccgaccagggcgtgtacctgggcctgagcaagacccaggtgctgagccccgccaccgccggcagcagcagcagcgacatcgcccccctgcccccccccgtgaccctggtgccccccccccccgacaccatgagctgcagagacagaacccaggagttcctgagcgcctgcaagagcctgcagaccagacagaacggcatccagaccaacaagcccgccctgagagccgtgagacagagaagcgagttcaccctgatggccaagagaatcggcaaggacctgagcaacaccttcgccaagctggagaagctgaccatcctggccaagagaaagagcctgttcgacgacaaggccgtggagatcgaggagctgacctacatcatcaagcaggacatcaacagcctgaacaagcagatcgcccagctgcaggacttcgtgagagccaagggcagccagagcggcagacacctgcagacccacagcaacaccatcgtggtgagcctgcagagcaagctggccagcatgagcaacgacttcaagagcgtgctggaggtgagaaccgagaacctgaagcagcagagaagcagaagagagcagttcagcagagcccccgtgagcgccctgcccctggcccccaaccacctgggcggcggcgccgtggtgctgggcgccgagagccacgccagcaaggacgtggccatcgacatgatggacagcagaaccagccagcagctgcagctgatcgacgagcaggacagctacatccagagcagagccgacaccatgcagaacatcgagagcaccatcgtggagctgggcagcatcttccagcagctggcccacatggtgaaggagcaggaggagaccatccagagaatcgacgagaacgtgctgggcgcccagctggacgtggaggccgcccacagcgagatcctgaagtacttccagagcgtgaccagcaacagatggctgatggtgaagatcttcctgatcctgatcgtgttcttcatcatcttcgtggtgttcctggcctag

SEQ ID NO: 101652 - DNA, 966 bp, Artificial Sequence
  Description of Artificial Sequence: Synthetic coding sequence
atgatccccagaaagagatacggcagcaagaacaccgaccagggcgtgtacctgggcctgagcaagacccaggtgctgagccccgccaccgccggcagcagcagcagcgacatcgcccccctgcccccccccgtgaccctggtgccccccccccccgacaccatgagctgcagagacagaacccaggagttcctgagcgcctgcaagagcctgcagaccagacagaacggcatccagaccaacaagcccgccctgagagccgtgagacagagaagcgagttcaccctgatggccaagagaatcggcaaggacctgagcaacaccttcgccaagctggagaagctgaccatcctggccaagagaaagagcctgttcgacgacaaggccgtggagatcgaggagctgacctacatcatcaagcaggacatcaacagcctgaacaagcagatcgcccagctgcaggacttcgtgagagccaagggcagccagagcggcagacacctgcagacccacagcaacaccatcgtggtgagcctgcagagcaagctggccagcatgagcaacgacttcaagagcgtgctggaggtgagaaccgagaacctgaagcagcagagaagcagaagagagcagttcagcagagcccccgtgagcgccctgcccctggcccccaaccacctgggcggcggcgccgtggtgctgggcgccgagagccacgccagcaaggacgtggccatcgacatgatggacagcagaaccagccagcagctgcagctgatcgacgagcaggacagctacatccagagcagagccgacaccatgcagaacatcgagagcaccatcgtggagctgggcagcatcttccagcagctggcccacatggtgaaggagcaggaggagaccatccagagcgtgctgctgttccccctgctgcccgccctgagccccggcagcaccagaacctgctag

SEQ ID NO: 101653 - DNA, 906 bp, Artificial Sequence
  Description of Artificial Sequence: Synthetic coding sequence
atgagctgcagagacagaacccaggagttcctgagcgcctgcaagagcctgcagaccagacagaacggcatccagaccaacaagcccgccctgagagccgtgagacagagaagcgagttcaccctgatggccaagagaatcggcaaggacctgagcaacaccttcgccaagctggagaagctgaccatcctggccaagagaaagagcctgttcgacgacaaggccgtggagatcgaggagctgacctacatcatcaagcaggacatcaacagcctgaacaagcagatcgcccagctgcaggacttcgtgagagccaagggcagccagagcggcagacacctgcagacccacagcaacaccatcgtggtgagcctgcagagcaagctggccagcatgagcaacgacttcaagagcgtgctggaggtgagaaccgagaacctgaagcagcagagaagcagaagagagcagttcagcagagcccccgtgagcgccctgcccctggcccccaaccacctgggcggcggcgccgtggtgctgggcgccgagagccacgccagcaaggacgtggccatcgacatgatggacagcagaaccagccagcagctgcagctgatcgacgagcaggacagctacatccagagcagagccgacaccatgcagaacatcgagagcaccatcgtggagctgggcagcatcttccagcagctggcccacatggtgaaggagcaggaggagaccatccagagaatcgacgagaacgtgctgggcgcccagctggacgtggaggccgcccacagcgagatcctgaagtacttccagagcgtgaccagcaacagatggctgatggtgaagatcttcctgatcctgatcgtgttcttcatcatcttcgtggtgttcctggcctag

SEQ ID NO: 101654 - DNA, 780 bp, Artificial Sequence
  Description of Artificial Sequence: Synthetic coding sequence
atggccaagagaatcggcaaggacctgagcaacaccttcgccaagctggagaagctgaccatcctggccaagagaaagagcctgttcgacgacaaggccgtggagatcgaggagctgacctacatcatcaagcaggacatcaacagcctgaacaagcagatcgcccagctgcaggacttcgtgagagccaagggcagccagagcggcagacacctgcagacccacagcaacaccatcgtggtgagcctgcagagcaagctggccagcatgagcaacgacttcaagagcgtgctggaggtgagaaccgagaacctgaagcagcagagaagcagaagagagcagttcagcagagcccccgtgagcgccctgcccctggcccccaaccacctgggcggcggcgccgtggtgctgggcgccgagagccacgccagcaaggacgtggccatcgacatgatggacagcagaaccagccagcagctgcagctgatcgacgagcaggacagctacatccagagcagagccgacaccatgcagaacatcgagagcaccatcgtggagctgggcagcatcttccagcagctggcccacatggtgaaggagcaggaggagaccatccagagaatcgacgagaacgtgctgggcgcccagctggacgtggaggccgcccacagcgagatcctgaagtacttccagagcgtgaccagcaacagatggctgatggtgaagatcttcctgatcctgatcgtgttcttcatcatcttcgtggtgttcctggcctag

SEQ ID NO: 101655 - DNA, 720 bp, Artificial Sequence
  Description of Artificial Sequence: Synthetic coding sequence
atgagctacacccccggcgtgggcggcgaccccgcccagctggcccagagaatcagcagcaacatccagaagatcacccagtgcagcgtggagatccagagaaccctgaaccagctgggcaccccccaggacagccccgagctgagacagcagctgcagcagaagcagcagtacaccaaccagctggccaaggagaccgacaagtacatcaaggagttcggcagcctgcccaccacccccagcgagcagagacagagaaagatccagaaggacagactggtggccgagttcaccaccagcctgaccaacttccagaaggtgcagagacaggccgccgagagagagaaggagttcgtggccagagtgagagccagcagcagagtgagcggcagcttccccgaggacagcagcaaggagagaaacctggtgagctgggagagccagacccagccccaggtgcaggtgcaggacgaggagatcaccgaggacgacctgagactgatccacgagagagagagcagcatcagacagctggaggccgacatcatggacatcaacgagatcttcaaggacctgggcatgatgatccacgagcagggcgacgtgatcgacagcatcgaggccaacgtggagaacgccgaggtgcacgtgcagcaggccaaccagcagctgagcagagccgccgactaccagaagaaggacagctgcatgctgatgtag

SEQ ID NO: 101656 - DNA, 786 bp, Artificial Sequence
  Description of Artificial Sequence: Synthetic coding sequence
atgagctacacccccggcgtgggcggcgaccccgcccagctggcccagagaatcagcagcaacatccagaagatcacccagtgcagcgtggagatccagagaaccctgaaccagctgggcaccccccaggacagccccgagctgagacagcagctgcagcagaagcagcagtacaccaaccagctggccaaggagaccgacaagtacatcaaggagttcggcagcctgcccaccacccccagcgagcagagacagagaaagatccagaaggacagactggtggccgagttcaccaccagcctgaccaacttccagaaggtgcagagacaggccgccgagagagagaaggagttcgtggccagagtgagagccagcagcagagtgagcggcagcttccccgaggacagcagcaaggagagaaacctggtgagctgggagagccagacccagccccaggtgcaggtgcaggacgaggagatcaccgaggacgacctgagactgatccacgagagagagagcagcatcagacagctggaggccgacatcatggacatcaacgagatcttcaaggacctgggcatgatgatccacgagcagggcgacgtgatcgacagcatcgaggccaacgtggagaacgccgaggtgcacgtgcagcaggccaaccagcagctgagcagagccgccgactaccagagaaagagcagaaagaccctgtgcatcatcatcctgatcctggtgatcggcgtggccatcatcagcctgatcatctggggcctgaaccactag

SEQ ID NO: 101657 - DNA, 786 bp, Artificial Sequence; identical to SEQ ID NO: 101656
  Description of Artificial Sequence: Synthetic coding sequence

SEQ ID NO: 101658 - DNA, 711 bp, Artificial Sequence
  Description of Artificial Sequence: Synthetic coding sequence
atggcccccgacccctggttcagcacctacgacagcacctgccagatcgcccaggagatcgccgagaagatccagcagagaaaccagtacgagagaaagggcgagaaggcccccaagctgaccgtgaccatcagagccctgctgcagaacctgaaggagaagatcgccctgctgaaggacctgctgctgagagccgtgagcacccaccagatcacccagctggagggcgacagaagacagaacctgctggacgacctggtgaccagagagagactgctgctggccagcttcaagaacgagggcgccgagcccgacctgatcagaagcagcctgatgagcgaggaggccaagagaggcgcccccaacccctggctgttcgaggagcccgaggagaccagaggcctgggcttcgacgagatcagacagcagcagcagaagatcatccaggagcaggacgccggcctggacgccctgagcagcatcatcagcagacagaagcagatgggccaggagatcggcaacgagctggacgagcagaacgagatcatcgacgacctggccaacctggtggagaacaccgacgagaagctgagaaacgagaccagaagagtgaacatggtggacagaaagagcgccagctgcggcatgatcatggtgatcctgctgctgctggtggccatcgtggtggtggccgtgtggcccaccaactag

SEQ ID NO: 101659 - DNA, 1785 bp, Artificial Sequence
  Description of Artificial Sequence: Synthetic coding sequence
atggcccccatcggcctgaaggccgtggtgggcgagaagatcatgcacgacgtgatcaagaaggtgaagaagaagggcgagtggaaggtgctggtggtggaccagctgagcatgagaatgctgagcagctgctgcaagatgaccgacatcatgaccgagggcatcaccatcgtggaggacatcaacaagagaagagagcccctgcccagcctggaggccgtgtacctgatcacccccagcgagaagagcgtgcacagcctgatcagcgacttcaaggacccccccaccgccaagtacagagccgcccacgtgttcttcaccgacagctgccccgacgccctgttcaacgagctggtgaagagcagagccgccaaggtgatcaagaccctgaccgagatcaacatcgccttcctgccctacgagagccaggtgtacagcctggacagcgccgacagcttccagagcttctacagcccccacaaggcccagatgaagaaccccatcctggagagactggccgagcagatcgccaccctgtgcgccaccctgaaggagtaccccgccgtgagatacagaggcgagtacaaggacaacgccctgctggcccagctgatccaggacaagctggacgcctacaaggccgacgaccccaccatgggcgagggccccgacaaggccagaagccagctgctgatcctggacagaggcttcgaccccagcagccccgtgctgcacgagctgaccttccaggccatgagctacgacctgctgcccatcgagaacgacgtgtacaagtacgagaccagcggcatcggcgaggccagagtgaaggaggtgctgctggacgaggacgacgacctgtggatcgccctgagacacaagcacatcgccgaggtgagccaggaggtgaccagaagcctgaaggacttcagcagcagcaagagaatgaacaccggcgagaagaccaccatgagagacctgagccagatgctgaagaagatgccccagtaccagaaggagctgagcaagtacagcacccacctgcacctggccgaggactgcatgaagcactaccagggcaccgtggacaagctgtgcagagtggagcaggacctggccatgggcaccgacgccgagggcgagaagatcaaggaccccatgagagccatcgtgcccatcctgctggacgccaacgtgagcacctacgacaagatcagaatcatcctgctgtacatcttcctgaagaacggcatcaccgaggagaacctgaacaagctgatccagcacgcccagatcccccccgaggacagcgagatcatcaccaacatggcccacctgggcgtgcccatcgtgaccgacagcaccctgagaagaagaagcaagcccgagagaaaggagagaatcagcgagcagacctaccagctgagcagatggacccccatcatcaaggacatcatggaggacaccatcgaggacaagctggacaccaagcactacccctacatcagcaccagaagcagcgccagcttcagcaccaccgccgtgagcgccagatacggccactggcacaagaacaaggcccccggcgagtacagaagcggccccagactgatcatcttcatcctgggcggcgtgagcctgaacgagatgagatgcgcctacgaggtgacccaggccaacggcaagtgggaggtgctgatcggcagcacccacatcctgaccccccagaagctgctggacaccctgaagaagctgaacaagaccgacgaggagatcagcagctag

SEQ ID NO: 101660 - DNA, 1674 bp, Artificial Sequence
  Description of Artificial Sequence: Synthetic coding sequence
atgaccgacatcatgaccgagggcatcaccatcgtggaggacatcaacaagagaagagagcccctgcccagcctggaggccgtgtacctgatcacccccagcgagaagagcgtgcacagcctgatcagcgacttcaaggacccccccaccgccaagtacagagccgcccacgtgttcttcaccgacagctgccccgacgccctgttcaacgagctggtgaagagcagagccgccaaggtgatcaagaccctgaccgagatcaacatcgccttcctgccctacgagagccaggtgtacagcctggacagcgccgacagcttccagagcttctacagcccccacaaggcccagatgaagaaccccatcctggagagactggccgagcagatcgccaccctgtgcgccaccctgaaggagtaccccgccgtgagatacagaggcgagtacaaggacaacgccctgctggcccagctgatccaggacaagctggacgcctacaaggccgacgaccccaccatgggcgagggccccgacaaggccagaagccagctgctgatcctggacagaggcttcgaccccagcagccccgtgctgcacgagctgaccttccaggccatgagctacgacctgctgcccatcgagaacgacgtgtacaagtacgagaccagcggcatcggcgaggccagagtgaaggaggtgctgctggacgaggacgacgacctgtggatcgccctgagacacaagcacatcgccgaggtgagccaggaggtgaccagaagcctgaaggacttcagcagcagcaagagaatgaacaccggcgagaagaccaccatgagagacctgagccagatgctgaagaagatgccccagtaccagaaggagctgagcaagtacagcacccacctgcacctggccgaggactgcatgaagcactaccagggcaccgtggacaagctgtgcagagtggagcaggacctggccatgggcaccgacgccgagggcgagaagatcaaggaccccatgagagccatcgtgcccatcctgctggacgccaacgtgagcacctacgacaagatcagaatcatcctgctgtacatcttcctgaagaacggcatcaccgaggagaacctgaacaagctgatccagcacgcccagatcccccccgaggacagcgagatcatcaccaacatggcccacctgggcgtgcccatcgtgaccgacagcaccctgagaagaagaagcaagcccgagagaaaggagagaatcagcgagcagacctaccagctgagcagatggacccccatcatcaaggacatcatggaggacaccatcgaggacaagctggacaccaagcactacccctacatcagcaccagaagcagcgccagcttcagcaccaccgccgtgagcgccagatacggccactggcacaagaacaaggcccccggcgagtacagaagcggccccagactgatcatcttcatcctgggcggcgtgagcctgaacgagatgagatgcgcctacgaggtgacccaggccaacggcaagtgggaggtgctgatcggcagcacccacatcctgacccccaccaagttcctgatggacctgagacaccccgacttcagagagagcagcagagtgagcttcgaggaccaggcccccaccatggagtag

SEQ ID NO: 101661 - DNA, 1308 bp, Artificial Sequence
  Description of Artificial Sequence: Synthetic coding sequence
atggcccccatcggcctgaaggccgtggtgggcgagaagatcatgcacgacgtgatcaagaaggtgaagaagaagggcgagtggaaggtgctggtggtggaccagctgagcatgagaatgctgagcagctgctgcaagatgaccgacatcatgaccgagggccccgacaaggccagaagccagctgctgatcctggacagaggcttcgaccccagcagccccgtgctgcacgagctgaccttccaggccatgagctacgacctgctgcccatcgagaacgacgtgtacaagtacgagaccagcggcatcggcgaggccagagtgaaggaggtgctgctggacgaggacgacgacctgtggatcgccctgagacacaagcacatcgccgaggtgagccaggaggtgaccagaagcctgaaggacttcagcagcagcaagagaatgaacaccggcgagaagaccaccatgagagacctgagccagatgctgaagaagatgccccagtaccagaaggagctgagcaagtacagcacccacctgcacctggccgaggactgcatgaagcactaccagggcaccgtggacaagctgtgcagagtggagcaggacctggccatgggcaccgacgccgagggcgagaagatcaaggaccccatgagagccatcgtgcccatcctgctggacgccaacgtgagcacctacgacaagatcagaatcatcctgctgtacatcttcctgaagaacggcatcaccgaggagaacctgaacaagctgatccagcacgcccagatcccccccgaggacagcgagatcatcaccaacatggcccacctgggcgtgcccatcgtgaccgacagcaccctgagaagaagaagcaagcccgagagaaaggagagaatcagcgagcagacctaccagctgagcagatggacccccatcatcaaggacatcatggaggacaccatcgaggacaagctggacaccaagcactacccctacatcagcaccagaagcagcgccagcttcagcaccaccgccgtgagcgccagatacggccactggcacaagaacaaggcccccggcgagtacagaagcggccccagactgatcatcttcatcctgggcggcgtgagcctgaacgagatgagatgcgcctacgaggtgacccaggccaacggcaagtgggaggtgctgatcggcagcacccacatcctgacccccaccaagttcctgatggacctgagacaccccgacttcagagagagcagcagagtgagcttcgaggaccaggcccccaccatggagtag

SEQ ID NO: 101662 - DNA, 1812 bp, Artificial Sequence
  Description of Artificial Sequence: Synthetic coding sequence
atggcccccatcggcctgaaggccgtggtgggcgagaagatcatgcacgacgtgatcaagaaggtgaagaagaagggcgagtggaaggtgctggtggtggaccagctgagcatgagaatgctgagcagctgctgcaagatgaccgacatcatgaccgagggcatcaccatcgtggaggacatcaacaagagaagagagcccctgcccagcctggaggccgtgtacctgatcacccccagcgagaagagcgtgcacagcctgatcagcgacttcaaggacccccccaccgccaagtacagagccgcccacgtgttcttcaccgacagctgccccgacgccctgttcaacgagctggtgaagagcagagccgccaaggtgatcaagaccctgaccgagatcaacatcgccttcctgccctacgagagccaggtgtacagcctggacagcgccgacagcttccagagcttctacagcccccacaaggcccagatgaagaaccccatcctggagagactggccgagcagatcgccaccctgtgcgccaccctgaaggagtaccccgccgtgagatacagaggcgagtacaaggacaacgccctgctggcccagctgatccaggacaagctggacgcctacaaggccgacgaccccaccatgggcgagggccccgacaaggccagaagccagctgctgatcctggacagaggcttcgaccccagcagccccgtgctgcacgagctgaccttccaggccatgagctacgacctgctgcccatcgagaacgacgtgtacaagtacgagaccagcggcatcggcgaggccagagtgaaggaggtgctgctggacgaggacgacgacctgtggatcgccctgagacacaagcacatcgccgaggtgagccaggaggtgaccagaagcctgaaggacttcagcagcagcaagagaatgaacaccggcgagaagaccaccatgagagacctgagccagatgctgaagaagatgccccagtaccagaaggagctgagcaagtacagcacccacctgcacctggccgaggactgcatgaagcactaccagggcaccgtggacaagctgtgcagagtggagcaggacctggccatgggcaccgacgccgagggcgagaagatcaaggaccccatgagagccatcgtgcccatcctgctggacgccaacgtgagcacctacgacaagatcagaatcatcctgctgtacatcttcctgaagaacggcatcaccgaggagaacctgaacaagctgatccagcacgcccagatcccccccgaggacagcgagatcatcaccaacatggcccacctgggcgtgcccatcgtgaccgacagcaccctgagaagaagaagcaagcccgagagaaaggagagaatcagcgagcagacctaccagctgagcagatggacccccatcatcaaggacatcatggaggacaccatcgaggacaagctggacaccaagcactacccctacatcagcaccagaagcagcgccagcttcagcaccaccgccgtgagcgccagatacggccactggcacaagaacaaggcccccggcgagtacagaagcggccccagactgatcatcttcatcctgggcggcgtgagcctgaacgagatgagatgcgcctacgaggtgacccaggccaacggcaagtgggaggtgctgatcggcagcacccacatcctgacccccaccaagttcctgatggacctgagacaccccgacttcagagagagcagcagagtgagcttcgaggaccaggcccccaccatggagtag

SEQ ID NO: 101663 - DNA, 1389 bp, Artificial Sequence
  Description of Artificial Sequence: Synthetic coding sequence
atggcccccaccatccagacccaggcccagagagaggacggccacagaagcggcgtggtgtgcagagtgaagtactgcaacagcctgcccgacatccccttcgaccccaagttcatcacctaccccttcgaccagaacagattcgtgcagtacaaggccaccagcctggagaagcagcacaagcacgacctgctgaccgagcccgacctgggcgtgaccatcgacctgatcaaccccgacacctacagaatcgaccccaacgtgctgctggaccccgccgacgagaagctgctggaggaggagatccaggcccccaccagcagcaagagaagccagcagcacgccaaggtggtgccctggatgagaaagaccgagtacatcagcaccgagttcaacagatacggcatcagcaacgagaagcccgaggtgaagatcggcgtgagcgtgaagcagcagttcaccgaggaggagatctacaaggacagagacagccagatcaccgccatcgagaagaccttcgaggacgcccagaagagcatgtggatcaacccctgcgcccaggtgatcttcgacagcgaccccgcccccaaggacaccagcggcgccgccgccctggagatgatgagccaggccatgatcagaggcatgatggacgaggagggcaaccagttcgtggcctacttcctgcccgtggaggagaccctgaagaagagaaagagagaccaggaggaggagatggactacgcccccgacgacgtgtacgactacaagatcgccagagagtacaactggaacgtgaagaacaaggccagcaagggctacgaggagaactacttcttcatcttcagagagggcgacggcgtgtactacaacgagctggagaccagagtgagactgagcaagagaagagccaaggccggcgtgcagagcggcaccaacgccctgctggtggtgaagcacagagacatgaacgagaaggagctggaggcccaggaggccagaaaggcccagctggagaaccacgagcccgaggaggaggaggaggaggagatggagaccgaggagaaggaggccggcggcagcgtgatgctgatcctgagaaccatgcccaccctgatgatgagaaccgaggacagacccaaggtggccgtgaccatgatccagaccgccgccgccatgggcgtggccagcggcgccggcgccaccgccgccgcccccgtgcccagccccgtggccgccagcaccagacccagaagaatggccgtgaagctgcagctgctgatccccgtgaagctgatcgtgaccgtgaccgagagccagggcatccagggctggttcagacaccactactgcgagcagcagagcaccttcctggtggtgtgcctgtag

SEQ ID NO: 101664 - DNA, 1197 bp, Artificial Sequence
  Description of Artificial Sequence: Synthetic coding sequence
atgtgcatcagagtgcacgtgagcatgtgcatgtgcatgtgcgtgcacgtgtgcgtgcacctgtgcatgcacgtgtgcgccgtgtgcatgtgcgtgtacgtgtgcgtgtgcgtgcacgtgcacgtgtgcgccagcgtgtgcgccttcgtgtgcatgtgcgtgtgcgtgtgcgtgtgcggcagcgtgtgcgccttcgtgagcgtgcacgtgtgcatgagagtgtacgtgtgcgtgtgcatctgcgtgcacctgtacgtgtgcgtgtgcgtgtgcctgtgcgcctgcgtgtacgcctgcgtgtgcatgtgcctgagactgtgcgtgagactgtgcgtgagcgtgtgcgcctgcgtgtacgcctgcatctgcatgtgcatctgcgtgcacgtgagcatgtacgtgtgcgccagcgtgtgcgcctgcgtgtgcgtgtgcgtgtgcgtgtgcgtgtgcatgagagtgtgcgcccaccagtgcctgcacgtgtgcatctgcgtgtacgtgtgcgccagaatctgcgtgtgcgcctgcgtgtacgtgtgcgtgtgcatcagcgtgtgcgcctgcgtgtacgtgtgcgtgcacctgtgcgtgtgcgcctgcgtgcacgcctgcgtgtgcgtgtgcgcctgcgtgcacctgtgcgtgtgcgcctgcgcccacgtgggcgccaccctggtgtgcatctgcacctacacctgccccagacccagcatgttcgcccacggcggcagatggggcgtggccggcagacccagacagcccatgagcctgggcgtgcaggcccaggcccagagagtgatccacctgccccagagcgtgcaggccctgatcaaggacttccagggcacccccaccttcacctacaaggccgcccacatcttcttcaccgacacctgccccgagcccctgttcagcgagctgggcagaagcagactggccaaggtggtgaagaccctgaaggagatccacctggccttcctgccctacgaggcccaggtgagacccggcctgatcctgggcagaggctggggcttcgtgaccaagtgccccctgttcccccagaagcagaccctgagactgggcgccgtggcccacacctgcaaccccagcgccgtgggcggccagggcagaagaatcacctggggccaggagttcgagaccagcctgggcaccgagcaggaccccgtgagctag

SEQ ID NO: 101665 - DNA, 1773 bp, Artificial Sequence
  Description of Artificial Sequence: Synthetic coding sequence
atggcccccagcggcctgaaggccgtggtgggcgagaagatcctgagcggcgtgatcagaagcgtgaagaaggacggcgagtggaaggtgctgatcatggaccaccccagcatgagaatcctgagcagctgctgcaagatgagcgacatcctggccgagggcatcaccatcgtggaggacatcaacaagagaagagagcccatccccagcctggaggccatctacctgctgagccccaccgagaaggccctgatcaaggacttccagggcacccccaccttcacctacaaggccgcccacatcttcttcaccgacacctgccccgagcccctgttcagcgagctgggcagaagcagactggccaaggtggtgaagaccctgaaggagatccacctggccttcctgccctacgaggcccaggtgttcagcctggacgccccccacagcacctacaacctgtactgccccttcagagccgaggagagaaccagacagctggaggtgctggcccagcagatcgccaccctgtgcgccaccctgcaggagtaccccgccatcagatacagaaagggccccgaggacaccgcccagctggcccacgccgtgctggccaagctgaacgccttcaaggccgacacccccagcctgggcgagggccccgagaagaccagaagccagctgctgatcatggacagagccgccgaccccgtgagccccctgctgcacgagctgaccttccaggccatggcctacgacctgctggacatcgagcaggacacctacagatacgagaccaccggcctgagcgaggccagagagaaggccgtgctgctggacgaggacgacgacctgtgggtggagctgagacacatgcacatcgccgacgtgagcaagaaggtgaccgagctgctgagaaccttctgcgagagcaagagactgaccaccgacaaggccaacatcaaggacctgagccagatcctgaagaagatgccccagtaccagaaggagctgaacaagtacagcacccacctgcacctggccgacgactgcatgaagcacttcaagggcagcgtggagaagctgtgcagcgtggagcaggacctggccatgggcagcgacgccgagggcgagaagatcaaggacagcatgaagctgatcgtgcccgtgctgctggacgccgccgtgcccgcctacgacaagatcagagtgctgctgctgtacatcctgctgagaaacggcgtgagcgaggagaacctggccaagctgatccagcacgccaacgtgcaggcccacagcagcctgatcagaaacctggagcagctgggcggcaccgtgaccaaccccggcggcagcggcaccagcagcagactggagcccagagagagaatggagcccacctaccagctgagcagatggacccccgtgatcaaggacgtgatggaggacgccgtggaggacagactggacagaaacctgtggcccttcgtgagcgaccccgcccccaccgccagcagccaggccgccgtgagcgccagattcggccactggcacaagaacaaggccggcatcgaggccagagccggccccagactgatcgtgtacgtgatgggcggcgtggccatgagcgagatgagagccgcctacgaggtgaccagagccaccgagggcaagtgggaggtgctgatcggcagcagccacatcctgacccccaccagattcctggacgacctgaaggccctggacaagaagctggaggacatcgccctgccctag

SEQ ID NO: 101666 - DNA, 1815 bp, Artificial Sequence
  Description of Artificial Sequence: Synthetic coding sequence
atggcccccagcggcctgaaggccgtggtgggcgagaagatcctgagcggcgtgatcagaagcgtgaagaaggacggcgagtggaaggtgctgatcatggaccaccccagcatgagaatcctgagcagctgctgcaagatgagcgacatcctggccgagggcatcaccatcgtggaggacatcaacaagagaagagagcccatccccagcctggaggccatctacctgctgagccccaccgagaaggcccaggcccagagagtgatccacctgccccagagcgtgcaggccctgatcaaggacttccagggcacccccaccttcacctacaaggccgcccacatcttcttcaccgacacctgccccgagcccctgttcagcgagctgggcagaagcagactggccaaggtggtgaagaccctgaaggagatccacctggccttcctgccctacgaggcccaggtgttcagcctggacgccccccacagcacctacaacctgtactgccccttcagagccgaggagagaaccagacagctggaggtgctggcccagcagatcgccaccctgtgcgccaccctgcaggagtaccccgccatcagatacagaaagggccccgaggacaccgcccagctggcccacgccgtgctggccaagctgaacgccttcaaggccgacacccccagcctgggcgagggccccgagaagaccagaagccagctgctgatcatggacagagccgccgaccccgtgagccccctgctgcacgagctgaccttccaggccatggcctacgacctgctggacatcgagcaggacacctacagatacgagaccaccggcctgagcgaggccagagagaaggccgtgctgctggacgaggacgacgacctgtgggtggagctgagacacatgcacatcgccgacgtgagcaagaaggtgaccgagctgctgagaaccttctgcgagagcaagagactgaccaccgacaaggccaacatcaaggacctgagccagatcctgaagaagatgccccagtaccagaaggagctgaacaagtacagcacccacctgcacctggccgacgactgcatgaagcacttcaagggcagcgtggagaagctgtgcagcgtggagcaggacctggccatgggcagcgacgccgagggcgagaagatcaaggacagcatgaagctgatcgtgcccgtgctgctggacgccgccgtgcccgcctacgacaagatcagagtgctgctgctgtacatcctgctgagaaacggcgtgagcgaggagaacctggccaagctgatccagcacgccaacgtgcaggcccacagcagcctgatcagaaacctggagcagctgggcggcaccgtgaccaaccccggcggcagcggcaccagcagcagactggagcccagagagagaatggagcccacctaccagctgagcagatggacccccgtgatcaaggacgtgatggaggacgccgtggaggacagactggacagaaacctgtggcccttcgtgagcgaccccgcccccaccgccagcagccaggccgccgtgagcgccagattcggccactggcacaagaacaaggccggcatcgaggccagagccggccccagactgatcgtgtacgtgatgggcggcgtggccatgagcgagatgagagccgcctacgaggtgaccagagccaccgagggcaagtgggaggtgctgatcggcagcagccacatcctgacccccaccagattcctggacgacctgaaggccctggacaagaagctggaggacatcgccctgccctag

SEQ ID NO: 101667 - DNA, 1740 bp, Artificial Sequence
  Description of Artificial Sequence: Synthetic coding sequence
atggcccccagcggcctgaaggccgtggtgggcgagaagatcctgagcggcgtgatcagaagcgtgaagaaggacggcgagtggaaggtgctgatcatggaccaccccagcatgagaatcctgagcagctgctgcaagatgagcgacatcctggccgagggcatcaccatcgtggaggacatcaacaagagaagagagcccatccccagcctggaggccatctacctgctgagccccaccgagaagagcgtgcaggccctgatcaaggacttccagggcacccccaccttcacctacaaggccgcccacatcttcttcaccgacacctgccccgagcccctgttcagcgagctgggcagaagcagactggccaaggtggtgaagaccctgaaggagatccacctggccttcctgccctacgaggcccaggtgttcagcctggacgccccccacagcacctacaacctgtactgccccttcagagccgaggagagaaccagacagctggaggtgctggcccagcagatcgccaccctgtgcgccaccctgcaggagtaccccgccatcagatacagaaagggccccgaggacaccgcccagctggcccacgccgtgctggccaagctgaacgccttcaaggccgacacccccagcctgggcgagggccccgagaagaccagaagccagctgctgatcatggacagagccgccgaccccgtgagccccctgctgcacgagctgaccttccaggccatggcctacgacctgctggacatcgagcaggacacctacagatacgagaccaccggcctgagcgaggccagagagaaggccgtgctgctggacgaggacgacgacctgtgggtggagctgagacacatgcacatcgccgacgtgagcaagaaggtgaccgagctgctgagaaccttctgcgagagcaagagactgaccaccgacaaggccaacatcaaggacctgagccagatcctgaagaagatgccccagtaccagaaggagctgaacaagtacagcacccacctgcacctggccgacgactgcatgaagcacttcaagggcagcgtggagaagctgtgcagcgtggagcaggacctggccatgggcagcgacgccgagggcgagaagatcaaggacagcatgaagctgatcgtgcccgtgctgctggacgccgccgtgcccgcctacgacaagatcagagtgctgctgctgtacatcctgctgagaaacggcgtgagcgaggagaacctggccaagctgatccagcacgccaacgtgcaggcccacagcagcctgatcagaaacctggagcagctgggcggcaccgtgaccaaccccggcggcagcggcaccagcagcagactggagcccagagagagaatggagcccacctaccagctgagcagatggacccccgtgatcaaggacgtgatggaggacgccgtggaggacagactggacagaaacctgtggcccttcgtgagcgaccccgcccccaccgccagcagccaggccgccgtgagcgccagattcggccactggcacaagaacaaggccggcatcgaggccagagccggccccagactgatcgtgtacgtgatgggcggcgtggccatgagcgagatgagagccgcctacgaggtgaccagagccaccgagggcagcggcagatgcagcctggccccccacaccagcagccccagacccgccagctggatgacctag

SEQ ID NO: 101668 - DNA, 2421 bp, Artificial Sequence
  Description of Artificial Sequence: Synthetic coding sequence
atgcacggcaagagcaccgccgtgctggagatggactacagcatcgtggacttcctgaccctgtgcgagaccccctaccccaacgacttccaggagccctacgccgtggtggtgctgctggagaaggacctggtgctgatcgacctggcccagaacggctaccccatcttcgagaacccctaccccctgagcatccacgagagccccgtgacctgctgcgagtacttcgccgactgccccgtggacctgatccccgccctgtacagcgtgggcgccagacagaagagacagggctacagcaagaaggagtggcccatcaacggcggcaactggggcctgggcgcccagagctaccccgagatcatcatcaccggccacgccgacggcagcgtgaagttctgggacgccagcgccatcaccctgcaggtgctgtacaagctgaagaccagcaaggtgttcgagaagagcagaaacaaggacgacagacccaacaccgacatcgtggacgaggacccctacgccatccagatcatcagctggtgccccgagagcagaatgctgtgcatcgccggcgtgagcgcccacgtgatcatctacagattcagcaagcaggaggtgatcaccgaggtgatccccatgctggaggtgagactgctgtacgagatcaacgacgtggagacccccgagggcgagcagcccccccccctgcccacccccgtgggcggcagcaacccccagcccatccccccccagagccaccccagcaccagcagcagcagcagcgacggcctgagagacaacgtgccctgcctgaaggtgaagaacagccccctgaagcagagccccggctaccagaccgagctggtgatccagctggtgtgggtgggcggcgagcccccccagcagatcaccagcctggccgtgaacagcagctacggcctggtggtgttcggcaactgcaacggcatcgccatggtggactacctgcagaaggccgtgctgctgaacctgggcaccatcgagctgtacggcagcaacgacccctacagaagagagcccagaagccccagaaagagcagacagcccagcggcgccggcctgtgcgacatcagcgagggcaccgtggtgcccgaggacagatgcaagagccccaccagcggcagcagcagcccccacaacagcgacgacgagcagaagatgaacaacttcatcgagaaggccaagatgagcagaaagctgagcctgcccaccgacctgaagcccgacctggacgtgaaggacaacagcttcagcagaagcagaagcagcagcgtgaccagcatcgacaaggagagcagagaggccatcagcgccctgcacttctgcgagaccttcaccagaaagaccgacagcagccccagcccctgcctgtgggtgggcaccaccctgggcaccgtgctggtgatcgccctgaacctgccccccggcggcgagcagagactgctgcagcccgtgatcgtgagccccagcggcaccatcctgagactgaagggcgccatcctgagaatggccttcctggacaccaccggctgcctgatcccccccgcctacgagccctggagagagcacaacgtgcccgaggagaaggacgagaaggagaagctgaagaagagaagacccgtgagcgtgagccccagcagcagccaggagatcagcgagaaccagtacgccgtgatctgcagcgagaagcaggccaaggtgatcagcctgcccacccagaactgcgcctacaagcagaacatcaccgagaccagcttcgtgctgagaggcgacatcgtggccctgagcaacagcatctgcctggcctgcttctgcgccaacggccacatcatgaccttcagcctgcccagcctgagacccctgctggacgtgtactacctgcccctgaccaacatgagaatcgccagaaccttctgcttcaccaacaacggccaggccctgtacctggtgagccccaccgagatccagagactgacctacagccaggagacctgcgagaacctgcaggagatgctgggcgagctgttcacccccgtggagacccccgaggcccccaacagaggcttcttcaagggcctgttcggcggcggcgcccagagcctggacagagaggagctgttcggcgagagcagcagcggcaaggccagcagaagcctggcccagcacatccccggccccggcggcatcgagggcgtgaagggcgccgccagcggcgtggtgggcgagctggccagagccagactggccctggacgagagaggccagaagctgggcgacctggaggagagaaccgccgccatgctgagcagcgccgagagcttcagcaagcacgcccacgagatcatgctgaagtacaaggacaagaagtggtaccagttctag

SEQ ID NO: 101669 - DNA, 3456 bp, Artificial Sequence
  Description of Artificial Sequence: Synthetic coding sequence
atgagaaagttcaacatcagaaaggtgctggacggcctgaccgccggcagcagcagcgccagccagcagcagcagcagcagcacccccccggcaacagagagcccgagatccaggagaccctgcagagcgagcacttccagctgtgcaagaccgtgagacacggcttcccctaccagcccagcgccctggccttcgaccccgtgcagaagatcctggccgtgggcacccagaccggcgccctgagactgttcggcagacccggcgtggagtgctactgccagcacgacagcggcgccgccgtgatccagctgcagttcctgatcaacgagggcgccctggtgagcgccctggccgacgacaccctgcacctgtggaacctgagacagaagagacccgccatcctgcacagcctgaagttctgcagagagagagtgaccttctgccacctgcccttccagagcaagtggctgtacgtgggcaccgagagaggcaacatccacatcgtgaacgtggagagcttcaccctgagcggctacgtgatcatgtggaacaaggccatcgagctgagcagcaagagccaccccggccccgtggtgcacatcagcgacaaccccatggacgagggcaagctgctgatcggcttcgagagcggcaccgtggtgctgtgggacctgaagagcaagaaggccgactacagatacacctacgacgaggccatccacagcgtggcctggcaccacgagggcaagcagttcatctgcagccacagcgacggcaccctgaccatctggaacgtgagaagccccgccaagcccgtgcagaccatcaccccccacggcaagcagctgaaggacggcaagaagcccgagccctgcaagcccatcctgaaggtggagttcaagaccaccagaagcggcgagcccttcatcatcctgagcggcggcctgagctacgacaccgtgggcagaagaccctgcctgaccgtgatgcacggcaagagcaccgccgtgctggagatggactacagcatcgtggacttcctgaccctgtgcgagaccccctaccccaacgacttccaggagccctacgccgtggtggtgctgctggagaaggacctggtgctgatcgacctggcccagaacggctaccccatcttcgagaacccctaccccctgagcatccacgagagccccgtgacctgctgcgagtacttcgccgactgccccgtggacctgatccccgccctgtacagcgtgggcgccagacagaagagacagggctacagcaagaaggagtggcccatcaacggcggcaactggggcctgggcgcccagagctaccccgagatcatcatcaccggccacgccgacggcagcgtgaagttctgggacgccagcgccatcaccctgcaggtgctgtacaagctgaagaccagcaaggtgttcgagaagagcagaaacaaggacgacagacccaacaccgacatcgtggacgaggacccctacgccatccagatcatcagctggtgccccgagagcagaatgctgtgcatcgccggcgtgagcgcccacgtgatcatctacagattcagcaagcaggaggtgatcaccgaggtgatccccatgctggaggtgagactgctgtacgagatcaacgacgtggagacccccgagggcgagcagcccccccccctgcccacccccgtgggcggcagcaacccccagcccatccccccccagagccaccccagcaccagcagcagcagcagcgacggcctgagagacaacgtgccctgcctgaaggtgaagaacagccccctgaagcagagccccggctaccagaccgagctggtgatccagctggtgtgggtgggcggcgagcccccccagcagatcaccagcctggccgtgaacagcagctacggcctggtggtgttcggcaactgcaacggcatcgccatggtggactacctgcagaaggccgtgctgctgaacctgggcaccatcgagctgtacggcagcaacgacccctacagaagagagcccagaagccccagaaagagcagacagcccagcggcgccggcctgtgcgacatcagcgagggcaccgtggtgcccgaggacagatgcaagagccccaccagcggcagcagcagcccccacaacagcgacgacgagcagaagatgaacaacttcatcgagaaggtgaagaccaagagcagaaagttcagcaagatggtggccaacgacatcgccaagatgagcagaaagctgagcctgcccaccgacctgaagcccgacctggacgtgaaggacaacagcttcagcagaagcagaagcagcagcgtgaccagcatcgacaaggagagcagagaggccatcagcgccctgcacttctgcgagaccttcaccagaaagaccgacagcagccccagcccctgcctgtgggtgggcaccaccctgggcaccgtgctggtgatcgccctgaacctgccccccggcggcgagcagagactgctgcagcccgtgatcgtgagccccagcggcaccatcctgagactgaagggcgccatcctgagaatggccttcctggacaccaccggctgcctgatcccccccgcctacgagccctggagagagcacaacgtgcccgaggagaaggacgagaaggagaagctgaagaagagaagacccgtgagcgtgagccccagcagcagccaggagatcagcgagaaccagtacgccgtgatctgcagcgagaagcaggccaaggtgatcagcctgcccacccagaactgcgcctacaagcagaacatcaccgagaccagcttcgtgctgagaggcgacatcgtggccctgagcaacagcatctgcctggcctgcttctgcgccaacggccacatcatgaccttcagcctgcccagcctgagacccctgctggacgtgtactacctgcccctgaccaacatgagaatcgccagaaccttctgcttcaccaacaacggccaggccctgtacctggtgagccccaccgagatccagagactgacctacagccaggagacctgcgagaacctgcaggagatgctgggcgagctgttcacccccgtggagacccccgaggcccccaacagaggcttcttcaagggcctgttcggcggcggcgcccagagcctggacagagaggagctgttcggcgagagcagcagcggcaaggccagcagaagcctggcccagcacatccccggccccggcggcatcgagggcgtgaagggcgccgccagcggcgtggtgggcgagctggccagagccagactggccctggacgagagaggccagaagctgggcgacctggaggagagaaccgccgccatgctgagcagcgccgagagcttcagcaagcacgcccacgagatcatgctgaagtacaaggacaagaagtggtaccagttctag

SEQ ID NO: 101670 - DNA, 525 bp, Artificial Sequence
  Description of Artificial Sequence: Synthetic coding sequence
tgaaaggccgtgctgctgaacctgggcaccatcgagctgtacggcagcaacgacccctacagaagagagcccagaagccccagaaagagcagacagcccagcggcgccggcctgtgcgacatcagcgagggcaccgtggtgcccgaggacagatgcaagagccccaccagcggcagcagcagcccccacaacagcgacgacgagcagaagatgaacaacttcatcgagaaggccaagatgagcagaaagctgagcctgcccaccgacctgaagcccgacctggacgtgaaggacaacagcttcagcagaagcagaagcagcagcgtgaccagcatcgacaaggagagcagagaggccatcagcgccctgcacttctgcgagaccttcaccagaaagaccgacagcagccccagcccctgcctgtgggtgggcaccaccctgggcaccgtgctggtgatcgccctgaacctgccccccggcggcgagcagagactgctgcagcccgtgatcgtgagccccagctag

SEQ ID NO: 101671 - DNA, 840 bp, Artificial Sequence
  Description of Artificial Sequence: Synthetic coding sequence
atggtggactacctgcagaaggccgtgctgctgaacctgggcaccatcgagctgtacggcagcaacgacccctacagaagagagcccagaagccccagaaagagcagacagcccagcggcggcgtgctgatcgtgaccagctgcatgtgcggcctgagcagcctgtacagcgagagcatgaagaagctgagaagcagcttcctgaccggcctgtgcgacatcagcgagggcaccgtggtgcccgaggacagatgcaagagccccaccagcgccaagatgagcagaaagctgagcctgcccaccgacctgaagcccgacctggacgtgaaggacaacagcttcagcagaagcagaagcagcagcgtgaccagcatcgacaaggagagcagagaggccatcagcgccctgcacttctgcgagaccttcaccagaaagaccgacagcagccccagcccctgcctgtgggtgggcaccaccctgggcaccgtgctggtgatcgccctgaacctgccccccggcggcgagcagagactgctgcagcccgtgatcgtgagccccagcggcaccatcctgagactgaagggcgccatcctgagaatggccttcctggacaccaccggctgcctgatcccccccgcctacgagccctggagagagcacaacgtgcccgaggagaaggacgagaaggagaagctgaagaagagaagacccgtgagcgtgagccccagcagcagccaggagatcagcgagaaccagtacgccgtgatctgcagcgagaagcaggccaaggtgatcagcctgcccacccagaactgcgcctacaagcagaacatcacctag

SEQ ID NO: 101672 - DNA, 3297 bp, Artificial Sequence
  Description of Artificial Sequence: Synthetic coding sequence
atgagaaagttcaacatcagaaaggtgctggacggcctgaccgccggcagcagcagcgccagccagcagcagcagcagcagcacccccccggcaacagagagcccgagatccaggagaccctgcagagcgagcacttccagctgtgcaagaccgtgagacacggcttcccctaccagcccagcgccctggccttcgaccccgtgcagaagatcctggccgtgggcacccagaccggcgccctgagactgttcggcagacccggcgtggagtgctactgccagcacgacagcggcgccgccgtgatccagctgcagttcctgatcaacgagggcgccctggtgagcgccctggccgacgacaccctgcacctgtggaacctgagacagaagagacccgccatcctgcacagcctgaagttctgcagagagagagtgaccttctgccacctgcccttccagagcaagtggctgtacgtgggcaccgagagaggcaacatccacatcgtgaacgtggagagcttcaccctgagcggctacgtgatcatgtggaacaaggccatcgagctgagcagcaagagccaccccggccccgtggtgcacatcagcgacaaccccatggacgagggcaagctgctgatcggcttcgagagcggcaccgtggtgctgtgggacctgaagagcaagaaggccgactacagatacacctacgacgaggccatccacagcgtggcctggcaccacgagggcaagcagttcatctgcagccacagcgacggcaccctgaccatctggaacgtgagaagccccgccaagcccgtgcagaccatcaccccccacggcaagcagctgaaggacggcaagaagcccgagccctgcaagcccatcctgaaggtggagttcaagaccaccagaagcggcgagcccttcatcatcctgagcggcggcctgagctacgacaccgtgggcagaagaccctgcctgaccgtgatgcacggcaagagcaccgccgtgctggagatggactacagcatcgtggacttcctgaccctgtgcgagaccccctaccccaacgacttccaggagccctacgccgtggtggtgctgctggagaaggacctggtgctgatcgacctggcccagaacggctaccccatcttcgagaacccctaccccctgagcatccacgagagccccgtgacctgctgcgagtacttcgccgactgccccgtggacctgatccccgccctgtacagcgtgggcgccagacagaagagacagggctacagcaagaaggagtggcccatcaacggcggcaactggggcctgggcgcccagagctaccccgagatcatcatcaccggccacgccgacggcagcgtgaagttctgggacgccagcgccatcaccctgcaggtgctgtacaagctgaagaccagcaaggtgttcgagaagagcagaaacaaggacgacagacccaacaccgacatcgtggacgaggacccctacgccatccagatcatcagctggtgccccgagagcagaatgctgtgcatcgccggcgtgagcgcccacgtgatcatctacagattcagcaagcaggaggtgatcaccgaggtgatccccatgctggaggtgagactgctgtacgagatcaacgacgtggagacccccgagggcgagcagcccccccccctgcccacccccgtgggcggcagcaacccccagcccatccccccccagagccaccccagcaccagcagcagcagcagcgacggcctgagagacaacgtgccctgcctgaaggtgaagaacagccccctgaagcagagccccggctaccagaccgagctggtgatccagctggtgtgggtgggcggcgagcccccccagcagatcaccagcctggccgtgaacagcagctacggcctggtggtgttcggcaactgcaacggcatcgccatggtggactacctgcagaaggccgtgctgctgaacctgggcaccatcgagctgtacggcagcaacgacccctacagaagagagcccagaagccccagaaagagcagacagcccagcggcgccggcctgtgcgacatcagcgagggcaccgtggtgcccgaggacagatgcaagagccccaccagcgacgtgaaggacaacagcttcagcagaagcagaagcagcagcgtgaccagcatcgacaaggagagcagagaggccatcagcgccctgcacttctgcgagaccttcaccagaaagaccgacagcagccccagcccctgcctgtgggtgggcaccaccctgggcaccgtgctggtgatcgccctgaacctgccccccggcggcgagcagagactgctgcagcccgtgatcgtgagccccagcggcaccatcctgagactgaagggcgccatcctgagaatggccttcctggacaccaccggctgcctgatcccccccgcctacgagccctggagagagcacaacgtgcccgaggagaaggacgagaaggagaagctgaagaagagaagacccgtgagcgtgagccccagcagcagccaggagatcagcgagaaccagtacgccgtgatctgcagcgagaagcaggccaaggtgatcagcctgcccacccagaactgcgcctacaagcagaacatcaccgagaccagcttcgtgctgagaggcgacatcgtggccctgagcaacagcatctgcctggcctgcttctgcgccaacggccacatcatgaccttcagcctgcccagcctgagacccctgctggacgtgtactacctgcccctgaccaacatgagaatcgccagaaccttctgcttcaccaacaacggccaggccctgtacctggtgagccccaccgagatccagagactgacctacagccaggagacctgcgagaacctgcaggagatgctgggcgagctgttcacccccgtggagacccccgaggcccccaacagaggcttcttcaagggcctgttcggcggcggcgcccagagcctggacagagaggagctgttcggcgagagcagcagcggcaaggccagcagaagcctggcccagcacatccccggccccggcggcatcgagggcgtgaagggcgccgccagcggcgtggtgggcgagctggccagagccagactggccctggacgagagaggccagaagctgggcgacctggaggagagaaccgccgccatgctgagcagcgccgagagcttcagcaagcacgcccacgagatcatgctgaagtacaaggacaagaagtggtaccagttctag

SEQ ID NO: 101673 - DNA, 3348 bp, Artificial Sequence
  Description of Artificial Sequence: Synthetic coding sequence
atgagaaagttcaacatcagaaaggtgctggacggcctgaccgccggcagcagcagcgccagccagcagcagcagcagcagcacccccccggcaacagagagcccgagatccaggagaccctgcagagcgagcacttccagctgtgcaagaccgtgagacacggcttcccctaccagcccagcgccctggccttcgaccccgtgcagaagatcctggccgtgggcacccagaccggcgccctgagactgttcggcagacccggcgtggagtgctactgccagcacgacagcggcgccgccgtgatccagctgcagttcctgatcaacgagggcgccctggtgagcgccctggccgacgacaccctgcacctgtggaacctgagacagaagagacccgccatcctgcacagcctgaagttctgcagagagagagtgaccttctgccacctgcccttccagagcaagtggctgtacgtgggcaccgagagaggcaacatccacatcgtgaacgtggagagcttcaccctgagcggctacgtgatcatgtggaacaaggccatcgagctgagcagcaagagccaccccggccccgtggtgcacatcagcgacaaccccatggacgagggcaagctgctgatcggcttcgagagcggcaccgtggtgctgtgggacctgaagagcaagaaggccgactacagatacacctacgacgaggccatccacagcgtggcctggcaccacgagggcaagcagttcatctgcagccacagcgacggcaccctgaccatctggaacgtgagaagccccgccaagcccgtgcagaccatcaccccccacggcaagcagctgaaggacggcaagaagcccgagccctgcaagcccatcctgaaggtggagttcaagaccaccagaagcggcgagcccttcatcatcctgagcggcggcctgagctacgacaccgtgggcagaagaccctgcctgaccgtgatgcacggcaagagcaccgccgtgctggagatggactacagcatcgtggacttcctgaccctgtgcgagaccccctaccccaacgacttccaggagccctacgccgtggtggtgctgctggagaaggacctggtgctgatcgacctggcccagaacggctaccccatcttcgagaacccctaccccctgagcatccacgagagccccgtgacctgctgcgagtacttcgccgactgccccgtggacctgatccccgccctgtacagcgtgggcgccagacagaagagacagggctacagcaagaaggagtggcccatcaacggcggcaactggggcctgggcgcccagagctaccccgagatcatcatcaccggccacgccgacggcagcgtgaagttctgggacgccagcgccatcaccctgcaggtgctgtacaagctgaagaccagcaaggtgttcgagaagagcagaaacaaggacgacagacccaacaccgacatcgtggacgaggacccctacgccatccagatcatcagctggtgccccgagagcagaatgctgtgcatcgccggcgtgagcgcccacgtgatcatctacagattcagcaagcaggaggtgatcaccgaggtgatccccatgctggaggtgagactgctgtacgagatcaacgacgtggagacccccgagggcgagcagcccccccccctgcccacccccgtgggcggcagcaacccccagcccatccccccccagagccaccccagcaccagcagcagcagcagcgacggcctgagagacaacgtgccctgcctgaaggtgaagaacagccccctgaagcagagccccggctaccagaccgagctggtgatccagctggtgtgggtgggcggcgagcccccccagcagatcaccagcctggccgtgaacagcagctacggcctggtggtgttcggcaactgcaacggcatcgccatggtggactacctgcagaaggccgtgctgctgaacctgggcaccatcgagctgtacggcagcaacgacccctacagaagagagcccagaagccccagaaagagcagacagcccagcggcgccggcctgtgcgacatcagcgagggcaccgtggtgcccgaggacagatgcaagagccccaccagcgccaagatgagcagaaagctgagcctgcccaccgacctgaagcccgacctggacgtgaaggacaacagcttcagcagaagcagaagcagcagcgtgaccagcatcgacaaggagagcagagaggccatcagcgccctgcacttctgcgagaccttcaccagaaagaccgacagcagccccagcccctgcctgtgggtgggcaccaccctgggcaccgtgctggtgatcgccctgaacctgccccccggcggcgagcagagactgctgcagcccgtgatcgtgagccccagcggcaccatcctgagactgaagggcgccatcctgagaatggccttcctggacaccaccggctgcctgatcccccccgcctacgagccctggagagagcacaacgtgcccgaggagaaggacgagaaggagaagctgaagaagagaagacccgtgagcgtgagccccagcagcagccaggagatcagcgagaaccagtacgccgtgatctgcagcgagaagcaggccaaggtgatcagcctgcccacccagaactgcgcctacaagcagaacatcaccgagaccagcttcgtgctgagaggcgacatcgtggccctgagcaacagcatctgcctggcctgcttctgcgccaacggccacatcatgaccttcagcctgcccagcctgagacccctgctggacgtgtactacctgcccctgaccaacatgagaatcgccagaaccttctgcttcaccaacaacggccaggccctgtacctggtgagccccaccgagatccagagactgacctacagccaggagacctgcgagaacctgcaggagatgctgggcgagctgttcacccccgtggagacccccgaggcccccaacagaggcttcttcaagggcctgttcggcggcggcgcccagagcctggacagagaggagctgttcggcgagagcagcagcggcaaggccagcagaagcctggcccagcacatccccggccccggcggcatcgagggcgtgaagggcgccgccagcggcgtggtgggcgagctggccagagccagactggccctggacgagagaggccagaagctgggcgacctggaggagagaaccgccgccatgctgagcagcgccgagagcttcagcaagcacgcccacgagatcatgctgaagtacaaggacaagaagtggtaccagttctag

SEQ ID NO: 101674 - DNA, 795 bp, Artificial Sequence
  Description of Artificial Sequence: Synthetic coding sequence
atcgagctgtacggcagcaacgacccctacagaagagagcccagaagccccagaaagagcagacagcccagcggcggcgtgctgatcgtgaccagctgcatgtgcggcctgagcagcctgtacagcgagagcatgaagaagctgagaagcagcttcctgaccggcctgtgcgacatcagcgagggcaccgtggtgcccgaggacagatgcaagagccccaccagcgccaagatgagcagaaagctgagcctgcccaccgacctgaagcccgacctggacgtgaaggacaacagcttcagcagaagcagaagcagcagcgtgaccagcatcgacaaggagagcagagaggccatcagcgccctgcacttctgcgagaccttcaccagaaagaccgacagcagccccagcccctgcctgtgggtgggcaccaccctgggcaccgtgctggtgatcgccctgaacctgccccccggcggcgagcagagactgctgcagcccgtgatcgtgagccccagcggcaccatcctgagactgaagggcgccatcctgagaatggccttcctggacaccaccggctgcctgatcccccccgcctacgagccctggagagagcacaacgtgcccgaggagaaggacgagaaggagaagctgaagaagagaagacccgtgagcgtgagccccagcagcagccaggagatcagcgagaaccagtacgccgtgatctgcagcgagaagcaggccaaggtgatcagcctgcccacccagaactgcgcctacaagcagaacatcacctag

SEQ ID NO: 101675 - DNA, 927 bp, Artificial Sequence
  Description of Artificial Sequence: Synthetic coding sequence
atgagaaagttcaacatcagaaaggtgctggacggcctgaccgccggcagcagcagcgccagccagcagcagcagcagcagcacccccccggcaacagagagcccgagatccaggagaccctgcagagcgagcacttccagctgtgcaagaccgtgagacacggcttcccctaccagcccagcgccctggccttcgaccccgtgcagaagatcctggccgtgggcacccagaccggcgccctgagactgttcggcagacccggcgtggagtgctactgccagcacgacagcggcgccgccgtgatccagctgcagttcctgatcaacgagggcgccctggtgagcgccctggccgacgacaccctgcacctgtggaacctgagacagaagagacccgccatcctgcacagcctgaagttctgcagagagagagtgaccttctgccacctgcccttccagagcaagtggctgtacgtgggcaccgagagaggcaacatccacatcgtgaacgtggagagcttcaccctgagcggctacgtgatcatgtggaacaaggccatcgagctgagcagcaagagccaccccggccccgtggtgcacatcagcgacaaccccatggacgagggcaagctgctgatcggcttcgagagcggcaccgtggtgctgtgggacctgaagagcaagaaggccgactacagatacacctacgacgaggccatccacagcgtggcctggcaccacgagggcaagcagttcatctgcagccacagcgacggcaccctgaccatctggaacgtgagaagccccgccaagcccgtgcagaccatcaccccccacggcaagcagctgaaggacggcaagaagcccgagccctgcaagcccatcctgaaggtggagttcaagaccaccagaagcggcgtgtgctag

SEQ ID NO: 101676 - DNA, 3561 bp, Artificial Sequence
  Description of Artificial Sequence: Synthetic coding sequence
atgaagaagttcaacttcagaaaggtgctggacggcctgaccgccagcagccccggcagcggcagcagcagcggcagcaacagcggcggcggcgccggcagcggcagcgtgcaccccgccggcaccgccggcgtgctgagagaggagatccaggagaccctgaccagcgagtacttccagatctgcaagaccgtgagacacggcttcccccaccagcccaccgccctggccttcgaccccgtgcagaagatcctggccatcggcaccagaaccggcgccatcagaatcctgggcagacccggcgtggactgctactgccagcacgagagcggcgccgccgtgctgcagctgcagttcctgatcaacgagggcgccctggtgagcgccagcagcgacgacaccctgcacctgtggaacctgagacagaagagacccgccatcctgcacagcctgaagttcaacagagagagaatcacctactgccacctgcccttccagagcaagtggctgtacgtgggcaccgagagaggcaacacccacatcgtgaacatcgagagcttcatcctgagcggctacgtgatcatgtggaacaaggccatcgagctgagcaccaagacccaccccggccccgtggtgcacctgagcgacagccccagagacgagggcaagctgctgatcggctacgagaacggcaccgtggtgttctgggacctgaagagcaagagagccgagctgagagtgtactacgacgaggccatccacagcatcgactggcaccacgagggcaagcagttcatgtgcagccacagcgacggcagcctgaccctgtggaacctgaagagccccagcagacccttccagaccaccatcccccacggcaagagccagagagagggcagaaagagcgagagctgcaagcccatcctgaaggtggagtacaagacctgcaagaacagcgagcccttcatcatcttcagcggcggcctgagctacgacaaggcctgcagaagacccagcctgaccatcatgcacggcaaggccatcaccgtgctggagatggaccaccccatcgtggagttcctgaccctgtgcgagaccccctaccccaacgagttccaggagccctacgccgtggtggtgctgctggagaaggacctgatcgtggtggacctgacccagagcaacttccccatcttcgagaacccctaccccatggacatccacgagagccccgtgacctgcaccgcctacttcgccgactgcccccccgacctgatcctggtgctgtacagcatcggcgtgaagcacaagaagcagggctacagcaacaaggagtggcccatcagcggcggcgcctggaacctgggcgcccagacctaccccgagatcatcatcaccggccacgccgacggcagcatcaagttctgggacgccagcgccatcaccctgcagatgctgtacaagctgaagaccagcaaggtgttcgagaagcagaaggtgggcgagggcaagcagacctgcgagatcgtggaggaggaccccttcgccatccagatgatctactggtgccccgagagcagaatcttctgcgtgagcggcgtgagcgcctacgtgatcatctacaagttcagcagacacgagatcaccaccgagatcgtgagcctggaggtgagactgcagtacgacgtggaggacatcatcacccccgagcccgagaccagcccccccttccccgacctgagcgcccagctgcccagcagcagaagcctgagcggcagcaccaacaccgtggccagcgagggcgtgaccaaggacagcatcccctgcctgaacgtgaagaccagacccgtgagaatgccccccggctaccaggccgagctggtgatccagctggtgtgggtggacggcgagcccccccagcagatcaccagcctggccgtgagcagcgcctacggcatcgtggccttcggcaactgcaacggcctggccgtggtggacttcatccagaagaccgtgctgctgagcatgggcaccatcgacctgtacagaagcagcgacctgtaccagagacagcccagaagccccagaaagaacaagcagttcatcgccgacaacttctgcatgagaggcctgagcaacttctaccccgacctgaccaagagaatcagaaccagctaccagagcctgaccgagctgaacgacagccccgtgcccctggagctggagagatgcaagagccccaccagcgaccacgtgaacggccactgcaccagccccaccagccagagctgcagcagcggcaagagactgagcagcgccgacgtgagcaaggtgaacagatggggccccggcagaccccccttcagaaaggcccagagcgccgcctgcatggagatcagcctgcccgtgaccaccgaggagaacagagagaacagctacaacagaagcagaagcagcagcatcagcagcatcgacaaggacagcaaggaggccatcaccgccctgtacttcatggacagcttcgccagaaagaacgacagcaccatcagcccctgcctgttcgtgggcaccagcctgggcatggtgctgatcatcagcctgaacctgcccctggccgacgagcagagattcaccgagcccgtgatggtgctgcccagcggcaccttcctgagcctgaagggcgccgtgctgaccttcagctgcatggacagaatgggcggcctgatgcagcccccctacgaggtgtggagagaccccaacaacatcgacgagaacgagaagagctggagaagaaaggtggtgatgaacagcagcagcgccagccaggagatcggcgaccaccagtacaccatcatctgcagcgagaagcaggccaaggtgttcagcctgcccagccagacctgcctgtacgtgcacaacatcaccgagaccagcttcatcctgcaggccaacgtggtggtgatgtgcagcagcgcctgcctggcctgcttctgcgccaacggccacatcatgatcatgagcctgcccagcctgagacccatgctggacgtgaactacctgcccctgaccgacatgagaatcgccagaaccttctgcttcaccaacgagggccaggccctgtacctggtgagccccaccgagatccagagactgacctacagccaggagatgtgcgacaacctgcaggacatgctgggcgacctgttcacccccatcgagacccccgaggcccagaacagaggcttcctgaagggcctgttcggcggcagcggccagaccttcgacagagaggagctgttcggcgaggccagcgccggcaaggccagcagaagcctggcccagcacatccccggccccggcagcatcgagggcatgaagggcgccgccggcggcgtgatgggcgagctgaccagagccagaatcgccctggacgagagaggccagagactgggcgagctggaggagaagaccgccggcatgatgaccagcgccgaggccttcagcaagcacgcccacgagctgatgctgaagtacaaggacaagaagtggtaccagttctag

SEQ ID NO: 101677 - DNA, 384 bp, Artificial Sequence
  Description of Artificial Sequence: Synthetic coding sequence
atgaagaagttcaacttcagaaaggtgctggacggcctgaccgccagcagccccggcagcggcagcagcagcggcagcaacagcggcggcggcgccggcagcggcagcgtgcaccccgccggcaccgccggcgtgctgagagaggagatccaggagaccctgaccagcgagtacttccagatctgcaagaccgtgagacacggcttcccccaccagcccaccgccctggccttcgaccccgtgcagaagatcctggccatcggcaccagaaccggcgccatcagaatcctgggcagacccggcgtggactgctactgccagcacgagagcggcgccgccgtgctgcagctgcagttcctgatcaacgagggcgccctggtgtag

SEQ ID NO: 101678 - DNA, 633 bp, Artificial Sequence
  Description of Artificial Sequence: Synthetic coding sequence
atgagcgccaagagcgccatcagcaaggagatcttcgcccccctggacgagagaatgctgggcgccgtgcaggtgaagagaagaaccaagaagaagatccccttcctggccaccggcggccagggcgagtacctgacctacatctgcctgagcgtgaccaacaagaagcccacccaggccagcatcaccaaggtgaagcagttcgagggcagcaccagcttcgtgagaagaagccagtggatgctggagcagctgagacaggtgaacggcatcgaccccaacggcgacagcgccgagttcgacctgctgttcgagaacgccttcgaccagtgggtggccagcaccgccagcgagaagtgcaccttcttccagatcctgcaccacacctgccagagatacctgaccgacagaaagcccgagttcatcaactgccagagcaagatcatgggcggcaacagcatcctgcacagcgccgccgacagcgtgaccagcgccgtgcagaaggccagccaggccctgaacgagagaggcgagagactgggcagagccgaggagaagaccgaggacctgaagaacagcgcccagcagttcgccgagaccgcccacaagctggccatgaagcacaagtgctag

SEQ ID NO: 101679 - DNA, 633 bp, Artificial Sequence
  Description of Artificial Sequence: Synthetic coding sequence
atgagcgccaagagcgccatcagcaaggagatcttcgcccccctggacgagagaatgctgggcgccgtgcaggtgaagagaagaaccaagaagaagatccccttcctggccaccggcggccagggcgagtacctgacctacatctgcctgagcgtgaccaacaagaagcccacccaggccagcatcaccaaggtgaagcagttcgagggcagcaccagcttcgtgagaagaagccagtggatgctggagcagctgagacaggtgaacggcatcgaccccaacggcgacagcgccgagttcgacctgctgttcgagaacgccttcgaccagtgggtggccagcaccgccagcgagaagtgcaccttcttccagatcctgcaccacacctgccagagatacctgaccgacagaaagcccgagttcatcaactgccagagcaagatcatgggcggcaacagcatcctgcacagcgccgccgacagcgtgaccagcgccgtgcagaaggccagccaggccctgaacgagagaggcgagagactgggcagagccgaggagaagaccgaggacctgaagaacagcgcccagcagttcgccgagaccgcccacaaggtgaccttcagaggcagaaagtag

SEQ ID NO: 101680 - DNA, 633 bp, Artificial Sequence; identical to SEQ ID NO: 101678
  Description of Artificial Sequence: Synthetic coding sequence

SEQ ID NO: 101681 - DNA, 633 bp, Artificial Sequence; identical to SEQ ID NO: 101678
  Description of Artificial Sequence: Synthetic coding sequence

SEQ ID NO: 101682 - DNA, 633 bp, Artificial Sequence; identical to SEQ ID NO: 101678
  Description of Artificial Sequence: Synthetic coding sequence

SEQ ID NO: 101683 - DNA, 327 bp, Artificial Sequence
  Description of Artificial Sequence: Synthetic coding sequence
atgagcgcctgcttcctggacaccagaagagccgccttcctgcagtgcgacctgcccagcagctacagaatcctgaccctgcccgagagcggccactgcggcagcgccgagcccgtgagcgacgcccccgccctgctgctgagcggcaacagcatcctgcacagcgccgccgacagcgtgaccagcgccgtgcagaaggccagccaggccctgaacgagagaggcgagagactgggcagagccgaggagaagaccgaggacctgaagaacagcgcccagcagttcgccgagaccgcccacaagctggccatgaagcacaagtgctag

SEQ ID NO: 101684 - DNA, 633 bp, Artificial Sequence; identical to SEQ ID NO: 101678
  Description of Artificial Sequence: Synthetic coding sequence

SEQ ID NO: 101685 - DNA, 633 bp, Artificial Sequence; identical to SEQ ID NO: 101678
  Description of Artificial Sequence: Synthetic coding sequence

SEQ ID NO: 101686 - DNA, 1617 bp, Artificial Sequence
  Description of Artificial Sequence: Synthetic coding sequence
atggccgtggccgccgccgccgccgccgccggccccgccggcgccggcggcggcagagcccagagaagcggcctgctggaggtgctggtgagagacagatggcacaaggtgctggtgaacctgagcgaggacgccctggtgctgagcagcgaggagggcgccgccgcctacaacggcatcggcaccgccaccaacggcagcttctgcagaggcgccggcgccggccaccccggcgccggcggcgcccagccccccgacagccccgccggcgtgagaaccgccttcaccgacctgcccgagcaggtgcccgagagcatcagcaaccagaagagaggcgtgaaggtgctgaagcaggagctgggcggcctgggcatcagcatcaagggcggcaaggagaacaagatgcccatcctgatcagcaagatcttcaagggcctggccgccgaccagacccaggccctgtacgtgggcgacgccatcctgagcgtgaacggcgccgacctgagagacgccacccacgacgaggccgtgcaggccctgaagagagccggcaaggaggtgctgctggaggtgaagtacatgagagaggccaccccctacgtgaagaagggcagccccgtgagcgagatcggctgggagacccccccccccgagagccccagactgggcggcagcaccagcgacccccccagcagccagagcttcagcttccacagagacagaaagagcatccccctgaagatgtgctacgtgaccagaagcatggccctggccgaccccgagaacagacagctggagatccacagccccgacgccaagcacaccgtgatcctgagaagcaaggacagcgccaccgcccaggcctggttcagcgccatccacagcaacgtgaacgacctgctgaccagagtgatcgccgaggtgagagagcagctgggcaagaccggcatcgccggcagcagagagatcagacacctgggctggctggccgagaaggtgcccggcgagagcaagaagcagtggaagcccgccctggtggtgctgaccgagaaggacctgctgatctacgacagcatgcccagaagaaaggaggcctggttcagccccgtgcacacctaccccctgctggccaccagactggtgcacagcggccccggcaagggcagcccccaggccggcgtggacctgagcttcgccaccagaaccggcaccagacagggcatcgagacccacctgttcagagccgagaccagcagagacctgagccactggaccagaagcatcgtgcagggctgccacaacagcgccgagctgatcgccgagatcagcaccgcctgcacctacaagaaccaggagtgcagactgaccatccactacgagaacggcttcagcatcaccaccgagccccaggagggcgccttccccaagaccatcatccagagcccctacgagaagctgaagatgagcagcgacgacggcatcagaatgctgtacctggacttcggcggcaaggacggcgagatccagctggacctgcacagctgccccaagcccatcgtgttcatcatccacagcttcctgagcgccaagatcaccagactgggcctggtggcctag

SEQ ID NO: 101687 - DNA, 1617 bp, Artificial Sequence; identical to SEQ ID NO: 101686
  Description of Artificial Sequence: Synthetic coding sequence

SEQ ID NO: 101688 - DNA, 87 bp, Artificial Sequence
  Description of Artificial Sequence: Synthetic coding sequence
atggccgtggccgccgccgccgccgccgccggccccgccggcgccggcggcggcagagcccagagaagcggcctgctggaggtgtag

SEQ ID NO: 101689 - DNA, 1623 bp, Artificial Sequence
  Description of Artificial Sequence: Synthetic coding sequence
atgagagtggccgccgccaccgccgccgccggcgccggccccgccatggccgtgtggaccagagccaccaaggccggcctggtggagctgctgctgagagagagatgggtgagagtggtggccgagctgagcggcgagagcctgagcctgaccggcgacgccgccgccgccgagctggagcccgccctgggccccgccgccgccgccttcaacggcctgcccaacggcggcggcgccggcgacagcctgcccggcagccccagcagaggcctgggcccccccagcccccccgccccccccagaggccccgccggcgaggccggcgccagcccccccgtgagaagagtgagagtggtgaagcaggaggccggcggcctgggcatcagcatcaagggcggcagagagaacagaatgcccatcctgatcagcaagatcttccccggcctggccgccgaccagagcagagccctgagactgggcgacgccatcctgagcgtgaacggcaccgacctgagacaggccacccacgaccaggccgtgcaggccctgaagagagccggcaaggaggtgctgctggaggtgaagttcatcagagaggtgaccccctacatcaagaagcccagcctggtgagcgacctgccctgggagggcgccgccccccagagccccagcttcagcggcagcgaggacagcggcagccccaagcaccagaacagcaccaaggacagaaagatcatccccctgaagatgtgcttcgccgccagaaacctgagcatgcccgacctggagaacagactgatcgagctgcacagccccgacagcagaaacaccctgatcctgagatgcaaggacaccgccaccgcccacagctggttcgtggccatccacaccaacatcatggccctgctgccccaggtgctggccgagctgaacgccatgctgggcgccaccagcaccgccggcggcagcaaggaggtgaagcacatcgcctggctggccgagcaggccaagctggacggcggcagacagcagtggagacccgtgctgatggccgtgaccgagaaggacctgctgctgtacgactgcatgccctggaccagagacgcctgggccagcccctgccacagctaccccctggtggccaccagactggtgcacagcggcagcggctgcagaagccccagcctgggcagcgacctgaccttcgccaccagaaccggcagcagacagggcatcgagatgcacctgttcagagtggagacccacagagacctgagcagctggaccagaatcctggtgcagggctgccacgccgccgccgagctgatcaaggaggtgagcctgggctgcatgctgaacggccaggaggtgagactgaccatccactacgagaacggcttcaccatcagcagagagaacggcggcagcagcagcatcctgtacagataccccttcgagagactgaagatgagcgccgacgacggcatcagaaacctgtacctggacttcggcggccccgagggcgagctgaccatggacctgcacagctgccccaagcccatcgtgttcgtgctgcacaccttcctgagcgccaaggtgaccagaatgggcctgctggtgtag

SEQ ID NO: 101690 - DNA, 1443 bp, Artificial Sequence
  Description of Artificial Sequence: Synthetic coding sequence
atggacttcagaaccgcctgcgaggagaccaagaccggcatctgcctgctgcaggacggcaaccaggagcccttcaaggtgagactgcacctggccaaggacatcctgatgatccaggagcaggacgtgatctgcgtgagcggcgagcccttctacagcggcgagagaaccgtgaccatcagaagacagaccgtgggcggcttcggcctgagcatcaagggcggcgccgagcacaacatccccgtggtggtgagcaagatcagcaaggagcagagagccgagctgagcggcctgctgttcatcggcgacgccatcctgcagatcaacggcatcaacgtgagaaagtgcagacacgaggaggtggtgcaggtgctgagaaacgccggcgaggaggtgaccctgaccgtgagcttcctgaagagagcccccgccttcctgaagctgcccctgaacgaggactgcgcctgcgcccccagcgaccagagcagcggcaccagcagccccctgtgcgacagcggcctgcacctgaactaccaccccaacaacaccgacaccctgagctgcagcagctggcccaccagccccggcctgagatgggagaagagatggtgcgacctgagactgatccccctgctgcacagcagattcagccagtacgtgcccggcaccgacctgagcagacagaacgccttccaggtgatcgccgtggacggcgtgtgcaccggcatcatccagtgcctgagcgccgaggactgcgtggactggctgcaggccatcgccaccaacatcagcaacctgaccaagcacaacatcaagaagatcaacagaaacttccccgtgaaccagcagatcgtgtacatgggctggtgcgaggccagagagcaggaccccctgcaggacagagtgtacagccccaccttcctggccctgagaggcagctgcctgtacaagttcctggccccccccgtgaccacctgggactggaccagagccgagaagaccttcagcgtgtacgagatcatgtgcaagatcctgaaggacagcgacctgctggacagaagaaagcagtgcttcaccgtgcagagcgagagcggcgaggacctgtacttcagcgtggagctggagagcgacctggcccagtgggagagagccttccagaccgccaccttcctggaggtggagagaatccagtgcaagacctacgcctgcgtgctggagagccacctgatgggcctgaccatcgacttcagcaccggcttcatctgcttcgacgccgccaccaaggagctggagttcagcaacctgttcgccgtgctgcactgcatccacagcttcttcgccgccaaggtggcctgcctggaccccctgttcctgggcaaccaggccaccgccagcaccgccgccagcagcgccaccaccagcaaggccaagtacaccacctag

SEQ ID NO: 101691 - DNA, 1443 bp, Artificial Sequence; identical to SEQ ID NO: 101690
  Description of Artificial Sequence: Synthetic coding sequence

SEQ ID NO: 101692 - DNA, 1554 bp, Artificial Sequence
  Description of Artificial Sequence: Synthetic coding sequence
atggacttcagaaccgcctgcgaggagaccaagaccggcatctgcctgctgcaggacggcaaccaggagcccttcaaggtgagactgcacctggccaaggacatcctgatgatccaggagcaggacgtgatctgcgtgagcggcgagcccttctacagcggcgagagaaccgtgaccatcagaagacagaccgtgggcggcttcggcctgagcatcaagggcggcgccgagcacaacatccccgtggtggtgagcaagatcagcaaggagcagagagccgagctgagcggcctgctgttcatcggcgacgccatcctgcagatcaacggcatcaacgtgagaaagtgcagacacgaggaggtggtgcaggtgctgagaaacgccggcgaggaggtgaccctgaccgtgagcttcctgaagagagcccccgccttcctgaagctgcccctgaacgaggactgcgcctgcgcccccagcgaccagagcagcggcaccagcagccccctgtgcgacagcggcctgcacctgaactaccaccccaacaacaccgacaccctgagctgcagcagctggcccaccagccccggcctgagatgggagaagagatggtgcgacctgagactgatccccctgctgcacagcagattcagccagtacgtgcccggcaccgacctgagcagacagaacgccttccaggtgatcgccgtggacggcgtgtgcaccggcatcatccagtgcctgagcgccgaggactgcgtggactggctgcaggccatcgccaccaacatcagcaacctgaccaagcacaacatcaagaagatcaacagaaacttccccgtgaaccagcagatcgtgtacatgggctggtgcgaggccagagagcaggaccccctgcaggacagagtgtacagccccaccttcctggccctgagaggcagctgcctgtacaagttcctggccccccccgtgaccacctgggactggaccagagccgagaagaccttcagcgtgtacgagatcatgtgcaagatcctgaaggacagcgacctgctggacagaagaaagcagtgcttcaccgtgcagagcgagagcggcgaggacctgtacttcagcgtggagctggagagcgacctggcccagtgggagagagccttccagaccgccaccttcctggaggtggagagaatccagtgcaagacctacgcctgcgtgctggagagccacctgatgggcctgaccatcgacttcagcaccggcttcatctgcttcgacgccgccaccaaggccgtgctgtggagatacaagttcagccagctgaagggcagcagcgacgacggcaagagcaagatcaagttcctgttccagaaccccgacaccaagcagatcgaggccaaggagctggagttcagcaacctgttcgccgtgctgcactgcatccacagcttcttcgccgccaaggtggcctgcctggaccccctgttcctgggcaaccaggccaccgccagcaccgccgccagcagcgccaccaccagcaaggccaagtacaccacctag

SEQ ID NO: 101693 - DNA, 1554 bp, Artificial Sequence; identical to SEQ ID NO: 101692
  Description of Artificial Sequence: Synthetic coding sequence

SEQ ID NO: 101694 - DNA, 279 bp, Artificial Sequence
  Description of Artificial Sequence: Synthetic coding sequence
atggacttcagaaccgcctgcgaggagaccaagaccggcatctgcctgctgcaggacggcaaccaggagcccttcaaggtgagactgcacctggccaaggacatcctgatgatccaggagcaggacgtgatctgcgtgagcggcgagcccttctacagcggcgagagaaccgtgaccatcagaagacagaccgtgggcggcttcggcctgagcatcaagggcggcgccgagcacaacatccccgtggtggtgagcaagatcagcaaggagcagagatag

SEQ ID NO: 101695 - DNA, 423 bp, Artificial Sequence
  Description of Artificial Sequence: Synthetic coding sequence
atggacgtgttcatgaagggcctgagcaaggccaaggagggcgtggtggccgccgccgagaagaccaagcagggcgtggccgaggccgccggcaagaccaaggagggcgtgctgtacgtgggcagcaagaccaaggagggcgtggtgcacggcgtggccaccgtggccgagaagaccaaggagcaggtgaccaacgtgggcggcgccgtggtgaccggcgtgaccgccgtggcccagaagaccgtggagggcgccggcagcatcgccgccgccaccggcttcgtgaagaaggaccagctgggcaagaacgaggagggcgccccccaggagggcatcctggaggacatgcccgtggaccccgacaacgaggcctacgagatgcccagcgaggagggctaccaggactacgagcccgaggcctag

SEQ ID NO: 101696 - DNA, 339 bp, Artificial Sequence
  Description of Artificial Sequence: Synthetic coding sequence
atggacgtgttcatgaagggcctgagcaaggccaaggagggcgtggtggccgccgccgagaagaccaagcagggcgtggccgaggccgccggcaagaccaaggagggcgtgctgtacgtgggcagcaagaccaaggagggcgtggtgcacggcgtggccaccgtggccgagaagaccaaggagcaggtgaccaacgtgggcggcgccgtggtgaccggcgtgaccgccgtggcccagaagaccgtggagggcgccggcagcatcgccgccgccaccggcttcgtgaagaaggaccagctgggcaaggagggctaccaggactacgagcccgaggcctag

SEQ ID NO: 101697 - DNA, 423 bp, Artificial Sequence; identical to SEQ ID NO: 101695
  Description of Artificial Sequence: Synthetic coding sequence

SEQ ID NO: 101698 - DNA, 381 bp, Artificial Sequence
  Description of Artificial Sequence: Synthetic coding sequence
atggacgtgttcatgaagggcctgagcaaggccaaggagggcgtggtggccgccgccgagaagaccaagcagggcgtggccgaggccgccggcaagaccaaggagggcgtgctgtacgtggtggccgagaagaccaaggagcaggtgaccaacgtgggcggcgccgtggtgaccggcgtgaccgccgtggcccagaagaccgtggagggcgccggcagcatcgccgccgccaccggcttcgtgaagaaggaccagctgggcaagaacgaggagggcgccccccaggagggcatcctggaggacatgcccgtggaccccgacaacgaggcctacgagatgcccagcgaggagggctaccaggactacgagcccgaggcctag

SEQ ID NO: 101699 - DNA, 423 bp, Artificial Sequence; identical to SEQ ID NO: 101695
  Description of Artificial Sequence: Synthetic coding sequence

SEQ ID NO: 101700 - DNA, 339 bp, Artificial Sequence; identical to SEQ ID NO: 101696
  Description of Artificial Sequence: Synthetic coding sequence

SEQ ID NO: 101701 - DNA, 348 bp, Artificial Sequence
  Description of Artificial Sequence: Synthetic coding sequence
atggacgtgttcatgaagggcctgagcaaggccaaggagggcgtggtggccgccgccgagaagaccaagcagggcgtggccgaggccgccggcaagaccaaggagggcgtgctgtacgtgggcagcaagaccaaggagggcgtggtgcacggcgtggccaccgtggccgagaagaccaaggagcaggtgaccaacgtgggcggcgccgtggtgaccggcgtgaccgccgtggcccagaagaccgtggagggcgccggcagcatcgccgccgccaccggcttcgtgaagaaggaccagctgggcaaggtgtggctgtgcaccttctgcgtgaccttcatcagctggtag

SEQ ID NO: 101702 - DNA, 381 bp, Artificial Sequence; identical to SEQ ID NO: 101698
  Description of Artificial Sequence: Synthetic coding sequence

SEQ ID NO: 101703 - DNA, 423 bp, Artificial Sequence; identical to SEQ ID NO: 101695
  Description of Artificial Sequence: Synthetic coding sequence

SEQ ID NO: 101704 - DNA, 204 bp, Artificial Sequence
  Description of Artificial Sequence: Synthetic coding sequence
atggacgtgttcatgaagggcctgagcaaggccaaggagggcgtggtggccgccgccgagaagaccaagcagggcgtggccgaggccgccggcaagaccaaggagggcgtgctgtacgtgggcagcaagaccaaggagggcgtggtgcacggcgtggccaccgtggccgagaagaccaaggagcaggtgaccaacgtgggctag

SEQ ID NO: 101705 - DNA, 423 bp, Artificial Sequence; identical to SEQ ID NO: 101695
  Description of Artificial Sequence: Synthetic coding sequence

SEQ ID NO: 101706 - DNA, 2760 bp, Artificial Sequence
  Description of Artificial Sequence: Synthetic coding sequence
atggaggcccccgagtacctggacctggacgagatcgacttcagcgacgacatcagctacagcgtgaccagcctgaagaccatccccgagctgtgcagaagatgcgacacccagaacgaggacagaagcgtgagcagcagcagctggaactgcggcatcagcaccctgatcaccaacacccagaagcccaccggcatcgccgacgtgtacagcaagttcagacccgtgaagagagtgagccccctgaagcaccagcccgagaccctggagaacaacgagagcgacgaccagaagaaccagaaggtggtggagtaccagaagggcggcgagagcgacctgggcccccagccccaggagctgggccccggcgacggcgtgggcggcccccccggcaagagcagcgagcccagcaccagcctgggcgagctggagcactacgacctggacatggacgagatcctggacgtgccctacatcaagagcagccagcagctggccagcttcaccaaggtgaccagcgagaagagaatcctgggcctgtgcaccaccatcaacggcctgagcggcaaggcctgcagcaccggcagcagcgagagcagcagcagcaacatggcccccttctgcgtgctgagccccgtgaagagcccccacctgagaaaggccagcgccgtgatccacgaccagcacaagctgagcaccgaggagaccgagatcagcccccccctggtgaagtgcggcagcgcctacgagcccgagaaccagagcaaggacttcctgaacaagaccttcagcgacccccacggcagaaaggtggagaagaccacccccgactgccagctgagagccttccacctgcagagcagcgccgccgagagcaagcccgaggagcaggtgagcggcctgaacagaaccagcagccagggccccgaggagagaagcgagtacctgaagaaggtgaagagcatcctgaacatcgtgaaggagggccagatcagcctgctgccccacctggccgccgacaacctggacaagatccacgacgagaacggcaacaacctgctgcacatcgccgccagccagggccacgccgagtgcctgcagcacctgaccagcctgatgggcgaggactgcctgaacgagagaaacaccgagaagctgacccccgccggcctggccatcaagaacggccagctggagtgcgtgagatggatggtgagcgagaccgaggccatcgccgagctgagctgcagcaaggacttccccagcctgatccactacgccggctgctacggccaggagaagatcctgctgtggctgctgcagttcatgcaggagcagggcatcagcctggacgaggtggaccaggacggcaacagcgccgtgcacgtggccagccagcacggctacctgggctgcatccagaccctggtggagtacggcgccaacgtgaccatgcagaaccacgccggcgagaagcccagccagagcgccgagagacagggccacaccctgtgcagcagatacctggtggtggtggagacctgcatgagcctggccagccaggtggtgaagctgaccaagcagctgaaggagcagaccgtggagagagtgaccctgcagaaccagctgcagcagttcctggaggcccagaagagcgagggcaagagcctgcccagcagccccagcagccccagcagccccgccagcagaaagagccagtggaagagccccgacgccgacgacgacagcgtggccaagagcaagcccggcgtgcaggagggcatccaggtgctgggcagcctgagcgccagcagcagagccagacccaaggccaaggacgaggacagcgacaagatcctgagacagctgctgggcaaggagatcagcgagaacgtgtgcacccaggagaagctgagcctggagttccaggacgcccaggccagcagcagaaacagcaagaagatccccctggagaagagagagctgaagctggccagactgagacagctgatgcagagaagcctgagcgagagcgacaccgacagcaacaacagcgaggaccccaagaccacccccgtgagaaaggccgacagacccagaccccagcccatcgtggagagcgtggagagcatggacagcgccgagagcctgcacctgatgatcaagaagcacaccctggccagcggcggcagaagattccccttcagcatcaaggccagcaagagcctggacggccacagccccagccccaccagcgagagcagcgagcccgacctggagagccagtaccccggcagcggcagcatcccccccaaccagcccagcggcgacccccagcagcccagccccgacagcaccgccgcccagaaggtggccaccagccccaagagcgccctgaagagccccagcagcaagagaagaaccagccagaacctgaagctgagagtgaccttcgaggagcccgtggtgcagatggagcagcccagcctggagctgaacggcgagaaggacaaggacaagggcagaaccctgcagagaaccagcaccagcaacgagagcggcgaccagctgaagagacccttcggcgccttcagaagcatcatggagaccctgagcggcaaccagaacaacaacaacaactaccaggccgccaaccagctgaagaccagcaccctgcccctgaccagcctgggcagaaagaccgacgccaagggcaaccccgccagcagcgccagcaagggcaagaacaaggccgcctag

SEQ ID NO: 101707 - DNA, 3051 bp, Artificial Sequence
  Description of Artificial Sequence: Synthetic coding sequence
atggaggcccccgagtacctggacctggacgagatcgacttcagcgacgacatcagcgacaacagaagccagggcaacagactgcagaagctgggcctggaggacaccgacagagaggacgccatgggcttcggcagccacagagccaagctgaccgtggtggccgccctgggcgcctgccactgccccgagaacgagtacagcgtgaccagcctgaagaccatccccgagctgtgcagaagatgcgacacccagaacgaggacagaagcgtgagcagcagcagctggaactgcggcatcagcaccctgatcaccaacacccagaagcccaccggcatcgccgacgtgtacagcaagttcagacccgtgaagagagtgagccccctgaagcaccagcccgagaccctggagaacaacgagagcgacgaccagaagaaccagaaggtggtggagtaccagaagggcggcgagagcgacctgggcccccagccccaggagctgggccccggcgacggcgtgggcggcccccccggcaagagcagcgagcccagcaccagcctgggcgagctggagcactacgacctggacatggacgagatcctggacgtgccctacatcaagagcagccagcagctggccagcttcaccaaggtgaccagcgagaagagaatcctgggcctgtgcaccaccatcaacggcctgagcggcaaggcctgcagcaccggcagcagcgagagcagcagcagcaacatggcccccttctgcgtgctgagccccgtgaagagcccccacctgagaaaggccagcgccgtgatccacgaccagcacaagctgagcaccgaggagaccgagatcagcccccccctggtgaagtgcggcagcgcctacgagcccgagaaccagagcaaggacttcctgaacaagaccttcagcgacccccacggcagaaaggtggagaagaccacccccgactgccagctgagagccttccacctgcagagcagcgccgccgagagcaagcccgaggagcaggtgagcggcctgaacagaaccagcagccagggccccgaggagagaagcgagtacctgaagaaggtgaagagcatcctgaacatcgtgaaggagggccagatcagcctgctgccccacctggccgccgacaacctggacaagatccacgacgagaacggcaacaacctgctgcacatcgccgccagccagggccacgccgagtgcctgcagcacctgaccagcctgatgggcgaggactgcctgaacgagagaaacaccgagaagctgacccccgccggcctggccatcaagaacggccagctggagtgcgtgagatggatggtgagcgagaccgaggccatcgccgagctgagctgcagcaaggacttccccagcctgatccactacgccggctgctacggccaggagaagatcctgctgtggctgctgcagttcatgcaggagcagggcatcagcctggacgaggtggaccaggacggcaacagcgccgtgcacgtggccagccagcacggctacctgggctgcatccagaccctggtggagtacggcgccaacgtgaccatgcagaaccacgccggcgagaagcccagccagagcgccgagagacagggccacaccctgtgcagcagatacctggtggtggtggagacctgcatgagcctggccagccaggtggtgaagctgaccaagcagctgaaggagcagaccgtggagagagtgaccctgcagaaccagctgcagcagttcctggaggcccagaagagcgagggcaagagcctgcccagcagccccagcagccccagcagccccgccagcagaaagagccagtggaagagccccgacgccgacgacgacagcgtggccaagagcaagcccggcgtgcaggagggcatccaggtgctgggcagcctgagcgccagcagcagagccagacccaaggccaaggacgaggacagcgacaagatcctgagacagctgctgggcaaggagatcagcgagaacgtgtgcacccaggagaagctgagcctggagttccaggacgcccaggccagcagcagaaacagcaagaagatccccctggagaagagagagctgaagctggccagactgagacagctgatgcagagaagcctgagcgagagcgacaccgacagcaacaacagcgaggaccccaagaccacccccgtgagaaaggccgacagacccagaccccagcccatcgtggagagcgtggagagcatggacagcgccgagagcctgcacctgatgatcaagaagcacaccctggccagcggcggcagaagattccccttcagcatcaaggccagcaagagcctggacggccacagccccagccccaccagcgagagcagcgagcccgacctggagagccagtaccccggcagcggcagcatcccccccaaccagcccagcggcgacccccagcagcccagccccgacagcaccgccgcccagaaggtggccaccagccccaagagcgccctgaagagccccagcagcaagagaagaaccagccagaacctgaagctgagagtgaccttcgaggagcccgtggtgcagatggagcagcccagcctggagctgaacggcgagaaggacaaggacaagggcagaaccctgcagagaaccagcaccagcaacgagagcggcgaccagctgaagagacccttcggcgccttcagaagcatcatggagaccctgagcggcaaccagaacaacaacaacaactaccaggccgccaaccagctgaagaccagcaccctgcccctgaccagcctgggcagaaagaccgacgccaagggcaaccccgccagcagcgccagcaagggcaagaacaaggccgagatgtacagcagctgcatcaacctgagcagcaacatgctgatcgaggagcacctgtgcaacgacaccagacacaacgacatcaacagaaagatgaagaagagctacagcatcaagcacatcgccgagcccgagagcaaggagctgttcctgtag

SEQ ID NO: 101708 - DNA, 2580 bp, Artificial Sequence
  Description of Artificial Sequence: Synthetic coding sequence
atggaggcccccgagtacctggacctggacgagatcgacttcagcgacgacatcagctacagcgtgaccagcctgaagaccatccccgagctgtgcagaagatgcgacacccagaacgaggacagaagcgtgagcagcagcagctggaactgcggcatcagcaccctgatcaccaacacccagaagcccaccggcatcgccgacgtgtacagcaagttcagacccgtgaagagagtgagccccctgaagcaccagcccgagaccctggagaacaacgagagcgacgaccagaagaaccagaaggtggtggagtaccagaagggcggcgagagcgacctgggcccccagccccaggagctgggccccggcgacggcgtgggcggcccccccggcaagagcagcgagcccagcaccagcctgggcgagctggagcactacgacctggacatggacgagatcctggacgtgccctacatcaagagcagccagcagctggccagcttcaccaaggtgaccagcgagaagagaatcctgggcctgtgcaccaccatcaacggcctgagcggcaaggcctgcagcaccggcagcagcgagagcagcagcagcaacatggcccccttctgcgtgctgagccccgtgaagagcccccacctgagaaaggccagcgccgtgatccacgaccagcacaagctgagcaccgaggagaccgagatcagcccccccctggtgaagtgcggcagcgcctacgagcccgagaaccagagcaaggacttcctgaacaagaccttcagcgacccccacggcagaaaggtggagaagaccacccccgactgccagctgagagccttccacctgcagagcagcgccgccgagagcaagcccgaggagcaggtgagcggcctgaacagaaccagcagccagggccccgaggagagaagcgagtacctgaagaaggtgaagagcatcctgaacatcgtgaaggagggccagatcagcctgctgaacggccagctggagtgcgtgagatggatggtgagcgagaccgaggccatcgccgagctgagctgcagcaaggacttccccagcctgatccactacgccggctgctacggccaggagaagatcctgctgtggctgctgcagttcatgcaggagcagggcatcagcctggacgaggtggaccaggacggcaacagcgccgtgcacgtggccagccagcacggctacctgggctgcatccagaccctggtggagtacggcgccaacgtgaccatgcagaaccacgccggcgagaagcccagccagagcgccgagagacagggccacaccctgtgcagcagatacctggtggtggtggagacctgcatgagcctggccagccaggtggtgaagctgaccaagcagctgaaggagcagaccgtggagagagtgaccctgcagaaccagctgcagcagttcctggaggcccagaagagcgagggcaagagcctgcccagcagccccagcagccccagcagccccgccagcagaaagagccagtggaagagccccgacgccgacgacgacagcgtggccaagagcaagcccggcgtgcaggagggcatccaggtgctgggcagcctgagcgccagcagcagagccagacccaaggccaaggacgaggacagcgacaagatcctgagacagctgctgggcaaggagatcagcgagaacgtgtgcacccaggagaagctgagcctggagttccaggacgcccaggccagcagcagaaacagcaagaagatccccctggagaagagagagctgaagctggccagactgagacagctgatgcagagaagcctgagcgagagcgacaccgacagcaacaacagcgaggaccccaagaccacccccgtgagaaaggccgacagacccagaccccagcccatcgtggagagcgtggagagcatggacagcgccgagagcctgcacctgatgatcaagaagcacaccctggccagcggcggcagaagattccccttcagcatcaaggccagcaagagcctggacggccacagccccagccccaccagcgagagcagcgagcccgacctggagagccagtaccccggcagcggcagcatcccccccaaccagcccagcggcgacccccagcagcccagccccgacagcaccgccgcccagaaggtggccaccagccccaagagcgccctgaagagccccagcagcaagagaagaaccagccagaacctgaagctgagagtgaccttcgaggagcccgtggtgcagatggagcagcccagcctggagctgaacggcgagaaggacaaggacaagggcagaaccctgcagagaaccagcaccagcaacgagagcggcgaccagctgaagagacccttcggcgccttcagaagcatcatggagaccctgagcggcaaccagaacaacaacaacaactaccaggccgccaaccagctgaagaccagcaccctgcccctgaccagcctgggcagaaagaccgacgccaagggcaaccccgccagcagcgccagcaagggcaagaacaaggccgcctag

SEQ ID NO: 101709 - DNA, 1812 bp, Artificial Sequence
  Description of Artificial Sequence: Synthetic coding sequence
atgacctacctgatccagagccaccacagcagaagaagccagaactgcgccgaggacgtgatcagaaagaccaagaccgaccagaacggccagctggagtgcgtgagatggatggtgagcgagaccgaggccatcgccgagctgagctgcagcaaggacttccccagcctgatccactacgccggctgctacggccaggagaagatcctgctgtggctgctgcagttcatgcaggagcagggcatcagcctggacgaggtggaccaggacggcaacagcgccgtgcacgtggccagccagcacggctacctgggctgcatccagaccctggtggagtacggcgccaacgtgaccatgcagaaccacgccggcgagaagcccagccagagcgccgagagacagggccacaccctgtgcagcagatacctggtggtggtggagacctgcatgagcctggccagccaggtggtgaagctgaccaagcagctgaaggagcagaccgtggagagagtgaccctgcagaaccagctgcagcagttcctggaggcccagaagagcgagggcaagagcctgcccagcagccccagcagccccagcagccccgccagcagaaagagccagtggaagagccccgacgccgacgacgacagcgtggccaagagcaagcccggcgtgcaggagggcatccaggtgctgggcagcctgagcgccagcagcagagccagacccaaggccaaggacgaggacagcgacaagatcctgagacagctgctgggcaaggagatcagcgagaacgtgtgcacccaggagaagctgagcctggagttccaggacgcccaggccagcagcagaaacagcaagaagatccccctggagaagagagagctgaagctggccagactgagacagctgatgcagagaagcctgagcgagagcgacaccgacagcaacaacagcgaggaccccaagaccacccccgtgagaaaggccgacagacccagaccccagcccatcgtggagagcgtggagagcatggacagcgccgagagcctgcacctgatgatcaagaagcacaccctggccagcggcggcagaagattccccttcagcatcaaggccagcaagagcctggacggccacagccccagccccaccagcgagagcagcgagcccgacctggagagccagtaccccggcagcggcagcatcccccccaaccagcccagcggcgacccccagcagcccagccccgacagcaccgccgcccagaaggtggccaccagccccaagagcgccctgaagagccccagcagcaagagaagaaccagccagaacctgaagctgagagtgaccttcgaggagcccgtggtgcagatggagcagcccagcctggagctgaacggcgagaaggacaaggacaagggcagaaccctgcagagaaccagcaccagcaacgagagcggcgaccagctgaagagacccttcggcgccttcagaagcatcatggagaccctgagcggcaaccagaacaacaacaacaactaccaggccgccaaccagctgaagaccagcaccctgcccctgaccagcctgggcagaaagaccgacgccaagggcaaccccgccagcagcgccagcaagggcaagaacaaggccgagatgtacagcagctgcatcaacctgagcagcaacatgctgatcgaggagcacctgtgcaacgacaccagacacaacgacatcaacagaaagatgaagaagagctacagcatcaagcacatcgccgagcccgagagcaaggagctgttcctgtag

SEQ ID NO: 101710 - DNA, 1566 bp, Artificial Sequence
  Description of Artificial Sequence: Synthetic coding sequence
atgaagctgaccctggtgatgacctacctgatccagagccaccacagcagaagaagccagaactgcgccgaggacgtgatcagaaagaccaagaccgaccaggagaagatcctgctgtggctgctgcagttcatgcaggagcagggcatcagcctggacgaggtggaccaggacggcaacagcgccgtgcacgtggccagccagcacggctacctgggctgcatccagaccctggtggagtacggcgccaacgtgaccatgcagaaccacgccggcgagaagcccagccagagcgccgagagacagggccacaccctgtgcagcagatacctggtggtggtggagacctgcatgagcctggccagccaggtggtgaagctgaccaagcagctgaaggagcagaccgtggagagagtgaccctgcagaaccagctgcagcagttcctggaggcccagaagagcgagggcaagagcctgcccagcagccccagcagccccagcagccccgccagcagaaagagccagtggaagagccccgacgccgacgacgacagcgtggccaagagcaagcccggcgtgcaggagggcatccaggtgctgggcagcctgagcgccagcagcagagccagacccaaggccaaggacgaggacagcgacaagatcctgagacagctgctgggcaaggagatcagcgagaacgtgtgcacccaggagaagctgagcctggagttccaggacgcccaggccagcagcagaaacagcaagaagatccccctggagaagagagagctgaagctggccagactgagacagctgatgcagagaagcctgagcgagagcgacaccgacagcaacaacagcgaggaccccaagaccacccccgtgagaaaggccgacagacccagaccccagcccatcgtggagagcgtggagagcatggacagcgccgagagcctgcacctgatgatcaagaagcacaccctggccagcggcggcagaagattccccttcagcatcaaggccagcaagagcctggacggccacagccccagccccaccagcgagagcagcgagcccgacctggagagccagtaccccggcagcggcagcatcccccccaaccagcccagcggcgacccccagcagcccagccccgacagcaccgccgcccagaaggtggccaccagccccaagagcgccctgaagagccccagcagcaagagaagaaccagccagaacctgaagctgagagtgaccttcgaggagcccgtggtgcagatggagcagcccagcctggagctgaacggcgagaaggacaaggacaagggcagaaccctgcagagaaccagcaccagcaacgagagcggcgaccagctgaagagacccttcggcgccttcagaagcatcatggagaccctgagcggcaaccagaacaacaacaacaactaccaggccgccaaccagctgaagaccagcaccctgcccctgaccagcctgggcagaaagaccgacgccaagggcaaccccgccagcagcgccagcaagggcaagaacaaggccgcctag

SEQ ID NO: 101711 - DNA, 1146 bp, Artificial Sequence
  Description of Artificial Sequence: Synthetic coding sequence
atgaagctgaccctggtgatgacctacctgatccagagccaccacagcagaagaagccagaactgcgccgaggacgtgatcagaaagaccaagaccgaccagaacggccagctggagtgcgtgagatggatggtgagcgagaccgaggccatcgccgagctgagctgcagcaaggacttccccagcctgatccactacgccggctgctacggccaggagaagatcctgctgtggctgctgcagttcatgcaggagcagggcatcagcctggacgaggtggaccaggacggcaacagcgccgtgcacgtggccagccagcacggctacctgggctgcatccagaccctggtggagtacggcgccaacgtgaccatgcagaaccacgccggcgagaagcccagccagagcgccgagagacagggccacaccctgtgcagcagatacctggtggtggtggagacctgcatgagcctggccagccaggtggtgaagctgaccaagcagctgaaggagcagaccgtggagagagtgaccctgcagaaccagctgcagcagttcctggaggcccagaagagcgagggcaagagcctgcccagcagccccagcagccccagcagccccgccagcagaaagagccagtggaagagccccgacgccgacgacgacagcgtggccaagagcaagcccggcgtgcaggagggcatccaggtgctgggcagcctgagcgccagcagcagagccagacccaaggccaaggacgaggacagcgacaagatcctgagacagctgctgggcaaggagatcagcgagaacgtgtgcacccaggagaagctgagcctggagttccaggacgcccaggccagcagcagaaacagcaagaagatccccctggagaagagagagctgaagctggccagactgagacagctgatgcagagaagcctgagcgagagcgacaccgacagcaacaacagcgaggaccccaagaccacccccgtgagaaaggccgacagacccagaccccagcccatcgtggagagcgtggagagcatggacagcgccggcttcctgagcgccagcagaccccccaacccctggatggccaccgcccacctgcccccccagagagccgccaaccagacctag

SEQ ID NO: 101712 - DNA, 1767 bp, Artificial Sequence
  Description of Artificial Sequence: Synthetic coding sequence
atggaggcccccgagtacctggacctggacgagatcgacttcagcgacgacatcagcgacaacagaagccagggcaacagactgcagaagctgggcctggaggacaccgacagagaggacgccatgggcttcggcagccacagagccaagctgaccgtggtggccgccctgggcgcctgccactgccccgagaacgagtacagcgtgaccagcctgaagaccatccccgagctgtgcagaagatgcgacacccagaacgaggacagaagcgtgagcagcagcagctggaactgcggcatcagcaccctgatcaccaacacccagaagcccaccggcatcgccgacgtgtacagcaagttcagacccgtgaagagagtgagccccctgaagcaccagcccgagaccctggagaacaacgagagcgacgaccagaagaaccagaaggtggtggagtaccagaagggcggcgagagcgacctgggcccccagccccaggagctgggccccggcgacggcgtgggcggcccccccggcaagagcagcgagcccagcaccagcctgggcgagctggagcactacgacctggacatggacgagatcctggacgtgccctacatcaagagcagccagcagctggccagcttcaccaaggtgaccagcgagaagagaatcctgggcctgtgcaccaccatcaacggcctgagcggcaaggcctgcagcaccggcagcagcgagagcagcagcagcaacatggcccccttctgcgtgctgagccccgtgaagagcccccacctgagaaaggccagcgccgtgatccacgaccagcacaagctgagcaccgaggagaccgagatcagcccccccctggtgaagtgcggcagcgcctacgagcccgagaaccagagcaaggacttcctgaacaagaccttcagcgacccccacggcagaaaggtggagaagaccacccccgactgccagctgagagccttccacctgcagagcagcgccgccgagagcaagcccgaggagcaggtgagcggcctgaacagaaccagcagccagggccccgaggagagaagcgagtacctgaagaaggtgaagagcatcctgaacatcgtgaaggagggccagatcagcctgctgccccacctggccgccgacaacctggacaagatccacgacgagaacggcaacaacctgctgcacatcgccgccagccagggccacgccgagtgcctgcagcacctgaccagcctgatgggcgaggactgcctgaacgagagaaacaccgagaagctgacccccgccggcctggccatcaagaacggccagctggagtgcgtgagatggatggtgagcgagaccgaggccatcgccgagctgagctgcagcaaggacttccccagcctgatccactacgccggctgctacggccaggagaagatcctgctgtggctgctgcagttcatgcaggagcagggcatcagcctggacgaggtggaccaggacggcaacagcgccgtgcacgtggccagccagcacggctacctgggctgcatccagaccagactgaagatccagggcacctggaacggcagcgagacctgcctgttcacccaccacttcagcagctacccccccatcagcagcggcctgcagtgccagggccaggagggcgtgctgttcatccccgaccaggtgggcgccgccaccaacaagcaggtgctgttccagaaccagctgcccgagaccaagagcagctactag

SEQ ID NO: 101713 - DNA, 267 bp, Artificial Sequence
  Description of Artificial Sequence: Synthetic coding sequence
atggaggcccccgagtacctggacctggacgagatcgacttcagcgacgacatcagctacagcgtgaccagcctgaagaccatccccgagctgtgcagaagatgcgacacccagaacgaggacagaagcgccacccccagctgcagacagagcagacagaacagcagaagaaagtggaagcagagcatcacctactgcggcgtgaccggcaccagaagagtgagcaccgccccccacttcttcgacggcagaagactgccccagtag

SEQ ID NO: 101714 - DNA, 297 bp, Artificial Sequence
  Description of Artificial Sequence: Synthetic coding sequence
atggaggcccccgagtacctggacctggacgagatcgacttcagcgacgacatcagctacagcgtgaccagcctgaagaccatccccgagctgtgcagaagatgcgacacccagaacgaggacagaagcgtgagcagcagcagctggaactgcggcatcagcaccctgatcaccaacacccagaagcccaccggcatcgccgacgtgtacagcaagttcagacccgtgaagagagtgagccccctgaagcaccagcccgagaccctggagaacaacgagagcgacgaccagaagtag

SEQ ID NO: 101715 - DNA, 45 bp, Artificial Sequence
  Description of Artificial Sequence: Synthetic coding sequence
atggaggcccccgagtacctggacctggacgagatcgacttctag

SEQ ID NO: 101716 - DNA, 408 bp, Artificial Sequence
  Description of Artificial Sequence: Synthetic coding sequence
atggaggcccccgagtacctggacctggacgagatcgacttcagcgacgacatcagctacagcgtgaccagcctgaagaccatccccgagctgtgcagaagatgcgacacccagaacgaggacagaagcgtgagcagcagcagctggaactgcggcatcagcaccctgatcaccaacacccagaagcccaccggcatcgccgacgtgtacagcaagttcagacccgtgaagagagtgagccccctgaagcaccagcccgagaccctggagaacaacgagagcgacgaccagaagaaccagaaggtggtggagtaccagaagggcggcgagagcgacctgggcccccagccccaggagctgggccccggcgacggcgtgggcggcccccccggcaagagcagcgagtag

SEQ ID NO: 101717 - DNA, 1434 bp, Artificial Sequence
  Description of Artificial Sequence: Synthetic coding sequence
atgcaggagcagggcatcagcctggacgaggtggaccaggacggcaacagcgccgtgcacgtggccagccagcacggctacctgggctgcatccagaccctggtggagtacggcgccaacgtgaccatgcagaaccacgccggcgagaagcccagccagagcgccgagagacagggccacaccctgtgcagcagatacctggtggtggtggagacctgcatgagcctggccagccaggtggtgaagctgaccaagcagctgaaggagcagaccgtggagagagtgaccctgcagaaccagctgcagcagttcctggaggcccagaagagcgagggcaagagcctgcccagcagccccagcagccccagcagccccgccagcagaaagagccagtggaagagccccgacgccgacgacgacagcgtggccaagagcaagcccggcgtgcaggagggcatccaggtgctgggcagcctgagcgccagcagcagagccagacccaaggccaaggacgaggacagcgacaagatcctgagacagctgctgggcaaggagatcagcgagaacgtgtgcacccaggagaagctgagcctggagttccaggacgcccaggccagcagcagaaacagcaagaagatccccctggagaagagagagctgaagctggccagactgagacagctgatgcagagaagcctgagcgagagcgacaccgacagcaacaacagcgaggaccccaagaccacccccgtgagaaaggccgacagacccagaccccagcccatcgtggagagcgtggagagcatggacagcgccgagagcctgcacctgatgatcaagaagcacaccctggccagcggcggcagaagattccccttcagcatcaaggccagcaagagcctggacggccacagccccagccccaccagcgagagcagcgagcccgacctggagagccagtaccccggcagcggcagcatcccccccaaccagcccagcggcgacccccagcagcccagccccgacagcaccgccgcccagaaggtggccaccagccccaagagcgccctgaagagccccagcagcaagagaagaaccagccagaacctgaagctgagagtgaccttcgaggagcccgtggtgcagatggagcagcccagcctggagctgaacggcgagaaggacaaggacaagggcagaaccctgcagagaaccagcaccagcaacgagagcggcgaccagctgaagagacccttcggcgccttcagaagcatcatggagaccctgagcggcaaccagaacaacaacaacaactaccaggccgccaaccagctgaagaccagcaccctgcccctgaccagcctgggcagaaagaccgacgccaagggcaaccccgccagcagcgccagcaagggcaagaacaaggccgcctag

SEQ ID NO: 101718 - DNA, 405 bp, Artificial Sequence
  Description of Artificial Sequence: Synthetic coding sequence
atggacgtgttcatgaagggcctgagcatggccaaggagggcgtggtggccgccgccgagaagaccaagcagggcgtgaccgaggccgccgagaagaccaaggagggcgtgctgtacgtgggcagcaagaccagagagggcgtggtgcagggcgtggccagcgtggccgagaagaccaaggagcaggccagccacctgggcggcgccgtgttcagcggcgccggcaacatcgccgccgccaccggcctggtgaagagagaggagttccccaccgacctgaagcccgaggaggtggcccaggaggccgccgaggagcccctgatcgagcccctgatggagcccgagggcgagagctacgaggaccccccccaggaggagtaccaggagtacgagcccgaggcctag

SEQ ID NO: 101719 - DNA, 405 bp, Artificial Sequence; identical to SEQ ID NO: 101718
  Description of Artificial Sequence: Synthetic coding sequence

SEQ ID NO: 101720 - DNA, 405 bp, Artificial Sequence; identical to SEQ ID NO: 101718
  Description of Artificial Sequence: Synthetic coding sequence

SEQ ID NO: 101721 - DNA, 405 bp, Artificial Sequence; identical to SEQ ID NO: 101718
  Description of Artificial Sequence: Synthetic coding sequence

SEQ ID NO: 101722 - DNA, 381 bp, Artificial Sequence
  Description of Artificial Sequence: Synthetic coding sequence
atggacgtgttcaagaagggcttcagcatcgccaaggagggcgtggtgggcgccgtggagaagaccaagcagggcgtgaccgaggccgccgagaagaccaaggagggcgtgatgtacgtgggcgccaagaccaaggagaacgtggtgcagagcgtgaccagcggcctgccctggggctggggctggggcggcggccagcccgtgagcagccacagcggcagagaggaccagggcgccggccagagaagagagagaggctgcggcgagcagagacagcactgcggccaccaggacagaggcggcggcggcgagcacagaggccacctgagaggcggcgcccagggcggcctggaggccatctgcccccccaccggcggctag

SEQ ID NO: 101723 - DNA, 384 bp, Artificial Sequence
  Description of Artificial Sequence: Synthetic coding sequence
atggacgtgttcaagaagggcttcagcatcgccaaggagggcgtggtgggcgccgtggagaagaccaagcagggcgtgaccgaggccgccgagaagaccaaggagggcgtgatgtacgtgggcgccaagaccaaggagaacgtggtgcagagcgtgaccagcgtggccgagaagaccaaggagcaggccaacgccgtgagcgaggccgtggtgagcagcgtgaacaccgtggccaccaagaccgtggaggaggccgagaacatcgccgtgaccagcggcgtggtgagaaaggaggacctgagacccagcgccccccagcaggagggcgaggccagcaaggagaaggaggaggtggccgaggaggcccagagcggcggcgactag

SEQ ID NO: 101724 - DNA, 471 bp, Artificial Sequence
  Description of Artificial Sequence: Synthetic coding sequence
atggccggccagttcagaagctacgtgtgggaccccctgctgatcctgagccagatcgtgctgatgcagaccgtgtactacggcagcctgggcctgtggctggccctggtggacggcctggtgagaagcagccccagcctggaccagatgttcgacgccgagatcctgggcttcagcaccccccccggcagactgagcatgatgagcttcatcctgaacgccctgacctgcgccctgggcctgctgtacttcatcagaagaggcaagcagtgcctggacttcaccgtgaccgtgcacttcttccacctgctgggctgctggttctacagcagcagattccccagcgccctgacctggtggctggtgcaggccgtgtgcatcgccctgatggccgtgatcggcgagtacctgtgcatgagaaccgagctgaaggagatccccctgaacagcgcccccaagagcaacgtgtag

SEQ ID NO: 101725 - DNA, 471 bp, Artificial Sequence; identical to SEQ ID NO: 101724
  Description of Artificial Sequence: Synthetic coding sequence

SEQ ID NO: 101726 - DNA, 357 bp, Artificial Sequence
  Description of Artificial Sequence: Synthetic coding sequence
atggccggccagttcagaagctacgtgtgggaccccctgctgatcctgagccagatcgtgctgatgcagaccgtgtactacggcagcctgggcctgtggctggccctggtggacggcctggtgagaagcagccccagcctggaccagatgttcgacgccgagatcctgggcttcagcaccccccccggcagactgagcatgatgagcttcatcctgaacgccctgacctgcgccctgggcctgctgtacttcatcagaagaggcaagcagtgcctggacttcaccgtgaccgtgcacttcttccacctgctgggctgctggttctacagcagcagattccccagcgccctgacctag

SEQ ID NO: 101727 - DNA, 231 bp, Artificial Sequence
  Description of Artificial Sequence: Synthetic coding sequence
atggccggccagttcagaagctacgtgtgggaccccctgctgatcctgagccagatcgtgctgatgcagaccgtgtactacggcagcctgggcctgtggctggccctggtggacggcctggtgagaagcagccccagcctggaccagatgttcgacgccgagatcctgggcttcagcaccccccccggcagactgagcatgatgagcttcatcctgaacgccctgacctag

SEQ ID NO: 101728 - DNA, 1134 bp, Artificial Sequence
  Description of Artificial Sequence: Synthetic coding sequence
atgagcagccccggcaccgagagcgccggcaagagcctgcagtacagagtggaccacctgctgagcgccgtggagaacgagctgcaggccggcagcgagaagggcgaccccaccgagagagagctgagagtgggcctggaggagagcgagctgtggctgagattcaaggagctgaccaacgagatgatcgtgaccaagaacggcagaagaatgttccccgtgctgaaggtgaacgtgagcggcctggaccccaacgccatgtacagcttcctgctggacttcgtggccgccgacaaccacagatggaagtacgtgaacggcgagtgggtgcccggcggcaagcccgagccccaggcccccagctgcgtgtacatccaccccgacagccccaacttcggcgcccactggatgaaggcccccgtgagcttcagcaaggtgaagctgaccaacaagctgaacggcggcggccagatcatgctgaacagcctgcacaagtacgagcccagaatccacatcgtgagagtgggcggcccccagagaatgatcaccagccactgcttccccgagacccagttcatcgccgtgaccgcctaccagaacgaggagatcaccgccctgaagatcaagtacaaccccttcgccaaggccttcctggacgccaaggagagaagcgaccacaaggagatgatggaggagcccggcgacagccagcagcccggctacagccagagctacagcgacaacagccccgcctgcctgagcatgctgcagagccacgacaactggagcagcctgggcatgcccgcccaccccagcatgctgcccgtgagccacaacgccagcccccccaccagcagcagccagtaccccagcctgtggagcgtgagcaacggcgccgtgacccccggcagccaggccgccgccgtgagcaacggcctgggcgcccagttcttcagaggcagccccgcccactacacccccctgacccaccccgtgagcgcccccagcagcagcggcagccccctgtacgagggcgccgccgccgccaccgacatcgtggacagccagtacgacgccgccgcccagggcagactgatcgccagctggacccccgtgagcccccccagcatgtag

SEQ ID NO: 101729 - DNA, 735 bp, Artificial Sequence
  Description of Artificial Sequence: Synthetic coding sequence
atgagatggtgcctgctgctgatctgggcccagggcctgagacaggcccccctggccagcggcatgatgaccggcaccatcgagaccaccggcaacatcagcgccgagaagggcggcagcatcatcctgcagtgccacctgagcagcaccaccgcccaggtgacccaggtgaactgggagcagcaggaccagctgctggccatctgcaacgccgacctgggctggcacatcagccccagcttcaaggacagagtggcccccggccccggcctgggcctgaccctgcagagcctgaccgtgaacgacaccggcgagtacttctgcatctaccacacctaccccgacggcacctacaccggcagaatcttcctggaggtgctggagagcagcgtggccgagcacggcgccagattccagatccccctgctgggcgccatggccgccaccctggtggtgatctgcaccgccgtgatcgtggtggtggccctgaccagaaagaagaaggccctgagaatccacagcgtggagggcgacctgagaagaaagagcgccggccaggaggagtggagccccagcgcccccagcccccccggcagctgcgtgcaggccgaggccgcccccgccggcctgtgcggcgagcagagaggcgaggactgcgccgagctgcacgactacttcaacgtgctgagctacagaagcctgggcaactgcagcttcttcaccgagaccggctag

SEQ ID NO: 101730 - DNA, 936 bp, Artificial Sequence
  Description of Artificial Sequence: Synthetic coding sequence
atggccttcctggtggcccaccccatgcagttcgtgtacctgctgaccaccctgtgcgtgttcaacatggtgttcgccaagctgggcttcagcgagaccgtgttcagccagagactgagcttcaccgtgctgagcgccgtgggctacttccagtggcagaagagaccccacctgctgcccgtgggccccctgggcagaagcatgagatggtgcctgctgctgatctgggcccagggcctgagacaggcccccctggccagcggcatgatgaccggcaccatcgagaccaccggcaacatcagcgccgagaagggcggcagcatcatcctgcagtgccacctgagcagcaccaccgcccaggtgacccaggtgaactgggagcagcaggaccagctgctggccatctgcaacgccgacctgggctggcacatcagccccagcttcaaggacagagtggcccccggccccggcctgggcctgaccctgcagagcctgaccgtgaacgacaccggcgagtacttctgcatctaccacacctaccccgacggcacctacaccggcagaatcttcctggaggtgctggagagcagcgtggccgagcacggcgccagattccagatccccctgctgggcgccatggccgccaccctggtggtgatctgcaccgccgtgatcgtggtggtggccctgaccagaaagaagaaggccctgagaatccacagcgtggagggcgacctgagaagaaagagcgccggccaggaggagtggagccccagcgcccccagcccccccggcagctgcgtgcaggccgaggccgcccccgccggcctgtgcggcgagcagagaggcgaggactgcgccgagctgcacgactacttcaacgtgctgagctacagaagcctgggcaactgcagcttcttcaccgagaccggctag

SEQ ID NO: 101731 - DNA, 735 bp, Artificial Sequence; identical to SEQ ID NO: 101729
  Description of Artificial Sequence: Synthetic coding sequence

SEQ ID NO: 101732 - DNA, 561 bp, Artificial Sequence
  Description of Artificial Sequence: Synthetic coding sequence
atgagcggcatcagcggctgccccttcttcctgtggggcctgctggccctgctgggcctggccctggtgatcagcctgatcttcaacatcagccactacgtggagaagcagagacaggacaagatgtacagctacagcagcgaccacaccagagtggacgagtactacatcgaggacacccccatctacggcaacctggacgacatgatcagcgagcccatggacgagaactgctacgagcagatgaaggccagacccgagaagagcgtgaacaagatgcaggaggccacccccagcgcccaggccaccaacgagacccagatgtgctacgccagcctggaccacagcgtgaagggcaagagaagaaagcccagaaagcagaacacccacttcagcgacaaggacggcgacgagcagctgcacgccatcgacgccagcgtgagcaagaccaccctggtggacagcttcagccccgagagccaggccgtggaggagaacatccacgacgaccccatcagactgttcggcctgatcagagccaagagagagcccatcaactag

SEQ ID NO: 101733 - DNA, 1308 bp, Artificial Sequence
  Description of Artificial Sequence: Synthetic coding sequence
atgagcagccccggcaccgagagcgccggcaagagcctgcagtacagagtggaccacctgctgagcgccgtggagaacgagctgcaggccggcagcgagaagggcgaccccaccgagagagagctgagagtgggcctggaggagagcgagctgtggctgagattcaaggagctgaccaacgagatgatcgtgaccaagaacggcagaagaatgttccccgtgctgaaggtgaacgtgagcggcctggaccccaacgccatgtacagcttcctgctggacttcgtggccgccgacaaccacagatggaagtacgtgaacggcgagtgggtgcccggcggcaagcccgagccccaggcccccagctgcgtgtacatccaccccgacagccccaacttcggcgcccactggatgaaggcccccgtgagcttcagcaaggtgaagctgaccaacaagctgaacggcggcggccagatcatgctgaacagcctgcacaagtacgagcccagaatccacatcgtgagagtgggcggcccccagagaatgatcaccagccactgcttccccgagacccagttcatcgccgtgaccgcctaccagaacgaggagatcaccgccctgaagatcaagtacaaccccttcgccaaggccttcctggacgccaaggagagaagcgaccacaaggagatgatggaggagcccggcgacagccagcagcccggctacagccagtggggctggctgctgcccggcaccagcaccctgtgcccccccgccaacccccacccccagttcggcggcgccctgagcctgcccagcacccacagctgcgacagataccccaccctgagaagccacagaagcagcccctaccccagcccctacgcccacagaaacaacagccccacctacagcgacaacagccccgcctgcctgagcatgctgcagagccacgacaactggagcagcctgggcatgcccgcccaccccagcatgctgcccgtgagccacaacgccagcccccccaccagcagcagccagtaccccagcctgtggagcgtgagcaacggcgccgtgacccccggcagccaggccgccgccgtgagcaacggcctgggcgcccagttcttcagaggcagccccgcccactacacccccctgacccaccccgtgagcgcccccagcagcagcggcagccccctgtacgagggcgccgccgccgccaccgacatcgtggacagccagtacgacgccgccgcccagggcagactgatcgccagctggacccccgtgagcccccccagcatgtag

SEQ ID NO: 101734 - DNA, 732 bp, Artificial Sequence
  Description of Artificial Sequence: Synthetic coding sequence
atgagcagccccggcaccgagagcgccggcaagagcctgcagtacagagtggaccacctgctgagcgccgtggagaacgagctgcaggccggcagcgagaagggcgaccccaccgagagagagctgagagtgggcctggaggagagcgagctgtggctgagattcaaggagctgaccaacgagatgatcgtgaccaagaacggcagaagaatgttccccgtgctgaaggtgaacgtgagcggcctggaccccaacgccatgtacagcttcctgctggacttcgtggccgccgacaaccacagatggaagtacgtgaacggcgagtgggtgcccggcggcaagcccgagccccaggcccccagctgcgtgtacatccaccccgacagccccaacttcggcgcccactggatgaaggcccccgtgagcttcagcaaggtgaagctgaccaacaagctgaacggcggcggccagatcatgctgaacagcctgcacaagtacgagcccagaatccacatcgtgagagtgggcggcccccagagaatgatcaccagccactgcttccccgagacccagttcatcgccgtgaccgcctaccagaacgaggagatcaccgccctgaagatcaagtacaaccccttcgccaaggccttcctggacgccaaggagagaagcgaccacaaggagatgatggaggagcccggcgacagccagcagcccggctacagccagtag

SEQ ID NO: 101735 - DNA, 366 bp, Artificial Sequence
  Description of Artificial Sequence: Synthetic coding sequence
atgagaatcatgctgctgttcaccgccatcctggccttcagcctggcccagagcttcggcgccgtgtgcaaggagccccaggaggaggtggtgcccggcggcggcagaagcaagagagaccccgacctgtaccagctgctgcagagactgttcaagagccacagcagcctggagggcctgctgaaggccctgagccaggccagcaccgaccccaaggagagcaccagccccgagaagagagacatgcacgacttcttcgtgggcctgatgggcaagagaagcgtgcagcccgacagccccaccgacgtgaaccaggagaacgtgcccagcttcggcatcctgaagtacccccccagagccgagtag

SEQ ID NO: 101736 - DNA, 366 bp, Artificial Sequence; identical to SEQ ID NO: 101735
  Description of Artificial Sequence: Synthetic coding sequence

SEQ ID NO: 101737 - DNA, 312 bp, Artificial Sequence
  Description of Artificial Sequence: Synthetic coding sequence
atgagaatcatgctgctgttcaccgccatcctggccttcagcctggcccagagcttcggcgccgtgtgcaaggagccccaggaggaggtggtgcccggcggcggcagaagcaagagagaccccgacctgtaccagctgctgcagagactgttcaagagccacagcagcctggagggcctgctgaaggccctgagccaggccagcaccgaccccaaggagagcaccagccccgagaagcacagccccaccgacgtgaaccaggagaacgtgcccagcttcggcatcctgaagtacccccccagagccgagtag

SEQ ID NO: 101738 - DNA, 366 bp, Artificial Sequence; identical to SEQ ID NO: 101735
  Description of Artificial Sequence: Synthetic coding sequence

SEQ ID NO: 101739 - DNA, 1224 bp, Artificial Sequence
  Description of Artificial Sequence: Synthetic coding sequence
atggacaacgtgctgcccgtggacagcgacctgagccccaacatcagcaccaacaccagcgagcccaaccagttcgtgcagcccgcctggcagatcgtgctgtgggccgccgcctacaccgtgatcgtggtgaccagcgtggtgggcaacgtggtggtgatgtggatcatcctggcccacaagagaatgagaaccgtgaccaactacttcctggtgaacctggccttcgccgaggccagcatggccgccttcaacaccgtggtgaacttcacctacgccgtgcacaacgagtggtactacggcctgttctactgcaagttccacaacttcttccccatcgccgccgtgttcgccagcatctacagcatgaccgccgtggccttcgacagatacatggccatcatccaccccctgcagcccagactgagcgccaccgccaccaaggtggtgatctgcgtgatctgggtgctggccctgctgctggccttcccccagggctactacagcaccaccgagaccatgcccagcagagtggtgtgcatgatcgagtggcccgagcaccccaacaagatctacgagaaggtgtaccacatctgcgtgaccgtgctgatctacttcctgcccctgctggtgatcggctacgcctacaccgtggtgggcatcaccctgtgggccagcgagatccccggcgacagcagcgacagataccacgagcaggtgagcgccaagagaaaggtggtgaagatgatgatcgtggtggtgtgcaccttcgccatctgctggctgcccttccacatcttcttcctgctgccctacatcaaccccgacctgtacctgaagaagttcatccagcaggtgtacctggccatcatgtggctggccatgagcagcaccatgtacaaccccatcatctactgctgcctgaacgacagattcagactgggcttcaagcacgccttcagatgctgccccttcatcagcgccggcgactacgagggcctggagatgaagagcaccagatacctgcagacccagggcagcgtgtacaaggtgagcagactggagaccaccatcagcaccgtggtgggcgcccacgaggaggagcccgaggacggccccaaggccacccccagcagcctggacctgaccagcaactgcagcagcagaagcgacagcaagaccatgaccgagagcttcagcttcagcagcaacgtgctgagctag

SEQ ID NO: 101740 - DNA, 936 bp, Artificial Sequence
  Description of Artificial Sequence: Synthetic coding sequence
atggacaacgtgctgcccgtggacagcgacctgagccccaacatcagcaccaacaccagcgagcccaaccagttcgtgcagcccgcctggcagatcgtgctgtgggccgccgcctacaccgtgatcgtggtgaccagcgtggtgggcaacgtggtggtgatgtggatcatcctggcccacaagagaatgagaaccgtgaccaactacttcctggtgaacctggccttcgccgaggccagcatggccgccttcaacaccgtggtgaacttcacctacgccgtgcacaacgagtggtactacggcctgttctactgcaagttccacaacttcttccccatcgccgccgtgttcgccagcatctacagcatgaccgccgtggccttcgacagatacatggccatcatccaccccctgcagcccagactgagcgccaccgccaccaaggtggtgatctgcgtgatctgggtgctggccctgctgctggccttcccccagggctactacagcaccaccgagaccatgcccagcagagtggtgtgcatgatcgagtggcccgagcaccccaacaagatctacgagaaggtgtaccacatctgcgtgaccgtgctgatctacttcctgcccctgctggtgatcggctacgcctacaccgtggtgggcatcaccctgtgggccagcgagatccccggcgacagcagcgacagataccacgagcaggtgagcgccaagagaaaggtggtgaagatgatgatcgtggtggtgtgcaccttcgccatctgctggctgcccttccacatcttcttcctgctgccctacatcaaccccgacctgtacctgaagaagttcatccagcaggtgtacctggccatcatgtggctggccatgagcagcaccatgtacaaccccatcatctactgctgcctgaacgacagatag

SEQ ID NO: 101741 - DNA, 1197 bp, Artificial Sequence
  Description of Artificial Sequence: Synthetic coding sequence
atgggcacctgcgacatcgtgaccgaggccaacatcagcagcggccccgagagcaacaccaccggcatcaccgccttcagcatgcccagctggcagctggccctgtgggccaccgcctacctggccctggtgctggtggccgtgaccggcaacgccatcgtgatctggatcatcctggcccacagaagaatgagaaccgtgaccaactacttcatcgtgaacctggccctggccgacctgtgcatggccgccttcaacgccgccttcaacttcgtgtacgccagccacaacatctggtacttcggcagagccttctgctacttccagaacctgttccccatcaccgccatgttcgtgagcatctacagcatgaccgccatcgccgccgacagatacatggccatcgtgcaccccttccagcccagactgagcgcccccagcaccaaggccgtgatcgccggcatctggctggtggccctggccctggccagcccccagtgcttctacagcaccgtgaccatggaccagggcgccaccaagtgcgtggtggcctggcccgaggacagcggcggcaagaccctgctgctgtaccacctggtggtgatcgccctgatctacttcctgcccctggccgtgatgttcgtggcctacagcgtgatcggcctgaccctgtggagaagagccgtgcccggccaccaggcccacggcgccaacctgagacacctgcaggccatgaagaagttcgtgaagaccatggtgctggtggtgctgaccttcgccatctgctggctgccctaccacctgtacttcatcctgggcagcttccaggaggacatctactgccacaagttcatccagcaggtgtacctggccctgttctggctggccatgagcagcaccatgtacaaccccatcatctactgctgcctgaaccacagattcagaagcggcttcagactggccttcagatgctgcccctgggtgacccccaccaaggaggacaagctggagctgacccccaccaccagcctgagcaccagagtgaacagatgccacaccaaggagaccctgttcatggccggcgacaccgcccccagcgaggccaccagcggcgaggccggcagaccccaggacggcagcggcctgtggttcggctacggcctgctggcccccaccaagacccacgtggagatctag

SEQ ID NO: 101742 - DNA, 561 bp, Artificial Sequence
  Description of Artificial Sequence: Synthetic coding sequence
atgttcgtggcctacagcgtgatcggcctgaccctgtggagaagagccgtgcccggccaccaggcccacggcgccaacctgagacacctgcaggccatgaagaagttcgtgaagaccatggtgctggtggtgctgaccttcgccatctgctggctgccctaccacctgtacttcatcctgggcagcttccaggaggacatctactgccacaagttcatccagcaggtgtacctggccctgttctggctggccatgagcagcaccatgtacaaccccatcatctactgctgcctgaaccacagattcagaagcggcttcagactggccttcagatgctgcccctgggtgacccccaccaaggaggacaagctggagctgacccccaccaccagcctgagcaccagagtgaacagatgccacaccaaggagaccctgttcatggccggcgacaccgcccccagcgaggccaccagcggcgaggccggcagaccccaggacggcagcggcctgtggttcggctacggcctgctggcccccaccaagacccacgtggagatctag

SEQ ID NO: 101743 - DNA, 1398 bp, Artificial Sequence
  Description of Artificial Sequence: Synthetic coding sequence
atggccaccctgcccgccgccgagacctggatcgacggcggcggcggcgtgggcgccgacgccgtgaacctgaccgccagcctggccgccggcgccgccaccggcgccgtggagaccggctggctgcagctgctggaccaggccggcaacctgagcagcagccccagcgccctgggcctgcccgtggccagccccgcccccagccagccctgggccaacctgaccaaccagttcgtgcagcccagctggagaatcgccctgtggagcctggcctacggcgtggtggtggccgtggccgtgctgggcaacctgatcgtgatctggatcatcctggcccacaagagaatgagaaccgtgaccaactacttcctggtgaacctggccttcagcgacgccagcatggccgccttcaacaccctggtgaacttcatctacgccctgcacagcgagtggtacttcggcgccaactactgcagattccagaacttcttccccatcaccgccgtgttcgccagcatctacagcatgaccgccatcgccgtggacagatacatggccatcatcgaccccctgaagcccagactgagcgccaccgccaccaagatcgtgatcggcagcatctggatcctggccttcctgctggccttcccccagtgcctgtacagcaagaccaaggtgatgcccggcagaaccctgtgcttcgtgcagtggcccgagggccccaagcagcacttcacctaccacatcatcgtgatcatcctggtgtactgcttccccctgctgatcatgggcatcacctacaccatcgtgggcatcaccctgtggggcggcgagatccccggcgacacctgcgacaagtaccacgagcagctgaaggccaagagaaaggtggtgaagatgatgatcatcgtggtgatgaccttcgccatctgctggctgccctaccacatctacttcatcctgaccgccatctaccagcagctgaacagatggaagtacatccagcaggtgtacctggccagcttctggctggccatgagcagcaccatgtacaaccccatcatctactgctgcctgaacaagagattcagagccggcttcaagagagccttcagatggtgccccttcatcaaggtgagcagctacgacgagctggagctgaagaccaccagattccaccccaacagacagagcagcatgtacaccgtgaccagaatggagagcatgaccgtggtgttcgaccccaacgacgccgacaccaccagaagcagcagaaagaagagagccacccccagagaccccagcttcaacggctgcagcagaagaaacagcaagagcgccagcgccaccagcagcttcatcagcagcccctacaccagcgtggacgagtacagctag

SEQ ID NO: 101744 - DNA, 5682 bp, Artificial Sequence
  Description of Artificial Sequence: Synthetic coding sequence
atgggccccggctgcgacctgctgctgagaaccgccgccaccatcaccgccgccgccatcatgagcgacaccgacagcgacgaggacagcgccggcggcggccccttcagcctggccggcttcctgttcggcaacatcaacggcgccggccagctggagggcgagagcgtgctggacgacgagtgcaagaagcacctggccggcctgggcgccctgggcctgggcagcctgatcaccgagctgaccgccaacgaggagctgaccggcaccgacggcgccctggtgaacgacgagggctgggtgagaagcaccgaggacgccgtggactacagcgacatcaacgaggtggccgaggacgagagcagaagataccagcagaccatgggcagcctgcagcccctgtgccacagcgactacgacgaggacgactacgacgccgactgcgaggacatcgactgcaagctgatgcccccccccccccccccccccggccccatgaagaaggacaaggaccaggacagcatcaccggcgtgagcgagaacggcgagggcatcatcctgcccagcatcatcgcccccagcagcctggccagcgagaaggtggacttcagcagcagcagcgacagcgagagcgagatgggcccccaggaggccacccaggccgagagcgaggacggcaagctgaccctgcccctggccggcatcatgcagcacgacgccaccaagctgctgcccagcgtgaccgagctgttccccgagttcagacccggcaaggtgctgagattcctgagactgttcggccccggcaagaacgtgcccagcgtgtggagaagcgccagaagaaagagaaagaagaagcacagagagctgatccaggaggagcagatccaggaggtggagtgcagcgtggagagcgaggtgagccagaagagcctgtggaactacgactacgcccccccccccccccccgagcagtgcctgagcgacgacgagatcaccatgatggcccccgtggagagcaagttcagccagagcaccggcgacatcgacaaggtgaccgacaccaagcccagagtggccgagtggagatacggccccgccagactgtggtacgacatgctgggcgtgcccgaggacggcagcggcttcgactacggcttcaagctgagaaagaccgagcacgagcccgtgatcaagagcagaatgatcgaggagttcagaaagctggaggagaacaacggcaccgacctgctggccgacgagaacttcctgatggtgacccagctgcactgggaggacgacatcatctgggacggcgaggacgtgaagcacaagggcaccaagccccagagagccagcctggccggctggctgcccagcagcatgaccagaaacgccatggcctacaacgtgcagcagggcttcgccgccaccctggacgacgacaagccctggtacagcatcttccccatcgacaacgaggacctggtgtacggcagatgggaggacaacatcatctgggacgcccaggccatgcccagactgctggagccccccgtgctgaccctggaccccaacgacgagaacctgatcctggagatccccgacgagaaggaggaggccaccagcaacagccccagcaaggagagcaagaaggagagcagcctgaagaagagcagaatcctgctgggcaagaccggcgtgatcaaggaggagccccagcagaacatgagccagcccgaggtgaaggacccctggaacctgagcaacgacgagtactactaccccaagcagcagggcctgagaggcaccttcggcggcaacatcatccagcacagcatccccgccgtggagctgagacagcccttcttccccacccacatgggccccatcaagctgagacagttccacagaccccccctgaagaagtacagcttcggcgccctgagccagcccggcccccacagcgtgcagcccctgctgaagcacatcaagaagaaggccaagatgagagagcaggagagacaggccagcggcggcggcgagatgttcttcatgagaaccccccaggacctgaccggcaaggacggcgacctgatcctggccgagtacagcgaggagaacggccccctgatgatgcaggtgggcatggccaccaagatcaagaactactacaagagaaagcccggcaaggaccccggcgcccccgactgcaagtacggcgagaccgtgtactgccacaccagccccttcctgggcagcctgcaccccggccagctgctgcaggccttcgagaacaacctgttcagagcccccatctacctgcacaagatgcccgagaccgacttcctgatcatcagaaccagacagggctactacatcagagagctggtggacatcttcgtggtgggccagcagtgccccctgttcgaggtgcccggccccaacagcaagagagccaacacccacatcagagacttcctgcaggtgttcatctacagactgttctggaagagcaaggacagacccagaagaatcagaatggaggacatcaagaaggccttccccagccacagcgagagcagcatcagaaagagactgaagctgtgcgccgacttcaagagaaccggcatggacagcaactggtgggtgctgaagagcgacttcagactgcccaccgaggaggagatcagagccatggtgagccccgagcagtgctgcgcctactacagcatgatcgccgccgagcagagactgaaggacgccggctacggcgagaagagcttcttcgcccccgaggaggagaacgaggaggacttccagatgaagatcgacgacgaggtgagaaccgccccctggaacaccaccagagccttcatcgccgccatgaagggcaagtgcctgctggaggtgaccggcgtggccgaccccaccggctgcggcgagggcttcagctacgtgaagatccccaacaagcccacccagcagaaggacgacaaggagccccagcccgtgaagaagaccgtgaccggcaccgacgccgacctgagaagactgagcctgaagaacgccaagcagctgctgagaaagttcggcgtgcccgaggaggagatcaagaagctgagcagatgggaggtgatcgacgtggtgagaaccatgagcaccgagcaggccagaagcggcgagggccccatgagcaagttcgccagaggcagcagattcagcgtggccgagcaccaggagagatacaaggaggagtgccagagaatcttcgacctgcagaacaaggtgctgagcagcaccgaggtgctgagcaccgacaccgacagcagcagcgccgaggacagcgacttcgaggagatgggcaagaacatcgagaacatgctgcagaacaagaagaccagcagccagctgagcagagagagagaggagcaggagagaaaggagctgcagagaatgctgctggccgccggcagcgccgccagcggcaacaaccacagagacgacgacaccgccagcgtgaccagcctgaacagcagcgccaccggcagatgcctgaagatctacagaaccttcagagacgaggagggcaaggagtacgtgagatgcgagaccgtgagaaagcccgccgtgatcgacgcctacgtgagaatcagaaccaccaaggacgaggagttcatcagaaagttcgccctgttcgacgagcagcacagagaggagatgagaaaggagagaagaagaatccaggagcagctgagaagactgaagagaaaccaggagaaggagaagctgaagggcccccccgagaagaagcccaagaagatgaaggagagacccgacctgaagctgaagtgcggcgcctgcggcgccatcggccacatgagaaccaacaagttctgccccctgtactaccagaccaacgccccccccagcaaccccgtggccatgaccgaggagcaggaggaggagctggagaagaccgtgatccacaacgacaacgaggagctgatcaaggtggagggcaccaagatcgtgctgggcaagcagctgatcgagagcgccgacgaggtgagaagaaagagcctggtgctgaagttccccaagcagcagctgccccccaagaagaagagaagagtgggcaccaccgtgcactgcgactacctgaacagaccccacaagagcatccacagaagaagaaccgaccccatggtgaccctgagcagcatcctggagagcatcatcaacgacatgagagacctgcccaacacctaccccttccacacccccgtgaacgccaaggtggtgaaggactactacaagatcatcaccagacccatggacctgcagaccctgagagagaacgtgagaaagagactgtaccccagcagagaggagttcagagagcacctggagctgatcgtgaagaacagcgccacctacaacggccccaagcacagcctgacccagatcagccagagcatgctggacctgtgcgacgagaagctgaaggagaaggaggacaagctggccagactggagaaggccatcaaccccctgctggacgacgacgaccaggtggccttcagcttcatcctggacaacatcgtgacccagaagatgatggccgtgcccgacagctggcccttccaccaccccgtgaacaagaagttcgtgcccgactactacaaggtgatcgtgaaccccatggacctggagaccatcagaaagaacatcagcaagcacaagtaccagagcagagagagcttcctggacgacgtgaacctgatcctggccaacagcgtgaagtacaacggccccgagagccagtacaccaagaccgcccaggagatcgtgaacgtgtgctaccagaccctgaccgagtacgacgagcacctgacccagctggagaaggacatctgcaccgccaaggaggccgccctggaggaggccgagctggagagcctggaccccatgacccccggcccctacaccccccagccccccgacctgtacgacaccaacaccagcctgagcatgagcagagacgccagcgtgttccaggacgagagcaacatgagcgtgctggacatccccagcgccacccccgagaagcaggtgacccaggagggcgaggacggcgacggcgacctggccgacgaggaggagggcaccgtgcagcagccccaggccagcgtgctgtacgaggacctgctgatgagcgagggcgaggacgacgaggaggacgccggcagcgacgaggagggcgacaaccccttcagcgccatccagctgagcgagagcggcagcgacagcgacgtgggcagcggcggcatcagacccaagcagcccagaatgctgcaggagaacaccagaatggacatggagaacgaggagagcatgatgagctacgagggcgacggcggcgaggccagccacggcctggaggacagcaacatcagctacggcagctacgaggagcccgaccccaagagcaacacccaggacaccagcttcagcagcatcggcggctacgaggtgagcgaggaggaggaggacgaggaggaggaggagcagagaagcggccccagcgtgctgagccaggtgcacctgagcgaggacgaggaggacagcgaggacttccacagcatcgccggcgacagcgacctggacagcgacgagtag

SEQ ID NO: 101745 - DNA, 5619 bp, Artificial Sequence
  Description of Artificial Sequence: Synthetic coding sequence
atgggccccggctgcgacctgctgctgagaaccgccgccaccatcaccgccgccgccatcatgagcgacaccgacagcgacgaggacagcgccggcggcggccccttcagcctggccggcttcctgttcggcaacatcaacggcgccggccagctggagggcgagagcgtgctggacgacgagtgcaagaagcacctggccggcctgggcgccctgggcctgggcagcctgatcaccgagctgaccgccaacgaggagctgaccggcaccgacggcgccctggtgaacgacgagggctgggtgagaagcaccgaggacgccgtggactacagcgacatcaacgaggtggccgaggacgagagcagaagataccagcagaccatgggcagcctgcagcccctgtgccacagcgactacgacgaggacgactacgacgccgactgcgaggacatcgactgcaagctgatgcccccccccccccccccccccggccccatgaagaaggacaaggaccaggacagcatcaccggcgagaaggtggacttcagcagcagcagcgacagcgagagcgagatgggcccccaggaggccacccaggccgagagcgaggacggcaagctgaccctgcccctggccggcatcatgcagcacgacgccaccaagctgctgcccagcgtgaccgagctgttccccgagttcagacccggcaaggtgctgagattcctgagactgttcggccccggcaagaacgtgcccagcgtgtggagaagcgccagaagaaagagaaagaagaagcacagagagctgatccaggaggagcagatccaggaggtggagtgcagcgtggagagcgaggtgagccagaagagcctgtggaactacgactacgcccccccccccccccccgagcagtgcctgagcgacgacgagatcaccatgatggcccccgtggagagcaagttcagccagagcaccggcgacatcgacaaggtgaccgacaccaagcccagagtggccgagtggagatacggccccgccagactgtggtacgacatgctgggcgtgcccgaggacggcagcggcttcgactacggcttcaagctgagaaagaccgagcacgagcccgtgatcaagagcagaatgatcgaggagttcagaaagctggaggagaacaacggcaccgacctgctggccgacgagaacttcctgatggtgacccagctgcactgggaggacgacatcatctgggacggcgaggacgtgaagcacaagggcaccaagccccagagagccagcctggccggctggctgcccagcagcatgaccagaaacgccatggcctacaacgtgcagcagggcttcgccgccaccctggacgacgacaagccctggtacagcatcttccccatcgacaacgaggacctggtgtacggcagatgggaggacaacatcatctgggacgcccaggccatgcccagactgctggagccccccgtgctgaccctggaccccaacgacgagaacctgatcctggagatccccgacgagaaggaggaggccaccagcaacagccccagcaaggagagcaagaaggagagcagcctgaagaagagcagaatcctgctgggcaagaccggcgtgatcaaggaggagccccagcagaacatgagccagcccgaggtgaaggacccctggaacctgagcaacgacgagtactactaccccaagcagcagggcctgagaggcaccttcggcggcaacatcatccagcacagcatccccgccgtggagctgagacagcccttcttccccacccacatgggccccatcaagctgagacagttccacagaccccccctgaagaagtacagcttcggcgccctgagccagcccggcccccacagcgtgcagcccctgctgaagcacatcaagaagaaggccaagatgagagagcaggagagacaggccagcggcggcggcgagatgttcttcatgagaaccccccaggacctgaccggcaaggacggcgacctgatcctggccgagtacagcgaggagaacggccccctgatgatgcaggtgggcatggccaccaagatcaagaactactacaagagaaagcccggcaaggaccccggcgcccccgactgcaagtacggcgagaccgtgtactgccacaccagccccttcctgggcagcctgcaccccggccagctgctgcaggccttcgagaacaacctgttcagagcccccatctacctgcacaagatgcccgagaccgacttcctgatcatcagaaccagacagggctactacatcagagagctggtggacatcttcgtggtgggccagcagtgccccctgttcgaggtgcccggccccaacagcaagagagccaacacccacatcagagacttcctgcaggtgttcatctacagactgttctggaagagcaaggacagacccagaagaatcagaatggaggacatcaagaaggccttccccagccacagcgagagcagcatcagaaagagactgaagctgtgcgccgacttcaagagaaccggcatggacagcaactggtgggtgctgaagagcgacttcagactgcccaccgaggaggagatcagagccatggtgagccccgagcagtgctgcgcctactacagcatgatcgccgccgagcagagactgaaggacgccggctacggcgagaagagcttcttcgcccccgaggaggagaacgaggaggacttccagatgaagatcgacgacgaggtgagaaccgccccctggaacaccaccagagccttcatcgccgccatgaagggcaagtgcctgctggaggtgaccggcgtggccgaccccaccggctgcggcgagggcttcagctacgtgaagatccccaacaagcccacccagcagaaggacgacaaggagccccagcccgtgaagaagaccgtgaccggcaccgacgccgacctgagaagactgagcctgaagaacgccaagcagctgctgagaaagttcggcgtgcccgaggaggagatcaagaagctgagcagatgggaggtgatcgacgtggtgagaaccatgagcaccgagcaggccagaagcggcgagggccccatgagcaagttcgccagaggcagcagattcagcgtggccgagcaccaggagagatacaaggaggagtgccagagaatcttcgacctgcagaacaaggtgctgagcagcaccgaggtgctgagcaccgacaccgacagcagcagcgccgaggacagcgacttcgaggagatgggcaagaacatcgagaacatgctgcagaacaagaagaccagcagccagctgagcagagagagagaggagcaggagagaaaggagctgcagagaatgctgctggccgccggcagcgccgccagcggcaacaaccacagagacgacgacaccgccagcgtgaccagcctgaacagcagcgccaccggcagatgcctgaagatctacagaaccttcagagacgaggagggcaaggagtacgtgagatgcgagaccgtgagaaagcccgccgtgatcgacgcctacgtgagaatcagaaccaccaaggacgaggagttcatcagaaagttcgccctgttcgacgagcagcacagagaggagatgagaaaggagagaagaagaatccaggagcagctgagaagactgaagagaaaccaggagaaggagaagctgaagggcccccccgagaagaagcccaagaagatgaaggagagacccgacctgaagctgaagtgcggcgcctgcggcgccatcggccacatgagaaccaacaagttctgccccctgtactaccagaccaacgccccccccagcaaccccgtggccatgaccgaggagcaggaggaggagctggagaagaccgtgatccacaacgacaacgaggagctgatcaaggtggagggcaccaagatcgtgctgggcaagcagctgatcgagagcgccgacgaggtgagaagaaagagcctggtgctgaagttccccaagcagcagctgccccccaagaagaagagaagagtgggcaccaccgtgcactgcgactacctgaacagaccccacaagagcatccacagaagaagaaccgaccccatggtgaccctgagcagcatcctggagagcatcatcaacgacatgagagacctgcccaacacctaccccttccacacccccgtgaacgccaaggtggtgaaggactactacaagatcatcaccagacccatggacctgcagaccctgagagagaacgtgagaaagagactgtaccccagcagagaggagttcagagagcacctggagctgatcgtgaagaacagcgccacctacaacggccccaagcacagcctgacccagatcagccagagcatgctggacctgtgcgacgagaagctgaaggagaaggaggacaagctggccagactggagaaggccatcaaccccctgctggacgacgacgaccaggtggccttcagcttcatcctggacaacatcgtgacccagaagatgatggccgtgcccgacagctggcccttccaccaccccgtgaacaagaagttcgtgcccgactactacaaggtgatcgtgaaccccatggacctggagaccatcagaaagaacatcagcaagcacaagtaccagagcagagagagcttcctggacgacgtgaacctgatcctggccaacagcgtgaagtacaacggccccgagagccagtacaccaagaccgcccaggagatcgtgaacgtgtgctaccagaccctgaccgagtacgacgagcacctgacccagctggagaaggacatctgcaccgccaaggaggccgccctggaggaggccgagctggagagcctggaccccatgacccccggcccctacaccccccagccccccgacctgtacgacaccaacaccagcctgagcatgagcagagacgccagcgtgttccaggacgagagcaacatgagcgtgctggacatccccagcgccacccccgagaagcaggtgacccaggagggcgaggacggcgacggcgacctggccgacgaggaggagggcaccgtgcagcagccccaggccagcgtgctgtacgaggacctgctgatgagcgagggcgaggacgacgaggaggacgccggcagcgacgaggagggcgacaaccccttcagcgccatccagctgagcgagagcggcagcgacagcgacgtgggcagcggcggcatcagacccaagcagcccagaatgctgcaggagaacaccagaatggacatggagaacgaggagagcatgatgagctacgagggcgacggcggcgaggccagccacggcctggaggacagcaacatcagctacggcagctacgaggagcccgaccccaagagcaacacccaggacaccagcttcagcagcatcggcggctacgaggtgagcgaggaggaggaggacgaggaggaggaggagcagagaagcggccccagcgtgctgagccaggtgcacctgagcgaggacgaggaggacagcgaggacttccacagcatcgccggcgacagcgacctggacagcgacgagtag

SEQ ID NO: 101746 - DNA, 1632 bp, Artificial Sequence
  Description of Artificial Sequence: Synthetic coding sequence
atgaccgaggagcaggaggaggagctggagaagaccgtgatccacaacgacaacgaggagctgatcaaggtggagggcaccaagatcgtgctgggcaagcagctgatcgagagcgccgacgaggtgagaagaaagagcctggtgctgaagttccccaagcagcagctgccccccaagaagaagagaagagtgggcaccaccgtgcactgcgactacctgaacagaccccacaagagcatccacagaagaagaaccgaccccatggtgaccctgagcagcatcctggagagcatcatcaacgacatgagagacctgcccaacacctaccccttccacacccccgtgaacgccaaggtggtgaaggactactacaagatcatcaccagacccatggacctgcagaccctgagagagaacgtgagaaagagactgtaccccagcagagaggagttcagagagcacctggagctgatcgtgaagaacagcgccacctacaacggccccaagcacagcctgacccagatcagccagagcatgctggacctgtgcgacgagaagctgaaggagaaggaggacaagctggccagactggagaaggccatcaaccccctgctggacgacgacgaccaggtggccttcagcttcatcctggacaacatcgtgacccagaagatgatggccgtgcccgacagctggcccttccaccaccccgtgaacaagaagttcgtgcccgactactacaaggtgatcgtgaaccccatggacctggagaccatcagaaagaacatcagcaagcacaagtaccagagcagagagagcttcctggacgacgtgaacctgatcctggccaacagcgtgaagtacaacggccccgagagccagtacaccaagaccgcccaggagatcgtgaacgtgtgctaccagaccctgaccgagtacgacgagcacctgacccagctggagaaggacatctgcaccgccaaggaggccgccctggaggaggccgagctggagagcctggaccccatgacccccggcccctacaccccccaggccaagccccccgacctgtacgacaccaacaccagcctgagcatgagcagagacgccagcgtgttccaggacgagagcaacatgagcgtgctggacatccccagcgccacccccgagaagcaggtgacccagatgagacagggcagaggcagactgggcgaggaggacagcgacgtggacatcgagggctacgacgacgaggaggaggacggcaagcccaagacccccgcccccgagggcgaggacggcgacggcgacctggccgacgaggaggagggcaccgtgcagcagccccaggccagcgtgctgtacgaggacctgctgatgagcgagggcgaggacgacgaggaggacgccggcagcgacgaggagggcgacaaccccttcagcgccatccagctgagcgagagcggcagcgacagcgacgtgggcagcggcggcatcagacccaagcagcccagaatgctgcaggagaacaccagaatggacatggagaacgaggagagcatgatgagctacgagggcgacggcggcgaggccagccacggcctggaggacagcaacatcagccaccagtag

SEQ ID NO: 101747 - DNA, 5688 bp, Artificial Sequence
  Description of Artificial Sequence: Synthetic coding sequence
atgggccccggctgcgacctgctgctgagaaccgccgccaccatcaccgccgccgccatcatgagcgacaccgacagcgacgaggacagcgccggcggcggccccttcagcctggccggcttcctgttcggcaacatcaacggcgccggccagctggagggcgagagcgtgctggacgacgagtgcaagaagcacctggccggcctgggcgccctgggcctgggcagcctgatcaccgagctgaccgccaacgaggagctgaccggcaccgacggcgccctggtgaacgacgagggctgggtgagaagcaccgaggacgccgtggactacagcgacatcaacgaggtggccgaggacgagagcagaagataccagcagaccatgggcagcctgcagcccctgtgccacagcgactacgacgaggacgactacgacgccgactgcgaggacatcgactgcaagctgatgcccccccccccccccccccccggccccatgaagaaggacaaggaccaggacagcatcaccggcgtgagcgagaacggcgagggcatcatcctgcccagcatcatcgcccccagcagcctggccagcgagaaggtggacttcagcagcagcagcgacagcgagagcgagatgggcccccaggaggccacccaggccgagagcgaggacggcaagctgaccctgcccctggccggcatcatgcagcacgacgccaccaagctgctgcccagcgtgaccgagctgttccccgagttcagacccggcaaggtgctgagattcctgagactgttcggccccggcaagaacgtgcccagcgtgtggagaagcgccagaagaaagagaaagaagaagcacagagagctgatccaggaggagcagatccaggaggtggagtgcagcgtggagagcgaggtgagccagaagagcctgtggaactacgactacgcccccccccccccccccgagcagtgcctgagcgacgacgagatcaccatgatggcccccgtggagagcaagttcagccagagcaccggcgacatcgacaaggtgaccgacaccaagcccagagtggccgagtggagatacggccccgccagactgtggtacgacatgctgggcgtgcccgaggacggcagcggcttcgactacggcttcaagctgagaaagaccgagcacgagcccgtgatcaagagcagaatgatcgaggagttcagaaagctggaggagaacaacggcaccgacctgctggccgacgagaacttcctgatggtgacccagctgcactgggaggacgacatcatctgggacggcgaggacgtgaagcacaagggcaccaagccccagagagccagcctggccggctggctgcccagcagcatgaccagaaacgccatggcctacaacgtgcagcagggcttcgccgccaccctggacgacgacaagccctggtacagcatcttccccatcgacaacgaggacctggtgtacggcagatgggaggacaacatcatctgggacgcccaggccatgcccagactgctggagccccccgtgctgaccctggaccccaacgacgagaacctgatcctggagatccccgacgagaaggaggaggccaccagcaacagccccagcaaggagagcaagaaggagagcagcctgaagaagagcagaatcctgctgggcaagaccggcgtgatcaaggaggagccccagcagaacatgagccagcccgaggtgaaggacccctggaacctgagcaacgacgagtactactaccccaagcagcagggcctgagaggcaccttcggcggcaacatcatccagcacagcatccccgccgtggagctgagacagcccttcttccccacccacatgggccccatcaagctgagacagttccacagaccccccctgaagaagtacagcttcggcgccctgagccagcccggcccccacagcgtgcagcccctgctgaagcacatcaagaagaaggccaagatgagagagcaggagagacaggccagcggcggcggcgagatgttcttcatgagaaccccccaggacctgaccggcaaggacggcgacctgatcctggccgagtacagcgaggagaacggccccctgatgatgcaggtgggcatggccaccaagatcaagaactactacaagagaaagcccggcaaggaccccggcgcccccgactgcaagtacggcgagaccgtgtactgccacaccagccccttcctgggcagcctgcaccccggccagctgctgcaggccttcgagaacaacctgttcagagcccccatctacctgcacaagatgcccgagaccgacttcctgatcatcagaaccagacagggctactacatcagagagctggtggacatcttcgtggtgggccagcagtgccccctgttcgaggtgcccggccccaacagcaagagagccaacacccacatcagagacttcctgcaggtgttcatctacagactgttctggaagagcaaggacagacccagaagaatcagaatggaggacatcaagaaggccttccccagccacagcgagagcagcatcagaaagagactgaagctgtgcgccgacttcaagagaaccggcatggacagcaactggtgggtgctgaagagcgacttcagactgcccaccgaggaggagatcagagccatggtgagccccgagcagtgctgcgcctactacagcatgatcgccgccgagcagagactgaaggacgccggctacggcgagaagagcttcttcgcccccgaggaggagaacgaggaggacttccagatgaagatcgacgacgaggtgagaaccgccccctggaacaccaccagagccttcatcgccgccatgaagggcaagtgcctgctggaggtgaccggcgtggccgaccccaccggctgcggcgagggcttcagctacgtgaagatccccaacaagcccacccagcagaaggacgacaaggagccccagcccgtgaagaagaccgtgaccggcaccgacgccgacctgagaagactgagcctgaagaacgccaagcagctgctgagaaagttcggcgtgcccgaggaggagatcaagaagctgagcagatgggaggtgatcgacgtggtgagaaccatgagcaccgagcaggccagaagcggcgagggccccatgagcaagttcgccagaggcagcagattcagcgtggccgagcaccaggagagatacaaggaggagtgccagagaatcttcgacctgcagaacaaggtgctgagcagcaccgaggtgctgagcaccgacaccgacagcagcagcgccgaggacagcgacttcgaggagatgggcaagaacatcgagaacatgctgcagaacaagaagaccagcagccagctgagcagagagagagaggagcaggagagaaaggagctgcagagaatgctgctggccgccggcagcgccgccagcggcaacaaccacagagacgacgacaccgccagcgtgaccagcctgaacagcagcgccaccggcagatgcctgaagatctacagaaccttcagagacgaggagggcaaggagtacgtgagatgcgagaccgtgagaaagcccgccgtgatcgacgcctacgtgagaatcagaaccaccaaggacgaggagttcatcagaaagttcgccctgttcgacgagcagcacagagaggagatgagaaaggagagaagaagaatccaggagcagctgagaagactgaagagaaaccaggagaaggagaagctgaagggcccccccgagaagaagcccaagaagatgaaggagagacccgacctgaagctgaagtgcggcgcctgcggcgccatcggccacatgagaaccaacaagttctgccccctgtactaccagaccaacgccccccccagcaaccccgtggccatgaccgaggagcaggaggaggagctggagaagaccgtgatccacaacgacaacgaggagctgatcaaggtggagggcaccaagatcgtgctgggcaagcagctgatcgagagcgccgacgaggtgagaagaaagagcctggtgctgaagttccccaagcagcagctgccccccaagaagaagagaagagtgggcaccaccgtgcactgcgactacctgaacagaccccacaagagcatccacagaagaagaaccgaccccatggtgaccctgagcagcatcctggagagcatcatcaacgacatgagagacctgcccaacacctaccccttccacacccccgtgaacgccaaggtggtgaaggactactacaagatcatcaccagacccatggacctgcagaccctgagagagaacgtgagaaagagactgtaccccagcagagaggagttcagagagcacctggagctgatcgtgaagaacagcgccacctacaacggccccaagcacagcctgacccagatcagccagagcatgctggacctgtgcgacgagaagctgaaggagaaggaggacaagctggccagactggagaaggccatcaaccccctgctggacgacgacgaccaggtggccttcagcttcatcctggacaacatcgtgacccagaagatgatggccgtgcccgacagctggcccttccaccaccccgtgaacaagaagttcgtgcccgactactacaaggtgatcgtgaaccccatggacctggagaccatcagaaagaacatcagcaagcacaagtaccagagcagagagagcttcctggacgacgtgaacctgatcctggccaacagcgtgaagtacaacggccccgagagccagtacaccaagaccgcccaggagatcgtgaacgtgtgctaccagaccctgaccgagtacgacgagcacctgacccagctggagaaggacatctgcaccgccaaggaggccgccctggaggaggccgagctggagagcctggaccccatgacccccggcccctacaccccccaggccaagccccccgacctgtacgacaccaacaccagcctgagcatgagcagagacgccagcgtgttccaggacgagagcaacatgagcgtgctggacatccccagcgccacccccgagaagcaggtgacccaggagggcgaggacggcgacggcgacctggccgacgaggaggagggcaccgtgcagcagccccaggccagcgtgctgtacgaggacctgctgatgagcgagggcgaggacgacgaggaggacgccggcagcgacgaggagggcgacaaccccttcagcgccatccagctgagcgagagcggcagcgacagcgacgtgggcagcggcggcatcagacccaagcagcccagaatgctgcaggagaacaccagaatggacatggagaacgaggagagcatgatgagctacgagggcgacggcggcgaggccagccacggcctggaggacagcaacatcagctacggcagctacgaggagcccgaccccaagagcaacacccaggacaccagcttcagcagcatcggcggctacgaggtgagcgaggaggaggaggacgaggaggaggaggagcagagaagcggccccagcgtgctgagccaggtgcacctgagcgaggacgaggaggacagcgaggacttccacagcatcgccggcgacagcgacctggacagcgacgagtag

SEQ ID NO: 101748 - DNA, 5721 bp, Artificial Sequence
  Description of Artificial Sequence: Synthetic coding sequence
atgggccccggctgcgacctgctgctgagaaccgccgccaccatcaccgccgccgccatcatgagcgacaccgacagcgacgaggacagcgccggcggcggccccttcagcctggccggcttcctgttcggcaacatcaacggcgccggccagctggagggcgagagcgtgctggacgacgagtgcaagaagcacctggccggcctgggcgccctgggcctgggcagcctgatcaccgagctgaccgccaacgaggagctgaccggcaccgacggcgccctggtgaacgacgagggctgggtgagaagcaccgaggacgccgtggactacagcgacatcaacgaggtggccgaggacgagagcagaagataccagcagaccatgggcagcctgcagcccctgtgccacagcgactacgacgaggacgactacgacgccgactgcgaggacatcgactgcaagctgatgcccccccccccccccccccccggccccatgaagaaggacaaggaccaggacagcatcaccggcgagaaggtggacttcagcagcagcagcgacagcgagagcgagatgggcccccaggaggccacccaggccgagagcgaggacggcaagctgaccctgcccctggccggcatcatgcagcacgacgccaccaagctgctgcccagcgtgaccgagctgttccccgagttcagacccggcaaggtgctgagattcctgagactgttcggccccggcaagaacgtgcccagcgtgtggagaagcgccagaagaaagagaaagaagaagcacagagagctgatccaggaggagcagatccaggaggtggagtgcagcgtggagagcgaggtgagccagaagagcctgtggaactacgactacgcccccccccccccccccgagcagtgcctgagcgacgacgagatcaccatgatggcccccgtggagagcaagttcagccagagcaccggcgacatcgacaaggtgaccgacaccaagcccagagtggccgagtggagatacggccccgccagactgtggtacgacatgctgggcgtgcccgaggacggcagcggcttcgactacggcttcaagctgagaaagaccgagcacgagcccgtgatcaagagcagaatgatcgaggagttcagaaagctggaggagaacaacggcaccgacctgctggccgacgagaacttcctgatggtgacccagctgcactgggaggacgacatcatctgggacggcgaggacgtgaagcacaagggcaccaagccccagagagccagcctggccggctggctgcccagcagcatgaccagaaacgccatggcctacaacgtgcagcagggcttcgccgccaccctggacgacgacaagccctggtacagcatcttccccatcgacaacgaggacctggtgtacggcagatgggaggacaacatcatctgggacgcccaggccatgcccagactgctggagccccccgtgctgaccctggaccccaacgacgagaacctgatcctggagatccccgacgagaaggaggaggccaccagcaacagccccagcaaggagagcaagaaggagagcagcctgaagaagagcagaatcctgctgggcaagaccggcgtgatcaaggaggagccccagcagaacatgagccagcccgaggtgaaggacccctggaacctgagcaacgacgagtactactaccccaagcagcagggcctgagaggcaccttcggcggcaacatcatccagcacagcatccccgccgtggagctgagacagcccttcttccccacccacatgggccccatcaagctgagacagttccacagaccccccctgaagaagtacagcttcggcgccctgagccagcccggcccccacagcgtgcagcccctgctgaagcacatcaagaagaaggccaagatgagagagcaggagagacaggccagcggcggcggcgagatgttcttcatgagaaccccccaggacctgaccggcaaggacggcgacctgatcctggccgagtacagcgaggagaacggccccctgatgatgcaggtgggcatggccaccaagatcaagaactactacaagagaaagcccggcaaggaccccggcgcccccgactgcaagtacggcgagaccgtgtactgccacaccagccccttcctgggcagcctgcaccccggccagctgctgcaggccttcgagaacaacctgttcagagcccccatctacctgcacaagatgcccgagaccgacttcctgatcatcagaaccagacagggctactacatcagagagctggtggacatcttcgtggtgggccagcagtgccccctgttcgaggtgcccggccccaacagcaagagagccaacacccacatcagagacttcctgcaggtgttcatctacagactgttctggaagagcaaggacagacccagaagaatcagaatggaggacatcaagaaggccttccccagccacagcgagagcagcatcagaaagagactgaagctgtgcgccgacttcaagagaaccggcatggacagcaactggtgggtgctgaagagcgacttcagactgcccaccgaggaggagatcagagccatggtgagccccgagcagtgctgcgcctactacagcatgatcgccgccgagcagagactgaaggacgccggctacggcgagaagagcttcttcgcccccgaggaggagaacgaggaggacttccagatgaagatcgacgacgaggtgagaaccgccccctggaacaccaccagagccttcatcgccgccatgaagggcaagtgcctgctggaggtgaccggcgtggccgaccccaccggctgcggcgagggcttcagctacgtgaagatccccaacaagcccacccagcagaaggacgacaaggagccccagcccgtgaagaagaccgtgaccggcaccgacgccgacctgagaagactgagcctgaagaacgccaagcagctgctgagaaagttcggcgtgcccgaggaggagatcaagaagctgagcagatgggaggtgatcgacgtggtgagaaccatgagcaccgagcaggccagaagcggcgagggccccatgagcaagttcgccagaggcagcagattcagcgtggccgagcaccaggagagatacaaggaggagtgccagagaatcttcgacctgcagaacaaggtgctgagcagcaccgaggtgctgagcaccgacaccgacagcagcagcgccgaggacagcgacttcgaggagatgggcaagaacatcgagaacatgctgcagaacaagaagaccagcagccagctgagcagagagagagaggagcaggagagaaaggagctgcagagaatgctgctggccgccggcagcgccgccagcggcaacaaccacagagacgacgacaccgccagcgtgaccagcctgaacagcagcgccaccggcagatgcctgaagatctacagaaccttcagagacgaggagggcaaggagtacgtgagatgcgagaccgtgagaaagcccgccgtgatcgacgcctacgtgagaatcagaaccaccaaggacgaggagttcatcagaaagttcgccctgttcgacgagcagcacagagaggagatgagaaaggagagaagaagaatccaggagcagctgagaagactgaagagaaaccaggagaaggagaagctgaagggcccccccgagaagaagcccaagaagatgaaggagagacccgacctgaagctgaagtgcggcgcctgcggcgccatcggccacatgagaaccaacaagttctgccccctgtactaccagaccaacgccccccccagcaaccccgtggccatgaccgaggagcaggaggaggagctggagaagaccgtgatccacaacgacaacgaggagctgatcaaggtggagggcaccaagatcgtgctgggcaagcagctgatcgagagcgccgacgaggtgagaagaaagagcctggtgctgaagttccccaagcagcagctgccccccaagaagaagagaagagtgggcaccaccgtgcactgcgactacctgaacagaccccacaagagcatccacagaagaagaaccgaccccatggtgaccctgagcagcatcctggagagcatcatcaacgacatgagagacctgcccaacacctaccccttccacacccccgtgaacgccaaggtggtgaaggactactacaagatcatcaccagacccatggacctgcagaccctgagagagaacgtgagaaagagactgtaccccagcagagaggagttcagagagcacctggagctgatcgtgaagaacagcgccacctacaacggccccaagcacagcctgacccagatcagccagagcatgctggacctgtgcgacgagaagctgaaggagaaggaggacaagctggccagactggagaaggccatcaaccccctgctggacgacgacgaccaggtggccttcagcttcatcctggacaacatcgtgacccagaagatgatggccgtgcccgacagctggcccttccaccaccccgtgaacaagaagttcgtgcccgactactacaaggtgatcgtgaaccccatggacctggagaccatcagaaagaacatcagcaagcacaagtaccagagcagagagagcttcctggacgacgtgaacctgatcctggccaacagcgtgaagtacaacggccccgagagccagtacaccaagaccgcccaggagatcgtgaacgtgtgctaccagaccctgaccgagtacgacgagcacctgacccagctggagaaggacatctgcaccgccaaggaggccgccctggaggaggccgagctggagagcctggaccccatgacccccggcccctacaccccccagccccccgacctgtacgacaccaacaccagcctgagcatgagcagagacgccagcgtgttccaggacgagagcaacatgagcgtgctggacatccccagcgccacccccgagaagcaggtgacccagatgagacagggcagaggcagactgggcgaggaggacagcgacgtggacatcgagggctacgacgacgaggaggaggacggcaagcccaagacccccgcccccgagggcgaggacggcgacggcgacctggccgacgaggaggagggcaccgtgcagcagccccaggccagcgtgctgtacgaggacctgctgatgagcgagggcgaggacgacgaggaggacgccggcagcgacgaggagggcgacaaccccttcagcgccatccagctgagcgagagcggcagcgacagcgacgtgggcagcggcggcatcagacccaagcagcccagaatgctgcaggagaacaccagaatggacatggagaacgaggagagcatgatgagctacgagggcgacggcggcgaggccagccacggcctggaggacagcaacatcagctacggcagctacgaggagcccgaccccaagagcaacacccaggacaccagcttcagcagcatcggcggctacgaggtgagcgaggaggaggaggacgaggaggaggaggagcagagaagcggccccagcgtgctgagccaggtgcacctgagcgaggacgaggaggacagcgaggacttccacagcatcgccggcgacagcgacctggacagcgacgagtag

SEQ ID NO: 101749 - DNA, 897 bp, Artificial Sequence
  Description of Artificial Sequence: Synthetic coding sequence
atgaccgaggagcaggaggaggagctggagaagaccgtgatccacaacgacaacgaggagctgatcaaggtggagggcaccaagatcgtgctgggcaagcagctgatcgagagcgccgacgaggtgagaagaaagagcctggtgctgaagttccccaagcagcagctgccccccaagaagaagagaagagtgggcaccaccgtgcactgcgactacctgaacagaccccacaagagcatccacagaagaagaaccgaccccatggtgaccctgagcagcatcctggagagcatcatcaacgacatgagagacctgcccaacacctaccccttccacacccccgtgaacgccaaggtggtgaaggactactacaagatcatcaccagacccatggacctgcagaccctgagagagaacgtgagaaagagactgtaccccagcagagaggagttcagagagcacctggagctgatcgtgaagaacagcgccacctacaacggccccaagcacagcctgacccagatcagccagagcatgctggacctgtgcgacgagaagctgaaggagaaggaggacaagctggccagactggagaaggccatcaaccccctgctggacgacgacgaccaggtggccttcagcttcatcctggacaacatcgtgacccagaagatgatggccgtgcccgacagctggcccttccaccaccccgtgaacaagaagttcgtgcccgactactacaaggtgatcgtgaaccccatggacctggagaccatcagaaagaacatcagcaagcacaagtaccagagcagagagagcttcctggacgacgtgaacctgatcctggccaacagcgtgaagtacaacggctacatgtgcaccacctgcagattctag

SEQ ID NO: 101750 - DNA, 657 bp, Artificial Sequence
  Description of Artificial Sequence: Synthetic coding sequence
atgagctgcagcggcagcggcgccgaccccgaggccgcccccgccagcgccgccagcgcccccggccccgccccccccgtgagcgcccccgccgccctgcccagcagcaccgccgccgagaacaaggccagccccgccggcaccgccggcggccccggcgccggcgccgccgccggcggcaccggccccctggccgccagagccggcgagcccgccgagagaagaggcgccgcccccgtgagcgccggcggcgccgccccccccgagggcgccatcagcaacggcgtgtacgtgctgcccagcgccgccaacggcgacgtgaagcccgtggtgagcagcacccccctggtggacttcctgatgcagctggaggactacacccccaccatccccgacgccgtgaccggctactacctgaacagagccggcttcgaggccagcgaccccagaatcatcagactgatcagcctggccgcccagaagttcatcagcgacatcgccaacgacgccctgcagcactgcaagatgaagggcaccgccagcggcagcagcagaagcaagagcaaggacagaaagtacaccctgaccatggaggacctgacccccgccctgagcgagtacggcatcaacgtgaagaagccccactacttcacctag

SEQ ID NO: 101751 - DNA, 636 bp, Artificial Sequence
  Description of Artificial Sequence: Synthetic coding sequence
atggacgacgcccacgagagccccagcgacaagggcggcgagaccggcgagagcgacgagaccgccgccgtgcccggcgaccccggcgccaccgacaccgacggcatccccgaggagaccgacggcgacgccgacgtggacctgaaggaggccgccgccgaggagggcgagctggagagccaggacgtgagcgacctgaccaccgtggagagagaggacagcagcctgctgaaccccgccgccaagaagctgaagatcgacaccaaggagaagaaggagaagaagcagaaggtggacgaggacgagatccagaagatgcagatcctggtgagcagcttcagcgaggagcagctgaacagatacgagatgtacagaagaagcgccttccccaaggccgccatcaagagactgatccagagcatcaccggcaccagcgtgagccagaacgtggtgatcgccatgagcggcatcagcaaggtgttcgtgggcgaggtggtggaggaggccctggacgtgtgcgagaagtggggcgagatgccccccctgcagcccaagcacatgagagaggccgtgagaagactgaagagcaagggccagatccccaacagcaagcacaagaagatcatcttcttctag

SEQ ID NO: 101752 - DNA, 465 bp, Artificial Sequence
  Description of Artificial Sequence: Synthetic coding sequence
atggacgacgcccacgagagccccagcgacaagggcggcgagaccggcgagagcgacgagaccgccgccgtgcccggcgaccccggcgccaccgacaccgacggcatccccgaggagaccgacggcgacgccgacgtggacctgaaggaggccgccgccgaggagggcgagctggagagccaggacgtgagcgacctgaccaccgtggagagagaggacagcagcctgctgaaccccgccgccaagaagctgaagatcgacaccaaggagaagaaggagaagaagcagaaggtggacgaggacgagatccagaagatgcagatcctggtgagcagcttcagcgaggagcagctgaacagatacgagatgtacagaagaagcgccttccccaaggccgccatcaagagacactggatgtgcgtgagaagcggcgagaagtgccaccactacaaccccaacatctag

SEQ ID NO: 101753 - DNA, 486 bp, Artificial Sequence
  Description of Artificial Sequence: Synthetic coding sequence
atgaaccagttcggccccagcgccctgatcaacctgagcaacttcagcagcatcaagcccgagcccgccagcacccccccccagggcagcatggccaacagcaccgccgtggtgaagatccccggcacccccggcgccggcggcagactgagccccgagaacaaccaggtgctgaccaagaagaagctgcaggacctggtgagagaggtggaccccaacgagcagctggacgaggacgtggaggagatgctgctgcagatcgccgacgacttcatcgagagcgtggtgaccgccgcctgccagctggccagacacagaaagagcagcaccctggaggtgaaggacgtgcagctgcacctggagagacagtggaacatgtggatccccggcttcggcagcgaggagatcagaccctacaagaaggcctgcaccaccgaggcccacaagcagagaatggccctgatcagaaagaccaccaagaagtag

SEQ ID NO: 101754 - DNA, 486 bp, Artificial Sequence; identical to SEQ ID NO: 101753
  Description of Artificial Sequence: Synthetic coding sequence

SEQ ID NO: 101755 - DNA, 1779 bp, Artificial Sequence
  Description of Artificial Sequence: Synthetic coding sequence
atgagcgacagcggcagctacggccagagcggcggcgagcagcagagctacagcacctacggcaaccccggcagccagggctacggccaggccagccagagctacagcggctacggccagaccaccgacagcagctacggccagaactacagcggctacagcagctacggccagagccagagcggctacagccagagctacggcggctacgagaaccagaagcagagcagctacagccagcagccctacaacaaccagggccagcagcagaacatggagagcagcggcagccagggcggcagagcccccagctacgaccagcccgactacggccagcaggacagctacgaccagcagagcggctacgaccagcaccagggcagctacgacgagcagagcaactacgaccagcagcacgacagctacagccagaaccagcagagctaccacagccagagagagaactacagccaccacacccaggacgacagaagagacgtgagcagatacggcgaggacaacagaggctacggcggcagccagggcggcggcagaggcagaggcggctacgacaaggacggcagaggccccatgaccggcagcagcggcggcgacagaggcggcttcaagaacttcggcggccacagagactacggccccagaaccgacgccgacagcgagagcgacaacagcgacaacaacaccatcttcgtgcagggcctgggcgagggcgtgagcaccgaccaggtgggcgagttcttcaagcagatcggcatcatcaagaccaacaagaagaccggcaagcccatgatcaacctgtacaccgacaaggacaccggcaagcccaagggcgaggccaccgtgagcttcgacgacccccccagcgccaaggccgccatcgactggttcgacggcaaggagttccacggcaacatcatcaaggtgagcttcgccaccagaagacccgagttcatgagaggcggcggcagcggcggcggcagaagaggcagaggcggctacagaggcagaggcggcttccagggcagaggcggcgaccccaagagcggcgactgggtgtgccccaaccccagctgcggcaacatgaacttcgccagaagaaacagctgcaaccagtgcaacgagcccagacccgaggacagcagacccagcggcggcgacttcagaggcagaggctacggcggcgagagaggctacagaggcagaggcggcagaggcggcgacagaggcggctacggcggcgacagaagcggcggcggctacggcggcgacagaagcagcggcggcggctacagcggcgacagaagcggcggcggctacggcggcgacagaagcggcggcggctacggcggcgacagaggcggcggctacggcggcgacagaggcggcggctacggcggcgacagaggcggcggctacggcggcgacagaggcggctacggcggcgacagaggcggcggctacggcggcgacagaggcggctacggcggcgacagaggcggctacggcggcgacagaggcggctacggcggcgacagaggcggctacggcggcgacagaagcagaggcggctacggcggcgacagaggcggcggcagcggctacggcggcgacagaagcggcggctacggcggcgacagaagcggcggcggctacggcggcgacagaggcggcggctacggcggcgacagaggcggctacggcggcaagatgggcggcagaaacgactacagaaacgaccagagaaacagaccctactag

SEQ ID NO: 101756 - DNA, 1779 bp, Artificial Sequence; identical to SEQ ID NO: 101755
  Description of Artificial Sequence: Synthetic coding sequence

SEQ ID NO: 101757 - DNA, 1188 bp, Artificial Sequence
  Description of Artificial Sequence: Synthetic coding sequence
atgaccggcagcagcggcggcgacagaggcggcttcaagaacttcggcggccacagagactacggccccagaaccgacgccgacagcgagagcgacaacagcgacaacaacaccatcttcgtgcagggcctgggcgagggcgtgagcaccgaccaggtgggcgagttcttcaagcagatcggcatcatcaagaccaacaagaagaccggcaagcccatgatcaacctgtacaccgacaaggacaccggcaagcccaagggcgaggccaccgtgagcttcgacgacccccccagcgccaaggccgccatcgactggttcgacggcaaggagttccacggcaacatcatcaaggtgagcttcgccaccagaagacccgagttcatgagaggcggcggcagcggcggcggcagaagaggcagaggcggctacagaggcagaggcggcttccagggcagaggcggcgaccccaagagcggcgactgggtgtgccccaaccccagctgcggcaacatgaacttcgccagaagaaacagctgcaaccagtgcaacgagcccagacccgaggacagcagacccagcggcggcgacttcagaggcagaggctacggcggcgagagaggctacagaggcagaggcggcagaggcggcgacagaggcggctacggcggcgacagaagcggcggcggctacggcggcgacagaagcagcggcggcggctacagcggcgacagaagcggcggcggctacggcggcgacagaagcggcggcggctacggcggcgacagaggcggcggctacggcggcgacagaggcggcggctacggcggcgacagaggcggcggctacggcggcgacagaggcggctacggcggcgacagaggcggcggctacggcggcgacagaggcggctacggcggcgacagaggcggctacggcggcgacagaggcggctacggcggcgacagaggcggctacggcggcgacagaagcagaggcggctacggcggcgacagaggcggcggcagcggctacggcggcgacagaagcggcggctacggcggcgacagaagcggcggcggctacggcggcgacagaggcggcggctacggcggcgacagaggcggctacggcggcaagatgggcggcagaaacgactacagaaacgaccagagaaacagaccctactag

SEQ ID NO: 101758 - DNA, 2790 bp, Artificial Sequence
  Description of Artificial Sequence: Synthetic coding sequence
atgtgcgagagctacagcagaagcctgctgagagtgagcgtggcccagatctgccaggccctgggctgggacagcgtgcagctgagcgcctgccacctgctgaccgacgtgctgcagagatacctgcagcagctgggcagaggctgccacagatacagcgagctgtacggcagaaccgaccccatcctggacgacgtgggcgaggccttccagctgatgggcgtgagcctgcacgagctggaggactacatccacaacatcgagcccgtgaccttcccccaccagatccccagcttccccgtgagcaagaacaacgtgctgcagttcccccagcccggcagcaaggacgccgaggagagaaaggagtacatccccgactacctgccccccatcgtgagcagccaggaggaggaggaggaggagcaggtgcccaccgacggcggcaccagcgccgaggccatgcaggtgcccctggaggaggacgacgagctggaggaggaggagatcatcaacgacgagaacttcctgggcaagagacccctggacagccccgaggccgaggagctgcccgccatgaagagacccagactgctgagcaccaagggcgacaccctggacgtggtgctgctggaggccagagagcccctgagcagcatcaacacccagaagatcccccccatgctgagccccgtgcacgtgcaggacagcaccgacctggccccccccagccccgagccccccatgctggcccccgtggccaagagccagatgcccaccgccaagcccctggagaccaagagcttcacccccaagaccaagaccaagaccagcagccccggccagaagaccaagagccccaagaccgcccagagccccgccatggtgggcagccccatcagaagccccaagaccgtgagcaaggagaagaagagccccggcagaagcaagagccccaagagccccaagagccccaaggtgaccacccacatcccccagacccccgtgagacccgagacccccaacagaacccccagcgccaccctgagcgagaagatcagcaaggagaccatccaggtgaagcagatccagaccccccccgacgccggcaagctgaacagcgagaaccagcccaagaaggccgtggtggccgacaagaccatcgaggccagcatcgacgccgtgatcgccagagcctgcgccgagagagagcccgaccccttcgagttcagcagcggcagcgagagcgagggcgacatcttcaccagccccaagagaatcagcggccccgagtgcaccacccccaaggccagcaccagcgccaacaacttcaccaagagcggcagcacccccctgcccctgagcggcggcaccagcagcagcgacaacagctggaccatggacgccagcatcgacgaggtggtgagaaaggccaagctgggcacccccagcaacatgccccccaacttcccctacatcagcagccccagcgtgagcccccccacccccgagcccctgcacaaggtgtacgaggagaagaccaagctgcccagcagcgtggaggtgaagaagaagctgaagaaggagctgaagaccaagatgaagaagaaggagaagcagagagacagagagagagagaaggacaagaacaaggacaagagcaaggagaaggacaaggtgaaggagaaggagaaggacaaggagaccggcagagagaccaagtacccctggaaggagttcctgaaggaggaggaggccgacccctacaagttcaagatcaaggagttcgaggacgtggaccccaaggtgaagctgaaggacggcctggtgagaaaggagaaggagaagcacaaggacaagaagaaggacagagagaagggcaagaaggacaaggacaagagagagaaggagaaggtgaaggacaagggcagagaggacaagatgaaggcccccgccccccccctggtgctgccccccaaggagctggccctgcccctgttcagccccgccaccgccagcagagtgcccgccatgctgcccagcctgctgcccgtgctgcccgagaagctgttcgaggagaaggagaaggtgaaggagaaggagaagaagaaggacaagaaggagaagaagaagaagaaggagaaggagaaggagaagaaggagaaggagagagagaaggagaagagagagagagagaagagagagaaggagaaggagaagcacaagcacgagaagatcaaggtggagcccgtggccctggcccccagccccgtgatccccagactgaccctgagagtgggcgccggccaggacaagatcgtgatcagcaaggtggtgcccgcccccgaggccaagcccgcccccagccagaacagacccaagacccccccccccgcccccgcccccgcccccggccccatgctggtgagccccgcccccgtgcccctgcccctgctggcccaggccgccgccggccccgccctgctgcccagccccggccccgccgccagcggcgccagcgccaaggcccccgtgagaagcgtggtgaccgagaccgtgagcacctacgtgatcagagacgagtggggcaaccagatctggatctgccccggctgcaacaagcccgacgacggcagccccatgatcggctgcgacgactgcgacgactggtaccactggccctgcgtgggcatcatgaccgccccccccgaggagatgcagtggttctgccccaagtgcgccaacaagaagaaggacaagaagcacaagaagagaaagcacagagcccactag

SEQ ID NO: 101759 - DNA, 852 bp, Artificial Sequence
  Description of Artificial Sequence: Synthetic coding sequence
atgtgcgagagctacagcagaagcctgctgagagtgagcgtggcccagatctgccaggccctgggctgggacagcgtgcagctgagcgcctgccacctgctgaccgacgtgctgcagagatacctgcagcagctgggcagaggctgccacagatacagcgagctgtacggcagaaccgaccccatcctggacgacgtgggcgaggccttccagctgatgggcgtgagcctgcacgagctggaggactacatccacaacatcgagcccgtgaccttcccccaccagatccccagcttccccgtgagcaagaacaacgtgctgcagttcccccagcccggcagcaaggacgccgaggagagaaaggagtacatccccgactacctgccccccatcgtgagcagccaggaggaggaggaggaggagcaggtgcccaccgacggcggcaccagcgccgaggccatgcaggtgcccctggaggaggacgacgagctggaggaggaggagatcatcaacgacgagaacttcctgggcaagagacccctggacagccccgaggccgaggagctgcccgccatgaagagacccagactgctgagcaccaagggcgacaccctggacgtggtgctgctggaggccagagagcccctgagcagcatcaacacccagaagatcccccccatgctgagccccgtgcacgtgcaggacagcaccgacctggccccccccagccccgagccccccatgctggcccccgtggccaagagccagatgcccaccgccaagcccctggagaccaagagcttcacccccaagaccaagaccaagaagaagaagaagaagaagaagagctag

SEQ ID NO: 101760 - DNA, 3258 bp, Artificial Sequence
  Description of Artificial Sequence: Synthetic coding sequence
atggccgccggcagcgacctgctggacgaggtgttcttcaacagcgaggtggacgagaaggtggtgagcgacctggtgggcagcctggagagccagctggccgccagcgccgcccaccaccaccacctggcccccagaacccccgaggtgagagccgccgccgccggcgccctgggcaaccacgtggtgagcggcagccccgccggcgccgccggcgccggccccgccgcccccgccgagggcgcccccggcgccgcccccgagcccccccccgccggcagagccagacccggcggcggcggcccccagagacccggcccccccagccccagaagacccctggtgcccgccggccccgccccccccgccgccaagctgagacccccccccgagggcagcgccggcagctgcgcccccgtgcccgccgccgccgccgtggccgccggccccgagcccgcccccgccggccccgccaagcccgccggccccgccgccctggccgccagagccggccccggccccggccccggccccggccccggccccggccccggccccggcaagcccgccggccccggcgccgcccagaccctgaacggcagcgccgccctgctgaacagccaccacgccgccgcccccgccgtgagcctggtgaacaacggccccgccgccctgctgcccctgcccaagcccgccgcccccggcaccgtgatccagaccccccccttcgtgggcgccgccgccccccccgcccccgccgcccccagcccccccgccgcccccgcccccgccgcccccgccgccgccccccccccccccccccccgcccccgccaccctggccagaccccccggccaccccgccggcccccccaccgccgcccccgccgtgcccccccccgccgccgcccagaacggcggcagcgccggcgccgcccccgcccccgcccccgccgccggcggccccgccggcgtgagcggccagcccggccccggcgccgccgccgccgcccccgcccccggcgtgaaggccgagagccccaagagagtggtgcaggccgccccccccgccgcccagaccctggccgccagcggccccgccagcaccgccgccagcatggtgatcggccccaccatgcagggcgccctgcccagccccgccgccgtgcccccccccgcccccggcacccccaccggcctgcccaagggcgccgccggcgccgtgacccagagcctgagcagaacccccaccgccaccaccagcggcatcagagccaccctgacccccaccgtgctggcccccagactgccccagcccccccagaaccccaccaacatccagaacttccagctgccccccggcatggtgctggtgagaagcgagaacggccagctgctgatgatcccccagcaggccctggcccagatgcaggcccaggcccacgcccagccccagaccaccatggcccccagacccgccacccccaccagcgccccccccgtgcagatcagcaccgtgcaggcccccggcacccccatcatcgccagacaggtgacccccaccaccatcatcaagcaggtgagccaggcccagaccaccgtgcagcccagcgccaccctgcagagaagccccggcgtgcagccccagctggtgctgggcggcgccgcccagaccgccagcctgggcaccgccaccgccgtgcagaccggcaccccccagagaaccgtgcccggcgccaccaccaccagcagcgccgccaccgagaccatggagaacgtgaagaagtgcaagaacttcctgagcaccctgatcaagctggccagcagcggcaagcagagcaccgagaccgccgccaacgtgaaggagctggtgcagaacctgctggacggcaagatcgaggccgaggacttcaccagcagactgtacagagagctgaacagcagcccccagccctacctggtgcccttcctgaagagaagcctgcccgccctgagacagctgacccccgacagcgccgccttcatccagcagagccagcagcagccccccccccccaccagccaggccaccaccgccctgaccgccgtggtgctgagcagcagcgtgcagagaaccgccggcaagaccgccgccaccgtgaccagcgccctgcagccccccgtgctgagcctgacccagcccacccaggtgggcgtgggcaagcagggccagcccacccccctggtgatccagcagccccccaagcccggcgccctgatcagacccccccaggtgaccctgacccagacccccatggtggccctgagacagccccacaacagaatcatgctgaccaccccccagcagatccagctgaaccccctgcagcccgtgcccgtggtgaagcccgccgtgctgcccggcaccaaggccctgagcgccgtgagcgcccaggccgccgccgcccagaagaacaagctgaaggagcccggcggcggcagcttcagagacgacgacgacatcaacgacgtggccagcatggccggcgtgaacctgagcgaggagagcgccagaatcctggccaccaacagcgagctggtgggcaccctgaccagaagctgcaaggacgagaccttcctgctgcaggcccccctgcagagaagaatcctggagatcggcaagaagcacggcatcaccgagctgcaccccgacgtggtgagctacgtgagccacgccacccagcagagactgcagaacctggtggagaagatcagcgagaccgcccagcagaagaacttcagctacaaggacgacgacagatacgagcaggccagcgacgtgagagcccagctgaagttcttcgagcagctggaccagatcgagaagcagagaaaggacgagcaggagagagagatcctgatgagagccgccaagagcagaagcagacaggaggaccccgagcagctgagactgaagcagaaggccaaggagatgcagcagcaggagctggcccagatgagacagagagacgccaacctgaccgccctggccgccatcggccccagaaagaagagaaaggtggactgccccggccccggcagcggcgccgagggcagcggccccggcagcgtggtgcccggcagcagcggcgtgggcacccccagacagttcaccagacagagaatcaccagagtgaacctgagagacctgatcttctgcctggagaacgagagagagaccagccacagcctgctgctgtacaaggccttcctgaagtag

SEQ ID NO: 101761 - DNA, 2850 bp, Artificial Sequence
  Description of Artificial Sequence: Synthetic coding sequence
ggcagaggcctgctgcagcagagaggcggcagagagagcggccccgccccccccgccgccaagctgagacccccccccgagggcagcgccggcagctgcgcccccgtgcccgccgccgccgccgtggccgccggccccgagcccgcccccgccggccccgccaagcccgccggccccgccgccctggccgccagagccggccccggccccggccccggccccggccccggccccggccccggccccggcaagcccgccggccccggcgccgcccagaccctgaacggcagcgccgccctgctgaacagccaccacgccgccgcccccgccgtgagcctggtgaacaacggccccgccgccctgctgcccctgcccaagcccgccgcccccgccgccgccccccccccccccccccccgcccccgccaccctggccagaccccccggccaccccgccggcccccccaccgccgcccccgccgtgcccccccccgccgccgcccagaacggcggcagcgccggcgccgcccccgcccccgcccccgccgccggcggccccgccggcgtgagcggccagcccggccccggcgccgccgccgccgcccccgcccccggcgtgaaggccgagagccccaagagagtggtgcaggccgccccccccgccgcccagaccctggccgccagcggccccgccagcaccgccgccagcatggtgatcggccccaccatgcagggcgccctgcccagccccgccgccgtgcccccccccgcccccggcacccccaccggcctgcccaagggcgccgccggcgccgtgacccagagcctgagcagaacccccaccgccaccaccagcggcatcagagccaccctgacccccaccgtgctggcccccagactgccccagcccccccagaaccccaccaacatccagaacttccagctgccccccggcatggtgctggtgagaagcgagaacggccagctgctgatgatcccccagcaggccctggcccagatgcaggcccaggcccacgcccagccccagaccaccatggcccccagacccgccacccccaccagcgccccccccgtgcagatcagcaccgtgcaggcccccggcacccccatcatcgccagacaggtgacccccaccaccatcatcaagcaggtgagccaggcccagaccaccgtgcagcccagcgccaccctgcagagaagccccggcgtgcagccccagctggtgctgggcggcgccgcccagaccgccagcctgggcaccgccaccgccgtgcagaccggcaccccccagagaaccgtgcccggcgccaccaccaccagcagcgccgccaccgagaccatggagaacgtgaagaagtgcaagaacttcctgagcaccctgatcaagctggccagcagcggcaagcagagcaccgagaccgccgccaacgtgaaggagctggtgcagaacctgctggacggcaagatcgaggccgaggacttcaccagcagactgtacagagagctgaacagcagcccccagccctacctggtgcccttcctgaagagaagcctgcccgccctgagacagctgacccccgacagcgccgccttcatccagcagagccagcagcagccccccccccccaccagccaggccaccaccgccctgaccgccgtggtgctgagcagcagcgtgcagagaaccgccggcaagaccgccgccaccgtgaccagcgccctgcagccccccgtgctgagcctgacccagcccacccaggtgggcgtgggcaagcagggccagcccacccccctggtgatccagcagccccccaagcccggcgccctgatcagacccccccaggtgaccctgacccagacccccatggtggccctgagacagccccacaacagaatcatgctgaccaccccccagcagatccagctgaaccccctgcagcccgtgcccgtggtgaagcccgccgtgctgcccggcaccaaggccctgagcgccgtgagcgcccaggccgccgccgcccagaagaacaagctgaaggagcccggcggcggcagcttcagagacgacgacgacatcaacgacgtggccagcatggccggcgtgaacctgagcgaggagagcgccagaatcctggccaccaacagcgagctggtgggcaccctgaccagaagctgcaaggacgagaccttcctgctgcaggcccccctgcagagaagaatcctggagatcggcaagaagcacggcatcaccgagctgcaccccgacgtggtgagctacgtgagccacgccacccagcagagactgcagaacctggtggagaagatcagcgagaccgcccagcagaagaacttcagctacaaggacgacgacagatacgagcaggccagcgacgtgagagcccagctgaagttcttcgagcagctggaccagatcgagaagcagagaaaggacgagcaggagagagagatcctgatgagagccgccaagagcagaagcagacaggaggaccccgagcagctgagactgaagcagaaggccaaggagatgcagcagcaggagctggcccagatgagacagagagacgccaacctgaccgccctggccgccatcggccccagaaagaagagaaaggtggactgccccggccccggcagcggcgccgagggcagcggccccggcagcgtggtgcccggcagcagcggcgtgggcacccccagacagttcaccagacagagaatcaccagagtgaacctgagagacctgatcttctgcctggagaacgagagagagaccagccacagcctgctgctgtacaaggccttcctgaagtag

SEQ ID NO: 101762 - DNA, 2589 bp, Artificial Sequence
  Description of Artificial Sequence: Synthetic coding sequence
atgcccgccggcctgaccgagcccgccggcgccgccccccccgccgccgtgagcgccagcggcaccgtgaccatggcccccgccggcgccctgcccgtgagagtggagagcacccccgtggccctgggcgccgtgaccaaggcccccgtgagcgtgtgcgtggagcccaccgccagccagcccctgagaagccccgtgggcaccctggtgaccaaggtggcccccgtgagcgccccccccaaggtgagcagcggccccagactgcccgccccccagatcgtggccgtgaaggcccccaacaccaccaccatccagttccccgccaacctgcagctgccccccggcaccgtgctgatcaagagcaacagcggccccctgatgctggtgagcccccagcagaccgtgaccagagccgagaccaccagcaacatcaccagcagacccgccgtgcccgccaacccccagaccgtgaagatctgcaccgtgcccaacagcagcagccagctgatcaagaaggtggccgtgacccccgtgaagaagctggcccagatcggcaccaccgtggtgaccaccgtgcccaagcccagcagcgtgcagagcgtggccgtgcccaccagcgtggtgaccgtgacccccggcaagcccctgaacaccgtgaccaccctgaagcccagcagcctgggcgccagcagcacccccagcaacgagcccaacctgaaggccgagaacagcgccgccgtgcagatcaacctgagccccaccatgctggagaacgtgaagaagtgcaagaacttcctggccatgctgatcaagctggcctgcagcggcagccagagccccgagatgggccagaacgtgaagaagctggtggagcagctgctggacgccaagatcgaggccgaggagttcaccagaaagctgtacgtggagctgaagagcagcccccagccccacctggtgcccttcctgaagaagagcgtggtggccctgagacagctgctgcccaacagccagagcttcatccagcagtgcgtgcagcagaccagcagcgacatggtgatcgccacctgcaccaccaccgtgaccaccagccccgtggtgaccaccaccgtgagcagcagccagagcgagaagagcatcatcgtgagcggcgccaccgcccccagaaccgtgagcgtgcagaccctgaaccccctggccggccccgtgggcgccaaggccggcgtggtgaccctgcacagcgtgggccccaccgccgccaccggcggcaccaccgccggcaccggcctgctgcagaccagcaagcccctggtgaccagcgtggccaacaccgtgaccaccgtgagcctgcagcccgagaagcccgtggtgagcggcaccgccgtgaccctgagcctgcccgccgtgaccttcggcgagaccagcggcgccgccatctgcctgcccagcgtgaagcccgtggtgagcagcgccggcaccaccagcgacaagcccgtgatcggcacccccgtgcagatcaagctggcccagcccggccccgtgctgagccagcccgccggcatcccccaggccgtgcaggtgaagcagctggtggtgcagcagcccagcggcggcaacgagaagcaggtgaccaccatcagccacagcagcaccctgaccatccagaagtgcggccagaagaccatgcccgtgaacaccatcatccccaccagccagttcccccccgccagcatcctgaagcagatcaccctgcccggcaacaagatcctgagcctgcaggccagccccacccagaagaacagaatcaaggagaacgtgaccagctgcttcagagacgaggacgacatcaacgacgtgaccagcatggccggcgtgaacctgaacgaggagaacgcctgcatcctggccaccaacagcgagctggtgggcaccctgatccagagctgcaaggacgagcccttcctgttcatcggcgccctgcagaagagaatcctggacatcggcaagaagcacgacatcaccgagctgaacagcgacgccgtgaacctgatcagccaggccacccaggagagactgagaggcctgctggagaagctgaccgccatcgcccagcacagaatgaccacctacaaggccagcgagaactacatcctgtgcagcgacaccagaagccagctgaagttcctggagaagctggaccagctggagaagcagagaaaggacctggaggagagagagatgctgctgaaggccgccaagagcagaagcaacaaggaggaccccgagcagctgagactgaagcagaaggccaaggagctgcagcagctggagctggcccagatccagcacagagacgccaacctgaccgccctggccgccatcggccccagaaagaagagacccctggagagcggcatcgagggcctgaaggacaacctgctggccagcggcaccagcagcctgaccgccaccaagcagctgcacagacccagaatcaccagaatctgcctgagagacctgatcttctgcatggagcaggagagagagatgaagtacagcagagccctgtacctggccctgctgaagtag

SEQ ID NO: 101763 - DNA, 1857 bp, Artificial Sequence
  Description of Artificial Sequence: Synthetic coding sequence
atgcccgccggcctgaccgagcccgccggcgccgccccccccgccgccgtgagcgccagcggcaccgtgaccatggcccccgccggcgccctgcccgtgagagtggagagcacccccgtggccctgggcgccgtgaccaaggcccccgtgagcgtgtgcgtggagcccaccgccagccagcccctgagaagccccgtgggcaccctggtgaccaaggtggcccccgtgagcgccccccccaaggtgagcagcggccccagactgcccgccccccagatcgtggccgtgaaggcccccaacaccaccaccatccagttccccgccaacctgcagctgccccccggcaccgtgctgatcaagagcaacagcggccccctgatgctggtgagcccccagcagaccgtgaccagagccgagaccaccagcaacatcaccagcagacccgccgtgcccgccaacccccagaccgtgaagatctgcaccgtgcccaacagcagcagccagctgatcaagaaggtggccgtgacccccgtgaagaagctggcccagatcggcaccaccgtggtgaccaccgtgcccaagcccagcagcgtgcagagcgtggccgtgcccaccagcgtggtgaccgtgacccccggcaagcccctgaacaccgtgaccaccctgaagcccagcagcctgggcgccagcagcacccccagcaacgagcccaacctgaaggccgagaacagcgccgccgtgcagatcaacctgagccccaccatgctggagaacgtgaagaagtgcaagaacttcctggccatgctgatcaagctggcctgcagcggcagccagagccccgagatgggccagaacgtgaagaagctggtggagcagctgctggacgccaagatcgaggccgaggagttcaccagaaagctgtacgtggagctgaagagcagcccccagccccacctggtgcccttcctgaagaagagcgtggtggccctgagacagctgctgcccaacagccagagcttcatccagcagtgcgtgcagcagaccagcagcgacatggtgatcgccacctgcaccaccaccgtgaccaccagccccgtggtgaccaccaccgtgagcagcagccagagcgagaagagcatcatcgtgagcggcgccaccgcccccagaaccgtgagcgtgcagaccctgaaccccctggccggccccgtgggcgccaaggccggcgtggtgaccctgcacagcgtgggccccaccgccgccaccggcggcaccaccgccggcaccggcctgctgcagaccagcaagcccctggtgaccagcgtggccaacaccgtgaccaccgtgagcctgcagcccgagaagcccgtggtgagcggcaccgccgtgaccctgagcctgcccgccgtgaccttcggcgagaccagcggcgccgccatctgcctgcccagcgtgaagcccgtggtgagcagcgccggcaccaccagcgacaagcccgtgatcggcacccccgtgcagatcaagctggcccagcccggccccgtgctgagccagcccgccggcatcccccaggccgtgcaggtgaagcagctggtggtgcagcagcccagcggcggcaacgagaagcaggtgaccaccatcagccacagcagcaccctgaccatccagaagtgcggccagaagaccatgcccgtgaacaccatcatccccaccagccagttcccccccgccagcatcctgaagcagatcaccctgcccggcaacaagatcctgagcctgcaggccagccccacccagaagaacagaatcaaggagaacgtgaccagctgcttcagaagcaccttcatctgcgtgtactag

SEQ ID NO: 101764 - DNA, 2598 bp, Artificial Sequence
  Description of Artificial Sequence: Synthetic coding sequence
atgcccgccggcctgaccgagcccgccggcgccgccccccccgccgccgtgagcgccagcggcaccgtgaccatggcccccgccggcgccctgcccgtgagagtggagagcacccccgtggccctgggcgccgtgaccaaggcccccgtgagcgtgtgcgtggagcccaccgccagccagcccctgagaagccccgtgggcaccctggtgaccaaggtggcccccgtgagcgccccccccaaggtgagcagcggccccagactgcccgccccccagatcgtggccgtgaaggcccccaacaccaccaccatccagttccccgccaacctgcagctgccccccggcaccgtgctgatcaagagcaacagcggccccctgatgctggtgagcccccagcagaccgtgaccagagccgagaccaccagcaacatcaccagcagacccgccgtgcccgccaacccccagaccgtgaagatctgcaccgtgcccaacagcagcagccagctgatcaagaaggtggccgtgacccccgtgaagaagctggcccagatcggcaccaccgtggtgaccaccgtgcccaagcccagcagcgtgcagagcgtggccgtgcccaccagcgtggtgaccgtgacccccggcaagcccctgaacaccgtgaccaccctgaagcccagcagcctgggcgccagcagcacccccagcaacgagcccaacctgaaggccgagaacagcgccgccgtgcagatcaacctgagccccaccatgctggagaacgtgaagaagtgcaagaacttcctggccatgctgatcaagctggcctgcagcggcagccagagccccgagatgggccagaacgtgaagaagctggtggagcagctgctggacgccaagatcgaggccgaggagttcaccagaaagctgtacgtggagctgaagagcagcccccagccccacctggtgcccttcctgaagaagagcgtggtggccctgagacagctgctgcccaacagccagagcttcatccagcagtgcgtgcagcagaccagcagcgacatggtgatcgccacctgcaccaccaccgtgaccaccagccccgtggtgaccaccaccgtgagcagcagccagagcgagaagagcatcatcgtgagcggcgccaccgcccccagaaccgtgagcgtgcagaccctgaaccccctggccggccccgtgggcgccaaggccggcgtggtgaccctgcacagcgtgggccccaccgccgccaccggcggcaccaccgccggcaccggcctgctgcagaccagcaagcccctggtgaccagcgtggccaacaccgtgaccaccgtgagcctgcagcccgagaagcccgtggtgagcggcaccgccgtgaccctgagcctgcccgccgtgaccttcggcgagaccagcggcgccgccatctgcctgcccagcgtgaagcccgtggtgttctgctgggaccacatcaagcccgtgatcggcacccccgtgcagatcaagctggcccagcccggccccgtgctgagccagcccgccggcatcccccaggccgtgcaggtgaagcagctgttcagcctgttccaggtggtgcagcagcccagcggcggcaacgagaagcaggtgaccaccatcagccacagcagcaccctgaccatccagaagtgcggccagaagaccatgcccgtgaacaccatcatccccaccagccagttcccccccgccagcatcctgaagcagatcaccctgcccggcaacaagatcctgagcctgcaggccagccccacccagaagaacagaatcaaggagaacgtgaccagctgcttcagagacgaggacgacatcaacgacgtgaccagcatggccggcgtgaacctgaacgaggagaacgcctgcatcctggccaccaacagcgagctggtgggcaccctgatccagagctgcaaggacgagcccttcctgttcatcggcgccctgcagaagagaatcctggacatcggcaagaagcacgacatcaccgagctgaacagcgacgccgtgaacctgatcagccaggccacccaggagagactgagaggcctgctggagaagctgaccgccatcgcccagcacagaatgaccacctacaaggccagcgagaactacatcctgtgcagcgacaccagaagccagctgaagttcctggagaagctggaccagctggagaagcagagaaaggacctggaggagagagagatgctgctgaaggccgccaagagcagaagcaacaaggaggaccccgagcagctgagactgaagcagaaggccaaggagctgcagcagctggagctggcccagatccagcacagagacgccaacctgaccgccctggccgccatcggccccagaaagaagagacccctggagagcggcatcgagggcctgaaggacaacctgctggccagcggcaccagcagcctgaccgccaccaagcagctgcacagacccagaatcaccagaatctgcctgagagacctgatcttctgcatggagcaggagagagagatgaagtacagcagagccctgtacctggccctgctgaagtag

SEQ ID NO: 101765 - DNA, 2238 bp, Artificial Sequence
  Description of Artificial Sequence: Synthetic coding sequence
atggccgccctggccgaggagcagaccgaggtggccgtgaagctggagcccgagggcccccccaccctgctgcccccccaggccggcgacggcgccggcgagggcagcggcggcaccaccaacaacggccccaacggcggcggcggcaacgtggccgccagcagcagcaccggcggcgacggcggcacccccaagcccaccgtggccgtgagcgccgccgcccccgccggcgccgcccccgtgcccgccgccgcccccgacgccggcgccccccacgacagacagaccctgctggccgtgctgcagttcctgagacagagcaagctgagagaggccgaggaggccctgagaagagaggccggcctgctggaggaggccgtggccggcagcggcgcccccggcgaggtggacagcgccggcgccgaggtgaccagcgccctgctgagcagagtgaccgccagcgcccccggccccgccgcccccgacccccccggcaccggcgccagcggcgccaccgtggtgagcggcagcgccagcggccccgccgcccccggcaaggtgggcagcgtggccgtggaggaccagcccgacgtgagcgccgtgctgagcgcctacaaccagcagggcgaccccaccatgtacgaggagtactacagcggcctgaagcacttcatcgagtgcagcctggactgccacagagccgagctgagccagctgttctaccccctgttcgtgcacatgtacctggagctggtgtacaaccagcacgagaacgaggccaagagcttcttcgagaagttccacggcgaccaggagtgctactaccaggacgacctgagagtgctgagcagcctgaccaagaaggagcacatgaagggcaacgagaccatgctggacttcagaaccagcaagttcgtgctgagaatcagcagagacagctaccagctgctgaagagacacctgcaggagaagcagaacaaccagatctggaacatcgtgcaggagcacctgtacatcgacatcttcgacggcatgcccagaagcaagcagcagatcgacgccatggtgggcagcctggccggcgaggccaagagagaggccaacaagagcaaggtgttcttcggcctgctgaaggagcccgagatcgaggtgcccctggacgacgaggacgaggagggcgagaacgaggagggcaagcccaagaagaagaagcccaagaaggacagcatcggcagcaagagcaagaagcaggaccccaacgcccccccccagaacagaatccccctgcccgagctgaaggacagcgacaagctggacaagatcatgaacatgaaggagaccaccaagagagtgagactgggccccgactgcctgcccagcatctgcttctacaccttcctgaacgcctaccagggcctgaccgccgtggacgtgaccgacgacagcagcctgatcgccggcggcttcgccgacagcaccgtgagagtgtggagcgtgacccccaagaagctgagaagcgtgaagcaggccagcgacctgagcctgatcgacaaggagagcgacgacgtgctggagagaatcatggacgagaagaccgccagcgagctgaagatcctgtacggccacagcggccccgtgtacggcgccagcttcagccccgacagactgtgggccaccgaccactaccagcccctgagaatcttcgccggccacctggccgacgtgaactgcaccagattccaccccaacagcaactacgtggccaccggcagcgccgacagaaccgtgagactgtgggacgtgctgaacggcaactgcgtgagaatcttcaccggccacaagggccccatccacagcctgaccttcagccccaacggcagattcctggccaccggcgccaccgacggcagagtgctgctgtgggacatcggccacggcctgatggtgggcgagctgaagggccacaccgacaccgtgtgcagcctgagattcagcagagacggcgagatcctggccagcggcagcatggacaacaccgtgagactgtgggacgccatcaaggccttcgaggacctggagaccgacgacttcaccaccgccaccggccacatcaacctgcccgagaacagccaggagctgctgctgggcacctacatgaccaagagcacccccgtggtgcacctgcacttcaccagaagaaacctggtgctggccgccggcgcctacagcccccagtag

SEQ ID NO: 101766 - DNA, 2403 bp, Artificial Sequence
  Description of Artificial Sequence: Synthetic coding sequence
atggccgccctggccgaggagcagaccgaggtggccgtgaagctggagcccgagggcccccccaccctgctgcccccccaggccggcgacggcgccggcgagggcagcggcggcaccaccaacaacggccccaacggcggcggcggcaacgtggccgccagcagcagcaccggcggcgacggcggcacccccaagcccaccgtggccgtgagcgccgccgcccccgccggcgccgcccccgtgcccgccgccgcccccgacgccggcgccccccacgacagacagaccctgctggccgtgctgcagttcctgagacagagcaagctgagagaggccgaggaggccctgagaagagaggccggcctgctggaggaggccgtggccggcagcggcgcccccggcgaggtggacagcgccggcgccgaggtgaccagcgccctgctgagcagagtgaccgccagcgcccccggccccgccgcccccgacccccccggcaccggcgccagcggcgccaccgtggtgagcggcagcgccagcggccccgccgcccccggcaaggtgggcagcgtggccgtggaggaccagcccgacgtgagcgccgtgctgagcgcctacaaccagcagggcgaccccaccatgtacgaggagtactacagcggcctgaagcacttcatcgagtgcagcctggactgccacagagccgagctgagccagctgttctaccccctgttcgtgcacatgtacctggagctggtgtacaaccagcacgagaacgaggccaagagcttcttcgagaagttccacggcgaccaggagtgctactaccaggacgacctgagagtgctgagcagcctgaccaagaaggagcacatgaagggcaacgagaccatgctggacttcagaaccagcaagttcgtgctgagaatcagcagagacagctaccagctgctgaagagacacctgcaggagaagcagaacaaccagatctggaacatcgtgcaggagcacctgtacatcgacatcttcgacggcatgcccagaagcaagcagcagatcgacgccatggtgggcagcctggccggcgaggccaagagagaggccaacaagagcaaggtgttcttcggcctgctgaaggagcccgagatcgaggtgcccctggacgacgaggacgaggagggcgagaacgaggagggcaagcccaagaagaagaagcccaagaaggacagcatcggcagcaagagcaagaagcaggaccccaacgcccccccccagaacagaatccccctgcccgagctgaaggacagcgacaagctggacaagatcatgaacatgaaggagaccaccaagagagtgagactgggccccgactgcctgcccagcatctgcttctacaccttcctgaacgcctaccagggcctgaccgccgtggacgtgaccgacgacagcagcctgatcgccggcggcttcgccgacagcaccgtgagagtgtggagcgtgacccccaagaagctgagaagcgtgaagcaggccagcgacctgagcctgatcgacaaggagagcgacgacgtgctggagagaatcatggacgagaagaccgccagcgagctgaagatcctgtacggccacagcggccccgtgtacggcgccagcttcagccccgacagaaactacctgctgagcagcagcgaggacggcaccgtgagactgtggagcctgcagaccttcacctgcctggtgggctacaagggccacaactaccccgtgtgggacacccagttcagcccctacggctactacttcgtgagcggcggccacgacagagtggccagactgtgggccaccgaccactaccagcccctgagaatcttcgccggccacctggccgacgtgaactgcaccagattccaccccaacagcaactacgtggccaccggcagcgccgacagaaccgtgagactgtgggacgtgctgaacggcaactgcgtgagaatcttcaccggccacaagggccccatccacagcctgaccttcagccccaacggcagattcctggccaccggcgccaccgacggcagagtgctgctgtgggacatcggccacggcctgatggtgggcgagctgaagggccacaccgacaccgtgtgcagcctgagattcagcagagacggcgagatcctggccagcggcagcatggacaacaccgtgagactgtgggacgccatcaaggccttcgaggacctggagaccgacgacttcaccaccgccaccggccacatcaacctgcccgagaacagccaggagctgctgctgggcacctacatgaccaagagcacccccgtggtgcacctgcacttcaccagaagaaacctggtgctggccgccggcgcctacagcccccagtag

SEQ ID NO: 101767 - DNA, 2034 bp, Artificial Sequence
  Description of Artificial Sequence: Synthetic coding sequence
atggccgaggagaagaagctgaagctgagcaacaccgtgctgcccagcgagagcatgaaggtggtggccgagagcatgggcatcgcccagatccaggaggagacctgccagctgctgaccgacgaggtgagctacagaatcaaggagatcgcccaggacgccctgaagttcatgcacatgggcaagagacagaagctgaccaccagcgacatcgactacgccctgaagctgaagaacgtggagcccctgtacggcttccacgcccaggagttcatccccttcagattcgccagcggcggcggcagagagctgtacttctacgaggagaaggaggtggacctgagcgacatcatcaacacccccctgcccagagtgcccctggacgtgtgcctgaaggcccactggctgagcatcgagggctgccagcccgccatccccgagaaccccccccccgcccccaaggagcagcagaaggccgaggccaccgagcccctgaagagcgccaagcccggccaggaggaggacggccccctgaagggcaagggccagggcgccaccaccgccgacggcaagggcaaggagaagaaggccccccccctgctggagggcgcccccctgagactgaagcccagaagcatccacgagctgagcgtggagcagcagctgtactacaaggagatcaccgaggcctgcgtgggcagctgcgaggccaagagagccgaggccctgcagagcatcgccaccgaccccggcctgtaccagatgctgcccagattcagcaccttcatcagcgagggcgtgagagtgaacgtggtgcagaacaacctggccctgctgatctacctgatgagaatggtgaaggccctgatggacaaccccaccctgtacctggagaagtacgtgcacgagctgatccccgccgtgatgacctgcatcgtgagcagacagctgtgcctgagacccgacgtggacaaccactgggccctgagagacttcgccgccagactggtggcccagatctgcaagcacttcagcaccaccaccaacaacatccagagcagaatcaccaagaccttcaccaagagctgggtggacgagaagaccccctggaccaccagatacggcagcatcgccggcctggccgagctgggccacgacgtgatcaagaccctgatcctgcccagactgcagcaggagggcgagagaatcagaagcgtgctggacggccccgtgctgagcaacatcgacagaatcggcgccgaccacgtgcagagcctgctgctgaagcactgcgcccccgtgctggccaagctgagacccccccccgacaaccaggacgcctacagagccgagttcggcagcctgggccccctgctgtgcagccaggtggtgaaggccagagcccaggccgccctgcaggcccagcaggtgaacagaaccaccctgaccatcacccagcccagacccaccctgaccctgagccaggccccccagcccggccccagaacccccggcctgctgaaggtgcccggcagcatcgccctgcccgtgcagaccctggtgagcgccagagccgccgcccccccccagcccagccccccccccaccaagttcatcgtgatgagcagcagcagcagcgcccccagcacccagcaggtgctgagcctgagcaccagcgcccccggcagcggcagcaccaccaccagccccgtgaccaccaccgtgcccagcgtgcagcccatcgtgaagctggtgagcaccgccaccaccgccccccccagcaccgcccccagcggccccggcagcgtgcagaagtacatcgtggtgagcctgccccccaccggcgagggcaagggcggccccaccagccaccccagccccgtgcccccccccgccagcagccccagccccctgagcggcagcgccctgtgcggcggcaagcaggaggccggcgacagccccccccccgcccccggcacccccaaggccaacggcagccagcccaacagcggcagcccccagcccgccccctag

SEQ ID NO: 101768 - DNA, 231 bp, Artificial Sequence
  Description of Artificial Sequence: Synthetic coding sequence
atggccgaggagaagaagctgaagctgagcaacaccgtgctgcccagcgagagcatgaaggtggtggccgagagcatgggcatcgcccagatccaggaggagacctgccagctgctgaccgacgaggtgagctacagaatcaaggagatcgcccaggacgccctgaagttcatgcacatgggcaagagacagaagctgaccaccagcgacatcgactacgccctgaagtag

SEQ ID NO: 101769 - DNA, 1806 bp, Artificial Sequence
  Description of Artificial Sequence: Synthetic coding sequence
atgcacatgggcaagagacagaagctgaccaccagcgacatcgactacgccctgaagctgaagaacgtggagcccctgtacggcttccacgcccaggagttcatccccttcagattcgccagcggcggcggcagagagctgtacttctacgaggagaaggaggtggacctgagcgacatcatcaacacccccctgcccagagtgcccctggacgtgtgcctgaaggcccccaaggagcagcagaaggccgaggccaccgagcccctgaagagcgccaagcccggccaggaggaggacggccccctgaagggcaagggccagggcgccaccaccgccgacggcaagggcaaggagaagaaggccccccccctgctggagggcgcccccctgagactgaagcccagaagcatccacgagctgagcgtggagcagcagctgtactacaaggagatcaccgaggcctgcgtgggcagctgcgaggccaagagagccgaggccctgcagagcatcgccaccgaccccggcctgtaccagatgctgcccagattcagcaccttcatcagcgagggcgtgagagtgaacgtggtgcagaacaacctggccctgctgatctacctgatgagaatggtgaaggccctgatggacaaccccaccctgtacctggagaagtacgtgcacgagctgatccccgccgtgatgacctgcatcgtgagcagacagctgtgcctgagacccgacgtggacaaccactgggccctgagagacttcgccgccagactggtggcccagatctgcaagcacttcagcaccaccaccaacaacatccagagcagaatcaccaagaccttcaccaagagctgggtggacgagaagaccccctggaccaccagatacggcagcatcgccggcctggccgagctgggccacgacgtgatcaagaccctgatcctgcccagactgcagcaggagggcgagagaatcagaagcgtgctggacggccccgtgctgagcaacatcgacagaatcggcgccgaccacgtgcagagcctgctgctgaagcactgcgcccccgtgctggccaagctgagacccccccccgacaaccaggacgcctacagagccgagttcggcagcctgggccccctgctgtgcagccaggtggtgaaggccagagcccaggccgccctgcaggcccagcaggtgaacagaaccaccctgaccatcacccagcccagacccaccctgaccctgagccaggccccccagcccggccccagaacccccggcctgctgaaggtgcccggcagcatcgccctgcccgtgcagaccctggtgagcgccagagccgccgcccccccccagcccagccccccccccaccaagttcatcgtgatgagcagcagcagcagcgcccccagcacccagcaggtgctgagcctgagcaccagcgcccccggcagcggcagcaccaccaccagccccgtgaccaccaccgtgcccagcgtgcagcccatcgtgaagctggtgagcaccgccaccaccgccccccccagcaccgcccccagcggccccggcagcgtgcagaagtacatcgtggtgagcctgccccccaccggcgagggcaagggcggccccaccagccaccccagccccgtgcccccccccgccagcagccccagccccctgagcggcagcgccctgtgcggcggcaagcaggaggccggcgacagccccccccccgcccccggcacccccaaggccaacggcagccagcccaacagcggcagcccccagcccgccccctag

SEQ ID NO: 101770 - DNA, 45 bp, Artificial Sequence
  Description of Artificial Sequence: Synthetic coding sequence
atggccgaggagaagaagctgaagctgagcaacaccgtgctgtag

SEQ ID NO: 101771 - DNA, 2145 bp, Artificial Sequence
  Description of Artificial Sequence: Synthetic coding sequence
atgaccaagagaagactgcagaccatcaccgcctgcctgcagctgagagagggcagccccagcctgcacagaggcctgcaccccagcagagaggagaagagagacagcagaatggccgaggagaagaagctgaagctgagcaacaccgtgctgcccagcgagagcatgaaggtggtggccgagagcatgggcatcgcccagatccaggaggagacctgccagctgctgaccgacgaggtgagctacagaatcaaggagatcgcccaggacgccctgaagttcatgcacatgggcaagagacagaagctgaccaccagcgacatcgactacgccctgaagctgaagaacgtggagcccctgtacggcttccacgcccaggagttcatccccttcagattcgccagcggcggcggcagagagctgtacttctacgaggagaaggaggtggacctgagcgacatcatcaacacccccctgcccagagtgcccctggacgtgtgcctgaaggcccactggctgagcatcgagggctgccagcccgccatccccgagaaccccccccccgcccccaaggagcagcagaaggccgaggccaccgagcccctgaagagcgccaagcccggccaggaggaggacggccccctgaagggcaagggccagggcgccaccaccgccgacggcaagggcaaggagaagaaggccccccccctgctggagggcgcccccctgagactgaagcccagaagcatccacgagctgagcgtggagcagcagctgtactacaaggagatcaccgaggcctgcgtgggcagctgcgaggccaagagagccgaggccctgcagagcatcgccaccgaccccggcctgtaccagatgctgcccagattcagcaccttcatcagcgagggcgtgagagtgaacgtggtgcagaacaacctggccctgctgatctacctgatgagaatggtgaaggccctgatggacaaccccaccctgtacctggagaagtacgtgcacgagctgatccccgccgtgatgacctgcatcgtgagcagacagctgtgcctgagacccgacgtggacaaccactgggccctgagagacttcgccgccagactggtggcccagatctgcaagcacttcagcaccaccaccaacaacatccagagcagaatcaccaagaccttcaccaagagctgggtggacgagaagaccccctggaccaccagatacggcagcatcgccggcctggccgagctgggccacgacgtgatcaagaccctgatcctgcccagactgcagcaggagggcgagagaatcagaagcgtgctggacggccccgtgctgagcaacatcgacagaatcggcgccgaccacgtgcagagcctgctgctgaagcactgcgcccccgtgctggccaagctgagacccccccccgacaaccaggacgcctacagagccgagttcggcagcctgggccccctgctgtgcagccaggtggtgaaggccagagcccaggccgccctgcaggcccagcaggtgaacagaaccaccctgaccatcacccagcccagacccaccctgaccctgagccaggccccccagcccggccccagaacccccggcctgctgaaggtgcccggcagcatcgccctgcccgtgcagaccctggtgagcgccagagccgccgcccccccccagcccagccccccccccaccaagttcatcgtgatgagcagcagcagcagcgcccccagcacccagcaggtgctgagcctgagcaccagcgcccccggcagcggcagcaccaccaccagccccgtgaccaccaccgtgcccagcgtgcagcccatcgtgaagctggtgagcaccgccaccaccgccccccccagcaccgcccccagcggccccggcagcgtgcagaagtacatcgtggtgagcctgccccccaccggcgagggcaagggcggccccaccagccaccccagccccgtgcccccccccgccagcagccccagccccctgagcggcagcgccctgtgcggcggcaagcaggaggccggcgacagccccccccccgcccccggcacccccaaggccaacggcagccagcccaacagcggcagcccccagcccgccccctag

SEQ ID NO: 101772 - DNA, 702 bp, Artificial Sequence
  Description of Artificial Sequence: Synthetic coding sequence
atggccgaggagaagaagctgaagctgagcaacaccgtgctgcccagcgagagcatgaaggtggtggccgagagcatgggcatcgcccagatccaggaggagacctgccagctgctgaccgacgaggtgagctacagaatcaaggagatcgcccaggacgccctgaagttcatgcacatgggcaagagacagaagctgaccaccagcgacatcgactacgccctgaagctgaagaacgtggagcccctgtacggcttccacgcccaggagttcatccccttcagattcgccagcggcggcggcagagagctgtacttctacgaggagaaggaggtggacctgagcgacatcatcaacacccccctgcccagagtgcccctggacgtgtgcctgaaggcccccaaggagcagcagaaggccgaggccaccgagcccctgaagagcgccaagcccggccaggaggaggacggccccctgaagggcaagggccagggcgccaccaccgccgacggcaagggcaaggagaagaaggccccccccctgctggagggcgcccccctgagactgaagcccagaagcatccacgagctgagcgtggagcagcagctgtactacaaggagatcaccgaggcctgcgtgggcagctgcgaggccaagagagccgaggccctgcagagcatcgccaccgaccccggcctgtag

SEQ ID NO: 101773 - DNA, 405 bp, Artificial Sequence
  Description of Artificial Sequence: Synthetic coding sequence
atggccgaggagaagaagctgaagctgagcaacaccgtgctgcccagcgagagcatgaaggtggtggccgagagcatgggcatcgcccagatccaggaggagacctgccagctgctgaccgacgaggtgagctacagaatcaaggagatcgcccaggacgccctgaagttcatgcacatgggcaagagacagaagctgaccaccagcgacatcgactacgccctgaagctgaagaacgtggagcccctgtacggcttccacgcccaggagttcatccccttcagattcgccagcggcggcggcagagagctgtacttctacgaggagaaggaggtggacctgagcgacatcatcaacacccccctgcccagagtgcccctggacgtgtgcctgaaggcccactag

SEQ ID NO: 101774 - DNA, 345 bp, Artificial Sequence
  Description of Artificial Sequence: Synthetic coding sequence
atggccgaggagaagaagctgaagctgagcaacaccgtgctgcccagcgagagcatgaaggtggtggccgagagcatgggcatcgcccagatccaggaggagacctgccagctgctgaccgacgaggtgagctacagaatcaaggagatcgcccaggacgccctgaagttcatgcacatgggcaagagacagaagctgaccaccagcgacatcgactacgccctgaagctgaagaacgtggagcccctgtacggcttccacgcccaggagttcatccccttcagattcgccagcggcggcggcagagagctgtacttctacgaggagaaggaggtggacctgtag

SEQ ID NO: 101775 - DNA, 2034 bp, Artificial Sequence; identical to SEQ ID NO: 101767
  Description of Artificial Sequence: Synthetic coding sequence

SEQ ID NO: 101776 - DNA, 2034 bp, Artificial Sequence; identical to SEQ ID NO: 101767
  Description of Artificial Sequence: Synthetic coding sequence

SEQ ID NO: 101777 - DNA, 30 bp, Artificial Sequence
  Description of Artificial Sequence: Synthetic coding sequence
atggccgaggagaagaagctgaagctgtag

SEQ ID NO: 101778 - DNA, 2205 bp, Artificial Sequence
  Description of Artificial Sequence: Synthetic coding sequence
atggacatcagacacagcgagttcctgccctgcctgcactgcccccccttcgtgggccccctgcccgtgagccacgtgagcttcagcagcgcctgccccgtgcccctgcccggcagccccagcctgcacagaggcctgcaccccagcagagaggagaagagagacagcagaatggccgaggagaagaagctgaagctgagcaacaccgtgctgcccagcgagagcatgaaggtggtggccgagagcatgggcatcgcccagatccaggaggagacctgccagctgctgaccgacgaggtgagctacagaatcaaggagatcgcccaggacgccctgaagttcatgcacatgggcaagagacagaagctgaccaccagcgacatcgactacgccctgaagctgaagaacgtggagcccctgtacggcttccacgcccaggagttcatccccttcagattcgccagcggcggcggcagagagctgtacttctacgaggagaaggaggtggacctgagcgacatcatcaacacccccctgcccagagtgcccctggacgtgtgcctgaaggcccactggctgagcatcgagggctgccagcccgccatccccgagaaccccccccccgcccccaaggagcagcagaaggccgaggccaccgagcccctgaagagcgccaagcccggccaggaggaggacggccccctgaagggcaagggccagggcgccaccaccgccgacggcaagggcaaggagaagaaggccccccccctgctggagggcgcccccctgagactgaagcccagaagcatccacgagctgagcgtggagcagcagctgtactacaaggagatcaccgaggcctgcgtgggcagctgcgaggccaagagagccgaggccctgcagagcatcgccaccgaccccggcctgtaccagatgctgcccagattcagcaccttcatcagcgagggcgtgagagtgaacgtggtgcagaacaacctggccctgctgatctacctgatgagaatggtgaaggccctgatggacaaccccaccctgtacctggagaagtacgtgcacgagctgatccccgccgtgatgacctgcatcgtgagcagacagctgtgcctgagacccgacgtggacaaccactgggccctgagagacttcgccgccagactggtggcccagatctgcaagcacttcagcaccaccaccaacaacatccagagcagaatcaccaagaccttcaccaagagctgggtggacgagaagaccccctggaccaccagatacggcagcatcgccggcctggccgagctgggccacgacgtgatcaagaccctgatcctgcccagactgcagcaggagggcgagagaatcagaagcgtgctggacggccccgtgctgagcaacatcgacagaatcggcgccgaccacgtgcagagcctgctgctgaagcactgcgcccccgtgctggccaagctgagacccccccccgacaaccaggacgcctacagagccgagttcggcagcctgggccccctgctgtgcagccaggtggtgaaggccagagcccaggccgccctgcaggcccagcaggtgaacagaaccaccctgaccatcacccagcccagacccaccctgaccctgagccaggccccccagcccggccccagaacccccggcctgctgaaggtgcccggcagcatcgccctgcccgtgcagaccctggtgagcgccagagccgccgcccccccccagcccagccccccccccaccaagttcatcgtgatgagcagcagcagcagcgcccccagcacccagcaggtgctgagcctgagcaccagcgcccccggcagcggcagcaccaccaccagccccgtgaccaccaccgtgcccagcgtgcagcccatcgtgaagctggtgagcaccgccaccaccgccccccccagcaccgcccccagcggccccggcagcgtgcagaagtacatcgtggtgagcctgccccccaccggcgagggcaagggcggccccaccagccaccccagccccgtgcccccccccgccagcagccccagccccctgagcggcagcgccctgtgcggcggcaagcaggaggccggcgacagccccccccccgcccccggcacccccaaggccaacggcagccagcccaacagcggcagcccccagcccgccccctag

SEQ ID NO: 101779 - DNA, 768 bp, Artificial Sequence
  Description of Artificial Sequence: Synthetic coding sequence
atggccgaggagaagaagctgaagctgagcaacaccgtgctgcccagcgagagcatgaaggtggtggccgagagcatgggcatcgcccagatccaggaggagacctgccagctgctgaccgacgaggtgagctacagaatcaaggagatcgcccaggacgccctgaagttcatgcacatgggcaagagacagaagctgaccaccagcgacatcgactacgccctgaagctgaagaacgtggagcccctgtacggcttccacgcccaggagttcatccccttcagattcgccagcggcggcggcagagagctgtacttctacgaggagaaggaggtggacctgagcgacatcatcaacacccccctgcccagagtgcccctggacgtgtgcctgaaggcccactggctgagcatcgagggctgccagcccgccatccccgagaaccccccccccgcccccaaggagcagcagaaggccgaggccaccgagcccctgaagagcgccaagcccggccaggaggaggacggccccctgaagggcaagggccagggcgccaccaccgccgacggcaagggcaaggagaagaaggccccccccctgctggagggcgcccccctgagactgaagcccagaagcatccacgagctgagcgtggagcagcagctgtactacaaggagatcaccgaggcctgcgtgggcagctgcgaggccaagagagccgaggccctgcagagcatcgccaccgaccccggcctgtaccagatgtag

SEQ ID NO: 101780 - DNA, 1050 bp, Artificial Sequence
  Description of Artificial Sequence: Synthetic coding sequence
atgagcaagagcaaggacgacgccccccacgagctggagagccagttcatcctgagactgccccccgagtacgccagcaccgtgagaagagccgtgcagagcggccacgtgaacctgaaggacagactgaccatcgagctgcaccccgacggcagacacggcatcgtgagagtggacagagtgcccctggccagcaagctggtggacctgccctgcgtgatggagagcctgaagaccatcgacaagaagaccttctacaagaccgccgacatctgccagatgctggtgagcaccgtggacggcgacctgtacccccccgtggaggagcccgtggccagcaccgaccccaaggccagcaagaagaaggacaaggacaaggagaagaagttcatctggaaccacggcatcaccctgcccctgaagaacgtgagaaagagaagattcagaaagaccgccaagaagaagtacatcgagagccccgacgtggagaaggaggtgaagagactgctgagcaccgacgccgaggccgtgagcaccagatgggagatcatcgccgaggacgagaccaaggaggccgagaaccagggcctggacatcagcagccccggcatgagcggccacagacagggccacgacagcctggagcacgacgagctgagagagatcttcaacgacctgagcagcagcagcgaggacgaggacgagacccagcaccaggacgaggaggacatcaacatcatcgacaccgaggaggacctggagagacagctgcaggacaagctgaacgagagcgacgagcagcaccaggagaacgagggcaccaaccagctggtgatgggcatccagaagcagatcgacaacatgaagggcaagctgcaggagacccaggacagagccaagagacaggaggacctgatcatgaaggtggagaacctggccctgaagaacagattccaggccgtgctggacgagctgaagcagaaggaggacagagagaaggagcagctgagcagcctgcaggaggagctggagagcctgctggagaagtag

SEQ ID NO: 101781 - DNA, 909 bp, Artificial Sequence
  Description of Artificial Sequence: Synthetic coding sequence
atgagcgagagccaggacgaggtgcccgacgaggtggagaaccagttcatcctgagactgcccctggagcacgcctgcaccgtgagaaacctggccagaagccagagcgtgaagatgaaggacaagctgaagatcgacctgctgcccgacggcagacacgccgtggtggaggtggaggacgtgcccctggccgccaagctggtggacctgccctgcgtgatcgagagcctgagaaccctggacaagaagaccttctacaagaccgccgacatcagccagatgctggtgtgcaccgccgacggcgacatccacctgagccccgaggagcccgccgccagcaccgaccccaacatcgtgagaaagaaggagagaggcagagaggagaagtgcgtgtggaagcacggcatcaccccccccctgaagaacgtgagaaagaagagattcagaaagacccagaagaaggtgcccgacgtgaaggagatggagaagagcagcttcaccgagtacatcgagagccccgacgtggagaacgaggtgaagagactgctgagaagcgacgccgaggccgtgagcaccagatgggaggtgatcgccgaggacggcaccaaggagatcgagagccagggcagcatccccggcttcctgatcagcagcggcatgagcagccacaagcagggccacaccagcagcgtgatggagatccagaagcagatcgagaagaaggagaagaagctgcacaagatccagaacaaggcccagagacagaaggacctgatcatgaaggtggagaacctgaccctgaagaaccacttccagagcgtgctggagcagctggagctgcaggagaagcagaagaacgagaagctgatcagcctgcaggagcagctgcagagattcctgaagaagtag

SEQ ID NO: 101782 - DNA, 1131 bp, Artificial Sequence
  Description of Artificial Sequence: Synthetic coding sequence
atgagcgagagccaggacgaggtgcccgacgaggtggagaaccagttcatcctgagactgcccctggagcacgcctgcaccgtgagaaacctggccagaagccagagcgtgaagatgaaggacaagctgaagatcgacctgctgcccgacggcagacacgccgtggtggaggtggaggacgtgcccctggccgccaagctggtggacctgccctgcgtgatcgagagcctgagaaccctggacaagaagaccttctacaagaccgccgacatcagccagatgctggtgtgcaccgccgacggcgacatccacctgagccccgaggagcccgccgccagcaccgaccccaacatcgtgagaaagaaggagagaggcagagaggagaagtgcgtgtggaagcacggcatcaccccccccctgaagaacgtgagaaagaagagattcagaaagacccagaagaaggtgcccgacgtgaaggagatggagaagagcagcttcaccgagtacatcgagagccccgacgtggagaacgaggtgaagagactgctgagaagcgacgccgaggccgtgagcaccagatgggaggtgatcgccgaggacggcaccaaggagatcgagagccagggcagcatccccggcttcctgatcagcagcggcatgagcagccacaagcagggccacaccagcagcgagtacgacatgctgagagagatgttcagcgacagcagaagcaacaacgacgacgacgaggacgaggacgacgaggacgaggacgaggacgaggacgaggacgaggacgaggacaaggaggaggaggaggaggactgcagcgaggagtacctggagagacagctgcaggccgagttcatcgagagcggccagtacagagccaacgagggcaccagcagcatcgtgatggagatccagaagcagatcgagaagaaggagaagaagctgcacaagatccagaacaaggcccagagacagaaggacctgatcatgaaggtggagaacctgaccctgaagaaccacttccagagcgtgctggagcagctggagctgcaggagaagcagaagaacgagaagctgatcagcctgcaggagcagctgcagagattcctgaagaagtag

SEQ ID NO: 101783 - DNA, 909 bp, Artificial Sequence; identical to SEQ ID NO: 101781
  Description of Artificial Sequence: Synthetic coding sequence

SEQ ID NO: 101784 - DNA, 1389 bp, Artificial Sequence
  Description of Artificial Sequence: Synthetic coding sequence
atggagtgccccgagggccagctgcccatcagcagcgagaacgacagcacccccaccgtgagcaccagcgaggtgaccagccagcaggagccccagatcctggtggacagaggcagcgagaccacctacgagagcagcgccgacatcgccggcgacgagggcacccagatccccgccgacgaggacacccagaccgacgccgacagcagcgcccaggccgccgcccaggcccccgagaacttccaggagggcaaggacatgagcgagagccaggacgaggtgcccgacgaggtggagaaccagttcatcctgagactgcccctggagcacgcctgcaccgtgagaaacctggccagaagccagagcgtgaagatgaaggacaagctgaagatcgacctgctgcccgacggcagacacgccgtggtggaggtggaggacgtgcccctggccgccaagctggtggacctgccctgcgtgatcgagagcctgagaaccctggacaagaagaccttctacaagaccgccgacatcagccagatgctggtgtgcaccgccgacggcgacatccacctgagccccgaggagcccgccgccagcaccgaccccaacatcgtgagaaagaaggagagaggcagagaggagaagtgcgtgtggaagcacggcatcaccccccccctgaagaacgtgagaaagaagagattcagaaagacccagaagaaggtgcccgacgtgaaggagatggagaagagcagcttcaccgagtacatcgagagccccgacgtggagaacgaggtgaagagactgctgagaagcgacgccgaggccgtgagcaccagatgggaggtgatcgccgaggacggcaccaaggagatcgagagccagggcagcatccccggcttcctgatcagcagcggcatgagcagccacaagcagggccacaccagcagcgagtacgacatgctgagagagatgttcagcgacagcagaagcaacaacgacgacgacgaggacgaggacgacgaggacgaggacgaggacgaggacgaggacgaggacgaggacaaggaggaggaggaggaggactgcagcgaggagtacctggagagacagctgcaggccgagttcatcgagagcggccagtacagagccaacgagggcaccagcagcatcgtgatggagatccagaagcagatcgagaagaaggagaagaagctgcacaagatccagaacaaggcccagagacagaaggacctgatcatgaaggtggagaacctgaccctgaagaaccacttccagagcgtgctggagcagctggagctgcaggagaagcagaagaacgagaagctgatcagcctgcaggagcagctgcagagattcctgaagaagtag

SEQ ID NO: 101785 - DNA, 1548 bp, Artificial Sequence
  Description of Artificial Sequence: Synthetic coding sequence
atgggcaactgggtggtgaaccactggttcagcgtgctgttcctggtggtgtggctgggcctgaacgtgttcctgttcgtggacgccttcctgaagtacgagaaggccgacaagtactactacaccagaaagatcctgggcagcaccctggcctgcgccagagccagcgccctgtgcctgaacttcaacagcaccctgatcctgctgcccgtgtgcagaaacctgctgagcttcctgagaggcacctgcagcttctgcagcagaaccctgagaaagcagctggaccacaacctgaccttccacaagctggtggcctacatgatctgcctgcacaccgccatccacatcatcgcccacctgttcaacttcgactgctacagcagaagcagacaggccaccgacggcagcctggccagcatcctgagcagcctgagccacgacgagaagaagggcggcagctggctgaaccccatccagagcagaaacaccaccgtggagtacgtgaccttcaccagcatcgccggcctgaccggcgtgatcatgaccatcgccctgatcctgatggtgaccagcgccaccgagttcatcagaagaagctacttcgaggtgttctggtacacccaccacctgttcatcttctacatcctgggcctgggcatccacggcatcggcggcatcgtgagaggccagaccgaggagagcatgaacgagagccaccccagaaagtgcgccgagagcttcgagatgtgggacgacagagacagccactgcagaagacccaagttcgagggccacccccccgagagctggaagtggatcctggcccccgtgatcctgtacatctgcgagagaatcctgagattctacagaagccagcagaaggtggtgatcaccaaggtggtgatgcaccccagcaaggtgctggagctgcagatgaacaagagaggcttcagcatggaggtgggccagtacatcttcgtgaactgccccagcatcagcctgctggagtggcaccccttcaccctgaccagcgcccccgaggaggacttcttcagcatccacatcagagccgccggcgactggaccgagaacctgatcagagccttcgagcagcagtacagccccatccccagaatcgaggtggacggccccttcggcaccgccagcgaggacgtgttccagtacgaggtggccgtgctggtgggcgccggcatcggcgtgacccccttcgccagcatcctgaagagcatctggtacaagttccagtgcgccgaccacaacctgaagaccaagaaggtgggccacgccgccctgaacttcgacaaggccaccgacatcgtgaccggcctgaagcagaagaccagcttcggcagacccatgtgggacaacgagttcagcaccatcgccaccagccaccccaagagcgtggtgggcgtgttcctgtgcggccccagaaccctggccaagagcctgagaaagtgctgccacagatacagcagcctggaccccagaaaggtgcagttctacttcaacaaggagaacttctag

SEQ ID NO: 101786 - DNA, 795 bp, Artificial Sequence; identical to SEQ ID NO: 85835
  Description of Artificial Sequence: Synthetic coding sequence

SEQ ID NO: 101787 - DNA, 510 bp, Artificial Sequence
  Description of Artificial Sequence: Synthetic coding sequence
atgtgccacagaaagcccggcacccccggcgtgggcaagaccaccctgggcaaggagctggccagcaagagcggcctgaagtacatcaacgtgggcgacctggccagagaggagcagctgtacgacggctacgacgaggagtacgactgccccatcctggacgaggacagagtggtggacgagctggacaaccagatgagagagggcggcgtgatcgtggactaccacggctgcgacttcttccccgagagatggttccacatcgtgttcgtgctgagaaccgacaccaacgtgctgtacgagagactggagaccagaggctacaacgagaagaagctgaccgacaacatccagtgcgagatcttccaggtgctgtacgaggaggccaccgccagctacaaggaggagatcgtgcaccagctgcccagcaacaagcccgaggagctggagaacaacgtggaccagatcctgaagtggatcgagcagtggatcaaggaccacaacagctag

SEQ ID NO: 101788 - DNA, 519 bp, Artificial Sequence
  Description of Artificial Sequence: Synthetic coding sequence
atgctgctgcccaacatcctgctgaccggcacccccggcgtgggcaagaccaccctgggcaaggagctggccagcaagagcggcctgaagtacatcaacgtgggcgacctggccagagaggagcagctgtacgacggctacgacgaggagtacgactgccccatcctggacgaggacagagtggtggacgagctggacaaccagatgagagagggcggcgtgatcgtggactaccacggctgcgacttcttccccgagagatggttccacatcgtgttcgtgctgagaaccgacaccaacgtgctgtacgagagactggagaccagaggctacaacgagaagaagctgaccgacaacatccagtgcgagatcttccaggtgctgtacgaggaggccaccgccagctacaaggaggagatcgtgcaccagctgcccagcaacaagcccgaggagctggagaacaacgtggaccagatcctgaagtggatcgagcagtggatcaaggaccacaacagctag

SEQ ID NO: 101789 - DNA, 597 bp, Artificial Sequence
  Description of Artificial Sequence: Synthetic coding sequence
atggagagcggcaagaccgccagccccaagagcatgcccaaggacgcccagatgatggcccagatcctgaaggacatgggcatcaccgagtacgagcccagagtgatcaaccagatgctggagttcgccttcagatacgtgaccaccatcctggacgacgccaagatctacagcagccacgccaagaaggccaccgtggacgccgacgacgtgagactggccatccagtgcagagccgaccagagcttcaccagccccccccccagagacttcctgctggacatcgccagacagagaaaccagacccccctgcccctgatcaagccctacagcggccccagactgccccccgacagatactgcctgaccgcccccaactacagactgaagagcctgcagaagaaggccagcaccagcgccggcagaatcaccgtgcccagactgagcgtgggcagcgtgaccagcagacccagcacccccaccctgggcacccccaccccccagaccatgagcgtgagcaccaaggtgggcacccccatgagcctgaccggccagagattcaccgtgcagatgcccaccagccagagccccgcctag

SEQ ID NO: 101790 - DNA, 411 bp, Artificial Sequence
  Description of Artificial Sequence: Synthetic coding sequence
atggagagcggcaagaccgccagccccaagagcatgcccaaggacgcccagatgatggcccagatcctgaaggacatgggcatcaccgagtacgagcccagagtgatcaaccagatgctggagttcgccttcagatacgtgaccaccatcctggacgacgccaagatctacagcagccacgccaagaaggccaccgtggacgccgacgacgtgagactggccatccagtgcagagccgaccagagcttcaccagccccccccccagagacttcctgctggacatcgccagacagagaaaccagacccccctgcccctgatcaagccctacagcggccccagactgccccccgacagatactgcctgaccgcccccaactacagactgaagagcctgcagaagaaggcctag

SEQ ID NO: 101791 - DNA, 795 bp, Artificial Sequence; identical to SEQ ID NO: 85835
  Description of Artificial Sequence: Synthetic coding sequence

SEQ ID NO: 101792 - DNA, 309 bp, Artificial Sequence
  Description of Artificial Sequence: Synthetic coding sequence
atggagagcggcaagaccgccagccccaagagcatgcccaaggacgcccagatgatggcccagatcctgaaggacatgggcatcaccgagtacgagcccagagtgatcaaccagatgctggagttcgccttcagatacgtgaccaccatcctggacgacgccaagatctacagcagccacgccaagaaggccaccgtggacgccgacgacgtgagactggccatccagtgcagagccgaccagagcttcaccagccccccccccagagacttcctgctggacatcgccagacagagaaaccagacctag

SEQ ID NO: 101793 - DNA, 501 bp, Artificial Sequence
  Description of Artificial Sequence: Synthetic coding sequence
atggagagcggcaagaccgccagccccaagagcatgcccaaggacgcccagatgatggcccagatcctgaaggacatgggcatcaccgagtacgagcccagagtgatcaaccagatgctggagttcgccttcagatacgtgaccaccatcctggacgacgccaagatctacagcagccacgccaagaaggccaccgtggacgccgacgacgtgagactggccatccagtgcagagccgaccagagcttcaccagccccccccccagagacttcctgctggacatcgccagacagagaaaccagacccccctgcccctgatcaagccctacagcggccccagactgccccccgacagatactgcctgaccgcccccaactacagactgaagagcctgcagaagaaggccagcaccagcgccggcagaatcaccgtgcccagactgagcgtgggcagcgtgaccagcagacccagcacccccaccctgggcacccccacctag

SEQ ID NO: 101794 - DNA, 384 bp, Artificial Sequence
  Description of Artificial Sequence: Synthetic coding sequence
atggagagcggcaagaccgccagccccaagagcatgcccaaggacgcccagatgatggcccagatcctgaaggacatgggcatcaccgagtacgagcccagagtgatcaaccagatgctggagttcgccttcagatacgtgaccaccatcctggacgacgccaagatctacagcagccacgccaagaaggccaccgtggacgccgacgacgtgagactggccatccagtgcagagccgaccagagcttcaccagccccccccccagagacttcctgctggacatcgccagacagagaaaccagacccccctgcccctgatcaagccctacagcggccccagactgccccccgacagatactgcctgaccgcccccaactactag

SEQ ID NO: 101795 - DNA, 756 bp, Artificial Sequence
  Description of Artificial Sequence: Synthetic coding sequence
atggagagcggcaagatggccccccccaagaacgcccccagagacgccctggtgatggcccagatcctgaaggacatgggcatcaccgagtacgagcccagagtgatcaaccagatgctggagttcgccttcagatacgtgaccaccatcctggacgacgccaagatctacagcagccacgccaagaagcccaacgtggacgccgacgacgtgagactggccatccagtgcagagccgaccagagcttcaccagccccccccccagagacttcctgctggacatcgccagacagaagaaccagacccccctgcccctgatcaagccctacgccggccccagactgccccccgacagatactgcctgaccgcccccaactacagactgaagagcctgatcaagaagggccccaaccagggcagactggtgcccagactgagcgtgggcgccgtgagcagcaagcccaccacccccaccatcgccaccccccagaccgtgagcgtgcccaacaaggtggccacccccatgagcgtgaccagccagagattcaccgtgcagatcccccccagccagagcacccccgtgaagcccgtgcccgccaccaccgccgtgcagaacgtgctgatcaaccccagcatgatcggccccaagaacatcctgatcaccaccaacatggtgagcagccagaacaccgccaacgaggccaaccccctgaagagaaagcacgaggacgacgacgacaacgacatcatgtag

SEQ ID NO: 101796 - DNA, 879 bp, Artificial Sequence
  Description of Artificial Sequence: Synthetic coding sequence
atgcccctgcacgtgaagtggcccttccccgccgtgccccccctgacctggaccctggccagcagcgtggtgatgggcctggtgggcacctacagctgcttctggaccaagtacatgaaccacctgaccgtgcacaacagagaggtgctgtacgagctgatcgagaagagaggccccgccacccccctgatcaccgtgagcaaccaccagagctgcatggacgacccccacctgtggggcatcctgaagctgagacacatctggaacctgaagctgatgagatggacccccgccgccgccgacatctgcttcaccaaggagctgcacagccacttcttcagcctgggcaagtgcgtgcccgtgtgcagaggcgccgagttcttccaggccgagaacgagggcaagggcgtgctggacaccggcagacacatgcccggcgccggcaagagaagagagaagggcgacggcgtgtaccagaagggcatggacttcatcctggagaagctgaaccacggcgactgggtgcacatcttccccgagggcaaggtgaacatgagcagcgagttcctgagattcaagtggggcatcggcagactgatcgccgagtgccacctgaaccccatcatcctgcccctgtggcacgtgggcatgaacgacgtgctgcccaacagccccccctacttccccagattcggccagaagatcaccgtgctgatcggcaagcccttcagcgccctgcccgtgctggagagactgagagccgagaacaagagcgccgtggagatgagaaaggccctgaccgacttcatccaggaggagttccagcacctgaagacccaggccgagcagctgcacaaccacctgcagcccggcagatag

SEQ ID NO: 101797 - DNA, 789 bp, Artificial Sequence
  Description of Artificial Sequence: Synthetic coding sequence
atgcccctgcacgtgaagtggcccttccccgccgtgccccccctgacctggaccctggccagcagcgtggtgatgggcctggtgggcacctacagctgcttctggaccaagtacatgaaccacctgaccgtgcacaacagagaggtgctgtacgagctgatcgagaagagaggccccgccacccccctgatcaccgtgagcaaccaccagagctgcatggacgacccccacctgtggggcatcctgaagctgagacacatctggaacctgaagctgatgagatggacccccgccgccgccgacatctgcttcaccaaggagctgcacagccacttcttcagcctgggcaagtgcgtgcccgtgtgcagaggcgacggcgtgtaccagaagggcatggacttcatcctggagaagctgaaccacggcgactgggtgcacatcttccccgagggcaaggtgaacatgagcagcgagttcctgagattcaagtggggcatcggcagactgatcgccgagtgccacctgaaccccatcatcctgcccctgtggcacgtgggcatgaacgacgtgctgcccaacagccccccctacttccccagattcggccagaagatcaccgtgctgatcggcaagcccttcagcgccctgcccgtgctggagagactgagagccgagaacaagagcgccgtggagatgagaaaggccctgaccgacttcatccaggaggagttccagcacctgaagacccaggccgagcagctgcacaaccacctgcagcccggcagatag

SEQ ID NO: 101798 - DNA, 837 bp, Artificial Sequence
  Description of Artificial Sequence: Synthetic coding sequence
atgcccctgcacgtgaagtggcccttccccgccgtgccccccctgacctggaccctggccagcagcgtggtgatgggcctggtgggcacctacagctgcttctggaccaagtacatgaaccacctgaccgtgcacaacagagaggtgctgtacgagctgatcgagaagagaggccccgccacccccctgatcaccgtgagcaaccaccagagctgcatggacgacccccacctgtggggcatcctgaagctgagacacatctggaacctgaagctgatgagatggacccccgccgccgccgacatctgcttcaccaaggagctgcacagccacttcttcagcctgggcaagtgcgtgcccgtgtgcagaggcgccgagttcttccaggccgagaacgagggcaagggcgtgctggacaccggcagacacatgcccggcgccggcaagagaagagagaagggcgacggcgtgtaccagaagggcatggacttcatcctggagaagctgaaccacggcgactgggtgcacatcttccccgagggcatcggcagactgatcgccgagtgccacctgaaccccatcatcctgcccctgtggcacgtgggcatgaacgacgtgctgcccaacagccccccctacttccccagattcggccagaagatcaccgtgctgatcggcaagcccttcagcgccctgcccgtgctggagagactgagagccgagaacaagagcgccgtggagatgagaaaggccctgaccgacttcatccaggaggagttccagcacctgaagacccaggccgagcagctgcacaaccacctgcagcccggcagatag

SEQ ID NO: 101799 - DNA, 747 bp, Artificial Sequence
  Description of Artificial Sequence: Synthetic coding sequence
atgcccctgcacgtgaagtggcccttccccgccgtgccccccctgacctggaccctggccagcagcgtggtgatgggcctggtgggcacctacagctgcttctggaccaagtacatgaaccacctgaccgtgcacaacagagaggtgctgtacgagctgatcgagaagagaggccccgccacccccctgatcaccgtgagcaaccaccagagctgcatggacgacccccacctgtggggcatcctgaagctgagacacatctggaacctgaagctgatgagatggacccccgccgccgccgacatctgcttcaccaaggagctgcacagccacttcttcagcctgggcaagtgcgtgcccgtgtgcagaggcgacggcgtgtaccagaagggcatggacttcatcctggagaagctgaaccacggcgactgggtgcacatcttccccgagggcatcggcagactgatcgccgagtgccacctgaaccccatcatcctgcccctgtggcacgtgggcatgaacgacgtgctgcccaacagccccccctacttccccagattcggccagaagatcaccgtgctgatcggcaagcccttcagcgccctgcccgtgctggagagactgagagccgagaacaagagcgccgtggagatgagaaaggccctgaccgacttcatccaggaggagttccagcacctgaagacccaggccgagcagctgcacaaccacctgcagcccggcagatag

SEQ ID NO: 101800 - DNA, 798 bp, Artificial Sequence
  Description of Artificial Sequence: Synthetic coding sequence
atgcccctgcacgtgaagtggcccttccccgccgtgccccccctgacctggaccctggccagcagcgtggtgatgggcctggtgggcacctacagctgcttctggaccaagtacatgaaccacctgaccgtgcacaacagagaggtgctgtacgagctgatcgagaagagaggccccgccacccccctgatcaccgtgagcaaccaccagagctgcatggacgacccccacctgtggggcatcctgaagctgagacacatctggaacctgaagctgatgagatggacccccgccgccgccgacatctgcttcaccaaggagctgcacagccacttcttcagcctgggcaagtgcgtgcccgtgtgcagaggcgccgagttcttccaggccgagaacgagggcaagggcgtgctggacaccggcagacacatgcccggcgccggcaagagaagagagaagggcaaggtgaacatgagcagcgagttcctgagattcaagtggggcatcggcagactgatcgccgagtgccacctgaaccccatcatcctgcccctgtggcacgtgggcatgaacgacgtgctgcccaacagccccccctacttccccagattcggccagaagatcaccgtgctgatcggcaagcccttcagcgccctgcccgtgctggagagactgagagccgagaacaagagcgccgtggagatgagaaaggccctgaccgacttcatccaggaggagttccagcacctgaagacccaggccgagcagctgcacaaccacctgcagcccggcagatag

SEQ ID NO: 101801 - DNA, 7629 bp, Artificial Sequence
  Description of Artificial Sequence: Synthetic coding sequence
atggtggccctgagcctgaagatctgcgtgagacactgcaacgtggtgaagaccatgcagttcgagcccagcaccgccgtgtacgacgcctgcagagtgatcagagagagagtgcccgaggcccagaccggccaggccagcgactacggcctgttcctgagcgacgaggaccccagaaagggcatctggctggaggccggcagaaccctggactactacatgctgagaaacggcgacatcctggagtacaagaagaagcagagaccccagaagatcagaatgctggacggcagcgtgaagaccgtgatggtggacgacagcaagaccgtgggcgagctgctggtgaccatctgcagcagaatcggcatcaccaactacgaggagtacagcctgatccaggagaccatcgaggagaagaaggaggagggcaccggcaccctgaagaaggacagaaccctgctgagagacgagagaaagatggagaagctgaaggccaagctgcacaccgacgacgacctgaactggctggaccacagcagaaccttcagagagcagggcgtggacgagaacgagaccctgctgctgagaagaaagttcttctacagcgaccagaacgtggacagcagagaccccgtgcagctgaacctgctgtacgtgcaggccagagacgacatcctgaacggcagccaccccgtgagcttcgagaaggcctgcgagttcggcggcttccaggcccagatccagttcggcccccacgtggagcacaagcacaagcccggcttcctggacctgaaggagttcctgcccaaggagtacatcaagcagagaggcgccgagaagagaatcttccaggagcacaagaactgcggcgagatgagcgagatcgaggccaaggtgaagtacgtgaagctggccagaagcctgagaacctacggcgtgagcttcttcctggtgaaggagaagatgaagggcaagaacaagctggtgcccagactgctgggcatcaccaaggacagcgtgatgagagtggacgagaagaccaaggaggtgctgcaggagtggcccctgaccaccgtgaagagatgggccgccagccccaagagcttcaccctggacttcggcgagtaccaggagagctactacagcgtgcagaccaccgagggcgagcagatcagccagctgatcgccggctacatcgacatcatcctgaagaagaagcagagcaaggacagattcggcctggagggcgacgaggagagcaccatgctggaggagagcgtgagccccaagaagagcaccatcctgcagcagcagttcaacagaaccggcaaggccgagcacggcagcgtggccctgcccgccgtgatgagaagcggcagcagcggccccgagaccttcaacgtgggcagcatgcccagcccccagcagcaggtgatggtgggccagatgcacagaggccacatgccccccctgaccagcgcccagcaggccctgatgggcaccatcaacaccagcatgcacgccgtgcagcaggcccaggacgacctgagcgagctggacagcctgccccccctgggccaggacatggccagcagagtgtgggtgcagaacaaggtggacgagagcaagcacgagatccacagccaggtggacgccatcaccgccggcaccgccagcgtggtgaacctgaccgccggcgaccccgccgacaccgactacaccgccgtgggctgcgccatcaccaccatcagcagcaacctgaccgagatgagcaagggcgtgaagctgctggccgccctgatggacgacgaggtgggcagcggcgaggacctgctgagagccgccagaaccctggccggcgccgtgagcgacctgctgaaggccgtgcagcccaccagcggcgagcccagacagaccgtgctgaccgccgccggcagcatcggccaggccagcggcgacctgctgagacagatcggcgagaacgagaccgacgagagattccaggacgtgctgatgagcctggccaaggccgtggccaacgccgccgccatgctggtgctgaaggccaagaacgtggcccaggtggccgaggacaccgtgctgcagaacagagtgatcgccgccgccacccagtgcgccctgagcaccagccagctggtggcctgcgccaaggtggtgagccccaccatcagcagccccgtgtgccaggagcagctgatcgaggccggcaagctggtggacagaagcgtggagaactgcgtgagagcctgccaggccgccaccaccgacagcgagctgctgaagcaggtgagcgccgccgccagcgtggtgagccaggccctgcacgacctgctgcagcacgtgagacagttcgccagcagaggcgagcccatcggcagatacgaccaggccaccgacaccatcatgtgcgtgaccgagagcatcttcagcagcatgggcgacgccggcgagatggtgagacaggccagagtgctggcccaggccaccagcgacctggtgaacgccatgagaagcgacgccgaggccgagatcgacatggagaacagcaagaagctgctggccgccgccaagctgctggccgacagcaccgccagaatggtggaggccgccaagggcgccgccgccaaccccgagaacgaggaccagcagcagagactgagagaggccgccgagggcctgagagtggccaccaacgccgccgcccagaacgccatcaagaagaagatcgtgaacagactggaggtggccgccaagcaggccgccgccgccgccacccagaccatcgccgccagccagaacgccgccgtgagcaacaagaaccccgccgcccagcagcagctggtgcagagctgcaaggccgtggccgaccacatcccccagctggtgcagggcgtgagaggcagccaggcccaggccgaggacctgagcgcccagctggccctgatcatcagcagccagaacttcctgcagcccggcagcaagatggtgagcagcgccaaggccgccgtgcccaccgtgagcgaccaggccgccgccatgcagctgagccagtgcgccaagaacctggccaccagcctggccgagctgagaaccgccagccagaaggcccacgaggcctgcggccccatggagatcgacagcgccctgaacaccgtgcagaccctgaagaacgagctgcaggacgccaagatggccgccgtggagagccagctgaagcccctgcccggcgagaccctggagaagtgcgcccaggacctgggcagcaccagcaaggccgtgggcagcagcatggcccagctgctgacctgcgccgcccagggcaacgagcactacaccggcgtggccgccagagagaccgcccaggccctgaagaccctggcccaggccgccagaggcgtggccgccagcaccaccgaccccgccgccgcccacgccatgctggacagcgccagagacgtgatggagggcagcgccatgctgatccaggaggccaagcaggccctgatcgcccccggcgacgccgagagacagcagagactggcccaggtggccaaggccgtgagccacagcctgaacaactgcgtgaactgcctgcccggccagaaggacgtggacgtggccctgaagagcatcggcgagagcagcaagaagctgctggtggacagcctgccccccagcaccaagcccttccaggaggcccagagcgagctgaaccaggccgccgccgacctgaaccagagcgccggcgaggtggtgcacgccaccagaggccagagcggcgagctggccgccgccagcggcaagttcagcgacgacttcgacgagttcctggacgccggcatcgagatggccggccaggcccagaccaaggaggaccagatccaggtgatcggcaacctgaagaacatcagcatggccagcagcaagctgctgctggccgccaagagcctgagcgtggaccccggcgcccccaacgccaagaacctgctggccgccgccgccagagccgtgaccgagagcatcaaccagctgatcaccctgtgcacccagcaggcccccggccagaaggagtgcgacaacgccctgagagagctggagaccgtgaagggcatgctggacaaccccaacgagcccgtgagcgacctgagctacttcgactgcatcgagagcgtgatggagaacagcaaggtgctgggcgagagcatggccggcatcagccagaacgccaagaccggcgacctgcccgccttcggcgagtgcgtgggcatcgccagcaaggccctgtgcggcctgaccgaggccgccgcccaggccgcctacctggtgggcatcagcgaccccaacagccaggccggccaccagggcctggtggaccccatccagttcgccagagccaaccaggccatccagatggcctgccagaacctggtggaccccggcagcagccccagccaggtgctgagcgccgccaccatcgtggccaagcacaccagcgccctgtgcaacgcctgcagaatcgccagcagcaagaccgccaaccccgtggccaagagacacttcgtgcagagcgccaaggaggtggccaacagcaccgccaacctggtgaagaccatcaaggccctggacggcgacttcagcgaggacaacagaaacaagtgcagaatcgccaccgcccccctgatcgaggccgtggagaacctgaccgccttcgccagcaaccccgagttcgtgagcatccccgcccagatcagcagcgagggcagccaggcccaggagcccatcctggtgagcgccaagaccatgctggagagcagcagctacctgatcagaaccgccagaagcctggccatcaaccccaaggacccccccacctggagcgtgctggccggccacagccacaccgtgagcgacagcatcaagagcctgatcaccagcatcagagacaaggcccccggccagagagagtgcgactacagcatcgacggcatcaacagatgcatcagagacatcgagcaggccagcctggccgccgtgagccagagcctggccaccagagacgacatcagcgtggaggccctgcaggagcagctgaccagcgtggtgcaggagatcggccacctgatcgaccccatcgccaccgccgccagaggcgaggccgcccagctgggccacaaggtgacccagctggccagctacttcgagcccctgatcctggccgccgtgggcgtggccagcaagatcctggaccaccagcagcagatgaccgtgctggaccagaccaagaccctggccgagagcgccctgcagatgctgtacgccgccaaggagggcggcggcaaccccaaggcccagcacacccacgacgccatcaccgaggccgcccagctgatgaaggaggccgtggacgacatcatggtgaccctgaacgaggccgccagcgaggtgggcctggtgggcggcatggtggacgccatcgccgaggccatgagcaagctggacgagggcaccccccccgagcccaagggcaccttcgtggactaccagaccaccgtggtgaagtacagcaaggccatcgccgtgaccgcccaggagatgatgaccaagagcgtgaccaaccccgaggagctgggcggcctggccagccagatgaccagcgactacggccacctggccttccagggccagatggccgccgccaccgccgagcccgaggagatcggcttccagatcagaaccagagtgcaggacctgggccacggctgcatcttcctggtgcagaaggccggcgccctgcaggtgtgccccaccgacagctacaccaagagagagctgatcgagtgcgccagagccgtgaccgagaaggtgagcctggtgctgagcgccctgcaggccggcaacaagggcacccaggcctgcatcaccgccgccaccgccgtgagcggcatcatcgccgacctggacaccaccatcatgttcgccaccgccggcaccctgaacgccgagaacagcgagaccttcgccgaccacagagagaacatcctgaagaccgccaaggccctggtggaggacaccaagctgctggtgagcggcgccgccagcacccccgacaagctggcccaggccgcccagagcagcgccgccaccatcacccagctggccgaggtggtgaagctgggcgccgccagcctgggcagcgacgaccccgagacccaggtggtgctgatcaacgccatcaaggacgtggccaaggccctgagcgacctgatcagcgccaccaagggcgccgccagcaagcccgtggacgaccccagcatgtaccagctgaagggcgccgccaaggtgatggtgaccaacgtgaccagcctgctgaagaccgtgaaggccgtggaggacgaggccaccagaggcaccagagccctggaggccaccatcgagtgcatcaagcaggagctgaccgtgttccagagcaaggacgtgcccgagaagaccagcagccccgaggagagcatcagaatgaccaagggcatcaccatggccaccgccaaggccgtggccgccggcaacagctgcagacaggaggacgtgatcgccaccgccaacctgagcagaaaggccgtgagcgacatgctgaccgcctgcaagcaggccagcttccaccccgacgtgagcgacgaggtgagaaccagagccctgagattcggcaccgagtgcaccctgggctacctggacctgctggagcacgtgctggtgatcctgcagaagcccacccccgagttcaagcagcagctggccgccttcagcaagagagtggccggcgccgtgaccgagctgatccaggccgccgaggccatgaagggcaccgagtgggtggaccccgaggaccccaccgtgatcgccgagaccgagctgctgggcgccgccgccagcatcgaggccgccgccaagaagctggagcagctgaagcccagagccaagcccaagcaggccgacgagaccctggacttcgaggagcagatcctggaggccgccaagagcatcgccgccgccaccagcgccctggtgaagagcgccagcgccgcccagagagagctggtggcccagggcaaggtgggcagcatccccgccaacgccgccgacgacggccagtggagccagggcctgatcagcgccgccagaatggtggccgccgccaccagcagcctgtgcgaggccgccaacgccagcgtgcagggccacgccagcgaggagaagctgatcagcagcgccaagcaggtggccgccagcaccgcccagctgctggtggcctgcaaggtgaaggccgaccaggacagcgaggccatgagaagactgcaggccgccggcaacgccgtgaagagagccagcgacaacctggtgagagccgcccagaaggccgccttcggcaaggccgacgacgacgacgtggtggtgaagaccaagttcgtgggcggcatcgcccagatcatcgccgcccaggaggagatgctgaagaaggagagagagctggaggaggccagaaagaagctggcccagatcagacagcagcagtacaagttcctgcccaccgagctgagagaggacgagggctag

SEQ ID NO: 101802 - DNA, 7629 bp, Artificial Sequence; identical to SEQ ID NO: 101801
  Description of Artificial Sequence: Synthetic coding sequence

SEQ ID NO: 101803 - DNA, 5190 bp, Artificial Sequence
  Description of Artificial Sequence: Synthetic coding sequence
atgaaggtgagcaccctgagagagagcagcgccatggccagccccctgcccagagagatggaggaggagctggtgcccaccggcagcgagcccggcgacaccagagccaagccccccgtgaagcccaagcccagagccctgcccgccaagcccgccctgcccgccaagcccagcctgctggtgcccgtgggccccagaccccccagaggccccctggccgagctgcccagcgccagaaagatgaacatgctggccggcccccagccctacggcggcagcaagagacccctgcccttcgcccccagacccgccgtggaggccagcaccggcggcgaggccacccaggagaccggcaaggaggaggccggcaaggaggagcccccccccctgaccccccccgccagatgcgccgcccccggcggcgtgagaaaggcccccgcccccttcagacccgccagcgagagattcgccgccaccaccgtggaggagatcctggccaagatggagcagcccagaaaggaggtgctggccagccccgacagactgtggggcagcagactgaccttcaaccacgacggcagcagcagatacggccccagaacctacggcaccaccaccgcccccagagacgaggacggcagcaccctgttcagaggctggagccaggagggccccgtgaagagccccgccgagtgcagagaggagcacagcaagacccccgaggagagaagcctgcccagcgacctggccttcaacggcgacctggccaaggccgccagcagcgagctgcccgccgacatcagcaagccctggatccccagcagccccgcccccagcagcgagaacggcggccccgccagccccggcctgcccgccgaggccagcggcagcggccccggcagcccccacctgcacccccccgacaagagcagcccctgccacagccagctgctggaggcccagacccccgaggccagccaggccagcccctgccccgccgtgacccccagcgcccccagcgccgccctgcccgacgagggcagcagacacacccccagccccggcctgcccgccgagggcgcccccgaggcccccagacccagcagccccccccccgaggtgctggagccccacagcctggaccagccccccgccaccagccccagacccctgatcgaggtgggcgagctgctggacctgaccagaaccttccccagcggcggcgaggaggaggccaagggcgacgcccacctgagacccaccagcctggtgcagagaagattcagcgagggcgtgctgcagagccccagccaggaccaggagaagctgggcggcagcctggccgccctgccccagggccagggcagccagctggccctggacagacccttcggcgccgagagcaactggagcctgagccagagcttcgagtggaccttccccaccagacccagcggcctgggcgtgtggagactggacagccccccccccagccccatcaccgaggccagcgaggccgccgaggccgccgaggccggcaacctggccgtgagcagcagagaggagggcgtgagccagcagggccagggcgccggcagcgcccccagcggcagcggcagcagctgggtgcagggcgacgaccccagcatgagcctgacccagaagggcgacggcgagagccagccccagttccccgccgtgcccctggagcccctgcccaccaccgagggcacccccggcctgcccctgcagcaggccgaggagagatacgagagccaggagcccctggccggccaggagagccccctgcccctggccaccagagaggccgccctgcccatcctggagcccgtgctgggccaggagcagcccgccgcccccgaccagccctgcgtgctgttcgccgacgcccccgagcccggccaggccctgcccgtggaggaggaggccgtgaccctggccagagccgagaccacccaggccagaaccgaggcccaggacctgtgcagagccagccccgagccccccggccccgagagcagcagcagatggctggacgacctgctggccagccccccccccagcggcggcggcgccagaagaggcgccggcgccgagctgaaggacacccagagccccagcacctgcagcgagggcctgctgggctggagccagaaggacctgcagagcgagttcggcatcaccggcgacccccagcccagcagcttcagccccagcagctggtgccagggcgccagccaggactacggcctgggcggcgccagccccagaggcgaccccggcctgggcgagagagactggaccagcaagtacggccagggcgccggcgagggcagcaccagagagtgggccagcagatgcggcatcggccaggaggagatggaggccagcagcagccaggaccagagcaaggtgagcgcccccggcgtgctgaccgcccaggacagagtggtgggcaagcccgcccagctgggcacccagagaagccaggaggccgacgtgcaggactgggagttcagaaagagagacagccagggcacctacagcagcagagacgccgagctgcaggaccaggagttcggcaagagagacagcctgggcacctacagcagcagagacgtgagcctgggcgactgggagttcggcaagagagacagcctgggcgcctacgccagccaggacgccaacgagcagggccaggacctgggcaagagagaccaccacggcagatacagcagccaggacgccgacgagcaggactgggagttccagaagagagacgtgagcctgggcacctacggcagcagagccgccgagccccaggagcaggagttcggcaagagcgcctggatcagagactacagcagcggcggcagcagcagaaccctggacgcccaggacagaagcttcggcaccagacccctgagcagcggcttcagccccgaggaggcccagcagcaggacgaggagttcgagaagaagatccccagcgtggaggacagcctgggcgagggcagcagagacgccggcagacccggcgagagaggcagcggcggcctgttcagccccagcaccgcccacgtgcccgacggcgccctgggccagagagaccagagcagctggcagaacagcgacgccagccaggaggtgggcggccaccaggagagacagcaggccggcgcccagggccccggcagcgccgacctggaggacggcgagatgggcaagagaggctgggtgggcgagttcagcctgagcgtgggcccccagagagaggccgccttcagccccggccagcaggactggagcagagacttctgcatcgaggccagcgagagaagctaccagttcggcatcatcggcaacgacagagtgagcggcgccggcttcagccccagcagcaagatggagggcggccacttcgtgccccccggcaagaccaccgccggcagcgtggactggaccgaccagctgggcctgagaaacctggaggtgagcagctgcgtgggcagcggcggcagcagcgaggccagagagagcgccgtgggccagatgggctggagcggcggcctgagcctgagagacatgaacctgaccggctgcctggagagcggcggcagcgaggagcccggcggcatcggcgtgggcgagaaggactggaccagcgacgtgaacgtgaagagcaaggacctggccgaggtgggcgagggcggcggccacagccaggccagagagagcggcgtgggccagaccgactggagcggcgtggaggccggcgagttcctgaagagcagagagagaggcgtgggccaggccgactggacccccgacctgggcctgagaaacatggcccccggcgccgtgtgcagccccggcgagagcaaggagctgggcgtgggccagatggactggggcaacaacctgggcctgagagacctggaggtgacctgcgaccccgacagcggcggcagccagggcctgagaggctgcggcgtgggccagatggactggacccaggacctggccccccagaacgtggagctgttcggcgcccccagcgaggccagagagcacggcgtgggcggcgtgagccagtgccccgagcccggcctgagacacaacggcagcctgagccccggcctggaggccagagaccccctggaggccagagagctgggcgtgggcgagaccagcggccccgagacccagggcgaggactacagcagcagcagcctggagccccaccccgccgaccccggcatggagaccggcgaggccctgagcttcggcgccagccccggcagatgccccgccagacccccccccagcggcagccagggcctgctggaggagatgctggccgccagcagcagcaaggccgtggccagaagagagagcgccgccagcggcctgggcggcctgctggaggaggagggcgccggcgccggcgccgcccaggaggaggtgctggagcccggcagagacagcccccccagctggagaccccagcccgacggcgaggccagccagaccgaggacgtggacggcacctggggcagcagcgccgccagatggagcgaccagggccccgcccagaccagcagaagacccagccagggcccccccgccagaagccccagccaggacttcagcttcatcgaggacaccgagatcctggacagcgccatgtacagaagcagagccaacctgggcagaaagagaggccacagagcccccgtgatcagacccggcggcaccctgggcctgagcgaggccgccgacagcgacgcccacctgttccaggacagcaccgagcccagagccagcagagtgcccagcagcgacgaggaggtggtggaggagccccagagcagaagaaccagaatgagcctgggcaccaagggcctgaaggtgaacctgttccccggcctgagccccagcgccctgaaggccaagctgagacccagaaacagaagcgccgaggagggcgagctggccgagagcaagagcagccagaaggagagcgccgtgcagagaagcaagagctgcaaggtgcccggcctgggcaagcccctgaccctgccccccaagcccgagaagagcagcggcagcgagggcagcagccccaactggctgcaggccctgaagctgaagaagaagaaggtgtag

SEQ ID NO: 101804 - DNA, 432 bp, Artificial Sequence
  Description of Artificial Sequence: Synthetic coding sequence
atgaaggtgagcaccctgagagagagcagcgccatggccagccccctgcccagagagatggaggaggagctggtgcccaccggcagcgagcccggcgacaccagagccaagccccccgtgaagcccaagcccagagccctgcccgccaagcccgccctgcccgccaagcccagcctgctggtgcccgtgggccccagaccccccagaggccccctggccgagctgcccagcgccagaaagatgaacatgctggccggcccccagccctacggcggcagcaagagacccctgcccttcgcccccagacccgccgtggaggccagcaccggcggcgaggccacccaggagaccggcaaggaggaggccggcaaggaggagcccccccccctgaccccccccgccagatgcgccgcccccggcggcgtgagatag

SEQ ID NO: 101805 - DNA, 5190 bp, Artificial Sequence; identical to SEQ ID NO: 101803
  Description of Artificial Sequence: Synthetic coding sequence

SEQ ID NO: 101806 - DNA, 3006 bp, Artificial Sequence
  Description of Artificial Sequence: Synthetic coding sequence
atgcccagcaccaacagagccggcagcctgaaggaccccgagatcgccgagctgttcttcaaggaggaccccgagaagctgttcaccgacctgagagagatcggccacggcagcttcggcgccgtgtacttcgccagagacgtgagaaccaacgaggtggtggccatcaagaagatgagctacagcggcaagcagagcaccgagaagtggcaggacatcatcaaggaggtgaagttcctgcagagaatcaagcaccccaacagcatcgagtacaagggctgctacctgagagagcacaccgcctggctggtgatggagtactgcctgggcagcgccagcgacctgctggaggtgcacaagaagcccctgcaggaggtggagatcgccgccatcacccacggcgccctgcagggcctggcctacctgcacagccacaccatgatccacagagacatcaaggccggcaacatcctgctgaccgagcccggccaggtgaagctggccgacttcggcagcgccagcatggccagccccgccaacagcttcgtgggcaccccctactggatggcccccgaggtgatcctggccatggacgagggccagtacgacggcaaggtggacgtgtggagcctgggcatcacctgcatcgagctggccgagagaaagccccccctgttcaacatgaacgccatgagcgccctgtaccacatcgcccagaacgagagccccaccctgcagagcaacgagtggagcgactacttcagaaacttcgtggacagctgcctgcagaagatcccccaggacagacccaccagcgaggagctgctgaagcacatcttcgtgctgagagagagacccgagaccgtgctgatcgacctgatccagagaaccaaggacgccgtgagagagctggacaacctgcagtacagaaagatgaagaagctgctgttccaggaggcccacaacggccccgccgtggaggcccaggaggaggaggaggagcaggaccacggcgtgggcagaaccggcaccgtgaacagcgtgggcagcaaccagagcatccccagcatgagcatcagcgccagcagccagagcagcagcgtgaacagcctgcccgacgtgagcgacgacaagagcgagctggacatgatggagggcgaccacaccgtgatgagcaacagcagcgtgatccacctgaagcccgaggaggagaactacagagaggagggcgaccccagaaccagagccagcgacccccagagccccccccaggtgagcagacacaagagccactacagaaacagagagcacttcgccaccatcagaaccgccagcctggtgaccagacagatgcaggagcacgagcaggacagcgagctgagagagcagatgagcggctacaagagaatgagaagacagcaccagaagcagctgatgaccctggagaacaagctgaaggccgagatggacgagcacagactgagactggacaaggacctggagacccagagaaacaacttcgccgccgagatggagaagctgatcaagaagcaccaggccgccatggagaaggaggccaaggtgatgagcaacgaggagaagaagttccagcagcacatccaggcccagcagaagaaggagctgaacagcttcctggagagccagaagagagagtacaagctgagaaaggagcagctgaaggaggagctgaacgagaaccagagcacccccaagaaggagaagcaggagtggctgagcaagcagaaggagaacatccagcacttccaggccgaggaggaggccaacctgctgagaagacagagacagtacctggagctggagtgcagaagattcaagagaagaatgctgctgggcagacacaacctggagcaggacctggtgagagaggagctgaacaagagacagacccagaaggacctggagcacgccatgctgctgagacagcacgagagcatgcaggagctggagttcagacacctgaacaccatccagaagatgagatgcgagctgatcagactgcagcaccagaccgagctgaccaaccagctggagtacaacaagagaagagagagagagctgagaagaaagcacgtgatggaggtgagacagcagcccaagagcctgaagagcaaggagctgcagatcaagaagcagttccaggacacctgcaagatccagaccagacagtacaaggccctgagaaaccacctgctggagaccacccccaagagcgagcacaaggccgtgctgaagagactgaaggaggagcagaccagaaagctggccatcctggccgagcagtacgaccacagcatcaacgagatgctgagcacccaggccctgagactggacgaggcccaggaggccgagtgccaggtgctgaagatgcagctgcagcaggagctggagctgctgaacgcctaccagagcaagatcaagatgcaggccgaggcccagcacgacagagagctgagagagctggagcagagagtgagcctgagaagagccctgctggagcagaagatcgaggaggagatgctggccctgcagaacgagagaaccgagagaatcagaagcctgctggagagacaggccagagagatcgaggccttcgacagcgagagcatgagactgggcttcagcaacatggtgctgagcaacctgagccccgaggccttcagccacagctaccccggcgccagcggctggagccacaaccccaccggcggccccggcccccactggggccaccccatgggcggccccccccaggcctggggccaccccatgcagggcggcccccagccctggggccaccccagcggccccatgcagggcgtgcccagaggcagcagcatgggcgtgagaaacagcccccaggccctgagaagaaccgccagcggcggcagaaccgagcagggcatgagcagaagcaccagcgtgaccagccagatcagcaacggcagccacatgagctacacctag

SEQ ID NO: 101807 - DNA, 2562 bp, Artificial Sequence
  Description of Artificial Sequence: Synthetic coding sequence
atgcccagcaccaacagagccggcagcctgaaggaccccgagatcgccgagctgttcttcaaggaggaccccgagaagctgttcaccgacctgagagagatcggccacggcagcttcggcgccgtgtacttcgccagagacgtgagaaccaacgaggtggtggccatcaagaagatgagctacagcggcaagcagagcaccgagaagtggcaggacatcatcaaggaggtgaagttcctgcagagaatcaagcaccccaacagcatcgagtacaagggctgctacctgagagagcacaccgcctggctggtgatggagtactgcctgggcagcgccagcgacctgctggaggtgcacaagaagcccctgcaggaggtggagatcgccgccatcacccacggcgccctgcagggcctggcctacctgcacagccacaccatgatccacagagacatcaaggccggcaacatcctgctgaccgagcccggccaggtgaagctggccgacttcggcagcgccagcatggccagccccgccaacagcttcgtgggcaccccctactggatggcccccgaggtgatcctggccatggacgagggccagtacgacggcaaggtggacgtgtggagcctgggcatcacctgcatcgagctggccgagagaaagccccccctgttcaacatgaacgccatgagcgccctgtaccacatcgcccagaacgagagccccaccctgcagagcaacgagtggagcgactacttcagaaacttcgtggacagctgcctgcagaagatcccccaggacagacccaccagcgaggagctgctgaagcacatcttcgtgctgagagagagacccgagaccgtgctgatcgacctgatccagagaaccaaggacgccgtgagagagctggacaacctgcagtacagaaagatgaagaagctgctgttccaggaggcccacaacggccccgccgtggaggcccaggaggaggaggaggagcaggaccacggcgtgggcagaaccggcaccgtgaacagcgtgggcagcaaccagagcatccccagcatgagcatcagcgccagcagccagagcagcagcgtgaacagcctgcccgacgtgagcgacgacaagagcgagctggacatgatggagggcgaccacaccgtgatgagcaacagcagcgtgatccacctgaagcccgaggaggagaactacagagaggagggcgaccccagaaccagagccagcgacccccagagccccccccaggtgagcagacacaagagccactacagaaacagagagcacttcgccaccatcagaaccgccagcctggtgaccagacagatgcaggagcacgagcaggacagcgagctgagagagcagatgagcggctacaagagaatgagaagacagcaccagaagcagctgatgaccctggagaacaagctgaaggccgagatggacgagcacagactgagactggacaaggacctggagacccagagaaacaacttcgccgccgagatggagaagctgatcaagaagcaccaggccgccatggagaaggaggccaaggtgatgagcaacgaggagaagaagttccagcagcacatccaggcccagcagaagaaggagctgaacagcttcctggagagccagaagagagagtacaagctgagaaaggagcagctgaaggagagcaaggagctgcagatcaagaagcagttccaggacacctgcaagatccagaccagacagtacaaggccctgagaaaccacctgctggagaccacccccaagagcgagcacaaggccgtgctgaagagactgaaggaggagcagaccagaaagctggccatcctggccgagcagtacgaccacagcatcaacgagatgctgagcacccaggccctgagactggacgaggcccaggaggccgagtgccaggtgctgaagatgcagctgcagcaggagctggagctgctgaacgcctaccagagcaagatcaagatgcaggccgaggcccagcacgacagagagctgagagagctggagcagagagtgagcctgagaagagccctgctggagcagaagatcgaggaggagatgctggccctgcagaacgagagaaccgagagaatcagaagcctgctggagagacaggccagagagatcgaggccttcgacagcgagagcatgagactgggcttcagcaacatggtgctgagcaacctgagccccgaggccttcagccacagctaccccggcgccagcggctggagccacaaccccaccggcggccccggcccccactggggccaccccatgggcggccccccccaggcctggggccaccccatgcagggcggcccccagccctggggccaccccagcggccccatgcagggcgtgcccagaggcagcagcatgggcgtgagaaacagcccccaggccctgagaagaaccgccagcggcggcagaaccgagcagggcatgagcagaagcaccagcgtgaccagccagatcagcaacggcagccacatgagctacacctag

SEQ ID NO: 101808 - DNA, 3150 bp, Artificial Sequence
  Description of Artificial Sequence: Synthetic coding sequence
atgcccgccggcggcagagccggcagcctgaaggaccccgacgtggccgagctgttcttcaaggacgaccccgagaagctgttcagcgacctgagagagatcggccacggcagcttcggcgccgtgtacttcgccagagacgtgagaaacagcgaggtggtggccatcaagaagatgagctacagcggcaagcagagcaacgagaagtggcaggacatcatcaaggaggtgagattcctgcagaagctgagacaccccaacaccatccagtacagaggctgctacctgagagagcacaccgcctggctggtgatggagtactgcctgggcagcgccagcgacctgctggaggtgcacaagaagcccctgcaggaggtggagatcgccgccgtgacccacggcgccctgcagggcctggcctacctgcacagccacaacatgatccacagagacgtgaaggccggcaacatcctgctgagcgagcccggcctggtgaagctgggcgacttcggcagcgccagcatcatggcccccgccaacagcttcgtgggcaccccctactggatggcccccgaggtgatcctggccatggacgagggccagtacgacggcaaggtggacgtgtggagcctgggcatcacctgcatcgagctggccgagagaaagccccccctgttcaacatgaacgccatgagcgccctgtaccacatcgcccagaacgagagccccgtgctgcagagcggccactggagcgagtacttcagaaacttcgtggacagctgcctgcagaagatcccccaggacagacccaccagcgaggtgctgctgaagcacagattcgtgctgagagagagaccccccaccgtgatcatggacctgatccagagaaccaaggacgccgtgagagagctggacaacctgcagtacagaaagatgaagaagatcctgttccaggaggcccccaacggccccggcgccgaggcccccgaggaggaggaggaggccgagccctacatgcacagagccggcaccctgaccagcctggagagcagccacagcgtgcccagcatgagcatcagcgccagcagccagagcagcagcgtgaacagcctggccgacgccagcgacaacgaggaggaggaggaggaggaggaggaggaggaggaggaggaggagggccccgaggccagagagatggccatgatgcaggagggcgagcacaccgtgaccagccacagcagcatcatccacagactgcccggcagcgacaacctgtacgacgacccctaccagcccgagatcacccccagccccctgcagccccccgccgcccccgcccccaccagcaccaccagcagcgccagaagaagagcctactgcagaaacagagaccacttcgccaccatcagaaccgccagcctggtgagcagacagatccaggagcacgagcaggacagcgccctgagagagcagctgagcggctacaagagaatgagaagacagcaccagaagcagctgctggccctggagagcagactgagaggcgagagagaggagcacagcgccagactgcagagagagctggaggcccagagagccggcttcggcgccgaggccgagaagctggccagaagacaccaggccatcggcgagaaggaggccagagccgcccaggccgaggagagaaagttccagcagcacatcctgggccagcagaagaaggagctggccgccctgctggaggcccagaagagaacctacaagctgagaaaggagcagctgaaggaggagctgcaggagaaccccagcacccccaagagagagaaggccgagtggctgctgagacagaaggagcagctgcagcagtgccaggccgaggaggaggccggcctgctgagaagacagagacagtacttcgagctgcagtgcagacagtacaagagaaagatgctgctggccagacacagcctggaccaggacctgctgagagaggacctgaacaagaagcagacccagaaggacctggagtgcgccctgctgctgagacagcacgaggccaccagagagctggagctgagacagctgcaggccgtgcagagaaccagagccgagctgaccagactgcagcaccagaccgagctgggcaaccagctggagtacaacaagagaagagagcaggagctgagacagaagcacgccgcccaggtgagacagcagcccaagagcctgaagagcaaggagctgcagatcaagaagcagttccaggagacctgcaagatccagaccagacagtacaaggccctgagagcccacctgctggagaccacccccaaggcccagcacaagagcctgctgaagagactgaaggaggagcagaccagaaagctggccatcctggccgagcagtacgaccagagcatcagcgagatgctgagcagccaggccctgagactggacgagacccaggaggccgagttccaggccctgagacagcagctgcagcaggagctggagctgctgaacgcctaccagagcaagatcaagatcagaaccgagagccagcacgagagagagctgagagagctggagcagagagtggccctgagaagagccctgctggagcagagagtggaggaggagctgctggccctgcagaccggcagaagcgagagaatcagaagcctgctggagagacaggccagagagatcgaggccttcgacgccgagagcatgagactgggcttcagcagcatggccctgggcggcatccccgccgaggccgccgcccagggctaccccgcccccccccccgcccccgcctggcccagcagacccgtgcccagaagcggcgcccactggagccacggcccccccccccccggcatgcccccccccgcctggagacagcccagcctgctggccccccccggcccccccaactggctgggcccccccacccagagcggcacccccagaggcggcgccctgctgctgctgagaaacagcccccagcccctgagaagagccgccagcggcggcagcggcagcgagaacgtgggcccccccgccgccgccgtgcccggccccctgagcagaagcaccagcgtggccagccacatcctgaacggcagcagccacttctacagctag

SEQ ID NO: 101809 - DNA, 3708 bp, Artificial Sequence
  Description of Artificial Sequence: Synthetic coding sequence
atgcccgccggcggcagagccggcagcctgaaggaccccgacgtggccgagctgttcttcaaggacgaccccgagaagctgttcagcgacctgagagagatcggccacggcagcttcggcgccgtgtacttcgccagagacgtgagaaacagcgaggtggtggccatcaagaagatgagctacagcggcaagcagagcaacgagaagtggcaggacatcatcaaggaggtgagattcctgcagaagctgagacaccccaacaccatccagtacagaggctgctacctgagagagcacaccgcctggctggtgatggagtactgcctgggcagcgccagcgacctgctggaggtgcacaagaagcccctgcaggaggtggagatcgccgccgtgacccacggcgccctgcagggcctggcctacctgcacagccacaacatgatccacagagacgtgaaggccggcaacatcctgctgagcgagcccggcctggtgaagctgggcgacttcggcagcgccagcatcatggcccccgccaacagcttcgtgggcaccccctactggatggcccccgaggtgatcctggccatggacgagggccagtacgacggcaaggtggacgtgtggagcctgggcatcacctgcatcgagctggccgagagaaagccccccctgttcaacatgaacgccatgagcgccctgtaccacatcgcccagaacgagagccccgtgctgcagagcggccactggagcgagtacttcagaaacttcgtggacagctgcctgcagaagatcccccaggacagacccaccagcgaggtgctgctgaagcacagattcgtgctgagagagagaccccccaccgtgatcatggacctgatccagagaaccaaggacgccgtgagagagctggacaacctgcagtacagaaagatgaagaagatcctgttccaggaggcccccaacggccccggcgccgaggcccccgaggaggaggaggaggccgagccctacatgcacagagccggcaccctgaccagcctggagagcagccacagcgtgcccagcatgagcatcagcgccagcagccagagcagcagcgtgaacagcctggccgacgccagcgacaacgaggaggaggaggaggaggaggaggaggaggaggaggaggaggagggccccgaggccagagagatggccatgatgcaggagggcgagcacaccgtgaccagccacagcagcatcatccacagactgcccggcagcgacaacctgtacgacgacccctaccagcccgagatcacccccagccccctgcagccccccgccgcccccgcccccaccagcaccaccagcagcgccagaagaagagcctactgcagaaacagagaccacttcgccaccatcagaaccgccagcctggtgagcagacagatccaggagcacgagcaggacagcgccctgagagagcagctgagcggctacaagagaatgagaagacagcaccagaagcagctgctggccctggagagcagactgagaggcgagagagaggagcacagcgccagactgcagagagagctggaggcccagagagccggcttcggcgccgaggccgagaagctggccagaagacaccaggccatcggcgagaaggaggccagagccgcccaggccgaggagagaaagttccagcagcacatcctgggccagcagaagaaggagctggccgccctgctggaggcccagaagagaacctacaagctgagaaaggagcagctgaaggaggagctgcaggagaaccccagcacccccaagagagagaaggccgagtggctgctgagacagaaggagcagctgcagcagtgccaggccgaggaggaggccggcctgctgagaagacagagacagtacttcgagctgcagtgcagacagtacaagagaaagatgctgctggccagacacagcctggaccaggacctgctgagagaggacctgaacaagaagcagacccagaaggacctggagtgcgccctgctgctgagacagcacgaggccaccagagagctggagctgagacagctgcaggccgtgcagagaaccagagccgagctgaccagactgcagcaccagaccgagctgggcaaccagctggagtacaacaagagaagagagcaggagctgagacagaagcacgccgcccaggtgagacagcagcccaagagcctgaaggtgagagccggccagagaccccccggcctgcccctgcccatccccggcgccctgggcccccccaacaccggcacccccatcgagcagcagccctgcagccccggccaggaggccgtgctggaccagagaatgctgggcgaggaggaggaggccgtgggcgagagaagaatcctgggcaaggagggcgccaccctggagcccaagcagcagagaatcctgggcgaggagagcggcgcccccagccccagcccccagaagcacggcagcctggtggacgaggaggtgtggggcctgcccgaggagatcgaggagctgagagtgcccagcctggtgccccaggagagaagcatcgtgggccaggaggaggccggcacctggagcctgtggggcaaggaggacgagagcctgctggacgaggagttcgagctgggctgggtgcagggccccgccctgacccccgtgcccgaggaggaggaggaggaggaggagggcgcccccatcggcacccccagagaccccggcgacggctgccccagccccgacatcccccccgagcccccccccacccacctgagaccctgccccgccagccagctgcccggcctgctgagccacggcctgctggccggcctgagcttcgccgtgggcagcagcagcggcctgctgcccctgctgctgctgctgctgctgcccctgctggccgcccagggcggcggcggcctgcaggccgccctgctggccctggaggtgggcctggtgggcctgggcgccagctacctgctgctgtgcaccgccctgcacctgcccagcagcctgttcctgctgctggcccagggcaccgccctgggcgccgtgctgggcctgagctggagaagaggcctgatgggcgtgcccctgggcctgggcgccgcctggctgctggcctggcccggcctggccctgcccctggtggccatggccgccggcggcagatgggtgagacagcagggccccagagtgagaagaggcatcagcagactgtggctgagagtgctgctgagactgagccccatggccttcagagccctgcagggctgcggcgccgtgggcgacagaggcctgttcgccctgtaccccaagaccaacaaggacggcttcagaagcagactgcccgtgcccggccccagaagaagaaaccccagaaccacccagcaccccctggccctgctggccagagtgtgggtgctgtgcaagggctggaactggagactggccagagccagccagggcctggccagccacctgcccccctgggccatccacaccctggccagctggggcctgctgagaggcgagagacccaccagaatccccagactgctgcccagaagccagagacagctgggcccccccgccagcagacagcccctgcccggcaccctggccggcagaagaagcagaaccagacagagcagagccctgcccccctggagatag

SEQ ID NO: 101810 - DNA, 2268 bp, Artificial Sequence
  Description of Artificial Sequence: Synthetic coding sequence
atgcccgccggcggcagagccggcagcctgaaggaccccgacgtggccgagctgttcttcaaggacgaccccgagaagctgttcagcgacctgagagagatcggccacggcagcttcggcgccgtgtacttcgccagagacgtgagaaacagcgaggtggtggccatcaagaagatgagctacagcggcaagcagagcaacgagaagtggcaggacatcatcaaggaggtgagattcctgcagaagctgagacaccccaacaccatccagtacagaggctgctacctgagagagcacaccgcctggctggtgatggagtactgcctgggcagcgccagcgacctgctggaggtgcacaagaagcccctgcaggaggtggagatcgccgccgtgacccacggcgccctgcagggcctggcctacctgcacagccacaacatgatccacagagacgtgaaggccggcaacatcctgctgagcgagcccggcctggtgaagctgggcgacttcggcagcgccagcatcatggcccccgccaacagcttcgtgggcaccccctactggatggcccccgaggtgatcctggccatggacgagggccagtacgacggcaaggtggacgtgtggagcctgggcatcacctgcatcgagctggccgagagaaagccccccctgttcaacatgaacgccatgagcgccctgtaccacatcgcccagaacgagagccccgtgctgcagagcggccactggagcgagtacttcagaaacttcgtggacagctgcctgcagaagatcccccaggacagacccaccagcgaggtgctgctgaagcacagattcgtgctgagagagagaccccccaccgtgatcatggacctgatccagagaaccaaggacgccgtgagagagctggacaacctgcagtacagaaagatgaagaagatcctgttccaggaggcccccaacggccccggcgccgaggcccccgaggaggaggaggaggccgagccctacatgcacagagccggcaccctgaccagcctggagagcagccacagcgtgcccagcatgagcatcagcgccagcagccagagcagcagcgtgaacagcctggccgacgccagcgacaacgaggaggaggaggaggaggaggaggaggaggaggaggaggaggagggccccgaggccagagagatggccatgatgcaggagggcgagcacaccgtgaccagccacagcagcatcatccacagactgcccggcagcgacaacctgtacgacgacccctaccagcccgagatcacccccagccccctgcagccccccgccgcccccgcccccaccagcaccaccagcagcgccagaagaagagcctactgcagaaacagagaccacttcgccaccatcagaaccgccagcctggtgagcagacagatccaggagcacgagcaggacagcgccctgagagagcagctgagcggctacaagagaatgagaagacagcaccagaagcagctgctggccctggagagcagactgagaggcgagagagaggagcacagcgccagactgcagagagagctggaggcccagagagccggcttcggcgccgaggccgagaagctggccagaagacaccaggccatcggcgagaaggaggccagagccgcccaggccgaggagagaaagttccagcagcacatcctgggccagcagaagaaggagctggccgccctgctggaggcccagaagagaacctacaagctgagaaaggagcagctgaaggaggagctgcaggagaaccccagcacccccaagagagagaaggccgagtggctgctgagacagaaggagcagctgcagcagtgccaggccgaggaggaggccggcctgctgagaagacagagacagtacttcgagctgcagtgcagacagtacaagagaaagatgctgctggccagacacagcctggaccaggacctgctgagagaggacctgaacaagaagcagacccagaaggacctggagtgcgccctgctgctgagacagcacgaggccaccagagagctggagctgagacagctgcaggccgtgcagagaaccagagccgagctgaccagactgcagcaccagaccgagctgggcaaccagctggagtacaacaagagaagagagcaggagctgagacagaagcacgccgcccaggtgagacagcagcccaagagcctgaagaagaagaccaacaccaacaagatcagcgagagatag

SEQ ID NO: 101811 - DNA, 3369 bp, Artificial Sequence
  Description of Artificial Sequence: Synthetic coding sequence
atgcccgccggcggcagagccggcagcctgaaggaccccgacgtggccgagctgttcttcaaggacgaccccgagaagctgttcagcgacctgagagagatcggccacggcagcttcggcgccgtgtacttcgccagagacgtgagaaacagcgaggtggtggccatcaagaagatgagctacagcggcaagcagagcaacgagaagtggcaggacatcatcaaggaggtgagattcctgcagaagctgagacaccccaacaccatccagtacagaggctgctacctgagagagcacaccgcctggctggtgatggagtactgcctgggcagcgccagcgacctgctggaggtgcacaagaagcccctgcaggaggtggagatcgccgccgtgacccacggcgccctgcagggcctggcctacctgcacagccacaacatgatccacagagacgtgaaggccggcaacatcctgctgagcgagcccggcctggtgaagctgggcgacttcggcagcgccagcatcatggcccccgccaacagcttcgtgggcaccccctactggatggcccccgaggtgatcctggccatggacgagggccagtacgacggcaaggtggacgtgtggagcctgggcatcacctgcatcgagctggccgagagaaagccccccctgttcaacatgaacgccatgagcgccctgtaccacatcgcccagaacgagagccccgtgctgcagagcggccactggagcgagtacttcagaaacttcgtggacagctgcctgcagaagatcccccaggacagacccaccagcgaggtgctgctgaagcacagattcgtgctgagagagagaccccccaccgtgatcatggacctgatccagagaaccaaggacgccgtgagagagctggacaacctgcagtacagaaagatgaagaagatcctgttccaggaggcccccaacggccccggcgccgaggcccccgaggaggaggaggaggccgagccctacatgcacagagccggcaccctgaccagcctggagagcagccacagcgtgcccagcatgagcatcagcgccagcagccagagcagcagcgtgaacagcctggccgacgccagcgacaacgaggaggaggaggaggaggaggaggaggaggaggaggaggaggagggccccgaggccagagagatggccatgatgcaggagggcgagcacaccgtgaccagccacagcagcatcatccacagactgcccggcagcgacaacctgtacgacgacccctaccagcccgagatcacccccagccccctgcagccccccgccgcccccgcccccaccagcaccaccagcagcgccagaagaagagcctactgcagaaacagagaccacttcgccaccatcagaaccgccagcctggtgagcagacagatccaggagcacgagcaggacagcgccctgagagagcagctgagcggctacaagagaatgagaagacagcaccagaagcagctgctggccctggagagcagactgagaggcgagagagaggagcacagcgccagactgcagagagagctggaggcccagagagccggcttcggcgccgaggccgagaagctggccagaagacaccaggccatcggcgagaaggaggccagagccgcccaggccgaggagagaaagttccagcagcacatcctgggccagcagaagaaggagctggccgccctgctggaggcccagaagagaacctacaagctgagaaaggagcagctgaaggaggagctgcaggagaaccccagcacccccaagagagagaaggccgagtggctgctgagacagaaggagcagctgcagcagtgccaggccgaggaggaggccggcctgctgagaagacagagacagtacttcgagctgcagtgcagacagtacaagagaaagatgctgctggccagacacagcctggaccaggacctgctgagagaggacctgaacaagaagcagacccagaaggacctggagtgcgccctgctgctgagacagcacgaggccaccagagagctggagctgagacagctgcaggccgtgcagagaaccagagccgagctgaccagactgcagcaccagaccgagctgggcaaccagctggagtacaacaagagaagagagcaggagctgagacagaagcacgccgcccaggtgagacagcagcccaagagcctgaaggagagaagcatcgtgggccaggaggaggccggcacctggagcctgtggggcaaggaggacgagagcctgctggacgaggagttcgagctgggctgggtgcagggccccgccctgacccccgtgcccgaggaggaggaggaggaggaggagggcgcccccatcggcacccccagagaccccggcgacggctgccccagccccgacatcccccccgagcccccccccacccacctgagaccctgccccgccagccagctgcccggcctgctgagccacggcctgctggccggcctgagcttcgccgtgggcagcagcagcggcctgctgcccctgctgctgctgctgctgctgcccctgctggccgcccagggcggcggcggcctgcaggccgccctgctggccctggaggtgggcctggtgggcctgggcgccagctacctgctgctgtgcaccgccctgcacctgcccagcagcctgttcctgctgctggcccagggcaccgccctgggcgccgtgctgggcctgagctggagaagaggcctgatgggcgtgcccctgggcctgggcgccgcctggctgctggcctggcccggcctggccctgcccctggtggccatggccgccggcggcagatgggtgagacagcagggccccagagtgagaagaggcatcagcagactgtggctgagagtgctgctgagactgagccccatggccttcagagccctgcagggctgcggcgccgtgggcgacagaggcctgttcgccctgtaccccaagaccaacaaggacggcttcagaagcagactgcccgtgcccggccccagaagaagaaaccccagaaccacccagcaccccctggccctgctggccagagtgtgggtgctgtgcaagggctggaactggagactggccagagccagccagggcctggccagccacctgcccccctgggccatccacaccctggccagctggggcctgctgagaggcgagagacccaccagaatccccagactgctgcccagaagccagagacagctgggcccccccgccagcagacagcccctgcccggcaccctggccggcagaagaagcagaaccagacagagcagagccctgcccccctggagatag

SEQ ID NO: 101812 - DNA, 1401 bp, Artificial Sequence
  Description of Artificial Sequence: Synthetic coding sequence
atgaagagcctgagcctgctgctggccgtggccctgggcctggccaccgccgtgagcgccggccccgccgtgatcgagtgctggttcgtggaggacgccagcggcaagggcctggccaagagacccggcgccctgctgctgagacagggccccggcgagcccccccccagacccgacctggaccccgagctgtacctgagcgtgcacgaccccgccggcgccctgcaggccgccttcagaagataccccagaggcgcccccgccccccactgcgagatgagcagattcgtgcccctgcccgccagcgccaagtgggccagcggcctgacccccgcccagaactgccccagagccctggacggcgcctggctgatggtgagcatcagcagccccgtgctgagcctgagcagcctgctgagaccccagcccgagccccagcaggagcccgtgctgatcaccatggccaccgtggagatgggcttccaccacgtgggccaggccgccctggagctgctgaccagcgtggtgctgaccgtgctgacccacacccccgcccccagagtgagactgggccaggacgccctgctggacctgagcttcgcctacatgccccccaccagcgaggccgccagcagcctggcccccggccccccccccttcggcctggagtggagaagacagcacctgggcaagggccacctgctgctggccgccacccccggcctgaacggccagatgcccgccgcccaggagggcgccgtggccttcgccgcctgggacgacgacgagccctggggcccctggaccggcaacggcaccttctggctgcccagagtgcagcccttccaggagggcacctacctggccaccatccacctgccctacctgcagggccaggtgaccctggagctggccgtgtacaagccccccaaggtgagcctgatgcccgccaccctggccagagccgcccccggcgaggccccccccgagctgctgtgcctggtgagccacttctaccccagcggcggcctggaggtggagtgggagctgagaggcggccccggcggcagaagccagaaggccgagggccagagatggctgagcgccctgagacaccacagcgacggcagcgtgagcctgagcggccacctgcagcccccccccgtgaccaccgagcagcacggcgccagatacgcctgcagaatccaccaccccagcctgcccgccagcggcagaagcgccgaggtgaccctggaggtggccggcctgagcggccccagcctggaggacagcgtgggcctgttcctgagcgccttcctgctgctgggcctgttcaaggccctgggctgggccgccgtgtacctgagcacctgcaaggacagcaagaagaaggccgagtag

SEQ ID NO: 101813 - DNA, 1347 bp, Artificial Sequence
  Description of Artificial Sequence: Synthetic coding sequence
atgaagagcctgagcctgctgctggccgtggccctgggcctggccaccgccgtgagcgccggccccgccgtgatcgagtgctggttcgtggaggacgccagcggcaagggcctggccaagagacccggcgccctgctgctgagacagggccccggcgagcccccccccagacccgacctggaccccgagctgtacctgagcgtgcacgaccccgccggcgccctgcaggccgccttcagaagataccccagaggcgcccccgccccccactgcgagatgagcagattcgtgcccctgcccgccagcgccaagtgggccagcggcctgacccccgcccagaactgccccagagccctggacggcgcctggctgatggtgagcatcagcagccccgtgctgagcctgagcagcctgctgagaccccagcccgagccccagcaggagcccgtgctgatcaccatggccaccgtggtgctgaccgtgctgacccacacccccgcccccagagtgagactgggccaggacgccctgctggacctgagcttcgcctacatgccccccaccagcgaggccgccagcagcctggcccccggccccccccccttcggcctggagtggagaagacagcacctgggcaagggccacctgctgctggccgccacccccggcctgaacggccagatgcccgccgcccaggagggcgccgtggccttcgccgcctgggacgacgacgagccctggggcccctggaccggcaacggcaccttctggctgcccagagtgcagcccttccaggagggcacctacctggccaccatccacctgccctacctgcagggccaggtgaccctggagctggccgtgtacaagccccccaaggtgagcctgatgcccgccaccctggccagagccgcccccggcgaggccccccccgagctgctgtgcctggtgagccacttctaccccagcggcggcctggaggtggagtgggagctgagaggcggccccggcggcagaagccagaaggccgagggccagagatggctgagcgccctgagacaccacagcgacggcagcgtgagcctgagcggccacctgcagcccccccccgtgaccaccgagcagcacggcgccagatacgcctgcagaatccaccaccccagcctgcccgccagcggcagaagcgccgaggtgaccctggaggtggccggcctgagcggccccagcctggaggacagcgtgggcctgttcctgagcgccttcctgctgctgggcctgttcaaggccctgggctgggccgccgtgtacctgagcacctgcaaggacagcaagaagaaggccgagtag

SEQ ID NO: 101814 - DNA, 1515 bp, Artificial Sequence
  Description of Artificial Sequence: Synthetic coding sequence
atgaagagcctgagcctgctgctggccgtggccctgggcctggccaccgccgtgagcgccggccccgccgtgatcgagtgctggttcgtggaggacgccagcggcaagggcctggccaagagacccggcgccctgctgctgagacagggccccggcgagcccccccccagacccgacctggaccccgagctgtacctgagcgtgcacgaccccgccggcgccctgcaggccgccttcagaagataccccagaggcgcccccgccccccactgcgagatgagcagattcgtgcccctgcccgccagcgccaagtgggccagcggcctgacccccgcccagaactgccccagagccctggacggcgcctggctgatggtgagcatcagcagccccgtgctgagcctgagcagcctgctgagaccccagcccgagccccagcaggagcccgtgctgatcaccatggccaccgtggtgctgaccgtgctgacccacacccccgcccccagagtgagactgggccaggacgccctgctggacctgagcttcgcctacatgccccccaccagcgaggccgccagcagcctggcccccggccccccccccttcggcctggagtggagaagacagcacctgggcaagggccacctgctgctggccgccacccccggcctgaacggccagatgcccgccgcccaggagggcgccgtggccttcgccgcctgggacgacgacgagccctggggcccctggaccggcaacggcaccttctggctgcccaccgtgcagcccttccaggagggcacctacctggccaccatccacctgccctacctgcagggccaggtgaccctggagctggccgtgtacaagccccccaaggtgagcctgatgcccgccaccctggccagagccgcccccggcgaggccccccccgagctgctgtgcctggtgagccacttctaccccagcggcggcctggaggtggagtgggagctgagaggcggccccggcggcagaagccagaaggccgagggccagagatggctgagcgccctgagacaccacagcgacggcagcgtgagcctgagcggccacctgcagcccccccccgtgaccaccgagcagcacggcgccagatacgcctgcagaatccaccaccccagcctgcccgccagcggcagaagcgccgaggtgaccctggaggtggccggcctgagcggccccagcctggaggacagcgtgggcctgttcctgagcgccttcctgctgctgggcctgttcaaggccctgggctgggccgccgtgtacctgagcacctgcaaggacagcaagaaggtgcagtgcagcaccagcctgtacctgagcctggtgaccctgagcccccaccccatcagcaagcccatggagggcggctgctggtgcggcagacagaacctgggcctggagttcaccctgatctgggtgaagacctggcactacatcctgaccgtgggcctgttcgagcacgccacctag

SEQ ID NO: 101815 - DNA, 1347 bp, Artificial Sequence
  Description of Artificial Sequence: Synthetic coding sequence
atgaagagcctgagcctgctgctggccgtggccctgggcctggccaccgccgtgagcgccggccccgccgtgatcgagtgctggttcgtggaggacgccagcggcaagggcctggccaagagacccggcgccctgctgctgagacagggccccggcgagcccccccccagacccgacctggaccccgagctgtacctgagcgtgcacgaccccgccggcgccctgcaggccgccttcagaagataccccagaggcgcccccgccccccactgcgagatgagcagattcgtgcccctgcccgccagcgccaagtgggccagcggcctgacccccgcccagaactgccccagagccctggacggcgcctggctgatggtgagcatcagcagccccgtgctgagcctgagcagcctgctgagaccccagcccgagccccagcaggagcccgtgctgatcaccatggccaccgtggtgctgaccgtgctgacccacacccccgcccccagagtgagactgggccaggacgccctgctggacctgagcttcgcctacatgccccccaccagcgaggccgccagcagcctggcccccggccccccccccttcggcctggagtggagaagacagcacctgggcaagggccacctgctgctggccgccacccccggcctgaacggccagatgcccgccgcccaggagggcgccgtggccttcgccgcctgggacgacgacgagccctggggcccctggaccggcaacggcaccttctggctgcccaccgtgcagcccttccaggagggcacctacctggccaccatccacctgccctacctgcagggccaggtgaccctggagctggccgtgtacaagccccccaaggtgagcctgatgcccgccaccctggccagagccgcccccggcgaggccccccccgagctgctgtgcctggtgagccacttctaccccagcggcggcctggaggtggagtgggagctgagaggcggccccggcggcagaagccagaaggccgagggccagagatggctgagcgccctgagacaccacagcgacggcagcgtgagcctgagcggccacctgcagcccccccccgtgaccaccgagcagcacggcgccagatacgcctgcagaatccaccaccccagcctgcccgccagcggcagaagcgccgaggtgaccctggaggtggccggcctgagcggccccagcctggaggacagcgtgggcctgttcctgagcgccttcctgctgctgggcctgttcaaggccctgggctgggccgccgtgtacctgagcacctgcaaggacagcaagaagaaggccgagtag

SEQ ID NO: 101816 - DNA, 1401 bp, Artificial Sequence
  Description of Artificial Sequence: Synthetic coding sequence
atgaagagcctgagcctgctgctggccgtggccctgggcctggccaccgccgtgagcgccggccccgccgtgatcgagtgctggttcgtggaggacgccagcggcaagggcctggccaagagacccggcgccctgctgctgagacagggccccggcgagcccccccccagacccgacctggaccccgagctgtacctgagcgtgcacgaccccgccggcgccctgcaggccgccttcagaagataccccagaggcgcccccgccccccactgcgagatgagcagattcgtgcccctgcccgccagcgccaagtgggccagcggcctgacccccgcccagaactgccccagagccctggacggcgcctggctgatggtgagcatcagcagccccgtgctgagcctgagcagcctgctgagaccccagcccgagccccagcaggagcccgtgctgatcaccatggccaccgtggagatgggcttccaccacgtgggccaggccgccctggagctgctgaccagcgtggtgctgaccgtgctgacccacacccccgcccccagagtgagactgggccaggacgccctgctggacctgagcttcgcctacatgccccccaccagcgaggccgccagcagcctggcccccggccccccccccttcggcctggagtggagaagacagcacctgggcaagggccacctgctgctggccgccacccccggcctgaacggccagatgcccgccgcccaggagggcgccgtggccttcgccgcctgggacgacgacgagccctggggcccctggaccggcaacggcaccttctggctgcccaccgtgcagcccttccaggagggcacctacctggccaccatccacctgccctacctgcagggccaggtgaccctggagctggccgtgtacaagccccccaaggtgagcctgatgcccgccaccctggccagagccgcccccggcgaggccccccccgagctgctgtgcctggtgagccacttctaccccagcggcggcctggaggtggagtgggagctgagaggcggccccggcggcagaagccagaaggccgagggccagagatggctgagcgccctgagacaccacagcgacggcagcgtgagcctgagcggccacctgcagcccccccccgtgaccaccgagcagcacggcgccagatacgcctgcagaatccaccaccccagcctgcccgccagcggcagaagcgccgaggtgaccctggaggtggccggcctgagcggccccagcctggaggacagcgtgggcctgttcctgagcgccttcctgctgctgggcctgttcaaggccctgggctgggccgccgtgtacctgagcacctgcaaggacagcaagaagaaggccgagtag

SEQ ID NO: 101817 - DNA, 1515 bp, Artificial Sequence
  Description of Artificial Sequence: Synthetic coding sequence
atgaagagcctgagcctgctgctggccgtggccctgggcctggccaccgccgtgagcgccggccccgccgtgatcgagtgctggttcgtggaggacgccagcggcaagggcctggccaagagacccggcgccctgctgctgagacagggccccggcgagcccccccccagacccgacctggaccccgagctgtacctgagcgtgcacgaccccgccggcgccctgcaggccgccttcagaagataccccagaggcgcccccgccccccactgcgagatgagcagattcgtgcccctgcccgccagcgccaagtgggccagcggcctgacccccgcccagaactgccccagagccctggacggcgcctggctgatggtgagcatcagcagccccgtgctgagcctgagcagcctgctgagaccccagcccgagccccagcaggagcccgtgctgatcaccatggccaccgtggtgctgaccgtgctgacccacacccccgcccccagagtgagactgggccaggacgccctgctggacctgagcttcgcctacatgccccccaccagcgaggccgccagcagcctggcccccggccccccccccttcggcctggagtggagaagacagcacctgggcaagggccacctgctgctggccgccacccccggcctgaacggccagatgcccgccgcccaggagggcgccgtggccttcgccgcctgggacgacgacgagccctggggcccctggaccggcaacggcaccttctggctgcccagagtgcagcccttccaggagggcacctacctggccaccatccacctgccctacctgcagggccaggtgaccctggagctggccgtgtacaagccccccaaggtgagcctgatgcccgccaccctggccagagccgcccccggcgaggccccccccgagctgctgtgcctggtgagccacttctaccccagcggcggcctggaggtggagtgggagctgagaggcggccccggcggcagaagccagaaggccgagggccagagatggctgagcgccctgagacaccacagcgacggcagcgtgagcctgagcggccacctgcagcccccccccgtgaccaccgagcagcacggcgccagatacgcctgcagaatccaccaccccagcctgcccgccagcggcagaagcgccgaggtgaccctggaggtggccggcctgagcggccccagcctggaggacagcgtgggcctgttcctgagcgccttcctgctgctgggcctgttcaaggccctgggctgggccgccgtgtacctgagcacctgcaaggacagcaagaaggtgcagtgcagcaccagcctgtacctgagcctggtgaccctgagcccccaccccatcagcaagcccatggagggcggctgctggtgcggcagacagaacctgggcctggagttcaccctgatctgggtgaagacctggcactacatcctgaccgtgggcctgttcgagcacgccacctag

SEQ ID NO: 101818 - DNA, 1347 bp, Artificial Sequence; identical to SEQ ID NO: 101813
  Description of Artificial Sequence: Synthetic coding sequence

SEQ ID NO: 101819 - DNA, 1515 bp, Artificial Sequence; identical to SEQ ID NO: 101817
  Description of Artificial Sequence: Synthetic coding sequence

SEQ ID NO: 101820 - DNA, 1401 bp, Artificial Sequence; identical to SEQ ID NO: 101812
  Description of Artificial Sequence: Synthetic coding sequence

SEQ ID NO: 101821 - DNA, 1347 bp, Artificial Sequence; identical to SEQ ID NO: 101813
  Description of Artificial Sequence: Synthetic coding sequence

SEQ ID NO: 101822 - DNA, 1515 bp, Artificial Sequence; identical to SEQ ID NO: 101814
  Description of Artificial Sequence: Synthetic coding sequence

SEQ ID NO: 101823 - DNA, 609 bp, Artificial Sequence
  Description of Artificial Sequence: Synthetic coding sequence
atgaagagcctgagcctgctgctggccgtggccctgggcctggccaccgccgtgagcgccggccccgccgtgatcgagtgctggttcgtggaggacgccagcggcaagggcctggccaagagacccggcgccctgctgctgagacagggccccggcgagcccccccccagacccgacctggaccccgagctgtacctgagcgtgcacgtggtgctgaccgtgctgacccacacccccgcccccagagtgagactgggccaggacgccctgctggacctgagcttcgcctacatgccccccaccagcgaggccgccagcagcctggcccccggccccccccccttcggcctggagtggagaagacagcacctgggcaagggccacctgctgctggccgccacccccggcctgaacggccagatgcccgccgcccaggagggcgccgtggccttcgccgcctgggacgacgacgagccctggggcccctggaccggcaacggcaccttctggctgcccagagtgcagcccttccaggagggcacctacctggccaccatccacctgccctacctgcagggccaggtgaccctggagctggccgtgtactag

SEQ ID NO: 101824 - DNA, 1347 bp, Artificial Sequence; identical to SEQ ID NO: 101815
  Description of Artificial Sequence: Synthetic coding sequence

SEQ ID NO: 101825 - DNA, 1401 bp, Artificial Sequence; identical to SEQ ID NO: 101812
  Description of Artificial Sequence: Synthetic coding sequence

SEQ ID NO: 101826 - DNA, 609 bp, Artificial Sequence
  Description of Artificial Sequence: Synthetic coding sequence
atgaagagcctgagcctgctgctggccgtggccctgggcctggccaccgccgtgagcgccggccccgccgtgatcgagtgctggttcgtggaggacgccagcggcaagggcctggccaagagacccggcgccctgctgctgagacagggccccggcgagcccccccccagacccgacctggaccccgagctgtacctgagcgtgcacgtggtgctgaccgtgctgacccacacccccgcccccagagtgagactgggccaggacgccctgctggacctgagcttcgcctacatgccccccaccagcgaggccgccagcagcctggcccccggccccccccccttcggcctggagtggagaagacagcacctgggcaagggccacctgctgctggccgccacccccggcctgaacggccagatgcccgccgcccaggagggcgccgtggccttcgccgcctgggacgacgacgagccctggggcccctggaccggcaacggcaccttctggctgcccaccgtgcagcccttccaggagggcacctacctggccaccatccacctgccctacctgcagggccaggtgaccctggagctggccgtgtactag

SEQ ID NO: 101827 - DNA, 609 bp, Artificial Sequence; identical to SEQ ID NO: 101823
  Description of Artificial Sequence: Synthetic coding sequence

SEQ ID NO: 101828 - DNA, 609 bp, Artificial Sequence; identical to SEQ ID NO: 101823
  Description of Artificial Sequence: Synthetic coding sequence

SEQ ID NO: 101829 - DNA, 1347 bp, Artificial Sequence
  Description of Artificial Sequence: Synthetic coding sequence
atgaagagcctgagcctgctgctggccgtggccctgggcctggccaccgccgtgagcgccggccccgccgtgatcgagtgctggttcgtggaggacgccagcggcaagggcctggccaagagacccggcgccctgctgctgagacagggccccggcgagcccccccccagacccgacctggaccccgagctgtacctgagcgtgcacgaccccgccggcgccctgcaggccgccttcagaagataccccagaggcgcccccgccccccactgcgagatgagcagattcgtgcccctgcccgccagcgccaagtgggccagcggcctgacccccgcccagaactgccccagagccctggacggcgcctggctgatggtgagcatcagcagccccgtgctgagcctgagcagcctgctgagaccccagcccgagccccagcaggagcccgtgctgatcaccatggccaccgtggtgctgaccgtgctgacccacacccccgcccccagagtgagactgggccaggacgccctgctggacctgagcttcgcctacatgccccccaccagcgaggccgccagcagcctggcccccggccccccccccttcggcctggagtggagaagacagcacctgggcaagggccacctgctgctggccgccacccccggcctgaacggccagatgcccgccgcccaggagggcgccgtggccttcgccgcctgggacgacgacgagccctggggcccctggaccggcaacggcaccttctggctgcccaccgtgcagcccttccaggagggcacctacctggccaccatccacctgccctacctgcagggccaggtgaccctggagctggccgtgtacaagccccccaaggtgagcctgatgcccgccaccctggccagagccgcccccggcgaggccccccccgagctgctgtgcctggtgagccacttctaccccagcggcggcctggaggtggagtgggagctgagaggcggccccggcggcagaagccagaaggccgagggccagagatggctgagcgccctgagacaccacagcgacggcagcgtgagcctgagcggccacctgcagcccccccccgtgaccaccgagcagcacggcgccagatacgcctgcagaatccaccaccccagcctgcccgccagcggcagaagcgccgaggtgaccctggaggtggccggcctgagcggccccagcctggaggacagcgtgggcctgttcctgagcgccttcctgctgctgggcctgttcaaggccctgggctgggccgccgtgtacctgagcacctgcaaggacagcaagaagcacgccacctag

SEQ ID NO: 101830 - DNA, 1515 bp, Artificial Sequence; identical to SEQ ID NO: 101817
  Description of Artificial Sequence: Synthetic coding sequence

SEQ ID NO: 101831 - DNA, 471 bp, Artificial Sequence
  Description of Artificial Sequence: Synthetic coding sequence
atgaagagcctgagcctgctgctggccgtggccctgggcctggccaccgccgtgagcgccggccccgccgtgatcgagtgctggttcgtggaggacgccagcggcaagggcctggccaagagacccggcgccctgctgctgagacagggccccggcgagcccccccccagacccgacctggaccccgagctgtacctgagcgtgcacgaccccgccggcgccctgcaggccgccttcagaagataccccagaggcgcccccgccccccactgcgagatgagcagattcgtgcccctgcccgccagcgccaagtgggccagcggcctgacccccgcccagaactgccccagagccctggacggcgcctggctgatggtgagcatcagcagcatgggccacgccatgcccgtggagttcaccatccccgcctgcctgcccagaggcgccgccctgagaagcccctggagatag

SEQ ID NO: 101832 - DNA, 1401 bp, Artificial Sequence; identical to SEQ ID NO: 101816
  Description of Artificial Sequence: Synthetic coding sequence

SEQ ID NO: 101833 - DNA, 1086 bp, Artificial Sequence
  Description of Artificial Sequence: Synthetic coding sequence
atgaagagcctgagcctgctgctggccgtggccctgggcctggccaccgccgtgagcgccggccccgccgtgatcgagtgctggttcgtggaggacgccagcggcaagggcctggccaagagacccggcgccctgctgctgagacagggccccggcgagcccccccccagacccgacctggaccccgagctgtacctgagcgtgcacgtggtgctgaccgtgctgacccacacccccgcccccagagtgagactgggccaggacgccctgctggacctgagcttcgcctacatgccccccaccagcgaggccgccagcagcctggcccccggccccccccccttcggcctggagtggagaagacagcacctgggcaagggccacctgctgctggccgccacccccggcctgaacggccagatgcccgccgcccaggagggcgccgtggccttcgccgcctgggacgacgacgagccctggggcccctggaccggcaacggcaccttctggctgcccaccgtgcagcccttccaggagggcacctacctggccaccatccacctgccctacctgcagggccaggtgaccctggagctggccgtgtacaagccccccaaggtgagcctgatgcccgccaccctggccagagccgcccccggcgaggccccccccgagctgctgtgcctggtgagccacttctaccccagcggcggcctggaggtggagtgggagctgagaggcggccccggcggcagaagccagaaggccgagggccagagatggctgagcgccctgagacaccacagcgacggcagcgtgagcctgagcggccacctgcagcccccccccgtgaccaccgagcagcacggcgccagatacgcctgcagaatccaccaccccagcctgcccgccagcggcagaagcgccgaggtgaccctggaggtggccggcctgagcggccccagcctggaggacagcgtgggcctgttcctgagcgccttcctgctgctgggcctgttcaaggccctgggctgggccgccgtgtacctgagcacctgcaaggacagcaagaagaaggccgagtag

SEQ ID NO: 101834 - DNA, 1347 bp, Artificial Sequence; identical to SEQ ID NO: 101829
  Description of Artificial Sequence: Synthetic coding sequence

SEQ ID NO: 101835 - DNA, 471 bp, Artificial Sequence; identical to SEQ ID NO: 101831
  Description of Artificial Sequence: Synthetic coding sequence

SEQ ID NO: 101836 - DNA, 1086 bp, Artificial Sequence
  Description of Artificial Sequence: Synthetic coding sequence
atgaagagcctgagcctgctgctggccgtggccctgggcctggccaccgccgtgagcgccggccccgccgtgatcgagtgctggttcgtggaggacgccagcggcaagggcctggccaagagacccggcgccctgctgctgagacagggccccggcgagcccccccccagacccgacctggaccccgagctgtacctgagcgtgcacgtggtgctgaccgtgctgacccacacccccgcccccagagtgagactgggccaggacgccctgctggacctgagcttcgcctacatgccccccaccagcgaggccgccagcagcctggcccccggccccccccccttcggcctggagtggagaagacagcacctgggcaagggccacctgctgctggccgccacccccggcctgaacggccagatgcccgccgcccaggagggcgccgtggccttcgccgcctgggacgacgacgagccctggggcccctggaccggcaacggcaccttctggctgcccagagtgcagcccttccaggagggcacctacctggccaccatccacctgccctacctgcagggccaggtgaccctggagctggccgtgtacaagccccccaaggtgagcctgatgcccgccaccctggccagagccgcccccggcgaggccccccccgagctgctgtgcctggtgagccacttctaccccagcggcggcctggaggtggagtgggagctgagaggcggccccggcggcagaagccagaaggccgagggccagagatggctgagcgccctgagacaccacagcgacggcagcgtgagcctgagcggccacctgcagcccccccccgtgaccaccgagcagcacggcgccagatacgcctgcagaatccaccaccccagcctgcccgccagcggcagaagcgccgaggtgaccctggaggtggccggcctgagcggccccagcctggaggacagcgtgggcctgttcctgagcgccttcctgctgctgggcctgttcaaggccctgggctgggccgccgtgtacctgagcacctgcaaggacagcaagaagcacgccacctag

SEQ ID NO: 101837 - DNA, 1347 bp, Artificial Sequence
  Description of Artificial Sequence: Synthetic coding sequence
atgaagagcctgagcctgctgctggccgtggccctgggcctggccaccgccgtgagcgccggccccgccgtgatcgagtgctggttcgtggaggacgccagcggcaagggcctggccaagagacccggcgccctgctgctgagacagggccccggcgagcccccccccagacccgacctggaccccgagctgtacctgagcgtgcacgaccccgccggcgccctgcaggccgccttcagaagataccccagaggcgcccccgccccccactgcgagatgagcagattcgtgcccctgcccgccagcgccaagtgggccagcggcctgacccccgcccagaactgccccagagccctggacggcgcctggctgatggtgagcatcagcagccccgtgctgagcctgagcagcctgctgagaccccagcccgagccccagcaggagcccgtgctgatcaccatggccaccgtggtgctgaccgtgctgacccacacccccgcccccagagtgagactgggccaggacgccctgctggacctgagcttcgcctacatgccccccaccagcgaggccgccagcagcctggcccccggccccccccccttcggcctggagtggagaagacagcacctgggcaagggccacctgctgctggccgccacccccggcctgaacggccagatgcccgccgcccaggagggcgccgtggccttcgccgcctgggacgacgacgagccctggggcccctggaccggcaacggcaccttctggctgcccagagtgcagcccttccaggagggcacctacctggccaccatccacctgccctacctgcagggccaggtgaccctggagctggccgtgtacaagccccccaaggtgagcctgatgcccgccaccctggccagagccgcccccggcgaggccccccccgagctgctgtgcctggtgagccacttctaccccagcggcggcctggaggtggagtgggagctgagaggcggccccggcggcagaagccagaaggccgagggccagagatggctgagcgccctgagacaccacagcgacggcagcgtgagcctgagcggccacctgcagcccccccccgtgaccaccgagcagcacggcgccagatacgcctgcagaatccaccaccccagcctgcccgccagcggcagaagcgccgaggtgaccctggaggtggccggcctgagcggccccagcctggaggacagcgtgggcctgttcctgagcgccttcctgctgctgggcctgttcaaggccctgggctgggccgccgtgtacctgagcacctgcaaggacagcaagaagcacgccacctag

SEQ ID NO: 101838 - DNA, 1086 bp, Artificial Sequence; identical to SEQ ID NO: 101836
  Description of Artificial Sequence: Synthetic coding sequence

SEQ ID NO: 101839 - DNA, 471 bp, Artificial Sequence; identical to SEQ ID NO: 101831
  Description of Artificial Sequence: Synthetic coding sequence

SEQ ID NO: 101840 - DNA, 1347 bp, Artificial Sequence; identical to SEQ ID NO: 101837
  Description of Artificial Sequence: Synthetic coding sequence

SEQ ID NO: 101841 - DNA, 1086 bp, Artificial Sequence; identical to SEQ ID NO: 101833
  Description of Artificial Sequence: Synthetic coding sequence

SEQ ID NO: 101842 - DNA, 1347 bp, Artificial Sequence; identical to SEQ ID NO: 101837
  Description of Artificial Sequence: Synthetic coding sequence

SEQ ID NO: 101843 - DNA, 1086 bp, Artificial Sequence; identical to SEQ ID NO: 101836
  Description of Artificial Sequence: Synthetic coding sequence

SEQ ID NO: 101844 - DNA, 2037 bp, Artificial Sequence
  Description of Artificial Sequence: Synthetic coding sequence
atgctgctggaggccgagagaagaagaggcggcggcgccgccggcgccagactgctggagagatacagaagagtgcccggcgtgagagccctgagagccgacagcgtgctgatcatcgagaccgtgcccggcttcccccccgccccccccgcccccggcgccgcccagatcagagccgccgaggtgctggtgtacggcgccccccccggcagagtgagcagactgctggagagattcgacccccccgccgcccccagaagaagaggcagccccgagagagccagaccccccccccccccccccccccccgccccccccagacccccccccgccgcccccagcccccccgccgcccccggccccagaggcggcggcgccagccccggcgccagaagaagcgacttcctgcagaagaccggcagcaacagcttcaccgtgcaccccagaggcctgcacagaggcgccggcgccagactgctgagcaacggccacagcgcccccgagcccagagccggccccgccaacagactggccggcagcccccccggcagcggccagtggaagcccaaggtggagagcggcgaccccagcctgcaccccccccccagccccggcacccccagcgccacccccgccagcccccccgccagcgccacccccagccagagacagtgcgtgagcgccgccaccagcaccaacgacagcttcgagatcagacccgcccccaagcccgtgatggagaccatccccctgggcgacctgcaggccagagccctggccagcctgagagccaacagcagaaacagcttcatggtgatccccaagagcaaggccagcggcgcccccccccccgagggcagacagagcgtggagctgcccaagggcgacctgggccccgccagccccagccaggagctgggcagccagcccgtgcccggcggcgacggcgcccccgccctgggcaagagccccctggaggtggaggcccagtgggccgtggaggagggcgcctgccccagaaccgccaccgccctggccgacagagccatcagatggcagagacccagcagccccccccccttcctgcccgccgccagcgaggaggccgagcccgccgagggcctgagagtgcccggcctggccaagaacagcagagagtacgtgagacccggcctgcccgtgaccttcatcgacgaggtggacagcgaggaggccccccaggccgccaagctgccctacctgccccaccccgccagacccctgcaccccgccagacccggctgcgtggccgagctgcagcccagaggcagcaacaccttcaccgtggtgcccaagagaaagcccggcaccctgcaggaccagcacttcagccaggccaacagagagcccagacccagagaggccgaggaggaggaggccagctgcctgctgggccccaccctgaagaagagataccccaccgtgcacgagatcgaggtgatcggcggctacctggccctgcagaagagctgcctgaccaaggccggcagcagcagaaagaagatgaagatcagcttcaacgacaagagcctgcagaccaccttcgagtaccccagcgagagcagcctggagcaggaggaggaggtggaccagcaggaggaggaggaggaggaggaggaggaggaggaggaggaggaggagggcagcggcagcgaggagaagcccttcgccctgttcctgcccagagccaccttcgtgagcagcgtgagacccgagagcagcagactgcccgagggcagcagcggcctgagcagctacacccccaagcacagcgtggccttcagcaagtggcaggagcaggccctggagcaggcccccagagaggccgagcccccccccgtggaggccatggtgagatgcggcggcgtggagagatggggcgagagcgacaccagagccagcccctgcgtgcacatcctgagcagccacttccagctgacccccgccagccagaacgacctgagcgacttcagaagcgagcccgccctgtacttctag

SEQ ID NO: 101845 - DNA, 2136 bp, Artificial Sequence
  Description of Artificial Sequence: Synthetic coding sequence
atggccgccctgggcagacccggcagcggccccagagccgccgtgcccgcctggaagagagagatcctggagagaaagagagccaagctggccgccctgggcggcggcgccggccccggcgccgccgagcccgagcagagagtgctggccgagagcctgggccccctgagagagaaccccttcatgctgctggaggccgagagaagaagaggcggcggcgccgccggcgccagactgctggagagatacagaagagtgcccggcgtgagagccctgagagccgacagcgtgctgatcatcgagaccgtgcccggcttcccccccgccccccccgcccccggcgccgcccagatcagagccgccgaggtgctggtgtacggcgccccccccggcagagtgagcagactgctggagagattcgacccccccgccgcccccagaagaagaggcagccccgagagagccagaccccccccccccccccccccccccgccccccccagacccccccccgccgcccccagcccccccgccgcccccggccccagaggcggcggcgccagccccggcgccagaagaagcgacttcctgcagaagaccggcagcaacagcttcaccgtgcaccccagaggcctgcacagaggcgccggcgccagactgctgagcaacggccacagcgcccccgagcccagagccggccccgccaacagactggccggcagcccccccggcagcggccagtggaagcccaaggtggagagcggcgaccccagcctgcaccccccccccagccccggcacccccagcgccacccccgccagcccccccgccagcgccacccccagccagagacagtgcgtgagcgccgccaccagcaccaacgacagcttcgagatcagacccgcccccaagcccgtgatggagaccatccccctgggcgacctgcaggccagagccctggccagcctgagagccaacagcagaaacagcttcatggtgatccccaagagcaaggccagcggcgcccccccccccgagggcagacagagcgtggagctgcccaagggcgacctgggccccgccagccccagccaggagctgggcagccagcccgtgcccggcggcgacggcgcccccgccctgggcaagagccccctggaggtggaggcccagtgggccgtggaggagggcgcctgccccagaaccgccaccgccctggccgacagagccatcagatggcagagacccagcagccccccccccttcctgcccgccgccagcgaggaggccgagcccgccgagggcctgagagtgcccggcctggccaagaacagcagagagtacgtgagacccggcctgcccgtgaccttcatcgacgaggtggacagcgaggaggccccccaggccgccaagctgccctacctgccccaccccgccagacccctgcaccccgccagacccggctgcgtggccgagctgcagcccagaggcagcaacaccttcaccgtggtgcccaagagaaagcccggcaccctgcaggaccagcacttcagccaggccaacagagagcccagacccagagaggccgaggaggaggaggccagctgcctgctgggccccaccctgaagaagagataccccaccgtgcacgagatcgaggtgatcggcggctacctggccctgcagaagagctgcctgaccaaggccggcagcagcagaaagaagatgaagatcagcttcaacgacaagagcctgcagaccaccttcgagtaccccagcgagagcagcctggagcaggaggaggaggtggaccagcaggaggaggaggaggaggaggaggaggaggaggaggaggaggaggagggcagcggcagcgaggagaagcccttcgccctgttcctgcccagagccaccttcgtgagcagcgtgagacccgagagcagcagactgcccgagggcagcagcggcctgagcagctacacccccaagcacagcgtggccttcagcaagtggcaggagcaggccctggagcaggcccccagagaggccgagcccccccccgtggaggccatgctgacccccgccagccagaacgacctgagcgacttcagaagcgagcccgccctgtacttctag

SEQ ID NO: 101846 - DNA, 4866 bp, Artificial Sequence
  Description of Artificial Sequence: Synthetic coding sequence
atggagtgggtgctggccgaggccctgctgagccagagcagagaccccagagccctgctgggcgccctgtgccagggcgaggccagcgccgagagagtggagaccctgagattcctgctgcagagactggaggacgaggaggccagaggcagcggcggcgccggcgccctgcccgaggccgccagagaggtggccgccggctacctggtgcccctgctgagaagcctgagaggcagacccgccggcggccccgaccccagcctgcagcccagacacagaagaagagtgctgagagccgccggcgccgccctgagaagctgcgtgagactggccggcagaccccagctggccgccgccctggccgaggaggccctgagagacctgctggccggctggagagcccccggcgccgaggccgccgtggaggtgctggccgccgtgggcccctgcctgagacccagagaggacggccccctgctggagagagtggccggcaccgccgtggccctggccctgggcggcggcggcgacggcgacgaggccggccccgccgaggacgccgccgccctggtggccggcagactgctgcccgtgctggtgcagtgcggcggcgccgccctgagagccgtgtggggcggcctggccgcccccggcgccagcctgggcagcggcagagtggaggagaagctgctggtgctgagcgccctggccgagaagctgctgcccgagcccggcggcgacagagccagaggcgccagagaggccggccccgacgccagaagatgctggagattctggagaaccgtgcaggccggcctgggccaggccgacgccctgaccagaaagagagccagatacctgctgcagagagccgtggaggtgagcgccgagctgggcgccgactgcacctgcggcccccaggagggcaacggccccagcctgttctggtggagcgagagaaagaaggacgagctgctgaagttctgggagaactacatcctgatcatggagaccctggagggcaaccagatccacgtgatcaagcccgtgctgcccaagctgaacaacctgttcgagtacgccgtgagcgaggagaacggctgctggctgttccaccccagctggcacatgtgcatctacaagagaatgttcgagagcgagaacaagatcctgagcaaggagggcgtgatccacttcctggagctgtacgagaccaagatcctgcccttcagccccgagttcagcgagttcatcatcggccccctgatggacgccctgagcgagagcagcctgtacagcagaagccccggccagcccatcggcagctgcagccccctgggcctgaagctgcagaagttcctggtgacctacatcagcctgctgcccgaggagatcaagagcagcttcctgctgaagttcatcagaaagatgaccagcagacactggtgcgccgtgcccatcctgttcctgagcaaggccctggccaacgtgcccagacacaaggccctgggcatcgacggcctgctggccctgagagacgtgatccactgcaccatgatcacccaccagatcctgctgagaggcgccgcccagtgctacctgctgcagaccgccatgaacctgctggacgtggagaaggtgagcctgagcgacgtgagcaccttcctgatgagcctgagacaggaggagagcctgggcagaggcaccagcctgtggaccgagctgtgcgactggctgagagtgaacgagagctacttcaagcccagccccacctgcagcagcatcggcctgcacaagaccagcctgaacgcctacgtgaagagcatcgtgcaggagtacgtgaagagcagcgcctgggagaccggcgagaactgcttcatgcccgactggttcgaggccaagctggtgagcctgatggtgctgctggccgtggacgtggagggcatgaagacccagtacagcggcaagcagagaaccgagaacgtgctgagaatcttcctggaccccctgctggacgtgctgatgaagttcagcaccaacgcctacatgcccctgctgaagaccgacagatgcctgcagctgctgctgaagctgctgaacacctgcagactgaagggcagcagcgcccaggacgacgaggtgagcaccgtgctgcagaacttcttcatgagcaccaccgagagcatcagcgagttcatcctgagaagactgaccatgaacgagctgaacagcgtgagcgacctggacagatgccacctgtacctgatggtgctgaccgagctgatcaacctgcacctgaaggtgggctggaagagaggcaaccccatctggagagtgatcagcctgctgaagaacgccagcatccagcacctgcaggagatggacagcggccaggagcccaccgtgggcagccagatccagagagtggtgagcatggccgccctggccatggtgtgcgaggccatcgaccagaagcccgagctgcagctggacagcctgcacgccggccccctggagagcttcctgagcagcctgcagctgaaccagaccctgcagaagccccacgccgaggagcagagcagctacgcccaccccctggagtgcagcagcgtgctggaggagagcagcagcagccagggctggggcaagatcgtggcccagtacatccacgaccagtgggtgtgcctgagcttcctgctgaagaagtaccacaccctgatccccaccaccggcagcgagatcctggagcccttcctgcccgccgtgcagatgcccatcagaaccctgcagagcgccctggaggccctgaccgtgctgagcagcgaccaggtgctgcccgtgttccactgcctgaaggtgctggtgcccaagctgctgaccagcagcgagagcctgtgcatcgagagcttcgacatggcctggaagatcatcagcagcctgagcaacacccagctgatcttctgggccaacctgaaggccttcgtgcagttcgtgttcgacaacaaggtgctgaccatcgccgccaagatcaagggccaggcctacttcaagatcaaggagatcatgtacaagatcatcgagatgagcgccatcaagaccggcgtgttcaacaccctgatcagctactgctgccagagctggatcgtgagcgccagcaacgtgagccagggcagcctgagcagcgccaagaactacagcgagctgatcctggaggcctgcatcttcggcaccgtgttcagaagagaccagagactggtgcaggacgtgcagaccttcatcgagaacctgggccacgactgcgccgccaacatcgtgatggagaacaccaagagagaggaccactacgtgagaatctgcgccgtgaagttcctgtgcctgctggacggcagcaacatgagccacaagctgttcatcgaggacctggccatcaagctgctggacaaggacgagctggtgagcaagagcaagaagagatactacgtgaacagcctgcagcacagagtgaagaacagagtgtggcagaccctgctggtgctgttccccagactggaccagaacttcctgaacggcatcatcgacagaatcttccaggccggcttcaccaacaaccaggccagcatcaagtacttcatcgagtggatcatcatcctgatcctgcacaagttcccccagttcctgcccaagttctgggactgcttcagctacggcgaggagaacctgaagaccagcatctgcaccttcctggccgtgctgagccacctggacatcatcacccagaacatccccgagaagaagctgatcctgaagcaggccctgatcgtggtgctgcagtggtgcttcaaccacaacttcagcgtgagactgtacgccctggtggccctgaagaagctgtggaccgtgtgcaaggtgctgagcgtggaggagttcgacgccctgacccccgtgatcgagagcagcctgcaccaggtggagagcatgcacggcgccggcaacgccaagaagaactggcagagaatccaggagcacttcttcttcgccaccttccaccccctgaaggactactgcctggagaccatcttctacatcctgcccagactgagcggcctgatcgaggacgagtggatcaccatcgacaagttcaccagattcaccgacgtgcccctggccgccggcttccagtggtacctgagccagacccagctgagcaagctgaagcccggcgactggagccagcaggacatcggcaccaacctggtggaggccgacaaccaggccgagtggaccgacgtgcagaagaagatcatcccctggaacagcagagtgagcgacctggacctggagctgctgttccaggacagagccgccagactgggcaagagcatcagcagactgatcgtggtggccagcctgatcgacaagcccaccaacctgggcggcctgtgcagaacctgcgaggtgttcggcgccagcgtgctggtggtgggcagcctgcagtgcatcagcgacaagcagttccagcacctgagcgtgagcgccgagcagtggctgcccctggtggaggtgaagcccccccagctgatcgactacctgcagcagaagaagaccgagggctacaccatcatcggcgtggagcagaccgccaagagcctggacctgacccagtactgcttccccgagaagagcctgctgctgctgggcaacgagagagagggcatccccgccaacctgatccagcagctggacgtgtgcgtggagatcccccagcagggcatcatcagaagcctgaacgtgcacgtgagcggcgccctgctgatctgggagtacaccagacagcagctgctgagccacggcgacaccaagccctag

SEQ ID NO: 101847 - DNA, 1101 bp, Artificial Sequence
  Description of Artificial Sequence: Synthetic coding sequence
atgagcgaggaggagcagggcagcggcaccaccaccggctgcggcctgcccagcatcgagcagatgctggccgccaaccccggcaagacccccatcagcctgctgcaggagtacggcaccagaatcggcaagacccccgtgtacgacctgctgaaggccgagggccaggcccaccagcccaacttcaccttcagagtgaccgtgggcgacaccagctgcaccggccagggccccagcaagaaggccgccaagcacaaggccgccgaggtggccctgaagcacctgaagggcggcagcatgctggagcccgccctggaggacagcagcagcttcagccccctggacagcagcctgcccgaggacatccccgtgttcaccgccgccgccgccgccacccccgtgcccagcgtggtgctgaccagaagcccccccatggagctgcagccccccgtgagcccccagcagagcgagtgcaaccccgtgggcgccctgcaggagctggtggtgcagaagggctggagactgcccgagtacaccgtgacccaggagagcggccccgcccacagaaaggagttcaccatgacctgcagagtggagagattcatcgagatcggcagcggcaccagcaagaagctggccaagagaaacgccgccgccaagatgctgctgagagtgcacaccgtgcccctggacgccagagacggcaacgaggtggagcccgacgacgaccacttcagcatcggcgtgggcagcagactggacggcctgagaaacagaggccccggctgcacctgggacagcctgagaaacagcgtgggcgagaagatcctgagcctgagaagctgcagcctgggcagcctgggcgccctgggccccgcctgctgcagagtgctgagcgagctgagcgaggagcaggccttccacgtgagctacctggacatcgaggagctgagcctgagcggcctgtgccagtgcctggtggagctgagcacccagcccgccaccgtgtgccacggcagcgccaccaccagagaggccgccagaggcgaggccgccagaagagccctgcagtacctgaagatcatggccggcagcaagtag

SEQ ID NO: 101848 - DNA, 1038 bp, Artificial Sequence
  Description of Artificial Sequence: Synthetic coding sequence
atgctggccgccaaccccggcaagacccccatcagcctgctgcaggagtacggcaccagaatcggcaagacccccgtgtacgacctgctgaaggccgagggccaggcccaccagcccaacttcaccttcagagtgaccgtgggcgacaccagctgcaccggccagggccccagcaagaaggccgccaagcacaaggccgccgaggtggccctgaagcacctgaagggcggcagcatgctggagcccgccctggaggacagcagcagcttcagccccctggacagcagcctgcccgaggacatccccgtgttcaccgccgccgccgccgccacccccgtgcccagcgtggtgctgaccagaagcccccccatggagctgcagccccccgtgagcccccagcagagcgagtgcaaccccgtgggcgccctgcaggagctggtggtgcagaagggctggagactgcccgagtacaccgtgacccaggagagcggccccgcccacagaaaggagttcaccatgacctgcagagtggagagattcatcgagatcggcagcggcaccagcaagaagctggccaagagaaacgccgccgccaagatgctgctgagagtgcacaccgtgcccctggacgccagagacggcaacgaggtggagcccgacgacgaccacttcagcatcggcgtgggcagcagactggacggcctgagaaacagaggccccggctgcacctgggacagcctgagaaacagcgtgggcgagaagatcctgagcctgagaagctgcagcctgggcagcctgggcgccctgggccccgcctgctgcagagtgctgagcgagctgagcgaggagcaggccttccacgtgagctacctggacatcgaggagctgagcctgagcggcctgtgccagtgcctggtggagctgagcacccagcccgccaccgtgtgccacggcagcgccaccaccagagaggccgccagaggcgaggccgccagaagagccctgcagtacctgaagatcatggccggcagcaagtag

SEQ ID NO: 101849 - DNA, 1038 bp, Artificial Sequence; identical to SEQ ID NO: 101848
  Description of Artificial Sequence: Synthetic coding sequence

SEQ ID NO: 101850 - DNA, 1245 bp, Artificial Sequence
  Description of Artificial Sequence: Synthetic coding sequence
atgagcgagtacatcagagtgaccgaggacgagaacgacgagcccatcgagatccccagcgaggacgacggcaccgtgctgctgagcaccgtgaccgcccagttccccggcgcctgcggcctgagatacagaaaccccgtgagccagtgcatgagaggcgtgagactggtggagggcatcctgcacgcccccgacgccggctggggcaacctggtgtacgtggtgaactaccccaaggacaacaagagaaagatggacgagaccgacgccagcagcgccgtgaaggtgaagagagccgtgcagaagaccagcgacctgatcgtgctgggcctgccctggaagaccaccgagcaggacctgaaggagtacttcagcaccttcggcgaggtgctgatggtgcaggtgaagaaggacctgaagaccggccacagcaagggcttcggcttcgtgagattcaccgagtacgagacccaggtgaaggtgatgagccagagacacatgatcgacggcagatggtgcgactgcaagctgcccaacagcaagcagagccaggacgagcccctgagaagcagaaaggtgttcgtgggcagatgcaccgaggacatgaccgaggacgagctgagagagttcttcagccagtacggcgacgtgatggacgtgttcatccccaagcccttcagagccttcgccttcgtgaccttcgccgacgaccagatcgcccagagcctgtgcggcgaggacctgatcatcaagggcatcagcgtgcacatcagcaacgccgagcccaagcacaacagcaacagacagctggagagaagcggcagattcggcggcaaccccggcggcttcggcaaccagggcggcttcggcaacagcagaggcggcggcgccggcctgggcaacaaccagggcagcaacatgggcggcggcatgaacttcggcgccttcagcatcaaccccgccatgatggccgccgcccaggccgccctgcagagcagctggggcatgatgggcatgctggccagccagcagaaccagagcggccccagcggcaacaaccagaaccagggcaacatgcagagagagcccaaccaggccttcggcagcggcaacaacagctacagcggcagcaacagcggcgccgccatcggctggggcagcgccagcaacgccggcagcggcagcggcttcaacggcggcttcggcagcagcatggacagcaagagcagcggctggggcatgtag

SEQ ID NO: 101851 - DNA, 888 bp, Artificial Sequence
  Description of Artificial Sequence: Synthetic coding sequence
atgagcgagtacatcagagtgaccgaggacgagaacgacgagcccatcgagatccccagcgaggacgacggcaccgtgctgctgagcaccgtgaccgcccagttccccggcgcctgcggcctgagatacagaaaccccgtgagccagtgcatgagaggcgtgagactggtggagggcatcctgcacgcccccgacgccggctggggcaacctggtgtacgtggtgaactaccccaaggacaacaagagaaagatggacgagaccgacgccagcagcgccgtgaaggtgaagagagccgtgcagaagaccagcgacctgatcgtgctgggcctgccctggaagaccaccgagcaggacctgaaggagtacttcagcaccttcggcgaggtgctgatggtgcaggtgaagaaggacctgaagaccggccacagcaagggcttcggcttcgtgagattcaccgagtacgagacccaggtgaaggtgatgagccagagacacatgatcgacggcagatggtgcgactgcaagctgcccaacagcaagcagagccaggacgagcccctgagaagcagaaaggtgttcgtgggcagatgcaccgaggacatgaccgaggacgagctgagagagttcttcagccagtacggcgacgtgatggacgtgttcatccccaagcccttcagagccttcgccttcgtgaccttcgccgacgaccagatcgcccagagcctgtgcggcgaggacctgatcatcaagggcatcagcgtgcacatcagcaacgccgagcccaagcacaacagcaacagacagctggagagaagcggcagattcggcgtgcacctgatcagcaacgtgtacggcagaagcaccagcctgaaggtggtgctgtag

SEQ ID NO: 101852 - DNA, 897 bp, Artificial Sequence
  Description of Artificial Sequence: Synthetic coding sequence
atgccccagatgctggccggcgagatctggtgcatgctgagcaccatccagaaggtgaagaaggacctgaagaccggccacagcaagggcttcggcttcgtgagattcaccgagtacgagacccaggtgaaggtgatgagccagagacacatgatcgacggcagatggtgcgactgcaagctgcccaacagcaagcagagccaggacgagcccctgagaagcagaaaggtgttcgtgggcagatgcaccgaggacatgaccgaggacgagctgagagagttcttcagccagtacggcgacgtgatggacgtgttcatccccaagcccttcagagccttcgccttcgtgaccttcgccgacgaccagatcgcccagagcctgtgcggcgaggacctgatcatcaagggcatcagcgtgcacatcagcaacgccgagcccaagcacaacagcaacagacagctggagagaagcggcagattcggcggcaaccccggcggcttcggcaaccagggcggcttcggcaacagcagaggcggcggcgccggcctgggcaacaaccagggcagcaacatgggcggcggcatgaacttcggcgccttcagcatcaaccccgccatgatggccgccgcccaggccgccctgcagagcagctggggcatgatgggcatgctggccagccagcagaaccagagcggccccagcggcaacaaccagaaccagggcaacatgcagagagagcccaaccaggccttcggcagcggcaacaacagctacagcggcagcaacagcggcgccgccatcggctggggcagcgccagcaacgccggcagcggcagcggcttcaacggcggcttcggcagcagcatggacagcaagagcagcggctggggcatgtag

SEQ ID NO: 101853 - DNA, 1533 bp, Artificial Sequence
  Description of Artificial Sequence: Synthetic coding sequence
atggccgccgacagcgacgacggcgccgtgagcgcccccgccgccagcgacggcggcgtgagcaagagcaccaccagcggcgaggagctggtggtgcaggtgcccgtggtggacgtgcagagcaacaacttcaaggagatgtggcccagcctgctgctggccatcaagaccgccaacttcgtggccgtggacaccgagctgagcggcctgggcgacagaaagagcctgctgaaccagtgcatcgaggagagatacaaggccgtgtgccacgccgccagaaccagaagcatcctgagcctgggcctggcctgcttcaagagacagcccgacaagggcgagcacagctacctggcccaggtgttcaacctgaccctgctgtgcatggaggagtacgtgatcgagcccaagagcgtgcagttcctgatccagcacggcttcaacttcaaccagcagtacgcccagggcatcccctaccacaagggcaacgacaagggcgacgagagccagagccagagcgtgagaaccctgttcctggagctgatcagagccagaagacccctggtgctgcacaacggcctgatcgacctggtgttcctgtaccagaacttctacgcccacctgcccgagagcctgggcaccttcaccgccgacctgtgcgagatgttccccgccggcatctacgacaccaagtacgccgccgagttccacgccagattcgtggccagctacctggagtacgccttcagaaagtgcgagagagagaacggcaagcagagagccgccggcagcccccacctgaccctggagttctgcaactaccccagcagcatgagagaccacatcgactacagatgctgcctgccccccgccacccacagaccccaccccaccagcatctgcgacaacttcagcgcctacggctggtgccccctgggcccccagtgcccccagagccacgacatcgacctgatcatcgacaccgacgaggccgccgccgaggacaagagaagaagaagaagaagaagagagaagagaaagagagccctgctgaacctgcccggcacccagaccagcggcgaggccaaggacggcccccccaagaagcaggtgtgcggcgacagcatcaagcccgaggagaccgagcaggaggtggccgccgacgagaccagaaacctgccccacagcaagcagggcaacaagaacgacctggagatgggcatcaaggccgccagacccgagatcgccgacagagccaccagcgaggtgcccggcagccaggccagccccaaccccgtgcccggcgacggcctgcacagagccggcttcgacgccttcatgaccggctacgtgatggcctacgtggaggtgagccagggcccccagccctgcagcagcggcccctggctgcccgagtgccacaacaaggtgtacctgagcggcaaggccgtgcccctgaccgtggccaagagccagttcagcagaagcagcaaggcccacaaccagaagatgaagctgacctggggcagcagctag

SEQ ID NO: 101854 - DNA, 1293 bp, Artificial Sequence
  Description of Artificial Sequence: Synthetic coding sequence
atggccgccgacagcgacgacggcgccgtgagcgcccccgccgccagcgacggcgccgagtgggcctggggccaggaggagttcgccgagcccggcgagcacagctacctggcccaggtgttcaacctgaccctgctgtgcatggaggagtacgtgatcgagcccaagagcgtgcagttcctgatccagcacggcttcaacttcaaccagcagtacgcccagggcatcccctaccacaagggcaacgacaagggcgacgagagccagagccagagcgtgagaaccctgttcctggagctgatcagagccagaagacccctggtgctgcacaacggcctgatcgacctggtgttcctgtaccagaacttctacgcccacctgcccgagagcctgggcaccttcaccgccgacctgtgcgagatgttccccgccggcatctacgacaccaagtacgccgccgagttccacgccagattcgtggccagctacctggagtacgccttcagaaagtgcgagagagagaacggcaagcagagagccgccggcagcccccacctgaccctggagttctgcaactaccccagcagcatgagagaccacatcgactacagatgctgcctgccccccgccacccacagaccccaccccaccagcatctgcgacaacttcagcgcctacggctggtgccccctgggcccccagtgcccccagagccacgacatcgacctgatcatcgacaccgacgaggccgccgccgaggacaagagaagaagaagaagaagaagagagaagagaaagagagccctgctgaacctgcccggcacccagaccagcggcgaggccaaggacggcccccccaagaagcaggtgtgcggcgacagcatcaagcccgaggagaccgagcaggaggtggccgccgacgagaccagaaacctgccccacagcaagcagggcaacaagaacgacctggagatgggcatcaaggccgccagacccgagatcgccgacagagccaccagcgaggtgcccggcagccaggccagccccaaccccgtgcccggcgacggcctgcacagagccggcttcgacgccttcatgaccggctacgtgatggcctacgtggaggtgagccagggcccccagccctgcagcagcggcccctggctgcccgagtgccacaacaaggtgtacctgagcggcaaggccgtgcccctgaccgtggccaagagccagttcagcagaagcagcaaggcccacaaccagaagatgaagctgacctggggcagcagctag

SEQ ID NO: 101855 - DNA, 1263 bp, Artificial Sequence
  Description of Artificial Sequence: Synthetic coding sequence
atgaccatggagaagggcatgagcagcggcgagggcctgcccagcagaagcagccaggtgagcgccggcaagatcaccgccaaggagctggagaccaagcagagctacaaggagaagagaggcggcttcgtgctggtgcacgccggcgccggctaccacagcgagagcaaggccaaggagtacaagcacgtgtgcaagagagcctgccagaaggccatcgagaagctgcaggccggcgccctggccaccgacgccgtgaccgccgccctggtggagctggaggacagccccttcaccaacgccggcatgggcagcaacctgaacctgctgggcgagatcgagtgcgacgccagcatcatggacggcaagagcctgaacttcggcgccgtgggcgccctgagcggcatcaagaaccccgtgagcgtggccaacagactgctgtgcgagggccagaagggcaagctgagcgccggcagaatccccccctgcttcctggtgggcgagggcgcctacagatgggccgtggaccacggcatccccagctgcccccccaacatcatgaccaccagattcagcctggccgccttcaagagaaacaagagaaagctggagctggccgagagagtggacaccgacttcatgcagctgaagaagagaagacagagcagcgagaaggagaacgacagcggcaccctggacaccgtgggcgccgtggtggtggaccacgagggcaacgtggccgccgccgtgagcagcggcggcctggccctgaagcaccccggcagagtgggccaggccgccctgtacggctgcggctgctgggccgagaacaccggcgcccacaacccctacagcaccgccgtgagcaccagcggctgcggcgagcacctggtgagaaccatcctggccagagagtgcagccacgccctgcaggccgaggacgcccaccaggccctgctggagaccatgcagaacaagttcatcagcagccccttcctggccagcgaggacggcgtgctgggcggcgtgatcgtgctgagaagctgcagatgcagcgccgagcccgacagcagccagaacaagcagaccctgctggtggagttcctgtggagccacaccaccgagagcatgtgcgtgggctacatgagcgcccaggacggcaaggccaagacccacatcagcagactgccccccggcgccgtggccggccagagcgtggccatcgagggcggcgtgtgcagactggagagccccgtgaactag

SEQ ID NO: 101856 - DNA, 918 bp, Artificial Sequence
  Description of Artificial Sequence: Synthetic coding sequence
atgaccatggagaagggcatgagcagcggcgagggcctgcccagcagaagcagccaggtgagcgccggcaagatcaccgccaaggagctggagaccaagcagagctacaaggagaagagaggcggcttcgtgctggtgcacgccggcgccggctaccacagcgagagcaaggccaaggagtacaagcacgtgtgcaagagagcctgccagaaggacagccccttcaccaacgccggcatgggcagcaacctgaacctgctgggcgagatcgagtgcgacgccagcatcatggacggcaagagcctgaacttcggcgccgtgggcgccctgagcggcatcaagaaccccgtgagcgtggccaacagactgctgtgcgagggccagaagggcaagctgagcgccggcagaatccccccctgcttcctggtgggcgagggcgcctacagatgggccgtggaccacggcatccccagctgcccccccaacatcatgaccaccagattcagcctggccgccttcaagagaaacaagagaaagctggagctggccgagagagtggacaccgacttcatgcagctgaagaagagaagacagagcagcgagaaggagaacgacagcggcaccctggacaccgtgggcgccgtggtggtggaccacgagggcaacgtggccgccgccgtgagcagcggcggcctggccctgaagcaccccggcagagtgggccaggccgccctgtacggctgcggctgctgggccgagaacaccggcgcccacaacccctacagcaccgccgtgagcaccagcggctgcggcgagcacctggtgagaaccatcctggccagagagtgcagccacgccctgcaggccgaggacgcccaccaggccctgctggagaccatgcagaacaagttcatctag

SEQ ID NO: 101857 - DNA, 333 bp, Artificial Sequence
  Description of Artificial Sequence: Synthetic coding sequence
tgaaagatcaccgccaaggagctggagaccaagcagagctacaaggagaagagaggcggcttcgtgctggtgcacgccggcgccggctaccacagcgagagcaaggccaaggagtacaagcacgtgtgcaagagagcctgccagaaggccatcgagaagctgcaggccggcgccctggccaccgacgccgtgaccgccgccctggtggagctggagctgatgtggaagggccagttccaggtgctgtgcgtgctgaccaacctgttcctggacatcatcaagaaccccaccaagaccaagttcaagaccatcagcaacgtgaaggtgtactag

SEQ ID NO: 101858 - DNA, 918 bp, Artificial Sequence; identical to SEQ ID NO: 101856
  Description of Artificial Sequence: Synthetic coding sequence

SEQ ID NO: 101859 - DNA, 438 bp, Artificial Sequence
  Description of Artificial Sequence: Synthetic coding sequence
atgaccatggagaagggcatgagcagcggcgagggcctgcccagcagaagcagccaggtgagcgccggcaagatcaccgccaaggagctggagaccaagcagagctacaaggagaagagaggcggcttcgtgctggtgcacgccggcgccggctaccacagcgagagcaaggccaaggagtacaagcacgtgtgcaagagagcctgccagaaggccatcgagaagctgcaggccggcgccctggccaccgacgccgtgaccgccgccctggtggagctggaggacgtggagagcatcctgtgcgccccctactggctggagaacgtgcacatgctgtacaagctgagaatgctgaccaagccctgctggagactgtgcaagaccagcctgagcgtgcacctgagcctgcccgtgaagatggcctgcctggccgagtag

SEQ ID NO: 101860 - DNA, 390 bp, Artificial Sequence
  Description of Artificial Sequence: Synthetic coding sequence
atgaccatggagaagggcatgagcagcggcgagggcctgcccagcagaagcagccaggtgagcgccggcaagatcaccgccaaggagctggagaccaagcagagctacaaggagaagagaggcggcttcgtgctggtgcacgccggcgccggctaccacagcgagagcaaggccaaggagtacaagcacgtgtgcaagagagcctgccagaaggccatcgagaagctgcaggccggcgccctggccaccgacgccgtgaccgccgccctggtggagctggaggtgtacacccacagctacaccagctggagctgcatccagcccagcatccacgtgctgctggtgaagagacagagaaagagccccctgcccagaatcagcaccttctag

SEQ ID NO: 101861 - DNA, 1443 bp, Artificial Sequence
  Description of Artificial Sequence: Synthetic coding sequence
atgctgctgtgcaccgccagactggtgggcctgcagctgctgatcagctgctgctgggccttcgcctgccacagcaccgagagcagccccgacttcaccctgcccggcgactacctgctggccggcctgttccccctgcacagcggctgcctgcaggtgagacacagacccgaggtgaccctgtgcgacagaagctgcagcttcaacgagcacggctaccacctgttccaggccatgagactgggcgtggaggagatcaacaacagcaccgccctgctgcccaacatcaccctgggctaccagctgtacgacgtgtgcagcgacagcgccaacgtgtacgccaccctgagagtgctgagcctgcccggccagcaccacatcgagctgcagggcgacctgctgcactacagccccaccgtgctggccgtgatcggccccgacagcaccaacagagccgccaccaccgccgccctgctgagccccttcctggtgcccatgatcagctacgccgccagcagcgagaccctgagcgtgaagagacagtaccccagcttcctgagaaccatccccaacgacaagtaccaggtggagaccatggtgctgctgctgcagaagttcggctggacctggatcagcctggtgggcagcagcgacgactacggccagctgggcgtgcaggccctggagaaccaggccaccggccagggcatctgcatcgccttcaaggacatcatgcccttcagcgcccaggtgggcgacgagagaatgcagtgcctgatgagacacctggcccaggccggcgccaccgtggtggtggtgttcagcagcagacagctggccagagtgttcttcgagagcgtggtgctgaccaacctgaccggcaaggtgtgggtggccagcgaggcctgggccctgagcagacacatcaccggcgtgcccggcatccagagaatcggcatggtgctgggcgtggccatccagaagagagccgtgcccggcctgaaggccttcgaggaggcctacgccagagccgacaagaaggcccccagaccctgccacaagggcagctggtgcagcagcaaccagctgtgcagagagtgccaggccttcatggcccacaccatgcccaagctgaaggccttcagcatgagcagcgcctacaacgcctacagagccgtgtacgccgtggcccacggcctgcaccagctgctgggctgcgccagcggcgcctgcagcagaggcagagtgtacccctggcagaccagcaccgacgccagcctggtgggcaagaagagcggccacctgagagaggccagacccgccagcagagccctgtggtgcttctggctgtgcgtgagcacccccctgggctgctgctggcagctgaccagatgctgctgctgctgctgcctgggcctgctggcctgcctgcccggcacctag

SEQ ID NO: 101862 - DNA, 2526 bp, Artificial Sequence
  Description of Artificial Sequence: Synthetic coding sequence
atgctgctgtgcaccgccagactggtgggcctgcagctgctgatcagctgctgctgggccttcgcctgccacagcaccgagagcagccccgacttcaccctgcccggcgactacctgctggccggcctgttccccctgcacagcggctgcctgcaggtgagacacagacccgaggtgaccctgtgcgacagaagctgcagcttcaacgagcacggctaccacctgttccaggccatgagactgggcgtggaggagatcaacaacagcaccgccctgctgcccaacatcaccctgggctaccagctgtacgacgtgtgcagcgacagcgccaacgtgtacgccaccctgagagtgctgagcctgcccggccagcaccacatcgagctgcagggcgacctgctgcactacagccccaccgtgctggccgtgatcggccccgacagcaccaacagagccgccaccaccgccgccctgctgagccccttcctggtgcccatgatcagctacgccgccagcagcgagaccctgagcgtgaagagacagtaccccagcttcctgagaaccatccccaacgacaagtaccaggtggagaccatggtgctgctgctgcagaagttcggctggacctggatcagcctggtgggcagcagcgacgactacggccagctgggcgtgcaggccctggagaaccaggccaccggccagggcatctgcatcgccttcaaggacatcatgcccttcagcgcccaggtgggcgacgagagaatgcagtgcctgatgagacacctggcccaggccggcgccaccgtggtggtggtgttcagcagcagacagctggccagagtgttcttcgagagcgtggtgctgaccaacctgaccggcaaggtgtgggtggccagcgaggcctgggccctgagcagacacatcaccggcgtgcccggcatccagagaatcggcatggtgctgggcgtggccatccagaagagagccgtgcccggcctgaaggccttcgaggaggcctacgccagagccgacaagaaggcccccagaccctgccacaagggcagctggtgcagcagcaaccagctgtgcagagagtgccaggccttcatggcccacaccatgcccaagctgaaggccttcagcatgagcagcgcctacaacgcctacagagccgtgtacgccgtggcccacggcctgcaccagctgctgggctgcgccagcggcgcctgcagcagaggcagagtgtacccctggcagctgctggagcagatccacaaggtgcacttcctgctgcacaaggacaccgtggccttcaacgacaacagagaccccctgagcagctacaacatcatcgcctgggactggaacggccccaagtggaccttcaccgtgctgggcagcagcacctggagccccgtgcagctgaacatcaacgagaccaagatccagtggcacggcaaggacaaccaggtgcccaagagcgtgtgcagcagcgactgcctggagggccaccagagagtggtgaccggcttccaccactgctgcttcgagtgcgtgccctgcggcgccggcaccttcctgaacaagagcgacctgtacagatgccagccctgcggcaaggaggagtgggcccccgagggcagccagacctgcttccccagaaccgtggtgttcctggccctgagagagcacaccagctgggtgctgctggccgccaacaccctgctgctgctgctgctgctgggcaccgccggcctgttcgcctggcacctggacacccccgtggtgagaagcgccggcggcagactgtgcttcctgatgctgggcagcctggccgccggcagcggcagcctgtacggcttcttcggcgagcccaccagacccgcctgcctgctgagacaggccctgttcgccctgggcttcaccatcttcctgagctgcctgaccgtgagaagcttccagctgatcatcatcttcaagttcagcaccaaggtgcccaccttctaccacgcctgggtgcagaaccacggcgccggcctgttcgtgatgatcagcagcgccgcccagctgctgatctgcctgacctggctggtggtgtggacccccctgcccgccagagagtaccagagattcccccacctggtgatgctggagtgcaccgagaccaacagcctgggcttcatcctggccttcctgtacaacggcctgctgagcatcagcgccttcgcctgcagctacctgggcaaggacctgcccgagaactacaacgaggccaagtgcgtgaccttcagcctgctgttcaacttcgtgagctggatcgccttcttcaccaccgccagcgtgtacgacggcaagtacctgcccgccgccaacatgatggccggcctgagcagcctgagcagcggcttcggcggctacttcctgcccaagtgctacgtgatcctgtgcagacccgacctgaacagcaccgagcacttccaggccagcatccaggactacaccagaagatgcggcagcacctag

SEQ ID NO: 101863 - DNA, 1764 bp, Artificial Sequence
  Description of Artificial Sequence: Synthetic coding sequence
atgctgctgtgcaccgccagactggtgggcctgcagctgctgatcagctgctgctgggccttcgcctgccacagcaccgagagcagccccgacttcaccctgcccggcgactacctgctggccggcctgttccccctgcacagcggctgcctgcaggtgagacacagacccgaggtgaccctgtgcgacagaagctgcagcttcaacgagcacggctaccacctgttccaggccatgagactgggcgtggaggagatcaacaacagcaccgccctgctgcccaacatcaccctgggctaccagctgtacgacgtgtgcagcgacagcgccaacgtgtacgccaccctgagagtgctgagcctgcccggccagcaccacatcgagctgcagggcgacctgctgcactacagccccaccgtgctggccgtgatcggccccgacagcaccaacagagccgccaccaccgccgccctgctgagccccttcctggtgcccatgctgctggagcagatccacaaggtgcacttcctgctgcacaaggacaccgtggccttcaacgacaacagagaccccctgagcagctacaacatcatcgcctgggactggaacggccccaagtggaccttcaccgtgctgggcagcagcacctggagccccgtgcagctgaacatcaacgagaccaagatccagtggcacggcaaggacaaccaggtgcccaagagcgtgtgcagcagcgactgcctggagggccaccagagagtggtgaccggcttccaccactgctgcttcgagtgcgtgccctgcggcgccggcaccttcctgaacaagagcgacctgtacagatgccagccctgcggcaaggaggagtgggcccccgagggcagccagacctgcttccccagaaccgtggtgttcctggccctgagagagcacaccagctgggtgctgctggccgccaacaccctgctgctgctgctgctgctgggcaccgccggcctgttcgcctggcacctggacacccccgtggtgagaagcgccggcggcagactgtgcttcctgatgctgggcagcctggccgccggcagcggcagcctgtacggcttcttcggcgagcccaccagacccgcctgcctgctgagacaggccctgttcgccctgggcttcaccatcttcctgagctgcctgaccgtgagaagcttccagctgatcatcatcttcaagttcagcaccaaggtgcccaccttctaccacgcctgggtgcagaaccacggcgccggcctgttcgtgatgatcagcagcgccgcccagctgctgatctgcctgacctggctggtggtgtggacccccctgcccgccagagagtaccagagattcccccacctggtgatgctggagtgcaccgagaccaacagcctgggcttcatcctggccttcctgtacaacggcctgctgagcatcagcgccttcgcctgcagctacctgggcaaggacctgcccgagaactacaacgaggccaagtgcgtgaccttcagcctgctgttcaacttcgtgagctggatcgccttcttcaccaccgccagcgtgtacgacggcaagtacctgcccgccgccaacatgatggccggcctgagcagcctgagcagcggcttcggcggctacttcctgcccaagtgctacgtgatcctgtgcagacccgacctgaacagcaccgagcacttccaggccagcatccaggactacaccagaagatgcggcagcacctag

SEQ ID NO: 101864 - DNA, 921 bp, Artificial Sequence
  Description of Artificial Sequence: Synthetic coding sequence
atgagactgggcgtggaggagatcaacaacagcaccgccctgctgcccaacatcaccctgggctaccagctgtacgacgtgtgcagcgacagcgccaacgtgtacgccaccctgagagtgctgagcctgcccggccagcaccacatcgagctgcagggcgacctgctgcactacagccccaccgtgctggccgtgatcggccccgacagcaccaacagagccgccaccaccgccgccctgctgagccccttcctggtgcccatgctgctggagcagatccacaaggtgcacttcctgctgcacaaggacaccgtggccttcaacgacaacagagaccccctgagcagctacaacatcatcgcctgggactggaacggccccaagtggaccttcaccgtgctgggcagcagcacctggagccccgtgcagctgaacatcaacgagaccaagatccagtggcacggcaaggacaaccaggtgcccaagagcgtgtgcagcagcgactgcctggagggccaccagagagtggtgaccggcttccaccactgctgcttcgagtgcgtgccctgcggcgccggcaccttcctgaacaagagcgacctgtacagatgccagccctgcggcaaggaggagtgggcccccgagggcagccagacctgcttccccagaaccgtggtgttcctggccctgagagagcacaccagctgggtgctgctggccgccaacaccctgctgctgctgctgctgctgggcaccgccggcctgttcgcctggcacctggacacccccgtggtgagaagcgccggcggcagactgtgcttcctgatgctgggcagcctggccgccggcagcggcagcctgtacggcttcttcggcgagcccagcctgcccctggtgagccccagcagctgccccgcctag

SEQ ID NO: 101865 - DNA, 2520 bp, Artificial Sequence
  Description of Artificial Sequence: Synthetic coding sequence
atgggccccagagccaagaccatcagcagcctgttcttcctgctgtgggtgctggccgagcccgccgagaacagcgacttctacctgcccggcgactacctgctgggcggcctgttcagcctgcacgccaacatgaagggcatcgtgcacctgaacttcctgcaggtgcccatgtgcaaggagtacgaggtgaaggtgatcggctacaacctgatgcaggccatgagattcgccgtggaggagatcaacaacgacagcagcctgctgcccggcgtgctgctgggctacgagatcgtggacgtgtgctacatcagcaacaacgtgcagcccgtgctgtacttcctggcccacgaggacaacctgctgcccatccaggaggactacagcaactacatcagcagagtggtggccgtgatcggccccgacaacagcgagagcgtgatgaccgtggccaacttcctgagcctgttcctgctgccccagatcacctacagcgccatcagcgacgagctgagagacaaggtgagattccccgccctgctgagaaccacccccagcgccgaccaccacatcgaggccatggtgcagctgatgctgcacttcagatggaactggatcatcgtgctggtgagcagcgacacctacggcagagacaacggccagctgctgggcgagagagtggccagaagagacatctgcatcgccttccaggagaccctgcccaccctgcagcccaaccagaacatgaccagcgaggagagacagagactggtgaccatcgtggacaagctgcagcagagcaccgccagagtggtggtggtgttcagccccgacctgaccctgtaccacttcttcaacgaggtgctgagacagaacttcaccggcgccgtgtggatcgccagcgagagctgggccatcgaccccgtgctgcacaacctgaccgagctgagacacctgggcaccttcctgggcatcaccatccagagcgtgcccatccccggcttcagcgagttcagagagtggggcccccaggccggccccccccccctgagcagaaccagccagagctacacctgcaaccaggagtgcgacaactgcctgaacgccaccctgagcttcaacaccatcctgagactgagcggcgagagagtggtgtacagcgtgtacagcgccgtgtacgccgtggcccacgccctgcacagcctgctgggctgcgacaagagcacctgcaccaagagagtggtgtacccctggcagctgctggaggagatctggaaggtgaacttcaccctgctggaccaccagatcttcttcgacccccagggcgacgtggccctgcacctggagatcgtgcagtggcagtgggacagaagccagaaccccttccagagcgtggccagctactaccccctgcagagacagctgaagaacatccaggacatcagctggcacaccatcaacaacaccatccccatgagcatgtgcagcaagagatgccagagcggccagaagaagaagcccgtgggcatccacgtgtgctgcttcgagtgcatcgactgcctgcccggcaccttcctgaaccacaccgaggacgagtacgagtgccaggcctgccccaacaacgagtggagctaccagagcgagaccagctgcttcaagagacagctggtgttcctggagtggcacgaggcccccaccatcgccgtggccctgctggccgccctgggcttcctgagcaccctggccatcctggtgatcttctggagacacttccagacccccatcgtgagaagcgccggcggccccatgtgcttcctgatgctgaccctgctgctggtggcctacatggtggtgcccgtgtacgtgggcccccccaaggtgagcacctgcctgtgcagacaggccctgttccccctgtgcttcaccatctgcatcagctgcatcgccgtgagaagcttccagatcgtgtgcgccttcaagatggccagcagattccccagagcctacagctactgggtgagataccagggcccctacgtgagcatggccttcatcaccgtgctgaagatggtgatcgtggtgatcggcatgctggccaccggcctgagccccaccaccagaaccgaccccgacgaccccaagatcaccatcgtgagctgcaaccccaactacagaaacagcctgctgttcaacaccagcctggacctgctgctgagcgtggtgggcttcagcttcgcctacatgggcaaggagctgcccaccaactacaacgaggccaagttcatcaccctgagcatgaccttctacttcaccagcagcgtgagcctgtgcaccttcatgagcgcctacagcggcgtgctggtgaccatcgtggacctgctggtgaccgtgctgaacctgctggccatcagcctgggctacttcggccccaagtgctacatgatcctgttctaccccgagagaaacacccccgcctacttcaacagcatgatccagggctacaccatgagaagagactag

SEQ ID NO: 101866 - DNA, 2559 bp, Artificial Sequence
  Description of Artificial Sequence: Synthetic coding sequence
atgctgggccccgccgtgctgggcctgagcctgtgggccctgctgcaccccggcaccggcgcccccctgtgcctgagccagcagctgagaatgaagggcgactacgtgctgggcggcctgttccccctgggcgaggccgaggaggccggcctgagaagcagaaccagacccagcagccccgtgtgcaccagattcagcagcaacggcctgctgtgggccctggccatgaagatggccgtggaggagatcaacaacaagagcgacctgctgcccggcctgagactgggctacgacctgttcgacacctgcagcgagcccgtggtggccatgaagcccagcctgatgttcctggccaaggccggcagcagagacatcgccgcctactgcaactacacccagtaccagcccagagtgctggccgtgatcggcccccacagcagcgagctggccatggtgaccggcaagttcttcagcttcttcctgatgccccaggtgagctacggcgccagcatggagctgctgagcgccagagagaccttccccagcttcttcagaaccgtgcccagcgacagagtgcagctgaccgccgccgccgagctgctgcaggagttcggctggaactgggtggccgccctgggcagcgacgacgagtacggcagacagggcctgagcatcttcagcgccctggccgccgccagaggcatctgcatcgcccacgagggcctggtgcccctgcccagagccgacgacagcagactgggcaaggtgcaggacgtgctgcaccaggtgaaccagagcagcgtgcaggtggtgctgctgttcgccagcgtgcacgccgcccacgccctgttcaactacagcatcagcagcagactgagccccaaggtgtgggtggccagcgaggcctggctgaccagcgacctggtgatgggcctgcccggcatggcccagatgggcaccgtgctgggcttcctgcagagaggcgcccagctgcacgagttcccccagtacgtgaagacccacctggccctggccaccgaccccgccttctgcagcgccctgggcgagagagagcagggcctggaggaggacgtggtgggccagagatgcccccagtgcgactgcatcaccctgcagaacgtgagcgccggcctgaaccaccaccagaccttcagcgtgtacgccgccgtgtacagcgtggcccaggccctgcacaacaccctgcagtgcaacgccagcggctgccccgcccaggaccccgtgaagccctggcagctgctggagaacatgtacaacctgaccttccacgtgggcggcctgcccctgagattcgacagcagcggcaacgtggacatggagtacgacctgaagctgtgggtgtggcagggcagcgtgcccagactgcacgacgtgggcagattcaacggcagcctgagaaccgagagactgaagatcagatggcacaccagcgacaaccagaagcccgtgagcagatgcagcagacagtgccaggagggccaggtgagaagagtgaagggcttccacagctgctgctacgactgcgtggactgcgaggccggcagctacagacagaaccccgacgacatcgcctgcaccttctgcggccaggacgagtggagccccgagagaagcaccagatgcttcagaagaagaagcagattcctggcctggggcgagcccgccgtgctgctgctgctgctgctgctgagcctggccctgggcctggtgctggccgccctgggcctgttcgtgcaccacagagacagccccctggtgcaggccagcggcggccccctggcctgcttcggcctggtgtgcctgggcctggtgtgcctgagcgtgctgctgttccccggccagcccagccccgccagatgcctggcccagcagcccctgagccacctgcccctgaccggctgcctgagcaccctgttcctgcaggccgccgagatcttcgtggagagcgagctgcccctgagctgggccgacagactgagcggctgcctgagaggcccctgggcctggctggtggtgctgctggccatgctggtggaggtggccctgtgcacctggtacctggtggccttcccccccgaggtggtgaccgactggcacatgctgcccaccgaggccctggtgcactgcagaaccagaagctgggtgagcttcggcctggcccacgccaccaacgccaccctggccttcctgtgcttcctgggcaccttcctggtgagaagccagcccggctgctacaacagagccagaggcctgaccttcgccatgctggcctacttcatcacctgggtgagcttcgtgcccctgctggccaacgtgcaggtggtgctgagacccgccgtgcagatgggcgccctgctgctgtgcgtgctgggcatcctggccgccttccacctgcccagatgctacctgctgatgagacagcccggcctgaacacccccgagttcttcctgggcggcggccccggcgacgcccagggccagaacgacggcaacaccggcaaccagggcaagcacgagtag

SEQ ID NO: 101867 - DNA, 876 bp, Artificial Sequence
  Description of Artificial Sequence: Synthetic coding sequence
atgatccccatccagctgaccgtgttcttcatgatcatctacgtgctggagagcctgaccatcatcgtgcagagcagcctgatcgtggccgtgctgggcagagagtggctgcaggtgagaagactgatgcccgtggacatgatcctgatcagcctgggcatcagcagattctgcctgcagtgggccagcatgctgaacaacttctgcagctacttcaacctgaactacgtgctgtgcaacctgaccatcacctgggagttcttcaacatcctgaccttctggctgaacagcctgctgaccgtgttctactgcatcaaggtgagcagcttcacccaccacatcttcctgtggctgagatggagaatcctgagactgttcccctggatcctgctgggcagcctgatgatcacctgcgtgaccatcatccccagcgccatcggcaactacatccagatccagctgctgaccatggagcacctgcccagaaacagcaccgtgaccgacaagctggagaacttccaccagtaccagttccaggcccacaccgtggccctggtgatccccttcatcctgttcctggccagcaccatcttcctgatggccagcctgaccaagcagatccagcaccacagcaccggccactgcaaccccagcatgaaggccagattcaccgccctgagaagcctggccgtgctgttcatcgtgttcaccagctacttcctgaccatcctgatcaccatcatcggcaccctgttcgacaagagatgctggctgtgggtgtgggaggccttcgtgtacgccttcatcctgatgcacagcaccagcctgatgctgagcagccccaccctgaagagaatcctgaagggcaagtgctag

SEQ ID NO: 101868 - DNA, 900 bp, Artificial Sequence
  Description of Artificial Sequence: Synthetic coding sequence
atgatgtgcttcctgctgatcatcagcagcatcctggtggtgttcgccttcgtgctgggcaacgtggccaacggcttcatcgccctggtgaacgtgatcgactgggtgaacaccagaaagatcagcagcgccgagcagatcctgaccgccctggtggtgagcagaatcggcctgctgtgggtgatgctgttcctgtggtacgccaccgtgttcaacagcgccctgtacggcctggaggtgagaatcgtggccagcaacgcctgggccgtgaccaaccacttcagcatgtggctggccgccagcctgagcatcttctgcctgctgaagatcgccaacttcagcaacctgatcagcctgcacctgaagaagagaatcaagagcgtggtgctggtgatcctgctgggccccctggtgttcctgatctgcaacctggccgtgatcaccatggacgagagagtgtggaccaaggagtacgagggcaacgtgacctggaagatcaagctgagaaacgccatccacctgagcagcctgaccgtgaccaccctggccaacctgatccccttcaccctgagcctgatctgcttcctgctgctgatctgcagcctgtgcaagcacctgaagaagatgagactgcacagcaagggcagccaggaccccagcaccaaggtgcacatcaaggccctgcagaccgtgaccagcttcctgatgctgttcgccatctacttcctgtgcatcatcaccagcacctggaacctgagaacccagcagagcaagctggtgctgctgctgtgccagaccgtggccatcatgtaccccagcttccacagcttcatcctgatcatgggcagcagaaagctgaagcagaccttcctgagcgtgctgtggcagatgaccagatag

SEQ ID NO: 101869 - DNA, 930 bp, Artificial Sequence
  Description of Artificial Sequence: Synthetic coding sequence
atgatgagcttcctgcacatcgtgttcagcatcctggtggtggtggccttcatcctgggcaacttcgccaacggcttcatcgccctgatcaacttcatcgcctgggtgaagagacagaagatcagcagcgccgaccagatcatcgccgccctggccgtgagcagagtgggcctgctgtgggtgatcctgctgcactggtacagcaccgtgctgaaccccaccagcagcaacctgaaggtgatcatcttcatcagcaacgcctgggccgtgaccaaccacttcagcatctggctggccaccagcctgagcatcttctacctgctgaagatcgtgaacttcagcagactgatcttccaccacctgaagagaaaggccaagagcgtggtgctggtgatcgtgctgggcagcctgttcttcctggtgtgccacctggtgatgaagcacacctacatcaacgtgtggaccgaggagtgcgagggcaacgtgacctggaagatcaagctgagaaacgccatgcacctgagcaacctgaccgtggccatgctggccaacctgatccccttcaccctgaccctgatcagcttcctgctgctgatctacagcctgtgcaagcacctgaagaagatgcagctgcacggcaagggcagccaggaccccagcaccaagatccacatcaaggccctgcagaccgtgaccagcttcctgatcctgctggccatctacttcctgtgcctgatcatcagcttctggaacttcaagatgagacccaaggagatcgtgctgatgctgtgccaggccttcggcatcatctaccccagcttccacagcttcatcctgatctggggcaacaagaccctgaagcagaccttcctgagcgtgctgtggcaggtgacctgctgggccaagggccagaaccagagcaccccctag

SEQ ID NO: 101870 - DNA, 951 bp, Artificial Sequence
  Description of Artificial Sequence: Synthetic coding sequence
atgatgggcctgaccgagggcgtgttcctgatcctgagcggcacccagttcaccctgggcatcctggtgaactgcttcatcgagctggtgaacggcagcagctggttcaagaccaagagaatgagcctgagcgacttcatcatcaccaccctggccctgctgagaatcatcctgctgtgcatcatcctgaccgacagcttcctgatcgagttcagccccaacacccacgacagcggcatcatcatgcagatcatcgacgtgagctggaccttcaccaaccacctgagcatctggctggccacctgcctgggcgtgctgtactgcctgaagatcgccagcttcagccaccccaccttcctgtggctgaagtggagagtgagcagagtgatggtgtggatgctgctgggcgccctgctgctgagctgcggcagcaccgccagcctgatcaacgagttcaagctgtacagcgtgttcagaggcatcgaggccaccagaaacgtgaccgagcacttcagaaagaagagaagcgagtactacctgatccacgtgctgggcaccctgtggtacctgccccccctgatcgtgagcctggccagctacagcctgctgatcttcagcctgggcagacacaccagacagatgctgcagaacggcaccagcagcagagaccccaccaccgaggcccacaagagagccatcagaatcatcctgagcttcttcttcctgttcctgctgtacttcctggccttcctgatcgccagcttcggcaacttcctgcccaagaccaagatggccaagatgatcggcgaggtgatgaccatgttctaccccgccggccacagcttcatcctgatcctgggcaacagcaagctgaagcagaccttcgtggtgatgctgagatgcgagagcggccacctgaagcccggcagcaagggccccatcttcagctag

SEQ ID NO: 101871 - DNA, 960 bp, Artificial Sequence
  Description of Artificial Sequence: Synthetic coding sequence
atgatcaccttcctgcccatcatcttcagcatcctgatcgtggtgatcttcgtgatcggcaacttcgccaacggcttcatcgccctggtgaacagcatcgagtgggtgaagagacagaagatcagcttcgtggaccagatcctgaccgccctggccgtgagcagagtgggcctgctgtgggtgctgctgctgcactggtacgccacccagctgaaccccgccttctacagcgtggaggtgagaatcaccgcctacaacgtgtgggccgtgaccaaccacttcagcagctggctggccaccagcctgagcatgttctacctgctgagaatcgccaacttcagcaacctgatcttcctgagaatcaagagaagagtgaagagcgtggtgctggtgatcctgctgggccccctgctgttcctggtgtgccacctgttcgtgatcaacatggacgagaccgtgtggaccaaggagtacgagggcaacgtgacctggaagatcaagctgagaagcgccatgtaccacagcaacatgaccctgaccatgctggccaacttcgtgcccctgaccctgaccctgatcagcttcctgctgctgatctgcagcctgtgcaagcacctgaagaagatgcagctgcacggcaagggcagccaggaccccagcaccaaggtgcacatcaaggccctgcagaccgtgaccagcttcctgctgctgtgcgccatctacttcctgagcatgatcatcagcgtgtgcaacttcggcagactggagaagcagcccgtgttcatgttctgccaggccatcatcttcagctaccccagcacccaccccttcatcctgatcctgggcaacaagaagctgaagcagatcttcctgagcgtgctgagacacgtgagatactgggtgaaggacagaagcctgagactgcacagattcaccagaggcgccctgtgcgtgttctag

SEQ ID NO: 101872 - DNA, 930 bp, Artificial Sequence
  Description of Artificial Sequence: Synthetic coding sequence
atgaccaccttcatccccatcatcttcagcagcgtggtggtggtgctgttcgtgatcggcaacttcgccaacggcttcatcgccctggtgaacagcatcgagagagtgaagagacagaagatcagcttcgccgaccagatcctgaccgccctggccgtgagcagagtgggcctgctgtgggtgctgctgctgaactggtacagcaccgtgttcaaccccgccttctacagcgtggaggtgagaaccaccgcctacaacgtgtgggccgtgaccggccacttcagcaactggctggccaccagcctgagcatcttctacctgctgaagatcgccaacttcagcaacctgatcttcctgcacctgaagagaagagtgaagagcgtgatcctggtgatgctgctgggccccctgctgttcctggcctgccagctgttcgtgatcaacatgaaggagatcgtgagaaccaaggagtacgagggcaacctgacctggaagatcaagctgagaagcgccgtgtacctgagcgacgccaccgtgaccaccctgggcaacctggtgcccttcaccctgaccctgctgtgcttcctgctgctgatctgcagcctgtgcaagcacctgaagaagatgcagctgcacggcaagggcagccaggaccccagcaccaaggtgcacatcaaggccctgcagaccgtgatcttcttcctgctgctgtgcgccgtgtacttcctgagcatcatgatcagcgtgtggagcttcggcagcctggagaacaagcccgtgttcatgttctgcaaggccatcagattcagctaccccagcatccaccccttcatcctgatctggggcaacaagaagctgaagcagaccttcctgagcgtgctgagacaggtgagatactgggtgaagggcgagaagcccagcagcccctag

SEQ ID NO: 101873 - DNA, 1002 bp, Artificial Sequence
  Description of Artificial Sequence: Synthetic coding sequence
atgctgaccctgaccagaatcagaaccgtgagctacgaggtgagaagcaccttcctgttcatcagcgtgctggagttcgccgtgggcttcctgaccaacgccttcgtgttcctggtgaacttctgggacgtggtgaagagacaggccctgagcaacagcgactgcgtgctgctgtgcctgagcatcagcagactgttcctgcacggcctgctgttcctgagcgccatccagctgacccacttccagaagctgagcgagcccctgaaccacagctaccaggccatcatcatgctgtggatgatcgccaaccaggccaacctgtggctggccgcctgcctgagcctgctgtactgcagcaagctgatcagattcagccacaccttcctgatctgcctggccagctgggtgagcagaaagatcagccagatgctgctgggcatcatcctgtgcagctgcatctgcaccgtgctgtgcgtgtggtgcttcttcagcagaccccacttcaccgtgaccaccgtgctgttcatgaacaacaacaccagactgaactggcagatcaaggacctgaacctgttctacagcttcctgttctgctacctgtggagcgtgccccccttcctgctgttcctggtgagcagcggcatgctgaccgtgagcctgggcagacacatgagaaccatgaaggtgtacaccagaaacagcagagaccccagcctggaggcccacatcaaggccctgaagagcctggtgagcttcttctgcttcttcgtgatcagcagctgcgccgccttcatcagcgtgcccctgctgatcctgtggagagacaagatcggcgtgatggtgtgcgtgggcatcatggccgcctgccccagcggccacgccgccatcctgatcagcggcaacgccaagctgagaagagccgtgatgaccatcctgctgtgggcccagagcagcctgaaggtgagagccgaccacaaggccgacagcagaaccctgtgctag

SEQ ID NO: 101874 - DNA, 900 bp, Artificial Sequence
  Description of Artificial Sequence: Synthetic coding sequence
atgctgagactgttctacttcagcgccatcatcgccagcgtgatcctgaacttcgtgggcatcatcatgaacctgttcatcaccgtggtgaactgcaagacctgggtgaagagccacagaatcagcagcagcgacagaatcctgttcagcctgggcatcaccagattcctgatgctgggcctgttcctggtgaacaccatctacttcgtgagcagcaacaccgagagaagcgtgtacctgagcgccttcttcgtgctgtgcttcatgttcctggacagcagcagcgtgtggttcgtgaccctgctgaacatcctgtactgcgtgaagatcaccaacttccagcacagcgtgttcctgctgctgaagagaaacatcagccccaagatccccagactgctgctggcctgcgtgctgatcagcgccttcaccacctgcctgtacatcaccctgagccaggccagccccttccccgagctggtgaccaccagaaacaacaccagcttcaacatcagcgagggcatcctgagcctggtggtgagcctggtgctgagcagcagcctgcagttcatcatcaacgtgaccagcgccagcctgctgatccacagcctgagaagacacatccagaagatgcagaagaacgccaccggcttctggaacccccagaccgaggcccacgtgggcgccatgaagctgatggtgtacttcctgatcctgtacatcccctacagcgtggccaccctggtgcagtacctgcccttctacgccggcatggacatgggcaccaagagcatctgcctgatcttcgccaccctgtacagccccggccacagcgtgctgatcatcatcacccaccccaagctgaagaccaccgccaagaagatcctgtgcttcaagaagtag

SEQ ID NO: 101875 - DNA, 972 bp, Artificial Sequence
  Description of Artificial Sequence: Synthetic coding sequence
atggccaccgtgaacaccgacgccaccgacaaggacatcagcaagttcaaggtgaccttcaccctggtggtgagcggcatcgagtgcatcaccggcatcctgggcagcggcttcatcaccgccatctacggcgccgagtgggccagaggcaagaccctgcccaccggcgacagaatcatgctgatgctgagcttcagcagactgctgctgcagatctggatgatgctggagaacatcttcagcctgctgttcagaatcgtgtacaaccagaacagcgtgtacatcctgttcaaggtgatcaccgtgttcctgaaccacagcaacctgtggttcgccgcctggctgaaggtgttctactgcctgagaatcgccaacttcaaccaccccctgttcttcctgatgaagagaaagatcatcgtgctgatgccctggctgctgagactgagcgtgctggtgagcctgagcttcagcttccccctgagcagagacgtgttcaacgtgtacgtgaacagcagcatccccatccccagcagcaacagcaccgagaagaagtacttcagcgagaccaacatggtgaacctggtgttcttctacaacatgggcatcttcgtgcccctgatcatgttcatcctggccgccaccctgctgatcctgagcctgaagagacacaccctgcacatgggcagcaacgccaccggcagcagagaccccagcatgaaggcccacatcggcgccatcaaggccaccagctacttcctgatcctgtacatcttcaacgccatcgccctgttcctgagcaccagcaacatcttcgacacctacagcagctggaacatcctgtgcaagatcatcatggccgcctaccccgccggccacagcgtgcagctgatcctgggcaaccccggcctgagaagagcctggaagagattccagcaccaggtgcccctgtacctgaagggccagaccctgtag

SEQ ID NO: 101876 - DNA, 924 bp, Artificial Sequence
  Description of Artificial Sequence: Synthetic coding sequence
atgcaggccgccctgaccgccttcttcgtgctgctgttcagcctgctgagcctgctgggcatcgccgccaacggcttcatcgtgctggtgctgggcagagagtggctgagatacggcagactgctgcccctggacatgatcctgatcagcctgggcgccagcagattctgcctgcagctggtgggcaccgtgcacaacttctactacagcgcccagaaggtggagtacagcggcggcctgggcagacagttcttccacctgcactggcacttcctgaacagcgccaccttctggttctgcagctggctgagcgtgctgttctgcgtgaagatcgccaacatcacccacagcaccttcctgtggctgaagtggagattccccggctgggtgccctggctgctgctgggcagcgtgctgatcagcttcatcatcaccctgctgttcttctgggtgaactaccccgtgtaccaggagttcctgatcagaaagttcagcggcaacatgacctacaagtggaacaccagaatcgagacctactacttccccagcctgaagctggtgatctggagcatccccttcagcgtgttcctggtgagcatcatgctgctgatcaacagcctgagaagacacacccagagaatgcagcacaacggccacagcctgcaggaccccagcacccaggcccacaccagagccctgaagagcctgatcagcttcctgatcctgtacgccctgagcttcctgagcctgatcatcgacgccgccaagttcatcagcatgcagaacgacttctactggccctggcagatcgccgtgtacctgtgcatcagcgtgcaccccttcatcctgatcttcagcaacctgaagctgagaagcgtgttcagccagctgctgctgctggccagaggcttctgggtggcctag

SEQ ID NO: 101877 - DNA, 945 bp, Artificial Sequence
  Description of Artificial Sequence: Synthetic coding sequence
atggccaccgagctggacaagatcttcctgatcctggccatcgccgagttcatcatcagcatgctgggcaacgtgttcatcggcctggtgaactgcagcgagggcatcaagaaccagaaggtgttcagcgccgacttcatcctgacctgcctggccatcagcaccatcggccagctgctggtgatcctgttcgacagcttcctggtgggcctggccagccacctgtacaccacctacagactgggcaagaccgtgatcatgctgtggcacatgaccaaccacctgaccacctggctggccacctgcctgagcatcttctacttcttcaagatcgcccacttcccccacagcctgttcctgtggctgagatggagaatgaacggcatgatcgtgatgctgctgatcctgagcctgttcctgctgatcttcgacagcctggtgctggagatcttcatcgacatcagcctgaacatcatcgacaagagcaacctgaccctgtacctggacgagagcaagaccctgtacgacaagctgagcatcctgaagaccctgctgagcctgaccagcttcatccccttcagcctgttcctgaccagcctgctgttcctgttcctgagcctggtgagacacaccagaaacctgaagctgagcagcctgggcagcagagacagcagcaccgaggcccacagaagagccatgaagatggtgatgagcttcctgttcctgttcatcgtgcacttcttcagcctgcaggtggccaacggcatcttcttcatgctgtggaacaacaagtacatcaagttcgtgatgctggccctgaacgccttccccagctgccacagcttcatcctgatcctgggcaacagcaagctgagacagaccgccgtgagactgctgtggcacctgagaaactacaccaagacccccaacgccctgcccctgtag

SEQ ID NO: 101878 - DNA, 930 bp, Artificial Sequence
  Description of Artificial Sequence: Synthetic coding sequence
atgatcaccttcctgcccatcatcttcagcagcctggtggtggtgaccttcgtgatcggcaacttcgccaacggcttcatcgccctggtgaacagcatcgagtggttcaagagacagaagatcagcttcgccgaccagatcctgaccgccctggccgtgagcagagtgggcctgctgtgggtgctgctgctgaactggtacagcaccgtgctgaaccccgccttcaacagcgtggaggtgagaaccaccgcctacaacatctgggccgtgatcaaccacttcagcaactggctggccaccaccctgagcatcttctacctgctgaagatcgccaacttcagcaacttcatcttcctgcacctgaagagaagagtgaagagcgtgatcctggtgatgctgctgggccccctgctgttcctggcctgccacctgttcgtgatcaacatgaacgagatcgtgagaaccaaggagttcgagggcaacatgacctggaagatcaagctgaagagcgccatgtacttcagcaacatgaccgtgaccatggtggccaacctggtgcccttcaccctgaccctgctgagcttcatgctgctgatctgcagcctgtgcaagcacctgaagaagatgcagctgcacggcaagggcagccaggaccccagcaccaaggtgcacatcaaggccctgcagaccgtgatcagcttcctgctgctgtgcgccatctacttcctgagcatcatgatcagcgtgtggagcttcggcagcctggagaacaagcccgtgttcatgttctgcaaggccatcagattcagctaccccagcatccaccccttcatcctgatctggggcaacaagaagctgaagcagaccttcctgagcgtgttctggcagatgagatactgggtgaagggcgagaagaccagcagcccctag

SEQ ID NO: 101879 - DNA, 930 bp, Artificial Sequence
  Description of Artificial Sequence: Synthetic coding sequence
atgatcaccttcctgcccatcatcttcagcatcctgatcgtggtgaccttcgtgatcggcaacttcgccaacggcttcatcgccctggtgaacagcatcgagtggttcaagagacagaagatcagcttcgccgaccagatcctgaccgccctggccgtgagcagagtgggcctgctgtgggtgctggtgctgaactggtacgccaccgagctgaaccccgccttcaacagcatcgaggtgagaatcaccgcctacaacgtgtgggccgtgatcaaccacttcagcaactggctggccaccagcctgagcatcttctacctgctgaagatcgccaacttcagcaacctgatcttcctgcacctgaagagaagagtgaagagcgtggtgctggtgatcctgctgggccccctgctgttcctggtgtgccacctgttcgtgatcaacatgaaccagatcatctggaccaaggagtacgagggcaacatgacctggaagatcaagctgagaagcgccatgtacctgagcaacaccaccgtgaccatcctggccaacctggtgcccttcaccctgaccctgatcagcttcctgctgctgatctgcagcctgtgcaagcacctgaagaagatgcagctgcacggcaagggcagccaggaccccagcatgaaggtgcacatcaaggccctgcagaccgtgaccagcttcctgctgctgtgcgccatctacttcctgagcatcatcatgagcgtgtggagcttcgagagcctggagaacaagcccgtgttcatgttctgcgaggccatcgccttcagctaccccagcacccaccccttcatcctgatctggggcaacaagaagctgaagcagaccttcctgagcgtgctgtggcacgtgagatactgggtgaagggcgagaagcccagcagcagctag

SEQ ID NO: 101880 - DNA, 900 bp, Artificial Sequence
  Description of Artificial Sequence: Synthetic coding sequence
atgctgagcgccggcctgggcctgctgatgctggtggccgtggtggagttcctgatcggcctgatcggcaacggcagcctggtggtgtggagcttcagagagtggatcagaaagttcaactggagcagctacaacctgatcatcctgggcctggccggctgcagattcctgctgcagtggctgatcatcctggacctgagcctgttccccctgttccagagcagcagatggctgagatacctgagcatcttctgggtgctggtgagccaggccagcctgtggttcgccaccttcctgagcgtgttctactgcaagaagatcaccaccttcgacagacccgcctacctgtggctgaagcagagagcctacaacctgagcctgtggtgcctgctgggctacttcatcatcaacctgctgctgaccgtgcagatcggcctgaccttctaccaccccccccagggcaacagcagcatcagataccccttcgagagctggcagtacctgtacgccttccagctgaacagcggcagctacctgcccctggtggtgttcctggtgagcagcggcatgctgatcgtgagcctgtacacccaccacaagaagatgaaggtgcacagcgccggcagaagagacgtgagagccaaggcccacatcaccgccctgaagagcctgggctgcttcctgctgctgcacctggtgtacatcatggccagccccttcagcatcaccagcaagacctacccccccgacctgaccagcgtgttcatctgggagaccctgatggccgcctaccccagcctgcacagcctgatcctgatcatgggcatccccagagtgaagcagacctgccagaagatcctgtggaagaccgtgtgcgccagaagatgctggggcccctag

SEQ ID NO: 101881 - DNA, 900 bp, Artificial Sequence
  Description of Artificial Sequence: Synthetic coding sequence
atgatcaccttcctgtacatcttcttcagcatcctgatcatggtgctgttcgtgctgggcaacttcgccaacggcttcatcgccctggtgaacttcatcgactgggtgaagagaaagaagatcagcagcgccgaccagatcctgaccgccctggccgtgagcagaatcggcctgctgtgggccctgctgctgaactggtacctgaccgtgctgaaccccgccttctacagcgtggagctgagaatcaccagctacaacgcctgggtggtgaccaaccacttcagcatgtggctggccgccaacctgagcatcttctacctgctgaagatcgccaacttcagcaacctgctgttcctgcacctgaagagaagagtgagaagcgtgatcctggtgatcctgctgggcaccctgatcttcctggtgtgccacctgctggtggccaacatggacgagagcatgtgggccgaggagtacgagggcaacatgaccggcaagatgaagctgagaaacaccgtgcacctgagctacctgaccgtgaccaccctgtggagcttcatccccttcaccctgagcctgatcagcttcctgatgctgatctgcagcctgtgcaagcacctgaagaagatgcagctgcacggcgagggcagccaggacctgagcaccaaggtgcacatcaaggccctgcagaccctgatcagcttcctgctgctgtgcgccatcttcttcctgttcctgatcgtgagcgtgtggagccccagaagactgagaaacgaccccgtggtgatggtgagcaaggccgtgggcaacatctacctggccttcgacagcttcatcctgatctggagaaccaagaagctgaagcacaccttcctgctgatcctgtgccagatcagatgctag

SEQ ID NO: 101882 - DNA, 957 bp, Artificial Sequence
  Description of Artificial Sequence: Synthetic coding sequence
atgaacggcgaccacatggtgctgggcagcagcgtgaccgacaagaaggccatcatcctggtgaccatcctgctgctgctgagactggtggccatcgccggcaacggcttcatcaccgccgccctgggcgtggagtgggtgctgagaagaatgctgctgccctgcgacaagctgctggtgagcctgggcgccagcagattctgcctgcagagcgtggtgatgggcaagaccatctacgtgttcctgcaccccatggccttcccctacaaccccgtgctgcagttcctggccttccagtgggacttcctgaacgccgccaccctgtggagcagcacctggctgagcgtgttctactgcgtgaagatcgccaccttcacccaccccgtgttcttctggctgaagcacaagctgagcggctggctgccctggatgctgttcagcagcgtgggcctgagcagcttcaccaccatcctgttcttcatcggcaaccacagaatgtaccagaactacctgagaaaccacctgcagccctggaacgtgaccggcgacagcatcagaagctactgcgagaagttctacctgttccccctgaagatgatcacctggaccatgcccaccgccgtgttcttcatctgcatgatcctgctgatcaccagcctgggcagacacagaaagaaggccctgctgaccaccagcggcttcagagagcccagcgtgcaggcccacatcaaggccctgctggccctgctgagcttcgccatgctgttcatcagctacttcctgagcctggtgttcagcgccgccggcatcttcccccccctggacttcaagttctgggtgtgggagagcgtgatctacctgtgcgccgccgtgcaccccatcatcctgctgttcagcaactgcagactgagagccgtgctgaagagcagaagaagcagcagatgcggcaccccctag

SEQ ID NO: 101883 - DNA, 1314 bp, Artificial Sequence
  Description of Artificial Sequence: Synthetic coding sequence
atgcccaagttcaaggccgccagaggcgtgggcggccaggagaagcacgcccccctggccgaccagatcctggccggcaacgccgtgagagccggcgtgagagagaagagaagaggcagaggcaccggcgaggccgaggaggagtacgtgggccccagactgagcagaagaatcctgcagcaggccagacagcagcaggaggagctggaggccgagcacggcaccggcgacaagcccgccgcccccagagagagaaccaccagactgggccccagaatgccccaggacggcagcgacgacgaggacgaggagtggcccaccctggagaaggccgccaccatgaccgccgccggccaccacgccgaggtggtggtggaccccgaggacgagagagccatcgagatgttcatgaacaagaacccccccgccagaagaaccctggccgacatcatcatggagaagctgaccgagaagcagaccgaggtggagaccgtgatgagcgaggtgagcggcttccccatgccccagctggaccccagagtgctggaggtgtacagaggcgtgagagaggtgctgagcaagtacagaagcggcaagctgcccaaggccttcaagatcatccccgccctgagcaactgggagcagatcctgtacgtgaccgagcccgaggcctggaccgccgccgccatgtaccaggccaccagaatcttcgccagcaacctgaaggagagaatggcccagagattctacaacctggtgctgctgcccagagtgagagacgacgtggccgagtacaagagactgaacttccacctgtacatggccctgaagaaggccctgttcaagcccggcgcctggttcaagggcatcctgatccccctgtgcgagagcggcacctgcaccctgagagaggccatcatcgtgggcagcatcatcaccaagtgcagcatccccgtgctgcacagcagcgccgccatgctgaagatcgccgagatggagtacagcggcgccaacagcatcttcctgagactgctgctggacaagaagtacgccctgccctacagagtgctggacgccctggtgttccacttcctgggcttcagaaccgagaagagagagctgcccgtgctgtggcaccagtgcctgctgaccctggtgcagagatacaaggccgacctggccaccgaccagaaggaggccctgctggagctgctgagactgcagccccacccccagctgagccccgagatcagaagagagctgcagagcgccgtgcccagagacgtggaggacgtgcccatcaccgtggagtag

SEQ ID NO: 101884 - DNA, 951 bp, Artificial Sequence
  Description of Artificial Sequence: Synthetic coding sequence
atggaccagaacaacagcctgcccccctacgcccagggcctggccagcccccagggcgccatgacccccggcatccccatcttcagccccatgatgccctacggcaccggcctgaccccccagcccatccagaacaccaacagcctgagcatcctggaggagcagcagagacagcagcagcagcagcagcagcagcagcagcagcagcagcagcaggccgtggccgccgccgccgtgcagcagagcaccagccagcaggccacccagggcaccagcggccaggccccccagctgttccacagccagaccctgaccaccgcccccctgcccggcaccacccccctgtaccccagccccatgacccccatgacccccatcacccccgccacccccgccagcgagagcagcggcatcgtgccccagctgcagaacatcgtgagcaccgtgaacctgggctgcaagctggacctgaagaccatcgccctgagagccagaaacgccgagtacaaccccaagagattcgccgccgtgatcatgagaatcagagagcccagaaccaccgccctgatcttcagcagcggcaagatggtgtgcaccggcgccaagagcgaggagcagagcagactggccgccagaaagtacgccagagtggtgcagaagctgggcttccccgccaagttcctggacttcaagatccagaacatggtgggcagctgcgacgtgaagttccccatcagactggagggcctggtgctgacccaccagcagttcagcagctacgagcccgagctgttccccggcctgatctacagaatgatcaagcccagaatcgtgctgctgatcttcgtgagcggcaaggtggtgctgaccggcgccaaggtgagagccgagatctacgaggccttcgagaacatctaccccatcctgaagggcttcagaaagaccacctag

SEQ ID NO: 101885 - DNA, 1020 bp, Artificial Sequence; identical to SEQ ID NO: 84001
  Description of Artificial Sequence: Synthetic coding sequence

SEQ ID NO: 101886 - DNA, 627 bp, Artificial Sequence
  Description of Artificial Sequence: Synthetic coding sequence
atggaccagaacaacagcctgcccccctacgcccagggcctggccagcccccagggcgccatgacccccggcatccccatcttcagccccatgatgccctacggcaccggcctgaccccccagcccatccagaacaccaacagcctgagcatcctggaggagcagcagagacagcagcagcagcagcagcagcagcagcagcagcagcagcagcagcagcagcagcagcagcagcagcagcagcagcagcagcagcagcagcagcagcagcagcagcagcagcaggccgtggccgccgccgccgtgcagcagagcaccagccagcaggccacccagggcaccagcggccaggccccccagctgttccacagccagaccctgaccaccgcccccctgcccggcaccacccccctgtaccccagccccatgacccccatgacccccatcacccccgccacccccgccagcgagagcagcggcatcgtgccccagctgcagaacatcgtgagcaccgtgaacctgggctgcaagctggacctgaagaccatcgccctgagagccagaaacgccgagtacaaccccaagagattcgccgccgtgatcatgagaatcagagagcccagatag

SEQ ID NO: 101887 - DNA, 456 bp, Artificial Sequence
  Description of Artificial Sequence: Synthetic coding sequence
atggaccagaacaacagcctgcccccctacgcccagggcctggccagcccccagggcgccatgacccccggcatccccatcttcagccccatgatgccctacggcaccggcctgaccccccagcccatccagaacaccaacagcctgagcatcctggaggagcagcagagacagcagcagcagcagcagcagcagcagcagcagcagcagcagcagcagcagcagcagcagcagcagcagcagcagcagcagcagcagcagcagcagcagcagcagcagcagcaggccgtggccgccgccgccgtgcagcagagcaccagccagcaggccacccagggcaccagcggccaggccccccagctgttccacagccagaccctgaccaccgcccccctgcccggcaccacccccctgtaccccagccccatgacccccatgacccccatcaccccctag

SEQ ID NO: 101888 - DNA, 306 bp, Artificial Sequence
  Description of Artificial Sequence: Synthetic coding sequence
tgagaggagcagagcagactggccgccagaaagtacgccagagtggtgcagaagctgggcttccccgccaagttcctggacttcaagatccagaacatggtgggcagctgcgacgtgaagttccccatcagctacgagcccgagctgttccccggcctgatctacagaatgatcaagcccagaatcgtgctgctgatcttcgtgagcggcaaggtggtgctgaccggcgccaaggtgagagccgagatctacgaggccttcgagaacatctaccccatcctgaagggcttcagaaagaccacctag

SEQ ID NO: 101889 - DNA, 960 bp, Artificial Sequence
  Description of Artificial Sequence: Synthetic coding sequence
atgacccccggcatccccatcttcagccccatgatgccctacggcaccggcctgaccccccagcccatccagaacaccaacagcctgagcatcctggaggagcagcagagacagcagcagcagcagcagcagcagcagcagcagcagcagcagcagcagcagcagcagcagcagcagcagcagcagcagcagcagcagcagcagcagcagcagcagcagcagcaggccgtggccgccgccgccgtgcagcagagcaccagccagcaggccacccagggcaccagcggccaggccccccagctgttccacagccagaccctgaccaccgcccccctgcccggcaccacccccctgtaccccagccccatgacccccatgacccccatcacccccgccacccccgccagcgagagcagcggcatcgtgccccagctgcagaacatcgtgagcaccgtgaacctgggctgcaagctggacctgaagaccatcgccctgagagccagaaacgccgagtacaaccccaagagattcgccgccgtgatcatgagaatcagagagcccagaaccaccgccctgatcttcagcagcggcaagatggtgtgcaccggcgccaagagcgaggagcagagcagactggccgccagaaagtacgccagagtggtgcagaagctgggcttccccgccaagttcctggacttcaagatccagaacatggtgggcagctgcgacgtgaagttccccatcagactggagggcctggtgctgacccaccagcagttcagcagctacgagcccgagctgttccccggcctgatctacagaatgatcaagcccagaatcgtgctgctgatcttcgtgagcggcaaggtggtgctgaccggcgccaaggtgagagccgagatctacgaggccttcgagaacatctaccccatcctgaagggcttcagaaagaccacctag

SEQ ID NO: 101890 - DNA, 2610 bp, Artificial Sequence
  Description of Artificial Sequence: Synthetic coding sequence
atggacttccccagcagcctgagacccgccctgttcctgaccggccccctgggcctgagcgacgtgcccgacctgagcttcatgtgcagctggagagacgccctgaccctgcccgaggcccagccccagaacagcgagaacggcgccctgcacgtgaccaaggacctgctgtgggagcccgccacccccggccccctgcccatgctgccccccctgatcgacccctgggaccccggcctgaccgccagagacctgctgttcagaggcggctgcagatacagaaagagacccagagtggtgctggacgtgaccgagcagatcagcagattcctgctggaccacggcgacgtggccttcgcccccctgggcaagctgatgctggagaacttcaagctggagggcgccggcagcagaaccaagaagaagaccgtggtgagcgtgaagaagctgctgcaggacctgggcggccaccagccctggggctgcccctgggcctacctgagcaacagacagagaagattcagcatcctgggcggccccatcctgggcaccagcgtggccagccacctggccgagctgctgcacgaggagctggtgctgagatgggagcagctgctgctggacgaggcctgcaccggcggcgccctggcctgggtgcccggcagaaccccccagttcggccagctggtgtaccccgccggcggcgcccaggacagactgcacttccaggaggtggtgctgacccccggcgacaacccccagttcctgggcaagcccggcagaatccagctgcagggccccgtgagacaggtggtgacctgcaccgtgcagggcgagagcaaggccctgatctacaccttcctgccccactggctgacctgctacctgacccccggccccttccaccccagcagcgccctgctggccgtgagaagcgactaccactgcgccgtgtggaagttcggcaagcagtggcagcccaccctgctgcaggccatgcaggtggagaagggcgccaccggcatcagcctgagcccccacctgcccggcgagctggccatctgcagcagaagcggcgccgtgtgcctgtggagccccgaggacggcctgagacagatctacagagaccccgagaccctggtgttcagagacagcagcagctggagatgggccgacttcaccgcccaccccagagtgctgaccgtgggcgacagaaccggcgtgaagatgctggacacccagggcccccccggctgcggcctgctgctgttcagactgggcgccgaggccagctgccagaagggcgagagagtgctgctgacccagtacctgggccacagcagccccaagtgcctgccccccaccctgcacctggtgtgcacccagttcagcctgtacctggtggacgagagactgcccctggtgcccatgctgaagtggaaccacggcctgcccagccccctgctgctggccagactgctgcccccccccagacccagctgcgtgcagcccctgctgctgggcggccagggcggccagctgcagctgctgcacctggccggcgagggcgccagcgtgcccagactggccggccccccccagagcctgcccagcagaatcgacagcctgcccgccttccccctgctggagcccaagatccagtggagactgcaggagagactgaaggcccccaccatcggcctggccgccgtggtgccccccctgcccagcgcccccacccccggcctggtgctgttccagctgagcgccgccggcgacgtgttctaccagcagctgagaccccaggtggacagcagcctgagaagagacgccggcccccccggcgacacccagcccgactgccacgcccccaccgccagctggaccagccaggacaccgccggctgcagccagtggctgaaggccctgctgaaggtgcccctggccccccccgtgtggaccgcccccaccttcacccacagacagatgctgggcagcaccgagctgagaagagaggaggaggagggccagagactgggcgtgctgagaaaggccatggccagaggccagctgctgctgcagagagacctgggcagcctgcccgccgccgagcccccccccgcccccgagagcggcctggaggacaagctgagcgagagactgggcgaggcctgggccggcagaggcgccgcctggtgggagagacagcagggcagaaccagcgagcccggcagacagaccagaagacccaagagaagaacccagctgagcagcagcttcagcctgagcggccacgtggaccccagcgaggacaccagcagcccccacagccccgagtggccccccgccgacgccctgcccctgccccccaccaccccccccagccaggagctgacccccgacgcctgcgcccagggcgtgcccagcgagcagagacagatgctgagagactacatggccaagctgcccccccagagagacacccccggctgcgccaccacccccccccacagccaggccagcagcgtgagagccaccagaagccagcagcacacccccgtgctgagcagcagccagcccctgagaaagaagcccagaatgggcttctag

SEQ ID NO: 101891 - DNA, 1353 bp, Artificial Sequence
  Description of Artificial Sequence: Synthetic coding sequence
atgagcgacttcagcgaggagctgaagggccccgtgaccgacgacgaggaggtggagaccagcgtgctgagcggcgccggcatgcacttcccctggctgcagacctacgtggagaccgtggccatcggcggcaagagaagaaaggacttcgcccagaccaccagcgcctgcctgagcttcatccaggaggccctgctgaagcaccagtggcagcaggccgccgagtacatgtacagctacttccagaccctggaggacagcgacagctacaagagacaggccgcccccgagatcatctggaagctgggcagcgagatcctgttctaccaccccaagagcaacatggagagcttcaacaccttcgccaacagaatgaagaacatcggcgtgatgaactacctgaagatcagcctgcagcacgccctgtacctgctgcaccacggcatgctgaaggacgccaagagaaacctgagcgaggccgagacctggagacacggcgagaacaccagcagcagagagatcctgatcaacctgatccaggcctacaagggcctgctgcagtactacacctggagcgagaagaagatggagctgagcaagctggacaaggacgactacgcctacaacgccgtggcccaggacgtgttcaaccacagctggaagaccagcgccaacatcagcgccctgatcaagatccccggcgtgtgggaccccttcgtgaagagctacgtggagatgctggagttctacggcgacagagacggcgcccaggaggtgctgaccaactacgcctacgacgagaagttccccagcaaccccaacgcccacatctacctgtacaacttcctgaagagacagaaggcccccagaagcaagctgatcagcgtgctgaagatcctgtaccagatcgtgcccagccacaagctgatgctggagttccacaccctgctgagaaagagcgagaaggaggagcacagaaagctgggcctggaggtgctgttcggcgtgctggacttcgccggctgcaccaagaacatcaccgcctggaagtacctggccaagtacctgaagaacatcctgatgggcaaccacctggcctgggtgcaggaggagtggaacagcagaaagaactggtggcccggcttccacttcagctacttctgggccaagagcgactggaaggaggacaccgccctggcctgcgagaaggccttcgtggccggcctgctgctgggcaagggctgcagatacttcagatacatcctgaagcaggaccaccagatcctgggcaagaagatcaagagaatgaagagaagcgtgaagaagtacagcatcgtgaaccccagactgtag

SEQ ID NO: 101892 - DNA, 1353 bp, Artificial Sequence; identical to SEQ ID NO: 101891
  Description of Artificial Sequence: Synthetic coding sequence

SEQ ID NO: 101893 - DNA, 1011 bp, Artificial Sequence
  Description of Artificial Sequence: Synthetic coding sequence
atggagagcttcaacaccttcgccaacagaatgaagaacatcggcgtgatgaactacctgaagatcagcctgcagcacgccctgtacctgctgcaccacggcatgctgaaggacgccaagagaaacctgagcgaggccgagacctggagacacggcgagaacaccagcagcagagagatcctgatcaacctgatccaggcctacaagggcctgctgcagtactacacctggagcgagaagaagatggagctgagcaagctggacaaggacgactacgcctacaacgccgtggcccaggacgtgttcaaccacagctggaagaccagcgccaacatcagcgccctgatcaagatccccggcgtgtgggaccccttcgtgaagagctacgtggagatgctggagttctacggcgacagagacggcgcccaggaggtgctgaccaactacgcctacgacgagaagttccccagcaaccccaacgcccacatctacctgtacaacttcctgaagagacagaaggcccccagaagcaagctgatcagcgtgctgaagatcctgtaccagatcgtgcccagccacaagctgatgctggagttccacaccctgctgagaaagagcgagaaggaggagcacagaaagctgggcctggaggtgctgttcggcgtgctggacttcgccggctgcaccaagaacatcaccgcctggaagtacctggccaagtacctgaagaacatcctgatgggcaaccacctggcctgggtgcaggaggagtggaacagcagaaagaactggtggcccggcttccacttcagctacttctgggccaagagcgactggaaggaggacaccgccctggcctgcgagaaggccttcgtggccggcctgctgctgggcaagggctgcagatacttcagatacatcctgaagcaggaccaccagatcctgggcaagaagatcaagagaatgaagagaagcgtgaagaagtacagcatcgtgaaccccagactgtag

SEQ ID NO: 101894 - DNA, 1011 bp, Artificial Sequence; identical to SEQ ID NO: 101893
  Description of Artificial Sequence: Synthetic coding sequence

SEQ ID NO: 101895 - DNA, 861 bp, Artificial Sequence
  Description of Artificial Sequence: Synthetic coding sequence
atgagcgacttcagcgaggagctgaagggccccgtgaccgacgacgaggaggtggagaccagcgtgctgagcggcgccggcatgcacttcccctggctgcagacctacgtggagaccgtggccatcggcggcaagagaagaaaggacttcgcccagaccaccagcgcctgcctgagcttcatccaggaggccctgctgaagcaccagtggcagcaggccgccgagtacatgtacagctacttccagaccctggaggacagcgacagctacaagagacaggccgcccccgagatcagcctgcagcacgccctgtacctgctgcaccacggcatgctgaaggacgccaagagaaacctgagcgaggccgagacctggagacacggcgagaacaccagcagcagagagatcctgatcaacctgatccaggcctacaagggcctgctgcagtactacacctggagcgagaagaagatggagctgagcaagctggacaaggacgactacgcctacaacgccgtggcccaggacgtgttcaaccacagctggaagaccagcgccaacatcagcgccctgatcaagatccccggcgtgtgggaccccttcgtgaagagctacgtggagatgctggagttctacggcgacagagacggcgcccaggaggtgctgaccaactacgcctacgacgagaagttccccagcaaccccaacgcccacatctacctgtacaacttcctgaagagacagaaggcccccagaagcaagctgatcagcgtgctgaagatcctgtaccagatcgtgcccagccacaagctgatgctggagttccacaccctgctgagaaagagcgagaaggaggagtag

SEQ ID NO: 101896 - DNA, 849 bp, Artificial Sequence
  Description of Artificial Sequence: Synthetic coding sequence
atgagcgacttcagcgaggagctgaagggccccgtgaccgacgacgaggaggtggagaccagcgtgctgagcggcgccggcatgcacttcccctggctgcagacctacgtggagaccgtggccatcggcggcaagagaagaaaggacttcgcccagaccaccagcgcctgcctgagcttcatccaggaggccctgctgaagcaccagtggcagcaggccgccgagtacatgtacagctacttccagaccctggaggacagcgacagctacaagagacaggccgcccccgagatcagcctgcagcacgccctgtacctgctgcaccacggcatgctgaaggacgccaagagaaacctgagcgaggccgagacctggagacacggcgagaacaccagcagcagagagatcctgatcaacctgatccaggcctacaagggcctgctgcagtactacacctggagcgagaagaagatggagctgagcaagctggacaaggacgactacgcctacaacgccgtggcccaggacgtgttcaaccacagctggaagaccagcgccaacatcagcgccctgatcaagatccccggcgtgtgggaccccttcgtgaagagctacgtggagatgctggagttctacggcgacagagacggcgcccaggaggtgctgaccaactacgcctacgacgagaagttccccagcaaccccaacgcccacatctacctgtacaacttcctgaagagacagaaggcccccagaagcaagctgatcagcgtgctgaagatcctgtaccagatcgtgcccagccacaagctgatgctggagttccacaccctgctgagaaagagctag

SEQ ID NO: 101897 - DNA, 936 bp, Artificial Sequence
  Description of Artificial Sequence: Synthetic coding sequence
atgagcgacttcagcgaggagctgaagggccccgtgaccgacgacgaggaggtggagaccagcgtgctgagcggcgccggcatgcacttcccctggctgcagacctacgtggagaccgtggccatcggcggcaagagaagaaaggacttcgcccagaccaccagcgcctgcctgagcttcatccaggaggccctgctgaagcaccagtggcagcaggccgccgagtacatgtacagctacttccagaccctggaggacagcgacagctacaagagacaggccgcccccgagatcatctggaagctgggcagcgagatcctgttctaccaccccaagagcaacatggagagcttcaacaccttcgccaacagaatgaagaacatcggcgtgatgaactacctgaagatcagcctgcagcacgccctgtacctgctgcaccacggcatgctgaaggacgccaagagaaacctgagcgaggccgagacctggagacacggcgagaacaccagcagcagagagatcctgatcaacctgatccaggcctacaagggcctgctgcagtactacacctggagcgagaagaagatggagctgagcaagctggacaaggacgactacgcctacaacgccgtggcccaggacgtgttcaaccacagctggaagaccagcgccaacatcagcgccctgatcaagatccccggcgtgtgggaccccttcgtgaagagctacgtggagatgctggagttctacggcgacagagacggcgcccaggaggtgctgaccaactacgcctacgacgagaagttccccagcaaccccaacgcccacatctacctgtacaacttcctgaagagacagaaggcccccagaagcaagctgatcagcgtgctgaagcacctgcagaagatcagcatcatgtacagcaccctgagatag

SEQ ID NO: 101898 - DNA, 2328 bp, Artificial Sequence
  Description of Artificial Sequence: Synthetic coding sequence
atgctgccccccctgatcgacccctgggaccccggcctgaccgccagagacctgctgttcagaggcggctgcagatacagaaagagacccagagtggtgctggacgtgaccgagcagatcagcagattcctgctggaccacggcgacgtggccttcgcccccctgggcaagctgatgctggagaacttcaagctggagggcgccggcagcagaaccaagaagaagaccgtggtgagcgtgaagaagctgctgcaggacctgggcggccaccagccctggggctgcccctgggcctacctgagcaacagacagagaagattcagcatcctgggcggccccatcctgggcaccagcgtggccagccacctggccgagctgctgcacgaggagctggtgctgagatgggagcagctgctgctggacgaggcctgcaccggcggcgccctggcctgggtgcccggcagaaccccccagttcggccagctggtgtaccccgccggcggcgcccaggacagactgcacttccaggaggtggtgctgacccccggcgacaacccccagttcctgggcaagcccggcagaatccagctgcagggccccgtgagacaggtggtgacctgcaccgtgcagggcgagaccctgctggccgtgagaagcgactaccactgcgccgtgtggaagttcggcaagcagtggcagcccaccctgctgcaggccatgcaggtggagaagggcgccaccggcatcagcctgagcccccacctgcccggcgagctggccatctgcagcagaagcggcgccgtgtgcctgtggagccccgaggacggcctgagacagatctacagagaccccgagaccctggtgttcagagacagcagcagctggagatgggccgacttcaccgcccaccccagagtgctgaccgtgggcgacagaaccggcgtgaagatgctggacacccagggcccccccggctgcggcctgctgctgttcagactgggcgccgaggccagctgccagaagggcgagagagtgctgctgacccagtacctgggccacagcagccccaagtgcctgccccccaccctgcacctggtgtgcacccagttcagcctgtacctggtggacgagagactgcccctggtgcccatgctgaagtggaaccacggcctgcccagccccctgctgctggccagactgctgcccccccccagacccagctgcgtgcagcccctgctgctgggcggccagggcggccagctgcagctgctgcacctggccgagggcgccagcgtgcccagactggccggccccccccagagcctgcccagcagaatcgacagcctgcccgccttccccctgctggagcccaagatccagtggagactgcaggagagactgaaggcccccaccatcggcctggccgccgtggtgccccccctgcccagcgcccccacccccggcctggtgctgttccagctgagcgccgccggcgacgtgttctaccagcagctgagaccccaggtggacagcagcctgagaagagacgccggcccccccggcgacacccagcccgactgccacgcccccaccgccagctggaccagccaggacaccgccggctgcagccagtggctgaaggccctgctgaaggtgcccctggccccccccgtgtggaccgcccccaccttcacccacagacagatgctgggcagcaccgagctgagaagagaggaggaggagggccagagactgggcgtgctgagaaaggccatggccagaggccagctgctgctgcagagagacctgggcagcctgcccgccgccgagcccccccccgcccccgagagcggcctggaggacaagctgagcgagagactgggcgaggcctgggccggcagaggcgccgcctggtgggagagacagcagggcagaaccagcgagcccggcagacagaccagaagacccaagagaagaacccagctgagcagcagcttcagcctgagcggccacgtggaccccagcgaggacaccagcagcccccacagccccgagtggccccccgccgacgccctgcccctgccccccaccaccccccccagccaggagctgacccccgacgcctgcgcccagggcgtgcccagcgagcagagacagatgctgagagactacatggccaagctgcccccccagagagacacccccggctgcgccaccacccccccccacagccaggccagcagcgtgagagccaccagaagccagcagcacacccccgtgctgagcagcagccagcccctgagaaagaagcccagaatgggcttctag

SEQ ID NO: 101899 - DNA, 2610 bp, Artificial Sequence; identical to SEQ ID NO: 101890
  Description of Artificial Sequence: Synthetic coding sequence

SEQ ID NO: 101900 - DNA, 1047 bp, Artificial Sequence
  Description of Artificial Sequence: Synthetic coding sequence
atggacttccccagcagcctgagacccgccctgttcctgaccggccccctgggcctgagcgacgtgcccgacctgagcttcatgtgcagctggagagacgccctgaccctgcccgaggcccagccccagaacagcgagaacggcgccctgcacgtgaccaaggacctgctgtgggagcccgccacccccggccccctgcccatgctgccccccctgatcgacccctgggaccccggcctgaccgccagagacctgctgttcagaggcggctgcagatacagaaagagacccagagtggtgctggacgtgaccgagcagatcagcagattcctgctggaccacggcgacgtggccttcgcccccctgggcaagctgatgctggagaacttcaagctggagggcgccggcagcagaaccaagaagaagaccgtggtgagcgtgaagaagctgctgcaggacctgggcggccaccagccctggggctgcccctgggcctacctgagcaacagacagagaagattcagcatcctgggcggccccatcctgggcaccagcgtggccagccacctggccgagctgctgcacgaggagctggtgctgagatgggagcagctgctgctggacgaggcctgcaccggcggcgccctggcctgggtgcccggcagaaccccccagttcggccagctggtgtaccccgccggcggcgcccaggacagactgcacttccaggaggtggtgctgacccccggcgacaacccccagttcctgggcaagcccggcagaatccagctgcagggccccgtgagacaggtggtgacctgcaccgtgcagggcgagaccctgctggccgtgagaagcgactaccactgcgccgtgtggaagttcggcaagcagtggcagcccaccctgctgcaggccatgcaggtggagaagggcgccaccggcatcagcctgagcccccacctgcccggcgagctggccatctgcagcagaagcggcgccgtgtgcctgtggagccccgaggacggctacagaagattcctgtag

SEQ ID NO: 101901 - DNA, 2331 bp, Artificial Sequence
  Description of Artificial Sequence: Synthetic coding sequence
atgctgccccccctgatcgacccctgggaccccggcctgaccgccagagacctgctgttcagaggcggctgcagatacagaaagagacccagagtggtgctggacgtgaccgagcagatcagcagattcctgctggaccacggcgacgtggccttcgcccccctgggcaagctgatgctggagaacttcaagctggagggcgccggcagcagaaccaagaagaagaccgtggtgagcgtgaagaagctgctgcaggacctgggcggccaccagccctggggctgcccctgggcctacctgagcaacagacagagaagattcagcatcctgggcggccccatcctgggcaccagcgtggccagccacctggccgagctgctgcacgaggagctggtgctgagatgggagcagctgctgctggacgaggcctgcaccggcggcgccctggcctgggtgcccggcagaaccccccagttcggccagctggtgtaccccgccggcggcgcccaggacagactgcacttccaggaggtggtgctgacccccggcgacaacccccagttcctgggcaagcccggcagaatccagctgcagggccccgtgagacaggtggtgacctgcaccgtgcagggcgagaccctgctggccgtgagaagcgactaccactgcgccgtgtggaagttcggcaagcagtggcagcccaccctgctgcaggccatgcaggtggagaagggcgccaccggcatcagcctgagcccccacctgcccggcgagctggccatctgcagcagaagcggcgccgtgtgcctgtggagccccgaggacggcctgagacagatctacagagaccccgagaccctggtgttcagagacagcagcagctggagatgggccgacttcaccgcccaccccagagtgctgaccgtgggcgacagaaccggcgtgaagatgctggacacccagggcccccccggctgcggcctgctgctgttcagactgggcgccgaggccagctgccagaagggcgagagagtgctgctgacccagtacctgggccacagcagccccaagtgcctgccccccaccctgcacctggtgtgcacccagttcagcctgtacctggtggacgagagactgcccctggtgcccatgctgaagtggaaccacggcctgcccagccccctgctgctggccagactgctgcccccccccagacccagctgcgtgcagcccctgctgctgggcggccagggcggccagctgcagctgctgcacctggccggcgagggcgccagcgtgcccagactggccggccccccccagagcctgcccagcagaatcgacagcctgcccgccttccccctgctggagcccaagatccagtggagactgcaggagagactgaaggcccccaccatcggcctggccgccgtggtgccccccctgcccagcgcccccacccccggcctggtgctgttccagctgagcgccgccggcgacgtgttctaccagcagctgagaccccaggtggacagcagcctgagaagagacgccggcccccccggcgacacccagcccgactgccacgcccccaccgccagctggaccagccaggacaccgccggctgcagccagtggctgaaggccctgctgaaggtgcccctggccccccccgtgtggaccgcccccaccttcacccacagacagatgctgggcagcaccgagctgagaagagaggaggaggagggccagagactgggcgtgctgagaaaggccatggccagaggccagctgctgctgcagagagacctgggcagcctgcccgccgccgagcccccccccgcccccgagagcggcctggaggacaagctgagcgagagactgggcgaggcctgggccggcagaggcgccgcctggtgggagagacagcagggcagaaccagcgagcccggcagacagaccagaagacccaagagaagaacccagctgagcagcagcttcagcctgagcggccacgtggaccccagcgaggacaccagcagcccccacagccccgagtggccccccgccgacgccctgcccctgccccccaccaccccccccagccaggagctgacccccgacgcctgcgcccagggcgtgcccagcgagcagagacagatgctgagagactacatggccaagctgcccccccagagagacacccccggctgcgccaccacccccccccacagccaggccagcagcgtgagagccaccagaagccagcagcacacccccgtgctgagcagcagccagcccctgagaaagaagcccagaatgggcttctag

SEQ ID NO: 101902 - DNA, 1179 bp, Artificial Sequence
  Description of Artificial Sequence: Synthetic coding sequence
atgctgaagtggaaccacggcctgcccagccccctgctgctggccagactgctgcccccccccagacccagctgcgtgcagcccctgctgctgggcggccagggcggccagctgcagctgctgcacctggccgagggcgccagcgtgcccagactggccggccccccccagagcctgcccagcagaatcgacagcctgcccgccttccccctgctggagcccaagatccagtggagactgcaggagagactgaaggcccccaccatcggcctggccgccgtggtgccccccctgcccagcgcccccacccccggcctggtgctgttccagctgagcgccgccggcgacgtgttctaccagcagctgagaccccaggtggacagcagcctgagaagagacgccggcccccccggcgacacccagcccgactgccacgcccccaccgccagctggaccagccaggacaccgccggctgcagccagtggctgaaggccctgctgaaggtgcccctggccccccccgtgtggaccgcccccaccttcacccacagacagatgctgggcagcaccgagctgagaagagaggaggaggagggccagagactgggcgtgctgagaaaggccatggccagaggccagctgctgctgcagagagacctgggcagcctgcccgccgccgagcccccccccgcccccgagagcggcctggaggacaagctgagcgagagactgggcgaggcctgggccggcagaggcgccgcctggtgggagagacagcagggcagaaccagcgagcccggcagacagaccagaagacccaagagaagaacccagctgagcagcagcttcagcctgagcggccacgtggaccccagcgaggacaccagcagcccccacagccccgagtggccccccgccgacgccctgcccctgccccccaccaccccccccagccaggagctgacccccgacgcctgcgcccagggcgtgcccagcgagcagagacagatgctgagagactacatggccaagctgcccccccagagagacacccccggctgcgccaccacccccccccacagccaggccagcagcgtgagagccaccagaagccagcagcacacccccgtgctgagcagcagccagcccctgagaaagaagcccagaatgggcttctag

SEQ ID NO: 101903 - DNA, 837 bp, Artificial Sequence
  Description of Artificial Sequence: Synthetic coding sequence
atggacaagagcggcatcgacagcctggaccacgtgaccagcgacgccgtggagctggccaacagaagcgacaacagcagcgacagcagcctgttcaagacccagtgcatcccctacagccccaagggcgagaagagaaaccccatcagaaagttcgtgagaacccccgagagcgtgcacgccagcgacagcagcagcgacagcagcttcgagcccatccccctgaccatcaaggccatcttcgagagattcaagaacagaaagaagagatacaagaagaagaagaagagaagataccagcccaccggcagacccagaggcagacccgagggcagaagaaaccccatctacagcctgatcgacaagaagaagcagttcagaagcagaggcagcggcttccccttcctggagagcgagaacgagaagaacgccccctggagaaagatcctgaccttcgagcaggccgtggccagaggcttcttcaactacatcgagaagctgaagtacgagcaccacctgaaggagagcctgaagcagatgaacgtgggcgaggacctggagaacgaggacttcgacagcagaagatacaagttcctggacgacgacggcagcatcagccccatcgaggagagcaccgccgaggacgaggacgccacccacctggaggacaacgagtgcgacatcaagctggccggcgacagcttcatcgtgagcagcgagttccccgtgagactgagcgtgtacctggaggaggaggacatcaccgaggaggccgccctgagcaagaagagagccaccaaggccaagaacaccggccagagaggcctgaagatgtag

SEQ ID NO: 101904 - DNA, 837 bp, Artificial Sequence; identical to SEQ ID NO: 101903
  Description of Artificial Sequence: Synthetic coding sequence

SEQ ID NO: 101905 - DNA, 837 bp, Artificial Sequence; identical to SEQ ID NO: 101903
  Description of Artificial Sequence: Synthetic coding sequence

SEQ ID NO: 101906 - DNA, 27 bp, Artificial Sequence
  Description of Artificial Sequence: Synthetic coding sequence
atggacaagagcggcatcgacagctag

SEQ ID NO: 101907 - DNA, 3030 bp, Artificial Sequence
  Description of Artificial Sequence: Synthetic coding sequence
atgagctggttcaacgccagccagctgagcagcttcgccaagcaggccctgagccaggcccagaagagcatcgacagagtgctggacatccaggaggaggagcccagcatctgggccgagaccatcccctacggcgagcccggcatcagcagccccgtgagcggcggctgggacaccagcacctggggcctgaagagcaacaccgagccccagagcccccccatcgccagccccaaggccatcaccaagcccgtgagaagaaccgtggtggacgagagcgagaacttcttcagcgccttcctgagccccaccgtgagcctgaaggtgagcgagagcgtgatcgacgtgaagaccaccatggagagcatcagcaacaccagcacccagagcctgaccgccgagaccaaggacatcgccctggagcccaaggagcagaagcacgaggacagacagagcaacacccccagcccccccgtgagcaccttcagcagcggcaccagcaccaccagcgacatcgaggtgctggaccacgagagcgtgatcagcgagagcagcgccagcagcagacaggagaccaccgacagcaagagcagcctgcacctgatgcagaccagcttccagctgctgagcgccagcgcctgccccgagtacaacagactggacgacttccagaagctgaccgagagctgctgcagcagcgacgccttcgagagaatcgacagcttcagcgtgcagagcctggacagcagaagcgtgagcgagatcaacagcgacgacgagctgagcggcaagggctacgccctggtgcccatcatcgtgaacagcagcacccccaagagcaagaccgtggagagcgccgagggcaagagcgaggaggtgaacgagaccctggtgatccccaccgaggaggccgagatggaggagagcggcagaagcgccacccccgtgaactgcgagcagcccgacatcctggtgagcagcacccccatcaacgagggccagaccgtgctggacaaggtggccgagcagtgcgagcccgccgagagccagcccgaggccctgagcgagaaggaggacgtgtgcaaggtgaccctgaccgtggagttcctgaacgagaagctggagaagagagaggcccagctgctgagcctgagcaaggagaaggccctgctggaggaggccttcgacaacctgaaggacgagatgttcagagtgaaggaggagagcagcagcatcagcagcctgaaggacgagttcacccagagaatcgccgaggccgagaagaaggtgcagctggcctgcaaggagagagacgccgccaagaaggagatcaagaacatcaaggaggagctggccaccagactgaacagcagcgagaccgccgacctgctgaaggagaaggacgagcagatcagaggcctgatggaggagggcgagaagctgagcaagcagcagctgcacaacagcaacatcatcaagaagctgagagccaaggacaaggagaacgagaacatggtggccaagctgaacaagaaggtgaaggagctggaggaggagctgcagcacctgaagcaggtgctggacggcaaggaggaggtggagaagcagcacagagagaacatcaagaagctgaacagcatggtggagagacaggagaaggacctgggcagactgcaggtggacatggacgagctggaggagaagaacagaagcatccaggccgccctggacagcgcctacaaggagctgaccgacctgcacaaggccaacgccgccaaggacagcgaggcccaggaggccgccctgagcagagagatgaaggccaaggaggagctgagcgccgccctggagaaggcccaggaggaggccagacagcagcaggagaccctggccatccaggtgggcgacctgagactggccctgcagagaaccgagcaggccgccgccagaaaggaggactacctgagacacgagatcggcgagctgcagcagagactgcaggaggccgagaacagaaaccaggagctgagccagagcgtgagcagcaccaccagacccctgctgagacagatcgagaacctgcaggccaccctgggcagccagaccagcagctgggagaagctggagaagaacctgagcgacagactgggcgagagccagaccctgctggccgccgccgtggagagagagagagccgccaccgaggagctgctggccaacaagatccagatgagcagcatggagagccagaacagcctgctgagacaggagaacagcagattccaggcccagctggagagcgagaagaacagactgtgcaagctggaggacgagaacaacagataccaggtggagctggagaacctgaaggacgagtacgtgagaaccctggaggagaccagaaaggagaagaccctgctgaacagccagctggagatggagagaatgaaggtggagcaggagagaaagaaggccatcttcacccaggagaccatcaaggagaaggagagaaagcccttcagcgtgagcagcacccccaccatgagcagaagcagcagcatcagcggcgtggacatggccggcctgcagaccagcttcctgagccaggacgagagccacgaccacagcttcggccccatgcccatcagcgccaacggcagcaacctgtacgacgccgtgagaatgggcgccggcagcagcatcatcgagaacctgcagagccagctgaagctgagagagggcgagatcacccacctgcagctggagatcggcaacctggagaagaccagaagcatcatggccgaggagctggtgaagctgaccaaccagaacgacgagctggaggagaaggtgaaggagatccccaagctgagaacccagctgagagacctggaccagagatacaacaccatcctgcagatgtacggcgagaaggccgaggaggccgaggagctgagactggacctggaggacgtgaagaacatgtacaagacccagatcgacgagctgctgagacagagcctgagctag

SEQ ID NO: 101908 - DNA, 3282 bp, Artificial Sequence
  Description of Artificial Sequence: Synthetic coding sequence
atgagctggttcaacgccagccagctgagcagcttcgccaagcaggccctgagccaggcccagaagagcatcgacagagtgctggacatccaggaggaggagcccagcatctgggccgagaccatcccctacggcgagcccggcatcagcagccccgtgagcggcggctgggacaccagcacctggggcctgaagagcaacaccgagccccagagcccccccatcgccagccccaaggccatcaccaagcccgtgagaagaaccgtggtggacgagagcgagaacttcttcagcgccttcctgagccccaccgacgtgcagaccatccagaagagccccgtggtgagcaagccccccgccaagagccagagacccgaggaggaggtgaagagcagcctgcacgagagcctgcacatcggccagagcagaacccccgagaccaccgagagccaggtgaaggacagcagcctgtgcgtgagcggcgagaccctggccgccggcaccagcagccccaagaccgagggcaagcacgaggagaccgtgaacaaggagagcgacatgaaggtgcccaccgtgagcctgaaggtgagcgagagcgtgatcgacgtgaagaccaccatggagagcatcagcaacaccagcacccagagcctgaccgccgagaccaaggacatcgccctggagcccaaggagcagaagcacgaggacagacagagcaacacccccagcccccccgtgagcaccttcagcagcggcaccagcaccaccagcgacatcgaggtgctggaccacgagagcgtgatcagcgagagcagcgccagcagcagacaggagaccaccgacagcaagagcagcctgcacctgatgcagaccagcttccagctgctgagcgccagcgcctgccccgagtacaacagactggacgacttccagaagctgaccgagagctgctgcagcagcgacgccttcgagagaatcgacagcttcagcgtgcagagcctggacagcagaagcgtgagcgagatcaacagcgacgacgagctgagcggcaagggctacgccctggtgcccatcatcgtgaacagcagcacccccaagagcaagaccgtggagagcgccgagggcaagagcgaggaggtgaacgagaccctggtgatccccaccgaggaggccgagatggaggagagcggcagaagcgccacccccgtgaactgcgagcagcccgacatcctggtgagcagcacccccatcaacgagggccagaccgtgctggacaaggtggccgagcagtgcgagcccgccgagagccagcccgaggccctgagcgagaaggaggacgtgtgcaagaccgtggagttcctgaacgagaagctggagaagagagaggcccagctgctgagcctgagcaaggagaaggccctgctggaggaggccttcgacaacctgaaggacgagatgttcagagtgaaggaggagagcagcagcatcagcagcctgaaggacgagttcacccagagaatcgccgaggccgagaagaaggtgcagctggcctgcaaggagagagacgccgccaagaaggagatcaagaacatcaaggaggagctggccaccagactgaacagcagcgagaccgccgacctgctgaaggagaaggacgagcagatcagaggcctgatggaggagggcgagaagctgagcaagcagcagctgcacaacagcaacatcatcaagaagctgagagccaaggacaaggagaacgagaacatggtggccaagctgaacaagaaggtgaaggagctggaggaggagctgcagcacctgaagcaggtgctggacggcaaggaggaggtggagaagcagcacagagagaacatcaagaagctgaacagcatggtggagagacaggagaaggacctgggcagactgcaggtggacatggacgagctggaggagaagaacagaagcatccaggccgccctggacagcgcctacaaggagctgaccgacctgcacaaggccaacgccgccaaggacagcgaggcccaggaggccgccctgagcagagagatgaaggccaaggaggagctgagcgccgccctggagaaggcccaggaggaggccagacagcagcaggagaccctggccatccaggtgggcgacctgagactggccctgcagagaaccgagcaggccgccgccagaaaggaggactacctgagacacgagatcggcgagctgcagcagagactgcaggaggccgagaacagaaaccaggagctgagccagagcgtgagcagcaccaccagacccctgctgagacagatcgagaacctgcaggccaccctgggcagccagaccagcagctgggagaagctggagaagaacctgagcgacagactgggcgagagccagaccctgctggccgccgccgtggagagagagagagccgccaccgaggagctgctggccaacaagatccagatgagcagcatggagagccagaacagcctgctgagacaggagaacagcagattccaggcccagctggagagcgagaagaacagactgtgcaagctggaggacgagaacaacagataccaggtggagctggagaacctgaaggacgagtacgtgagaaccctggaggagaccagaaaggagaagaccctgctgaacagccagctggagatggagagaatgaaggtggagcaggagagaaagaaggccatcttcacccaggagaccatcaaggagaaggagagaaagcccttcagcgtgagcagcacccccaccatgagcagaagcagcagcatcagcggcgtggacatggccggcctgcagaccagcttcctgagccaggacgagagccacgaccacagcttcggccccatgcccatcagcgccaacggcagcaacctgtacgacgccgtgagaatgggcgccggcagcagcatcatcgagaacctgcagagccagctgaagctgagagagggcgagatcacccacctgcagctggagatcggcaacctggagaagaccagaagcatcatggccgaggagctggtgaagctgaccaaccagaacgacgagctggaggagaaggtgaaggagatccccaagctgagaacccagctgagagacctggaccagagatacaacaccatcctgcagatgtacggcgagaaggccgaggaggccgaggagctgagactggacctggaggacgtgaagaacatgtacaagacccagatcgacgagctgctgagacagagcctgagctag

SEQ ID NO: 101909 - DNA, 1602 bp, Artificial Sequence
  Description of Artificial Sequence: Synthetic coding sequence
atgagctggttcaacgccagccagctgagcagcttcgccaagcaggccctgagccaggcccagaagagcatcgacagagtgctggacatccaggaggaggagcccagcatctgggccgagaccatcccctacggcgagcccggcatcagcagccccgtgagcggcggctgggacaccagcacctggggcctgaagagcaacaccgagccccagagcccccccatcgccagccccaaggccatcaccaagcccgtgagaagaaccgtggtggacgagagcgagaacttcttcagcgccttcctgagccccaccgacgtgcagaccatccagaagagccccgtggtgagcaagccccccgccaagagccagagacccgaggaggaggtgaagagcagcctgcacgagagcctgcacatcggccagagcagaacccccgagaccaccgagagccaggtgaaggacagcagcctgtgcgtgagcggcgagaccctggccgccggcaccagcagccccaagaccgagggcaagcacgaggagaccgtgaacaaggagagcgacatgaaggtgcccaccgtgagcctgaaggtgagcgagagcgtgatcgacgtgaagaccaccatggagagcatcagcaacaccagcacccagagcctgaccgccgagaccaaggacatcgccctggagcccaaggagcagaagcacgaggacagacagagcaacacccccagcccccccgtgagcaccttcagcagcggcaccagcaccaccagcgacatcgaggtgctggaccacgagagcgtgatcagcgagagcagcgccagcagcagacaggagaccaccgacagcaagagcagcctgcacctgatgcagaccagcttccagctgctgagcgccagcgcctgccccgagtacaacagactggacgacttccagaagctgaccgagagctgctgcagcagcgacgccttcgagagaatcgacagcttcagcgtgcagagcctggacagcagaagcgtgagcgagatcaacagcgacgacgagctgagcggcaagggctacgccctggtgcccatcatcgtgaacagcagcacccccaagagcaagaccgtggagagcgccgagggcaagagcgaggaggtgaacgagaccctggtgatccccaccgaggaggccgagatggaggagagcggcagaagcgccacccccgtgaactgcgagcagcccgacatcctggtgagcagcacccccatcaacgagggccagaccgtgctggacaaggtggccgagcagtgcgagcccgccgagagccagcccgaggccctgagcgagaaggaggacgtgtgcaagaccgtggagttcctgaacgagaagctggagaagagagaggcccagctgctgagcctgagcaaggagaaggccctgctggaggaggccttcgacaacctgaaggacgagatgttcagagtgaaggaggagagcagcagcatcagcagcctgaaggacgagttcacccagagaatcgccgaggccgagaagaaggtgcagctggcctgcaaggagagagacgccgccaagaaggaggtgaagagaaagaagagatag

SEQ ID NO: 101910 - DNA, 3291 bp, Artificial Sequence
  Description of Artificial Sequence: Synthetic coding sequence
atgagctggttcaacgccagccagctgagcagcttcgccaagcaggccctgagccaggcccagaagagcatcgacagagtgctggacatccaggaggaggagcccagcatctgggccgagaccatcccctacggcgagcccggcatcagcagccccgtgagcggcggctgggacaccagcacctggggcctgaagagcaacaccgagccccagagcccccccatcgccagccccaaggccatcaccaagcccgtgagaagaaccgtggtggacgagagcgagaacttcttcagcgccttcctgagccccaccgacgtgcagaccatccagaagagccccgtggtgagcaagccccccgccaagagccagagacccgaggaggaggtgaagagcagcctgcacgagagcctgcacatcggccagagcagaacccccgagaccaccgagagccaggtgaaggacagcagcctgtgcgtgagcggcgagaccctggccgccggcaccagcagccccaagaccgagggcaagcacgaggagaccgtgaacaaggagagcgacatgaaggtgcccaccgtgagcctgaaggtgagcgagagcgtgatcgacgtgaagaccaccatggagagcatcagcaacaccagcacccagagcctgaccgccgagaccaaggacatcgccctggagcccaaggagcagaagcacgaggacagacagagcaacacccccagcccccccgtgagcaccttcagcagcggcaccagcaccaccagcgacatcgaggtgctggaccacgagagcgtgatcagcgagagcagcgccagcagcagacaggagaccaccgacagcaagagcagcctgcacctgatgcagaccagcttccagctgctgagcgccagcgcctgccccgagtacaacagactggacgacttccagaagctgaccgagagctgctgcagcagcgacgccttcgagagaatcgacagcttcagcgtgcagagcctggacagcagaagcgtgagcgagatcaacagcgacgacgagctgagcggcaagggctacgccctggtgcccatcatcgtgaacagcagcacccccaagagcaagaccgtggagagcgccgagggcaagagcgaggaggtgaacgagaccctggtgatccccaccgaggaggccgagatggaggagagcggcagaagcgccacccccgtgaactgcgagcagcccgacatcctggtgagcagcacccccatcaacgagggccagaccgtgctggacaaggtggccgagcagtgcgagcccgccgagagccagcccgaggccctgagcgagaaggaggacgtgtgcaaggtgaccctgaccgtggagttcctgaacgagaagctggagaagagagaggcccagctgctgagcctgagcaaggagaaggccctgctggaggaggccttcgacaacctgaaggacgagatgttcagagtgaaggaggagagcagcagcatcagcagcctgaaggacgagttcacccagagaatcgccgaggccgagaagaaggtgcagctggcctgcaaggagagagacgccgccaagaaggagatcaagaacatcaaggaggagctggccaccagactgaacagcagcgagaccgccgacctgctgaaggagaaggacgagcagatcagaggcctgatggaggagggcgagaagctgagcaagcagcagctgcacaacagcaacatcatcaagaagctgagagccaaggacaaggagaacgagaacatggtggccaagctgaacaagaaggtgaaggagctggaggaggagctgcagcacctgaagcaggtgctggacggcaaggaggaggtggagaagcagcacagagagaacatcaagaagctgaacagcatggtggagagacaggagaaggacctgggcagactgcaggtggacatggacgagctggaggagaagaacagaagcatccaggccgccctggacagcgcctacaaggagctgaccgacctgcacaaggccaacgccgccaaggacagcgaggcccaggaggccgccctgagcagagagatgaaggccaaggaggagctgagcgccgccctggagaaggcccaggaggaggccagacagcagcaggagaccctggccatccaggtgggcgacctgagactggccctgcagagaaccgagcaggccgccgccagaaaggaggactacctgagacacgagatcggcgagctgcagcagagactgcaggaggccgagaacagaaaccaggagctgagccagagcgtgagcagcaccaccagacccctgctgagacagatcgagaacctgcaggccaccctgggcagccagaccagcagctgggagaagctggagaagaacctgagcgacagactgggcgagagccagaccctgctggccgccgccgtggagagagagagagccgccaccgaggagctgctggccaacaagatccagatgagcagcatggagagccagaacagcctgctgagacaggagaacagcagattccaggcccagctggagagcgagaagaacagactgtgcaagctggaggacgagaacaacagataccaggtggagctggagaacctgaaggacgagtacgtgagaaccctggaggagaccagaaaggagaagaccctgctgaacagccagctggagatggagagaatgaaggtggagcaggagagaaagaaggccatcttcacccaggagaccatcaaggagaaggagagaaagcccttcagcgtgagcagcacccccaccatgagcagaagcagcagcatcagcggcgtggacatggccggcctgcagaccagcttcctgagccaggacgagagccacgaccacagcttcggccccatgcccatcagcgccaacggcagcaacctgtacgacgccgtgagaatgggcgccggcagcagcatcatcgagaacctgcagagccagctgaagctgagagagggcgagatcacccacctgcagctggagatcggcaacctggagaagaccagaagcatcatggccgaggagctggtgaagctgaccaaccagaacgacgagctggaggagaaggtgaaggagatccccaagctgagaacccagctgagagacctggaccagagatacaacaccatcctgcagatgtacggcgagaaggccgaggaggccgaggagctgagactggacctggaggacgtgaagaacatgtacaagacccagatcgacgagctgctgagacagagcctgagctag

SEQ ID NO: 101911 - DNA, 4950 bp, Artificial Sequence
  Description of Artificial Sequence: Synthetic coding sequence
atggagagcgtggagaaggactggggctggggcctgtggagaaacctgagatgcctgggccacgcccaccagggcaagtgctgcaccgagggcggcatcagcagcaccaccaagaccagcagcgagaacggcagctgctgcttcgagaaggccgccagaaaggaccacgtgtgcagattcatcggctgcggcagaaacgacagattcaactacgtggtgatgcagctgcagggcagaaacctggccgacctgagaagaagccagagcagaggcaccttcaccatcagcaccaccctgagactgggcagacagatcctggagagcatcgagagcatccacagcgtgggcttcctgcacagagacatcaagcccagcaacttcgccatgggcagattccccagcacctgcagaaagtgctacatgctggacttcggcctggccagacagttcaccaacagctgcggcgacgtgagaccccccagagccgtggccggcttcagaggcaccgtgagatacgccagcatcaacgcccacagaaacagagagatgggcagacacgacgacctgtggagcctgttctacatgctggtggagttcgtggtgggccagctgccctggagaaagatcaaggacaaggagcaggtgggcagcatcaaggagagatacgaccacagactgatgctgaagcacctgccccccgagttcagcatcttcctggaccacatcagcagcctggactacttcaccaagcccgactaccagatgagcatcagagtgaccagaaagagctacaaggtgagcaccagcggcccccaggccttcaacagcctgagctacaccagcggccccggcgcctgcatcagcagcagcagcttcagcagaatgggcagcagcagcttcagaggcggcctgggcgccggctacggcggcgccagcggcggcatcaccaccatcaccgtgaaccagagcctgctgagccccctgaacctggaggtggaccccaacatccaggccgtgagaacccaggaggagaagcagatcaagaccctgaacaacaagttcttcagcttcatcgacaaggtgagattcctggagcagcagaacaagatgctggagaccaagtggagcctggtgcagcagcagaagatggccagaagcaacatggacaacatgttcgagagctacatcaacaacctgaagtggcagctggagaccctgggccaggagaagctgaagctggaggccgagctgggcaacatgcacggcctggtggaggacttcagaaacaagtacgaggtggagatcagcaagtgcaccgagatggagaacgagttcgtgctgatcaaggagtacgtggacgaggcctacatgaacaagatggagctggagagcagcctgaaggagctgaccgccaagatcagcttcctgagacagctgtacgaggaggagatcggcagctgcagccccagaagcagaatccacctgtggtgctgcagctggaccaccgccgccagctggacctggaccgccagcagcctgagaagcagacccgagggcttccccggcggctgccacgccgacaccgagcagagaggcgagctggccatcaaggacgccaacgccaagctgagcgagctggaggccgccctgcagctggccagccaggacatggccagacagctgagagagtaccaggagctgatgaacgtgaagctggccctggacatcaagatcgccacctacagaaagctgctggagggcgaggagagctggctggagagcggcatgcagaacatgagcatccacatgaagaccaccagcagctacgccggcggccagagcctggcctacggcggcctgaccagccccggcctgagctacggcctgggcagcagcttcggcagcggcatgggcagcagcagcttcagccacaccagcagcagcagagccgtggtgatgaagaagatcgagaccagagacggcaagctggtgagcgagagcagcaacgtgctgcccaacctgagaatcaccgccaccctgctgaccagcgtgttcgacaacagcatcaagaccttcggcgtgatcgagagcgaccccttcgactgggagaagaccggcaacgacggcagcctgaccaccaccaccaccagcaccaccccccagctgcacaccagactgacccccgccgccatcggcatcgccaacgccacccccatccccggcgacctgctgagagagaacaccgacgaggtgttccccgacgagcagctgagcgacggcgagaacggcatccccgtgggcgtgagccccgacaagctgcccggcagcctgggccaccccagaccccaggagaaggacgtgtgggaggagatggacgccaacaagaacaagatcaagctgggcatctgcaaggccgccaccgaggaggagaacagccacggccaggccaacggcctgctgaacgcccccagcctgggcagccccatcagagtgagaagcgagatcacccagcccgacagagacatccccctggtgagaaagctgagaagcatccacagcttcgagctggagaagagactgaccctggagcccaagcccgacaccgacaagttcctggagacctgcctggagaagatgcagaaggacaccagcgccggcaaggagagcatcctgcccgccctgctgcacaagccctgcgtgcccgccgtgagcagaaccgaccacatctggcactacgacgaggagtacctgcccgacgccagcaagcccgccagcgccaacacccccgagcaggccgacggcggcggcagcaacggcttcatcgccgtgaacctgagcagctgcaagcaggagatcgacagcaaggagtgggtgatcgtggacaaggagcaggacctgcaggacttcagaaccaacgaggccgtgggccacaagaccaccggcagccccagcgacgaggagcccgaggtgctgcaggtgctggaggccagcccccaggacgagaagctgcagctgggcccctgggccgagaacgaccacctgaagaaggagaccagcggcgtggtgctggccctgagcgccgagggcccccccaccgccgccagcgagcagtacaccgacagactggagctgcagcccggcgccgccagccagttcatcgccgccacccccaccagcctgatggaggcccaggccgagggccccctgaccgccatcaccatccccagacccagcgtggccagcacccagagcaccagcggcagcttccactgcggccagcagcccgagaagaaggacctgcagcccatggagcccaccgtggagctgtacagccccagagagaacttcagcggcctggtggtgaccgagggcgagccccccagcggcggcagcagaaccgacctgggcctgcagatcgaccacatcggccacgacatgctgcccaacatcagagagagcaacaagagccaggacctgggccccaaggagctgcccgaccacaacagactggtggtgagagagttcgagaacctgcccggcgagaccgaggagaagagcatcctgctggagagcgacaacgaggacgagaagctgagcagaggccagcactgcatcgagatcagcagcctgcccggcgacctggtgatcgtggagaaggaccacagcgccaccaccgagcccctggacgtgaccaagacccagaccttcagcgtggtgcccaaccaggacaagaacaacgagatcatgaagctgctgaccgtgggcaccagcgagatcagcagcagagacatcgacccccacgtggagggccagatcggccaggtggccgagatgcagaagaacaagatcagcaaggacgacgacatcatgagcgaggacctgcccggccaccagggcgacctgagcaccttcctgcaccaggagggcaagagagagaagatcacccccagaaacggcgagctgttccactgcgtgagcgagaacgagcacggcgcccccaccagaaaggacatggtgagaagcagcttcgtgaccagacacagcagaatccccgtgctggcccaggagatcgacagcaccctggagagcagcagccccgtgagcgccaaggagaagctgctgcagaagaaggcctaccagcccgacctggtgaagctgctggtggagaagagacagttcaagagcttcctgggcgacctgagcagcgccagcgacaagctgctggaggagaagctggccaccgtgcccgcccccttctgcgaggaggaggtgctgacccccttcagcagactgaccgtggacagccacctgagcagaagcgccgaggacagcttcctgagccccatcatcagccagagcagaaagagcaagatccccagacccgtgagctgggtgaacaccgaccaggtgaacagcagcaccagcagccagttcttccccagacccccccccggcaagccccccaccagacccggcgtggaggccagactgagaagatacaaggtgctgggcagcagcaacagcgacagcgacctgttcagcagactggcccagatcctgcagaacggcagccagaagcccagaagcaccacccagtgcaagagccccggcagcccccacaaccccaagaccccccccaagagccccgtggtgcccagaagaagccccagcgccagccccagaagcagcagcctgcccagaaccagcagcagcagccccagcagagccggcagaccccaccacgaccagagaagcagcagcccccacctgggcagaagcaagagcccccccagccacagcggcagcagcagcagcagaagaagctgccagcaggagcactgcaagcccagcaagaacggcctgaagggcagcggcagcctgcaccaccacagcgccagcaccaagaccccccagggcaagagcaagcccgccagcaagctgagcagatag

SEQ ID NO: 101912 - DNA, 3735 bp, Artificial Sequence
  Description of Artificial Sequence: Synthetic coding sequence
atgagcggcggcggcgagcagctggacatcctgagcgtgggcatcctggtgaaggagagatggaaggtgctgagaaagatcggcggcggcggcttcggcgagatctacgacgccctggacatgctgaccagagagaacgtggccctgaaggtggagagcgcccagcagcccaagcaggtgctgaagatggaggtggccgtgctgaagaagctgcagggcaaggaccacgtgtgcagattcatcggctgcggcagaaacgacagattcaactacgtggtgatgcagctgcagggcagaaacctggccgacctgagaagaagccagagcagaggcaccttcaccatcagcaccaccctgagactgggcagacagatcctggagagcatcgagagcatccacagcgtgggcttcctgcacagagacatcaagcccagcaacttcgccatgggcagattccccagcacctgcagaaagtgctacatgctggacttcggcctggccagacagttcaccaacagctgcggcgacgtgagaccccccagagccgtggccggcttcagaggcaccgtgagatacgccagcatcaacgcccacagaaacagagagatgggcagacacgacgacctgtggagcctgttctacatgctggtggagttcgtggtgggccagctgccctggagaaagatcaaggacaaggagcaggtgggcagcatcaaggagagatacgaccacagactgatgctgaagcacctgccccccgagttcagcatcttcctggaccacatcagcagcctggactacttcaccaagcccgactaccagctgctgaccagcgtgttcgacaacagcatcaagaccttcggcgtgatcgagagcgaccccttcgactgggagaagaccggcaacgacggcagcctgaccaccaccaccaccagcaccaccccccagctgcacaccagactgacccccgccgccatcggcatcgccaacgccacccccatccccggcgacctgctgagagagaacaccgacgaggtgttccccgacgagcagctgagcgacggcgagaacggcatccccgtgggcgtgagccccgacaagctgcccggcagcctgggccaccccagaccccaggagaaggacgtgtgggaggagatggacgccaacaagaacaagatcaagctgggcatctgcaaggccgccaccgaggaggagaacagccacggccaggccaacggcctgctgaacgcccccagcctgggcagccccatcagagtgagaagcgagatcacccagcccgacagagacatccccctggtgagaaagctgagaagcatccacagcttcgagctggagaagagactgaccctggagcccaagcccgacaccgacaagttcctggagacctgcctggagaagatgcagaaggacaccagcgccggcaaggagagcatcctgcccgccctgctgcacaagccctgcgtgcccgccgtgagcagaaccgaccacatctggcactacgacgaggagtacctgcccgacgccagcaagcccgccagcgccaacacccccgagcaggccgacggcggcggcagcaacggcttcatcgccgtgaacctgagcagctgcaagcaggagatcgacagcaaggagtgggtgatcgtggacaaggagcaggacctgcaggacttcagaaccaacgaggccgtgggccacaagaccaccggcagccccagcgacgaggagcccgaggtgctgcaggtgctggaggccagcccccaggacgagaagctgcagctgggcccctgggccgagaacgaccacctgaagaaggagaccagcggcgtggtgctggccctgagcgccgagggcccccccaccgccgccagcgagcagtacaccgacagactggagctgcagcccggcgccgccagccagttcatcgccgccacccccaccagcctgatggaggcccaggccgagggccccctgaccgccatcaccatccccagacccagcgtggccagcacccagagcaccagcggcagcttccactgcggccagcagcccgagaagaaggacctgcagcccatggagcccaccgtggagctgtacagccccagagagaacttcagcggcctggtggtgaccgagggcgagccccccagcggcggcagcagaaccgacctgggcctgcagatcgaccacatcggccacgacatgctgcccaacatcagagagagcaacaagagccaggacctgggccccaaggagctgcccgaccacaacagactggtggtgagagagttcgagaacctgcccggcgagaccgaggagaagagcatcctgctggagagcgacaacgaggacgagaagctgagcagaggccagcactgcatcgagatcagcagcctgcccggcgacctggtgatcgtggagaaggaccacagcgccaccaccgagcccctggacgtgaccaagacccagaccttcagcgtggtgcccaaccaggacaagaacaacgagatcatgaagctgctgaccgtgggcaccagcgagatcagcagcagagacatcgacccccacgtggagggccagatcggccaggtggccgagatgcagaagaacaagatcagcaaggacgacgacatcatgagcgaggacctgcccggccaccagggcgacctgagcaccttcctgcaccaggagggcaagagagagaagatcacccccagaaacggcgagctgttccactgcgtgagcgagaacgagcacggcgcccccaccagaaaggacatggtgagaagcagcttcgtgaccagacacagcagaatccccgtgctggcccaggagatcgacagcaccctggagagcagcagccccgtgagcgccaaggagaagctgctgcagaagaaggcctaccagcccgacctggtgaagctgctggtggagaagagacagttcaagagcttcctgggcgacctgagcagcgccagcgacaagctgctggaggagaagctggccaccgtgcccgcccccttctgcgaggaggaggtgctgacccccttcagcagactgaccgtggacagccacctgagcagaagcgccgaggacagcttcctgagccccatcatcagccagagcagaaagagcaagatccccagacccgtgagctgggtgaacaccgaccaggtgaacagcagcaccagcagccagttcttccccagacccccccccggcaagccccccaccagacccggcgtggaggccagactgagaagatacaaggtgctgggcagcagcaacagcgacagcgacctgttcagcagactggcccagatcctgcagaacggcagccagaagcccagaagcaccacccagtgcaagagccccggcagcccccacaaccccaagaccccccccaagagccccgtggtgcccagaagaagccccagcgccagccccagaagcagcagcctgcccagaaccagcagcagcagccccagcagagccggcagaccccaccacgaccagagaagcagcagcccccacctgggcagaagcaagagcccccccagccacagcggcagcagcagcagcagaagaagctgccagcaggagcactgcaagcccagcaagaacggcctgaagggcagcggcagcctgcaccaccacagcgccagcaccaagaccccccagggcaagagcaagcccgccagcaagctgagcagatag

SEQ ID NO: 101913 - DNA, 3525 bp, Artificial Sequence
  Description of Artificial Sequence: Synthetic coding sequence
gagcccggcaaggaccacgtgtgcagattcatcggctgcggcagaaacgacagattcaactacgtggtgatgcagctgcagggcagaaacctggccgacctgagaagaagccagagcagaggcaccttcaccatcagcaccaccctgagactgggcagacagatcctggagagcatcgagagcatccacagcgtgggcttcctgcacagagacatcaagcccagcaacttcgccatgggcagattccccagcacctgcagaaagtgctacatgctggacttcggcctggccagacagttcaccaacagctgcggcgacgtgagaccccccagagccgtggccggcttcagaggcaccgtgagatacgccagcatcaacgcccacagaaacagagagatgggcagacacgacgacctgtggagcctgttctacatgctggtggagttcgtggtgggccagctgccctggagaaagatcaaggacaaggagcaggtgggcagcatcaaggagagatacgaccacagactgatgctgaagcacctgccccccgagttcagcatcttcctggaccacatcagcagcctggactacttcaccaagcccgactaccagctgctgaccagcgtgttcgacaacagcatcaagaccttcggcgtgatcgagagcgaccccttcgactgggagaagaccggcaacgacggcagcctgaccaccaccaccaccagcaccaccccccagctgcacaccagactgacccccgccgccatcggcatcgccaacgccacccccatccccggcgacctgctgagagagaacaccgacgaggtgttccccgacgagcagctgagcgacggcgagaacggcatccccgtgggcgtgagccccgacaagctgcccggcagcctgggccaccccagaccccaggagaaggacgtgtgggaggagatggacgccaacaagaacaagatcaagctgggcatctgcaaggccgccaccgaggaggagaacagccacggccaggccaacggcctgctgaacgcccccagcctgggcagccccatcagagtgagaagcgagatcacccagcccgacagagacatccccctggtgagaaagctgagaagcatccacagcttcgagctggagaagagactgaccctggagcccaagcccgacaccgacaagttcctggagacctgcctggagaagatgcagaaggacaccagcgccggcaaggagagcatcctgcccgccctgctgcacaagccctgcgtgcccgccgtgagcagaaccgaccacatctggcactacgacgaggagtacctgcccgacgccagcaagcccgccagcgccaacacccccgagcaggccgacggcggcggcagcaacggcttcatcgccgtgaacctgagcagctgcaagcaggagatcgacagcaaggagtgggtgatcgtggacaaggagcaggacctgcaggacttcagaaccaacgaggccgtgggccacaagaccaccggcagccccagcgacgaggagcccgaggtgctgcaggtgctggaggccagcccccaggacgagaagctgcagctgggcccctgggccgagaacgaccacctgaagaaggagaccagcggcgtggtgctggccctgagcgccgagggcccccccaccgccgccagcgagcagtacaccgacagactggagctgcagcccggcgccgccagccagttcatcgccgccacccccaccagcctgatggaggcccaggccgagggccccctgaccgccatcaccatccccagacccagcgtggccagcacccagagcaccagcggcagcttccactgcggccagcagcccgagaagaaggacctgcagcccatggagcccaccgtggagctgtacagccccagagagaacttcagcggcctggtggtgaccgagggcgagccccccagcggcggcagcagaaccgacctgggcctgcagatcgaccacatcggccacgacatgctgcccaacatcagagagagcaacaagagccaggacctgggccccaaggagctgcccgaccacaacagactggtggtgagagagttcgagaacctgcccggcgagaccgaggagaagagcatcctgctggagagcgacaacgaggacgagaagctgagcagaggccagcactgcatcgagatcagcagcctgcccggcgacctggtgatcgtggagaaggaccacagcgccaccaccgagcccctggacgtgaccaagacccagaccttcagcgtggtgcccaaccaggacaagaacaacgagatcatgaagctgctgaccgtgggcaccagcgagatcagcagcagagacatcgacccccacgtggagggccagatcggccaggtggccgagatgcagaagaacaagatcagcaaggacgacgacatcatgagcgaggacctgcccggccaccagggcgacctgagcaccttcctgcaccaggagggcaagagagagaagatcacccccagaaacggcgagctgttccactgcgtgagcgagaacgagcacggcgcccccaccagaaaggacatggtgagaagcagcttcgtgaccagacacagcagaatccccgtgctggcccaggagatcgacagcaccctggagagcagcagccccgtgagcgccaaggagaagctgctgcagaagaaggcctaccagcccgacctggtgaagctgctggtggagaagagacagttcaagagcttcctgggcgacctgagcagcgccagcgacaagctgctggaggagaagctggccaccgtgcccgcccccttctgcgaggaggaggtgctgacccccttcagcagactgaccgtggacagccacctgagcagaagcgccgaggacagcttcctgagccccatcatcagccagagcagaaagagcaagatccccagacccgtgagctgggtgaacaccgaccaggtgaacagcagcaccagcagccagttcttccccagacccccccccggcaagccccccaccagacccggcgtggaggccagactgagaagatacaaggtgctgggcagcagcaacagcgacagcgacctgttcagcagactggcccagatcctgcagaacggcagccagaagcccagaagcaccacccagtgcaagagccccggcagcccccacaaccccaagaccccccccaagagccccgtggtgcccagaagaagccccagcgccagccccagaagcagcagcctgcccagaaccagcagcagcagccccagcagagccggcagaccccaccacgaccagagaagcagcagcccccacctgggcagaagcaagagcccccccagccacagcggcagcagcagcagcagaagaagctgccagcaggagcactgcaagcccagcaagaacggcctgaagggcagcggcagcctgcaccaccacagcgccagcaccaagaccccccagggcaagagcaagcccgccagcaagctgagcagatag

SEQ ID NO: 101914 - DNA, 2244 bp, Artificial Sequence
  Description of Artificial Sequence: Synthetic coding sequence
atgaccagcttccaggaggtgcccctgcagaccagcaacttcgcccacgtgatcttccagaacgtggccaagagctacctgcccaacgcccacctggagtgccactacaccctgaccccctacatccacccccaccccaaggactgggtgggcatcttcaaggtgggctggagcaccgccagagactactacaccttcctgtggagccccatgcccgagcactacgtggagggcagcaccgtgaactgcgtgctggccttccagggctactacctgcccaacgacgacggcgagttctaccagttctgctacgtgacccacaagggcgagatcagaggcgccagcacccccttccagttcagagccagcagccccgtggaggagctgctgaccatggaggacgagggcaacagcgacatgctggtggtgaccaccaaggccggcctgctggagctgaagatcgagaagaccatgaaggagaaggaggagctgctgaagctgatcgccgtgctggagaaggagaccgcccagctgagagagcaggtgggcagaatggagagagagctgaaccacgagaaggagagatgcgaccagctgcaggccgagcagaagggcctgaccgaggtgacccagagcctgaagatggagaacgaggagttcaagaagagattcagcgacgccaccagcaaggcccaccagctggaggaggacatcgtgagcgtgacccacaaggccatcgagaaggagaccgagctggacagcctgaaggacaagctgaagaaggcccagcacgagagagagcagctggagtgccagctgaagaccgagaaggacgagaaggagctgtacaaggtgcacctgaagaacaccgagatcgagaacaccaagctgatgagcgaggtgcagaccctgaagaacctggacggcaacaaggagagcgtgatcacccacttcaaggaggagatcggcagactgcagctgtgcctggccgagaaggagaacctgcagagaaccttcctgctgaccaccagcagcaaggaggacacctgcttcctgaaggagcagctgagaaaggccgaggagcaggtgcaggccaccagacaggaggtggtgttcctggccaaggagctgagcgacgccgtgaacgtgagagacagaaccatggccgacctgcacaccgccagactggagaacgagaaggtgaagaagcagctggccgacgccgtggccgagctgaagctgaacgccatgaagaaggaccaggacaagaccgacaccctggagcacgagctgagaagagaggtggaggacctgaagctgagactgcagatggccgccgaccactacaaggagaagttcaaggagtgccagagactgcagaagcagatcaacaagctgagcgaccagagcgccaacaacaacaacgtgttcaccaagaagaccggcaaccagcagaaggtgaacgacgccagcgtgaacaccgaccccgccaccagcgccagcaccgtggacgtgaagcccagccccagcgccgccgaggccgacttcgacatcgtgaccaagggccaggtgtgcgagatgaccaaggagatcgccgacaagaccgagaagtacaacaagtgcaagcagctgctgcaggacgagaaggccaagtgcaacaagtacgccgacgagctggccaagatggagctgaagtggaaggagcaggtgaagatcgccgagaacgtgaagctggagctggccgaggtgcaggacaactacaaggagctgaagagaagcctggagaaccccgccgagagaaagatggaggacggcgccgacggcgccttctaccccgacgagatccagagaccccccgtgagagtgcccagctggggcctggaggacaacgtggtgtgcagccagcccgccagaaacttcagcagacccgacggcctggaggacagcgaggacagcaaggaggacgagaacgtgcccaccgcccccgacccccccagccagcacctgagaggccacggcaccggcttctgcttcgacagcagcttcgacgtgcacaagaagtgccccctgtgcgagctgatgttcccccccaactacgaccagagcaagttcgaggagcacgtggagagccactggaaggtgtgccccatgtgcagcgagcagttcccccccgactacgaccagcaggtgttcgagagacacgtgcagacccacttcgaccagaacgtgctgaacttcgactag

SEQ ID NO: 101915 - DNA, 2370 bp, Artificial Sequence
  Description of Artificial Sequence: Synthetic coding sequence
atgaccagcttccaggaggtgcccctgcagaccagcaacttcgcccacgtgatcttccagaacgtggccaagagctacctgcccaacgcccacctggagtgccactacaccctgaccccctacatccacccccaccccaaggactgggtgggcatcttcaaggtgggctggagcaccgccagagactactacaccttcctgtggagccccatgcccgagcactacgtggagggcagcaccgtgaactgcgtgctggccttccagggctactacctgcccaacgacgacggcgagttctaccagttctgctacgtgacccacaagggcgagatcagaggcgccagcacccccttccagttcagagccagcagccccgtggaggagctgctgaccatggaggacgagggcaacagcgacatgctggtggtgaccaccaaggccggcctgctggagctgaagatcgagaagaccatgaaggagaaggaggagctgctgaagctgatcgccgtgctggagaaggagaccgcccagctgagagagcaggtgggcagaatggagagagagctgaaccacgagaaggagagatgcgaccagctgcaggccgagcagaagggcctgaccgaggtgacccagagcctgaagatggagaacgaggagttcaagaagagattcagcgacgccaccagcaaggcccaccagctggaggaggacatcgtgagcgtgacccacaaggccatcgagaaggagaccgagctggacagcctgaaggacaagctgaagaaggcccagcacgagagagagcagctggagtgccagctgaagaccgagaaggacgagaaggagctgtacaaggtgcacctgaagaacaccgagatcgagaacaccaagctgatgagcgaggtgcagaccctgaagaacctggacggcaacaaggagagcgtgatcacccacttcaaggaggagatcggcagactgcagctgtgcctggccgagaaggagaacctgcagagaaccttcctgctgaccaccagcagcaaggaggacacctgcttcctgaaggagcagctgagaaaggccgaggagcaggtgcaggccaccagacaggaggtggtgttcctggccaaggagctgagcgacgccgtgaacgtgagagacagaaccatggccgacctgcacaccgccagactggagaacgagaaggtgaagaagcagctggccgacgccgtggccgagctgaagctgaacgccatgaagaaggaccaggacaagaccgacaccctggagcacgagctgagaagagaggtggaggacctgaagctgagactgcagatggccgccgaccactacaaggagaagttcaaggagtgccagagactgcagaagcagatcaacaagctgagcgaccagagcgccaacaacaacaacgtgttcaccaagaagaccggcaaccagcagaaggtgaacgacgccagcgtgaacaccgaccccgccaccagcgccagcaccgtggacgtgaagcccagccccagcgccgccgaggccgacttcgacatcgtgaccaagggccaggtgtgcgagatgaccaaggagatcgccgacaagaccgagaagtacaacaagtgcaagcagctgctgcaggacgagaaggccaagtgcaacaagtacgccgacgagctggccaagatggagctgaagtggaaggagcaggtgaagatcgccgagaacgtgaagctggagctggccgaggtgcaggacaactacaaggagctgaagagaagcctggagaaccccgccgagagaaagatggagggccagaacagccagagcccccagtgcttcaagacctgcagcgagcagaacggctacgtgctgaccctgagcaacgcccagcccgtgctgcagtacggcaacccctacgccagccaggagaccagagacggcgccgacggcgccttctaccccgacgagatccagagaccccccgtgagagtgcccagctggggcctggaggacaacgtggtgtgcagccagcccgccagaaacttcagcagacccgacggcctggaggacagcgaggacagcaaggaggacgagaacgtgcccaccgcccccgacccccccagccagcacctgagaggccacggcaccggcttctgcttcgacagcagcttcgacgtgcacaagaagtgccccctgtgcgagctgatgttcccccccaactacgaccagagcaagttcgaggagcacgtggagagccactggaaggtgtgccccatgtgcagcgagcagttcccccccgactacgaccagcaggtgttcgagagacacgtgcagacccacttcgaccagaacgtgctgaacttcgactag

SEQ ID NO: 101916 - DNA, 417 bp, Artificial Sequence
  Description of Artificial Sequence: Synthetic coding sequence
atgaccagcttccaggaggtgcccctgcagaccagcaacttcgcccacgtgatcttccagaacgtggccaagagctacctgcccaacgcccacctggagtgccactacaccctgaccccctacatccacccccaccccaaggactgggtgggcatcttcaaggtgggctggagcaccgccagagactactacaccttcctgtggagccccatgcccgagcactacgtggagggcagcaccgtgaactgcgtgctggccttccagggctactacctgcccaacgacgacggcgagttctaccagttctgctacgtgacccacaagggcgagatcagaggcgccagcacccccttccagttcagagccagcagccccgtggaggagctgctgaccatggaggacgagggcaacagctag

SEQ ID NO: 101917 - DNA, 297 bp, Artificial Sequence
  Description of Artificial Sequence: Synthetic coding sequence
atgaccagcttccaggaggtgcccctgcagaccagcaacttcgcccacgtgatcttccagaacgtggccaagagctacctgcccaacgcccacctggagtgccactacaccctgaccccctacatccacccccaccccaaggactgggtgggcatcttcaaggtgggctggagcaccgccagagactactacaccttcctgtggagccccatgcccgagcactacgtggagggcagcaccgtgaactgcgtgctggccttccagggctactacctgcccaacgacgacggcgagtag

SEQ ID NO: 101918 - DNA, 1773 bp, Artificial Sequence
  Description of Artificial Sequence: Synthetic coding sequence
atgaaggagaaggaggagctgctgaagctgatcgccgtgctggagaaggagaccgcccagctgagagagcaggtgggcagaatggagagagagctgaaccacgagaaggagagatgcgaccagctgcaggccgagcagaagggcctgaccgaggtgacccagagcctgaagatggagaacgaggagttcaagaagagattcagcgacgccaccagcaaggcccaccagctggaggaggacatcgtgagcgtgacccacaaggccatcgagaaggagaccgagctggacagcctgaaggacaagctgaagaaggcccagcacgagagagagcagctggagtgccagctgaagaccgagaaggacgagaaggagctgtacaaggtgcacctgaagaacaccgagatcgagaacaccaagctgatgagcgaggtgcagaccctgaagaacctggacggcaacaaggagagcgtgatcacccacttcaaggaggagatcggcagactgcagctgtgcctggccgagaaggagaacctgcagagaaccttcctgctgaccaccagcagcaaggaggacacctgcttcctgaaggagcagctgagaaaggccgaggagcaggtgcaggccaccagacaggaggtggtgttcctggccaaggagctgagcgacgccgtgaacgtgagagacagaaccatggccgacctgcacaccgccagactggagaacgagaaggtgaagaagcagctggccgacgccgtggccgagctgaagctgaacgccatgaagaaggaccaggacaagaccgacaccctggagcacgagctgagaagagaggtggaggacctgaagctgagactgcagatggccgccgaccactacaaggagaagttcaaggagtgccagagactgcagaagcagatcaacaagctgagcgaccagagcgccaacaacaacaacgtgttcaccaagaagaccggcaaccagcagaaggtgaacgacgccagcgtgaacaccgaccccgccaccagcgccagcaccgtggacgtgaagcccagccccagcgccgccgaggccgacttcgacatcgtgaccaagggccaggtgtgcgagatgaccaaggagatcgccgacaagaccgagaagtacaacaagtgcaagcagctgctgcaggacgagaaggccaagtgcaacaagtacgccgacgagctggccaagatggagctgaagtggaaggagcaggtgaagatcgccgagaacgtgaagctggagctggccgaggtgcaggacaactacaaggagctgaagagaagcctggagaaccccgccgagagaaagatggaggacggcgccgacggcgccttctaccccgacgagatccagagaccccccgtgagagtgcccagctggggcctggaggacaacgtggtgtgcagccagcccgccagaaacttcagcagacccgacggcctggaggacagcgaggacagcaaggaggacgagaacgtgcccaccgcccccgacccccccagccagcacctgagaggccacggcaccggcttctgcttcgacagcagcttcgacgtgcacaagaagtgccccctgtgcgagctgatgttcccccccaactacgaccagagcaagttcgaggagcacgtggagagccactggaaggtgtgccccatgtgcagcgagcagttcccccccgactacgaccagcaggtgttcgagagacacgtgcagacccacttcgaccagaacgtgctgaacttcgactag

SEQ ID NO: 101919 - DNA, 2244 bp, Artificial Sequence; identical to SEQ ID NO: 101914
  Description of Artificial Sequence: Synthetic coding sequence

SEQ ID NO: 101920 - DNA, 3480 bp, Artificial Sequence
  Description of Artificial Sequence: Synthetic coding sequence
atggagcccatcaccttcaccgccagaaagcacctgctgagcaacgaggtgagcgtggacttcggcctgcagctggtgggcagcctgcccgtgcacagcctgaccaccatgcccatgctgccctgggtggtggccgaggtgagaagactgagcagacagagcaccagaaaggagcccgtgaccaagcaggtgagactgtgcgtgagccccagcggcctgagatgcgagcccgagcccggcagaagccagcagtgggaccccctgatctacagcagcatcttcgagtgcaagccccagagagtgcacaagctgatccacaacagccacgaccccagctacttcgcctgcctgatcaaggaggacgccgtgcacagacagagcatctgctacgtgttcaaggccgacgaccagaccaaggtgcccgagatcatcagcagcatcagacaggccggcaagatcgccagacaggaggagctgcactgccccagcgagttcgacgacaccttcagcaagaagttcgaggtgctgttctgcggcagagtgaccgtggcccacaagaaggccccccccgccctgatcgacgagtgcatcgagaagttcaaccacgtgagcggcagcagaggcagcgagagccccagacccaaccccccccacgccgcccccaccggcagccaggagcccgtgagaagacccatgagaaagagcttcagccagcccggcctgagaagcctggccttcagaaaggagctgcaggacggcggcctgagaagcagcggcttcttcagcagcttcgaggagagcgacatcgagaaccacctgatcagcggccacaacatcgtgcagcccaccgacatcgaggagaacagaaccatgctgttcaccatcggccagagcgaggtgtacctgatcagccccgacaccaagaagatcgccctggagaagaacttcaaggagatcagcttctgcagccagggcatcagacacgtggaccacttcggcttcatctgcagagagagcagcggcggcggcggcttccacttcgtgtgctacgtgttccagtgcaccaacgaggccctggtggacgagatcatgatgaccctgaagcaggccttcaccgtggccgccgtgcagcagaccgccaaggcccccgcccagctgtgcgagggctgccccctgcagagcctgcacaagctgtgcgagagaatcgagggcatgaacagcagcaagaccaagctggagctgcagaagcacctgaccaccctgaccaaccaggagcaggccaccatcttcgaggaggtgcagaagctgagacccagaaacgagcagagagagaacgagctgatcatcagcttcctgagatgcctgtacgaggagaagcagaaggagcacatccacatcggcgagatgaagcagaccagccagatggccgccgagaacatcggcagcgagctgccccccagcgccaccagattcagactggacatgctgaagaacaaggccaagagaagcctgaccgagagcctggagagcatcctgagcagaggcaacaaggccagaggcctgcaggagcacagcatcagcgtggacctggacagcagcctgagcagcaccctgagcaacaccagcaaggagcccagcgtgtgcgagaaggaggccctgcccatcagcgagagcagcttcaagctgctgggcagcagcgaggacctgagcagcgacagcgagagccacctgcccgaggagcccgcccccctgagcccccagcaggccttcagaagaagagccaacaccctgagccacttccccatcgagtgccaggagcccccccagcccgccagaggcagccccggcgtgagccagagaaagctgatgagataccacagcgtgagcaccgagaccccccacgagagaaacgtggaccccagccccgtgggcgagagcaagcacagacccggccagagcagcgcccccgcccccccccccagactgaaccccagcgccagcagccccaacttcttcaagtacctgaagcacaacagcagcggcgagcagagcggcaacgccgtgcccaagagcatcagctacagaaacgccctgagaaagaagctgcacagcagcagcagcgtgcccaacttcctgaagttcctggcccccgtggacgagaacaacaccagcgacttcatgaacaccaagagagacttcgagagcaaggccaaccacctgggcgacagcggcggcacccccgtgaagaccagaagacacagctggagacagcagatcttcctgagagtggccaccccccagaaggcctgcgacagcagcagcagatacgaggactacagcgagctgggcgagctgccccccagaagccccctggagcccgtgtgcgaggacggccccttcggccccccccccgaggagaagaagagaaccagcagagagctgagagagctgtggcagaaggccatcctgcagcagatcctgctgctgagaatggagaaggagaaccagaagctgcaggccagcgagaacgacctgctgaacaagagactgaagctggactacgaggagatcaccccctgcctgaaggaggtgaccaccgtgtgggagaagatgctgagcacccccggcagaagcaagatcaagttcgacatggagaagatgcacagcgccgtgggccagggcgtgcccagacaccacagaggcgagatctggaagttcctggccgagcagttccacctgaagcaccagttccccagcaagcagcagcccaaggacgtgccctacaaggagctgctgaagcagctgaccagccagcagcacgccatcctgatcgacctgggcagaaccttccccacccacccctacttcagcgcccagctgggcgccggccagctgagcctgtacaacatcctgaaggcctacagcctgctggaccaggaggtgggctactgccagggcctgagcttcgtggccggcatcctgctgctgcacatgagcgaggaggaggccttcaagatgctgaagttcctgatgttcgacatgggcctgagaaagcagtacagacccgacatgatcatcctgcagatggagaagaccatcaaccaggtgttcgagatggacatcgccaagcagctgcaggcctacgaggtggagtaccacgtgctgcaggaggagctgatcgacagcagccccctgagcgacaaccagagaatggacaagctggagaagaccaacagcagcctgagaaagcagaacctggacctgctggagcagctgcaggtggccaacggcagaatccagagcctggaggccaccatcgagaagctgctgagcagcgagagcaagctgaagcaggccatgctgaccctggagctggagagaagcgccctgctgcagaccgtggaggagctgagaagaagaagcgccgagcccagcgacagagagcccgagtgcacccagcccgagcccaccggcgactag

SEQ ID NO: 101921 - DNA, 3507 bp, Artificial Sequence
  Description of Artificial Sequence: Synthetic coding sequence
atggagcccatcaccttcaccgccagaaagcacctgctgagcaacgaggtgagcgtggacttcggcctgcagctggtgggcagcctgcccgtgcacagcctgaccaccatgcccatgctgccctgggtggtggccgaggtgagaagactgagcagacagagcaccagaaaggagcccgtgaccaagcaggtgagactgtgcgtgagccccagcggcctgagatgcgagcccgagcccggcagaagccagcagtgggaccccctgatctacagcagcatcttcgagtgcaagccccagagagtgcacaagctgatccacaacagccacgaccccagctacttcgcctgcctgatcaaggaggacgccgtgcacagacagagcatctgctacgtgttcaaggccgacgaccagaccaaggtgcccgagatcatcagcagcatcagacaggccggcaagatcgccagacaggaggagctgcactgccccagcgagttcgacgacaccttcagcaagaagttcgaggtgctgttctgcggcagagtgaccgtggcccacaagaaggccccccccgccctgatcgacgagtgcatcgagaagttcaaccacgtgagcggcagcagaggcagcgagagccccagacccaaccccccccacgccgcccccaccggcagccaggagcccgtgagaagacccatgagaaagagcttcagccagcccggcctgagaagcctggccttcagaaaggagctgcaggacggcggcctgagaagcagcggcttcttcagcagcttcgaggagagcgacatcgagaaccacctgatcagcggccacaacatcgtgcagcccaccgacatcgaggagaacagaaccatgctgttcaccatcggccagagcgaggtgtacctgatcagccccgacaccaagaagatcgccctggagaagaacttcaaggagatcagcttctgcagccagggcatcagacacgtggaccacttcggcttcatctgcagagagagcagcggcggcggcggcttccacttcgtgtgctacgtgttccagtgcaccaacgaggccctggtggacgagatcatgatgaccctgaagcaggccttcaccgtggccgccgtgcagcagaccgccaaggcccccgcccagctgtgcgagggctgccccctgcagagcctgcacaagctgtgcgagagaatcgagggcatgaacagcagcaagaccaagctggagctgcagaagcacctgaccaccctgaccaaccaggagcaggccaccatcttcgaggaggtgcagaagctgagacccagaaacgagcagagagagaacgagctgatcatcagcttcctgagatgcctgtacgaggagaagcagaaggagcacatccacatcggcgagatgaagcagaccagccagatggccgccgagaacatcggcagcgagctgccccccagcgccaccagattcagactggacatgctgaagaacaaggccaagagaagcctgaccgagagcctggagagcatcctgagcagaggcaacaaggccagaggcctgcaggagcacagcatcagcgtggacctggacagcagcctgagcagcaccctgagcaacaccagcaaggagcccagcgtgtgcgagaaggaggccctgcccatcagcgagagcagcttcaagctgctgggcagcagcgaggacctgagcagcgacagcgagagccacctgcccgaggagcccgcccccctgagcccccagcaggccttcagaagaagagccaacaccctgagccacttccccatcgagtgccaggagcccccccagcccgccagaggcagccccggcgtgagccagagaaagctgatgagataccacagcgtgagcaccgagaccccccacgagagaaaggacttcgagagcaaggccaaccacctgggcgacagcggcggcacccccgtgaagaccagaagacacagctggagacagcagatcttcctgagagtggccaccccccagaaggcctgcgacagcagcagcagatacgaggactacagcgagctgggcgagctgccccccagaagccccctggagcccgtgtgcgaggacggccccttcggccccccccccgaggagaagaagagaaccagcagagagctgagagagctgtggcagaaggccatcctgcagcagatcctgctgctgagaatggagaaggagaaccagaagctgcaggccagcgagaacgacctgctgaacaagagactgaagctggactacgaggagatcaccccctgcctgaaggaggtgaccaccgtgtgggagaagatgctgagcacccccggcagaagcaagatcaagttcgacatggagaagatgcacagcgccgtgggccagggcgtgcccagacaccacagaggcgagatctggaagttcctggccgagcagttccacctgaagcaccagttccccagcaagcagcagcccaaggacgtgccctacaaggagctgctgaagcagctgaccagccagcagcacgccatcctgatcgacctgggcagaaccttccccacccacccctacttcagcgcccagctgggcgccggccagctgagcctgtacaacatcctgaaggcctacagcctgctggaccaggaggtgggctactgccagggcctgagcttcgtggccggcatcctgctgctgcacatgagcgaggaggaggccttcaagatgctgaagttcctgatgttcgacatgggcctgagaaagcagtacagacccgacatgatcatcctgcagatccagatgtaccagctgagcagactgctgcacgactaccacagagacctgtacaaccacctggaggagcacgagatcggccccagcctgtacgccgccccctggttcctgaccatgttcgccagccagttccccctgggcttcgtggccagagtgttcgacatgatcttcctgcagggcaccgaggtgatcttcaaggtggccctgagcctgctgggcagccacaagcccctgatcctgcagcacgagaacctggagaccatcgtggacttcatcaagagcaccctgcccaacctgggcctggtgcagatggagaagaccatcaaccaggtgttcgagatggacatcgccaagcagctgcaggcctacgaggtggagtaccacgtgctgcaggaggagctgatcgacagcagccccctgagcgacaaccagagaatggacaagctggagaagaccaacagcagcctgagaaagcagaacctggacctgctggagcagctgcaggtggccaacggcagaatccagagcctggaggccaccatcgagaagctgctgagcagcgagagcaagctgaagcaggccatgctgaccctggagctggagagaagcgccctgctgcagaccgtggaggagctgagaagaagaagcgccgagcccagcgacagagagcccgagtgcacccagcccgagcccaccggcgactag

SEQ ID NO: 101922 - DNA, 1299 bp, Artificial Sequence
  Description of Artificial Sequence: Synthetic coding sequence
atggagaaggagaaccagaagctgcaggccagcgagaacgacctgctgaacaagagactgaagctggactacgaggagatcaccccctgcctgaaggaggtgaccaccgtgtgggagaagatgctgagcacccccggcagaagcaagatcaagttcgacatggagaagatgcacagcgccgtgggccagggcgtgcccagacaccacagaggcgagatctggaagttcctggccgagcagttccacctgaagcaccagttccccagcaagcagcagcccaaggacgtgccctacaaggagctgctgaagcagctgaccagccagcagcacgccatcctgatcgacctgggcagaaccttccccacccacccctacttcagcgcccagctgggcgccggccagctgagcctgtacaacatcctgaaggcctacagcctgctggaccaggaggtgggctactgccagggcctgagcttcgtggccggcatcctgctgctgcacatgagcgaggaggaggccttcaagatgctgaagttcctgatgttcgacatgggcctgagaaagcagtacagacccgacatgatcatcctgcagatccagatgtaccagctgagcagactgctgcacgactaccacagagacctgtacaaccacctggaggagcacgagatcggccccagcctgtacgccgccccctggttcctgaccatgttcgccagccagttccccctgggcttcgtggccagagtgttcgacatgatcttcctgcagggcaccgaggtgatcttcaaggtggccctgagcctgctgggcagccacaagcccctgatcctgcagcacgagaacctggagaccatcgtggacttcatcaagagcaccctgcccaacctgggcctggtgcagatggagaagaccatcaaccaggtgttcgagatggacatcgccaagcagctgcaggcctacgaggtggagtaccacgtgctgcaggaggagctgatcgacagcagccccctgagcgacaaccagagaatggacaagctggagaagaccaacagcagcctgagaaagcagaacctggacctgctggagcagctgcaggtggccaacggcagaatccagagcctggaggccaccatcgagaagctgctgagcagcgagagcaagctgaagcaggccatgctgaccctggagctggagagaagcgccctgctgcagaccgtggaggagctgagaagaagaagcgccgagcccagcgacagagagcccgagtgcacccagcccgagcccaccggcgactag

SEQ ID NO: 101923 - DNA, 933 bp, Artificial Sequence
  Description of Artificial Sequence: Synthetic coding sequence
atggcccaggccctgggcgaggacctggtgcagccccccgagctgcaggacgacagcagcagcctgggcagcgacagcgagctgagcggccccggcccctacagacaggccgacagatacggcttcatcggcggcagcagcgccgagcccggccccggccacccccccgccgacctgatcagacagagagagatgaagtgggtggagatgaccagccactgggagaagaccatgagcagaagatacaagaaggtgaagatgcagtgcagaaagggcatccccagcgccctgagagccagatgctggcccctgctgtgcggcgcccacgtgtgccagaagaacagccccggcacctaccaggagctggccgaggcccccggcgacccccagtggatggagaccatcggcagagacctgcacagacagttccccctgcacgagatgttcgtgagcccccagggccacggcagaggcagctgcagatgcagcagacccaccccctgcatcgacagaagcagagccaccgccagacccagaggcccctggctgctgtgctgcagctgcacctgcccccagagaagacccagcggcgcctggtgcagaagcgtgagaagcaccagcctgggcaccaccggccccacctggtgccagagcaccgtgccctgcggcgccgacaccggcgcccccggcgccggccactgcagagccgccagaggcctgccctggccccccggcgacaccggcagccccagcagccacccccccagagccgccgccggcggcggcctgcacgtgaccggcgcccagagaggcgccgtgagagccggccccgccgccggcgaccagggccccgccggccccgccgccagattcagagccggcacccccgcccccgccaccggcccccccagaagaggccccagccacctgtag

SEQ ID NO: 101924 - DNA, 1662 bp, Artificial Sequence
  Description of Artificial Sequence: Synthetic coding sequence
atggacagccccggctacaactgcttcgtggacaaggacaagatggacgccgccatccaggacctgggccccaaggagctgagctgcaccgagctgcaggagctgaagcagctggccagacagggctactgggcccagagccacgccctgagaggcaaggtgtaccagagactgatcagagacatcccctgcagaaccgtgacccccgacgccagcgtgtacagcgacatcgtgggcaagatcgtgggcaagcacagcagcagctgcctgcccctgcccgagttcgtggacaacacccaggtgcccagctactgcctgaacgccagaggcgagggcgccgtgagaaagatcctgctgtgcctggccaaccagttccccgacatcagcttctgccccgccctgcccgccgtggtggccctgctgctgcactacagcatcgacgaggccgagtgcttcgagaaggcctgcagaatcctggcctgcaacgaccccggcagaagactgatcgaccagagcttcctggccttcgagagcagctgcatgaccttcggcgacctggtgaacaagtactgccaggccgcccacaagctgatggtggccgtgagcgaggacgtgctgcaggtgtacgccgactggcagagatggctgttcggcgagctgcccctgtgctacttcgccagagtgttcgacgtgttcctggtggagggctacaaggtgctgtacagagtggccctggccatcctgaagttcttccacaaggtgagagccggccagcccctggagagcgacagcgtgaagcaggacatcagaaccttcgtgagagacatcgccaagaccgtgagccccgagaagctgctggagaaggccttcgccatcagactgttcagcagaaaggagatccagctgctgcagatggccaacgagaaggccctgaagcagaagggcatcaccgtgaagcagaagagacagttcgtgcacctggccgtgcacgccgagaacttcagaagcgagatcgtgagcgtgagagagatgagagacatctggagctgggtgcccgagagattcgccctgtgccagcccctgctgctgttcagcagcctgcagcacggctacagcctggccagattctacttccagtgcgagggccacgagcccaccctgctgctgatcaagaccacccagaaggaggtgtgcggcgcctacctgagcaccgactggagcgagagaaacaagttcggcggcaagctgggcttcttcggcaccggcgagtgcttcgtgttcagactgcagcccgaggtgcagagatacgagtgggtggtgatcaagcaccccgagctgaccaagcccccccccctgatggccgccgagcccaccgcccccctgagccacagcgccagcagcgaccccgccgacagactgagccccttcctggccgccagacacttcaacctgcccagcaagaccgagagcatgttcatggccggcggcagcgactgcctgatcgtgggcggcggcggcggccaggccctgtacatcgacggcgacctgaacagaggcagaaccagccactgcgacaccttcaacaaccagcccctgtgcagcgagaacttcctgatcgccgccgtggaggcctggggcttccaggaccccgacacccagtag

SEQ ID NO: 101925 - DNA, 759 bp, Artificial Sequence
  Description of Artificial Sequence: Synthetic coding sequence
atgggcgtgctgctgacccagagaaccctgctgagcctggtgctggccctgctgttccccagcatggccagcatggccgccatcggcagctgcagcaaggagtacagagtgctgctgggccagctgcagaagcagaccgacctgatgcaggacaccagcagactgctggacccctacatcagaatccagggcctggacgtgcccaagctgagagagcactgcagagagagacccggcgccttccccagcgaggagaccctgagaggcctgggcagaagaggcttcctgcagaccctgaacgccaccctgggctgcgtgctgcacagactggccgacctggagcagagactgcccaaggcccaggacctggagagaagcggcctgaacatcgaggacctggagaagctgcagatggccagacccaacatcctgggcctgagaaacaacatctactgcatggcccagctgctggacaacagcgacaccgccgagcccaccaaggccggcagaggcgccagccagccccccacccccacccccgccagcgacgccttccagagaaagctggagggctgcagattcctgcacggctaccacagattcatgcacagcgtgggcagagtgttcagcaagtggggcgagagccccaacagaagcagaagacacagcccccaccaggccctgagaaagggcgtgagaagaaccagacccagcagaaagggcaagagactgatgaccagaggccagctgcccagatag

SEQ ID NO: 101926 - DNA, 1263 bp, Artificial Sequence
  Description of Artificial Sequence: Synthetic coding sequence
atgctgaacaactgggacaagtggatggccaagaagcacaagaagatcagactgagatgccagaagggcatcccccccagcctgagaggcagagcctggcagtacctgagcggcggcaaggtgaagctgcagcagaaccccggcaagttcgacgagctggacatgagccccggcgaccccaagtggctggacgtgatcgagagagacctgcacagacagttccccttccacgagatgttcgtgagcagaggcggccacggccagcaggacctgttcagagtgctgaaggcctacaccctgtacagacccgaggagggctactgccaggcccaggcccccatcgccgccgtgctgctgatgcacatgcccgccgagcaggccttctggtgcctggtgcagatctgcgagaagtacctgcccggctactacagcgagaagctggaggccatccagctggacggcgagatcctgttcagcctgctgcagaaggtgagccccgtggcccacaagcacctgagcagacagaagatcgaccccctgctgtacatgaccgagtggttcatgtgcgccttcagcagaaccctgccctggagcagcgtgctgagagtgtgggacatgttcttctgcgagggcgtgaagatcatcttcagagtgggcctggtgctgctgaagcacgccctgggcagccccgagaaggtgaaggcctgccagggccagtacgagaccatcgagagactgagaagcctgagccccaagatcatgcaggaggccttcctggtgcaggaggtggtggagctgcccgtgaccgagagacagatcgagagagagcacctgatccagctgagaagatggcaggagaccagaggcgagctgcagtgcagaagcccccccagactgcacggcgccaaggccatcctggacgccgagcccggccccagacccgccctgcagcccagccccagcatcagactgcccctggacgcccccctgcccggcagcaaggccaagcccaagccccccaagcaggcccagaaggagcagagaaagcagatgaagggcagaggccagctggagaagccccccgcccccaaccaggccatggtggtggccgccgccggcgacgcctgccccccccagcacgtgccccccaaggacagcgcccccaaggacagcgccccccaggacctggccccccaggtgagcgcccaccacagaagccaggagagcctgaccagccaggagagcgaggacacctacctgtag

SEQ ID NO: 101927 - DNA, 1548 bp, Artificial Sequence
  Description of Artificial Sequence: Synthetic coding sequence
atggccaagagcaacggcgagaacggccccagagcccccgccgccggcgagagcctgagcggcaccagagagagcctggcccagggccccgacgccgccaccaccgacgagctgagcagcctgggcagcgacagcgaggccaacggcttcgccgagagaagaatcgacaagttcggcttcatcgtgggcagccagggcgccgagggcgccccctgccccctgctgcacagactggaggaggtgcccctggaggtgctgagacagagagagagcaagtggctggacatgctgaacaactgggacaagtggatggccaagaagcacaagaagatcagactgagatgccagaagggcatcccccccagcctgagaggcagagcctggcagtacctgagcggcggcaaggtgaagctgcagcagaaccccggcaagttcgacgagctggacatgagccccggcgaccccaagtggctggacgtgatcgagagagacctgcacagacagttccccttccacgagatgttcgtgagcagaggcggccacggccagcaggacctgttcagagtgctgaaggcctacaccctgtacagacccgaggagggctactgccaggcccaggcccccatcgccgccgtgctgctgatgcacatgcccgccgagcaggccttctggtgcctggtgcagatctgcgagaagtacctgcccggctactacagcgagaagctggaggccatccagctggacggcgagatcctgttcagcctgctgcagaaggtgagccccgtggcccacaagcacctgagcagacagaagatcgaccccctgctgtacatgaccgagtggttcatgtgcgccttcagcagaaccctgccctggagcagcgtgctgagagtgtgggacatgttcttctgcgagggcgtgaagatcatcttcagagtgggcctggtgctgctgaagcacgccctgggcagccccgagaaggtgaaggcctgccagggccagtacgagaccatcgagagactgagaagcctgagccccaagatcatgcaggaggccttcctggtgcaggaggtggtggagctgcccgtgaccgagagacagatcgagagagagcacctgatccagctgagaagatggcaggagaccagaggcgagctgcagtgcagaagcccccccagactgcacggcgccaaggccatcctggacgccgagcccggccccagacccgccctgcagcccagccccagcatcagactgcccctggacgcccccctgcccggcagcaaggccaagcccaagccccccaagcaggcccagaaggagcagagaaagcagatgaagggcagaggccagctggagaagccccccgcccccaaccaggccatggtggtggccgccgccggcgacgcctgccccccccagcacgtgccccccaaggacagcgcccccaaggacagcgccccccaggacctggccccccaggtgagcgcccaccacagaagccaggagagcctgaccagccaggagagcgaggacacctacctgtag

SEQ ID NO: 101928 - DNA, 2427 bp, Artificial Sequence
  Description of Artificial Sequence: Synthetic coding sequence
atggagaccggcaccgcccccctggtggccccccccagaagacacggcgcccccgccgcccccagccccccccccagaggcagcagagccggccccgtggtggtggtggcccccggcccccccgtgaccaccgccaccagcgcccccgtgaccctggtggcccccggcgaggccagacccgcctgggtgcccggcagcgccgagaccagcgcccccgcccccgcccccgcccccgcccccgcccccgccgtgaccggcagcaccgtggtggtgctgaccctggaggccagccccgaggcccccaagccccagctgcccagcggccccgagagccccgagcccgccgccgtggccggcgtggagaccagcagagccctggccgccggcgccgacagccccaagaccgaggaggccagacccagccccgcccccggccccggcacccccaccggcacccccaccagaacccccagcagaaccgcccccggcgccctgaccgccaagccccccctggcccccaagcccggcaccaccgtggccagcggcgtgaccgccagaagcgccagcggccaggtgaccggcggccacggcgccgccgccgccaccagcgccagcgccggccaggcccccgaggaccccagcggccccggcaccggccccagcggcacctgcgaggcccccgtggccgtggtgaccgtgacccccgcccccgagcccgccgagaacagccaggacctgggcagcaccagcagcctgggccccggcatcagcggccccagaggccaggcccccgacaccctgagctacctggacagcgtgagcctgatgagcggcaccctggagagcctggccgacgacgtgagcagcatgggcagcgacagcgagatcaacggcctggccctgagaaagaccgacaagtacggcttcctgggcggcagccagtacagcggcagcctggagagcagcatccccgtggacgtggccagacagagagagctgaagtggctggacatgttcagcaactgggacaagtggctgagcagaagattccagaaggtgaagctgagatgcagaaagggcatccccagcagcctgagagccaaggcctggcagtacctgagcaacagcaaggagctgctggagcagaaccccggcaagttcgaggagctggagagagcccccggcgaccccaagtggctggacgtgatcgagaaggacctgcacagacagttccccttccacgagatgttcgccgccagaggcggccacggccagcaggacctgtacagaatcctgaaggcctacaccatctacagacccgacgagggctactgccaggcccaggcccccgtggccgccgtgctgctgatgcacatgcccgccgagcaggccttctggtgcctggtgcagatctgcgacaagtacctgcccggctactacagcgccggcctggaggccatccagctggacggcgagatcttcttcgccctgctgagaagagccagccccctggcccacagacacctgagaagacagagaatcgaccccgtgctgtacatgaccgagtggttcatgtgcatcttcgccagaaccctgccctgggccagcgtgctgagagtgtgggacatgttcttctgcgagggcgtgaagatcatcttcagagtggccctggtgctgctgagacacaccctgggcagcgtggagaagctgagaagctgccagggcatgtacgagaccatggagcagctgagaaacctgccccagcagtgcatgcaggaggacttcctggtgcacgaggtgaccaacctgcccgtgaccgaggccctgatcgagagagagaacgccgcccagctgaagaagtggagagagaccagaggcgagctgcagtacagacccagcagaagactgcacggcagcagagccatccacgaggagagaagaagacagcagccccccctgggccccagcagcagcctgctgagcctgcccggcctgaagagcagaggcagcagagccgccggcggcgcccccagcccccccccccccgtgagaagagccagcgccggccccgcccccggccccgtggtgaccgccgagggcctgcaccccagcctgcccagccccaccggcaacagcacccccctgggcagcagcaaggagaccagaaagcaggagaaggagagacagaagcaggagaaggagagacagaagcaggagaaggagagagagaaggagagacagaagcaggagaaggagagagagaagcaggagaaggagagagagaagcaggagaaggagagacagaagcaggagaagaaggcccagggcagaaagctgagcctgagaagaaaggccgacggcccccccggcccccacgacggcggcgacagacccagcgccgaggccagacaggacgcctacttctag

SEQ ID NO: 101929 - DNA, 1341 bp, Artificial Sequence
  Description of Artificial Sequence: Synthetic coding sequence
atggcccaggccctgggcgaggacctggtgcagccccccgagctgcaggacgacagcagcagcctgggcagcgacagcgagctgagcggccccggcccctacagacaggccgacagatacggcttcatcggcggcagcagcgccgagcccggccccggccacccccccgccgacctgatcagacagagagagatgaagtgggtggagatgaccagccactgggagaagaccatgagcagaagatacaagaaggtgaagatgcagtgcagaaagggcatccccagcgccctgagagccagatgctggcccctgctgtgcggcgcccacgtgtgccagaagaacagccccggcacctaccaggagctggccgaggcccccggcgacccccagtggatggagaccatcggcagagacctgcacagacagttccccctgcacgagatgttcgtgagcccccagggccacggccagcagggcctgctgcaggtgctgaaggcctacaccctgtacagacccgagcagggctactgccaggcccagggccccgtggccgccgtgctgctgatgcacctgccccccgaggaggccttctggtgcctggtgcagatctgcgaggtgtacctgcccggctactacggcccccacatggaggccgtgagactggacgccgaggtgttcatggccctgctgagaagactgctgccccacgtgcacaagcacctgcagcaggtgggcgtgggccccctgctgtacctgcccgagtggttcctgtgcctgttcgccagaagcctgcccttccccaccgtgctgagagtgtgggacgccttcctgagcgagggcgccagagtgctgttcagagtgggcctgaccctggtgagactggccctgggcaccgccgagcagagaggcgcctgccccggcctgctggagaccctgggcgccctgagagccatcccccccgcccagctgcaggaggaggccttcatgagccaggtgcacagcgtggtgctgagcgagagagacctgcagagagagatcaaggcccagctggcccagctgcccgacagcgcccccggccccccccccagaccccaggtgagactggccggcgcccaggccatcttcgaggcccagcagctggccggcgtgagaagaggcgccaagcccgaggtgcccagaatcgtggtgcagccccccgaggagcccagaccccccagaagaaagccccagaccagaggcaagaccttccacggcctgctgaccagagccagaggcccccccatcgagggcccccccagaccccagagaggcagcaccagcttcctggacaccagattctag

SEQ ID NO: 101930 - DNA, 1341 bp, Artificial Sequence; identical to SEQ ID NO: 101929
  Description of Artificial Sequence: Synthetic coding sequence

SEQ ID NO: 101931 - DNA, 2049 bp, Artificial Sequence
  Description of Artificial Sequence: Synthetic coding sequence
atgtgccccggcctgtacccctacagcagcctgctggagtacggcagaagcatgatcatctacgagcaggagggcgtgtacatccacagcagctgcggcaagaccaacgaccaggacggcctgatcagcggcatcctgagagtgctggagaaggacgccgaggtgatcgtggactggagacccctggacgacgccctggacagcagcagcatcctgtacgccagaaaggacagcagcagcgtggtggagtggacccaggcccccaaggagagaggccacagaggcagcgagcacctgaacagctacgaggccgagtgggacatggtgaacaccgtgagcttcaagagaaagccccacaccaacggcgacgcccccagccacagaaacggcaagagcaagtggagcttcctgttcagcctgaccgacctgaagagcatcaagcagaacaaggagggcatgggctggagctacctggtgttctgcctgaaggacgacgtggtgctgcccgccctgcacttccaccagggcgacagcaagctgctgatcgagagcctggagaagtacgtggtgctgtgcgagagcccccaggacaagagaaccctgctggtgaactgccagaacaagagcctgagccagagcttcgagaacctgctggacgagcccgcctacggcctgatccagaagatcaagaaggacccctacaccgccaccatgatcggcttcagcaaggtgaccaactacatcttcgacagcctgagaggcagcgaccccagcacccaccagagaccccccagcgagatggccgacttcctgagcgacgccatccccggcctgaagatcaaccagcaggaggagcccggcttcgaggtgatcaccagaatcgacctgggcgagagacccgtggtgcagagaagagagcccgtgagcctggaggagtggaccaagaacatcgacagcgagggcagaatcctgaacgtggacaacatgaagcagatgatcttcagaggcggcctgagccacgccctgagaaagcaggcctggaagttcctgctgggctacttcccctgggacagcaccaaggaggagagaacccagctgcagaagcagaagaccgacgagtacttcagaatgaagctgcagtggaagagcatcagccaggagcaggagaagagaaacagcagactgagagactacagaagcctgatcgagaaggacgtgaacagaaccgacagaaccaacaagttctacgagggccaggacaaccccggcctgatcctgctgcacgacatcctgatgacctactgcatgtacgacttcgacctgggctacgtgcagggcatgagcgacctgctgagccccctgctgtacgtgatggagaacgaggtggacgccttctggtgcttcgccagctacatggaccagatgcaccagaacttcgaggagcagatgcagggcatgaagacccagctgatccagctgagcaccctgctgagactgctggacagcggcttctgcagctacctggagagccaggacagcggctacctgtacttctgcttcagatggctgctgatcagattcaagagagagttcagcttcctggacatcctgagactgtgggaggtgatgtggaccgagctgccctgcaccaacttccacctgctgctgtgctgcgccatcctggagagcgagaagcagcagatcatggagaagcactacggcttcaacgagatcctgaagcacatcaacgagctgagcatgaagatcgacgtggaggacatcctgtgcaaggccgaggccatcagcctgcagatggtgaagtgcaaggagctgccccaggccgtgtgcgagatcctgggcctgcagggcagcgaggtgaccacccccgacagcgacgtgggcgaggacgagaacgtggtgatgaccccctgccccaccagcgccttccagagcaacgccctgcccaccctgagcgccagcggcgccagaaacgacagccccacccagatccccgtgagcagcgacgtgtgcagactgacccccgcctag

SEQ ID NO: 101932 - DNA, 1338 bp, Artificial Sequence
  Description of Artificial Sequence: Synthetic coding sequence
atgatcggcttcagcaaggtgaccaactacatcttcgacagcctgagaggcagcgaccccagcacccaccagagaccccccagcgagatggccgacttcctgagcgacgccatccccggcctgaagatcaaccagcaggaggagcccggcttcgaggtgatcaccagaatcgacctgggcgagagacccgtggtgcagagaagagagcccgtgagcctggaggagtggaccaagaacatcgacagcgagggcagaatcctgaacgtggacaacatgaagcagatgatcttcagaggcggcctgagccacgccctgagaaagcaggcctggaagttcctgctgggctacttcccctgggacagcaccaaggaggagagaacccagctgcagaagcagaagaccgacgagtacttcagaatgaagctgcagtggaagagcatcagccaggagcaggagaagagaaacagcagactgagagactacagaagcctgatcgagaaggacgtgaacagaaccgacagaaccaacaagttctacgagggccaggacaaccccggcctgatcctgctgcacgacatcctgatgacctactgcatgtacgacttcgacctgggctacgtgcagggcatgagcgacctgctgagccccctgctgtacgtgatggagaacgaggtggacgccttctggtgcttcgccagctacatggaccagatgcaccagaacttcgaggagcagatgcagggcatgaagacccagctgatccagctgagcaccctgctgagactgctggacagcggcttctgcagctacctggagagccaggacagcggctacctgtacttctgcttcagatggctgctgatcagattcaagagagagttcagcttcctggacatcctgagactgtgggaggtgatgtggaccgagctgccctgcaccaacttccacctgctgctgtgctgcgccatcctggagagcgagaagcagcagatcatggagaagcactacggcttcaacgagatcctgaagcacatcaacgagctgagcatgaagatcgacgtggaggacatcctgtgcaaggccgaggccatcagcctgcagatggtgaagtgcaaggagctgccccaggccgtgtgcgagatcctgggcctgcagggcagcgaggtgaccacccccgacagcgacgtgggcgaggacgagaacgtggtgatgaccccctgccccaccagcgccttccagagcaacgccctgcccaccctgagcgccagcggcgccagaaacgacagccccacccagatccccgtgagcagcgacgtgtgcagactgacccccgcctag

SEQ ID NO: 101933 - DNA, 2025 bp, Artificial Sequence
  Description of Artificial Sequence: Synthetic coding sequence
atggccgccgccggcgtggtgagcggcaagatcatctacgagcaggagggcgtgtacatccacagcagctgcggcaagaccaacgaccaggacggcctgatcagcggcatcctgagagtgctggagaaggacgccgaggtgatcgtggactggagacccctggacgacgccctggacagcagcagcatcctgtacgccagaaaggacagcagcagcgtggtggagtggacccaggcccccaaggagagaggccacagaggcagcgagcacctgaacagctacgaggccgagtgggacatggtgaacaccgtgagcttcaagagaaagccccacaccaacggcgacgcccccagccacagaaacggcaagagcaagtggagcttcctgttcagcctgaccgacctgaagagcatcaagcagaacaaggagggcatgggctggagctacctggtgttctgcctgaaggacgacgtggtgctgcccgccctgcacttccaccagggcgacagcaagctgctgatcgagagcctggagaagtacgtggtgctgtgcgagagcccccaggacaagagaaccctgctggtgaactgccagaacaagagcctgagccagagcttcgagaacctgctggacgagcccgcctacggcctgatccagaagatcaagaaggacccctacaccgccaccatgatcggcttcagcaaggtgaccaactacatcttcgacagcctgagaggcagcgaccccagcacccaccagagaccccccagcgagatggccgacttcctgagcgacgccatccccggcctgaagatcaaccagcaggaggagcccggcttcgaggtgatcaccagaatcgacctgggcgagagacccgtggtgcagagaagagagcccgtgagcctggaggagtggaccaagaacatcgacagcgagggcagaatcctgaacgtggacaacatgaagcagatgatcttcagaggcggcctgagccacgccctgagaaagcaggcctggaagttcctgctgggctacttcccctgggacagcaccaaggaggagagaacccagctgcagaagcagaagaccgacgagtacttcagaatgaagctgcagtggaagagcatcagccaggagcaggagaagagaaacagcagactgagagactacagaagcctgatcgagaaggacgtgaacagaaccgacagaaccaacaagttctacgagggccaggacaaccccggcctgatcctgctgcacgacatcctgatgacctactgcatgtacgacttcgacctgggctacgtgcagggcatgagcgacctgctgagccccctgctgtacgtgatggagaacgaggtggacgccttctggtgcttcgccagctacatggaccagatgcaccagaacttcgaggagcagatgcagggcatgaagacccagctgatccagctgagcaccctgctgagactgctggacagcggcttctgcagctacctggagagccaggacagcggctacctgtacttctgcttcagatggctgctgatcagattcaagagagagttcagcttcctggacatcctgagactgtgggaggtgatgtggaccgagctgccctgcaccaacttccacctgctgctgtgctgcgccatcctggagagcgagaagcagcagatcatggagaagcactacggcttcaacgagatcctgaagcacatcaacgagctgagcatgaagatcgacgtggaggacatcctgtgcaaggccgaggccatcagcctgcagatggtgaagtgcaaggagctgccccaggccgtgtgcgagatcctgggcctgcagggcagcgaggtgaccacccccgacagcgacgtgggcgaggacgagaacgtggtgatgaccccctgccccaccagcgccttccagagcaacgccctgcccaccctgagcgccagcggcgccagaaacgacagccccacccagatccccgtgagcagcgacgtgtgcagactgacccccgcctag

SEQ ID NO: 101934 - DNA, 2076 bp, Artificial Sequence
  Description of Artificial Sequence: Synthetic coding sequence
atggccgccgccggcgtggtgagcggcaagatcatctacgagcaggagggcgtgtacatccacagcagctgcggcaagaccaacgaccaggacggcctgatcagcggcatcctgagagtgctggagaaggacgccgaggtgatcgtggactggagacccctggacgacgccctggacagcagcagcatcctgtacgccagaaaggacagcagcagcgtggtggagtggacccaggcccccaaggagagaggccacagaggcagcgagcacctgaacagctacgaggccgagtgggacatggtgaacaccgtgagcttcaagagaaagccccacaccaacggcgacgcccccagccacagaaacggcaagagcaagtggagcttcctgttcagcctgaccgacctgaagagcatcaagcagaacaaggagggcatgggctggagctacctggtgttctgcctgaaggacgacgtggtgctgcccgccctgcacttccaccagggcgacagcaagctgctgatcgagagcctggagaagtacgtggtgctgtgcgagagcccccaggacaagagaaccctgctggtgaactgccagaacaagagcctgagccagagcttcgagaacctgctggacgagcccgcctacggcctgatccaggccggcctgctggacagaagaaagctgctgtgggccatccaccactggaagaagatcaagaaggacccctacaccgccaccatgatcggcttcagcaaggtgaccaactacatcttcgacagcctgagaggcagcgaccccagcacccaccagagaccccccagcgagatggccgacttcctgagcgacgccatccccggcctgaagatcaaccagcaggaggagcccggcttcgaggtgatcaccagaatcgacctgggcgagagacccgtggtgcagagaagagagcccgtgagcctggaggagtggaccaagaacatcgacagcgagggcagaatcctgaacgtggacaacatgaagcagatgatcttcagaggcggcctgagccacgccctgagaaagcaggcctggaagttcctgctgggctacttcccctgggacagcaccaaggaggagagaacccagctgcagaagcagaagaccgacgagtacttcagaatgaagctgcagtggaagagcatcagccaggagcaggagaagagaaacagcagactgagagactacagaagcctgatcgagaaggacgtgaacagaaccgacagaaccaacaagttctacgagggccaggacaaccccggcctgatcctgctgcacgacatcctgatgacctactgcatgtacgacttcgacctgggctacgtgcagggcatgagcgacctgctgagccccctgctgtacgtgatggagaacgaggtggacgccttctggtgcttcgccagctacatggaccagatgcaccagaacttcgaggagcagatgcagggcatgaagacccagctgatccagctgagcaccctgctgagactgctggacagcggcttctgcagctacctggagagccaggacagcggctacctgtacttctgcttcagatggctgctgatcagattcaagagagagttcagcttcctggacatcctgagactgtgggaggtgatgtggaccgagctgccctgcaccaacttccacctgctgctgtgctgcgccatcctggagagcgagaagcagcagatcatggagaagcactacggcttcaacgagatcctgaagcacatcaacgagctgagcatgaagatcgacgtggaggacatcctgtgcaaggccgaggccatcagcctgcagatggtgaagtgcaaggagctgccccaggccgtgtgcgagatcctgggcctgcagggcagcgaggtgaccacccccgacagcgacgtgggcgaggacgagaacgtggtgatgaccccctgccccaccagcgccttccagagcaacgccctgcccaccctgagcgccagcggcgccagaaacgacagccccacccagatccccgtgagcagcgacgtgtgcagactgacccccgcctag

SEQ ID NO: 101935 - DNA, 2133 bp, Artificial Sequence
  Description of Artificial Sequence: Synthetic coding sequence
atgcacaacatcagaggcaacaagcaggcccagggcaccggccacgagccccccggcgaggacagcccccagagcggcgagccccagagagaggagcagcccctggccagcgacgccagcacccccggcagagagcccgaggacagccccaagcccgcccccaagcccagcctgaccatcagcttcgcccagaaggccaagagacagaacaacaccttccccttcttcagcgagggcatcaccagaaacagaaccgcccaggagaaggtggccgccctggagcagcaggtgctgatgctgaccaaggagctgaagagccagaaggagctggtgaagatcctgcacaaggccctggaggccgcccagcaggagaagagagccagcagcgcctacctggccgccgccgaggacaaggacagactggagctggtgagacacaaggtgagacagatcgccgagctgggcagaagagtggaggccctggagcaggagagagagagcctggcccacaccgccagcctgagagagcagcaggtgcaggagctgcagcagcacgtgcagctgctgatggacaagaaccacgccaagcagcaggtgatctgcaagctgagcgagaaggtgacccaggacttcacccacccccccgaccagagccccctgagacccgacgccgccaacagagacttcctgagccagcagggcaagatcgagcacctgaaggacgacatggaggcctacagaacccagaactgcttcctgaacagcgagatccaccaggtgaccaagatctggagaaaggtggccgagaaggagaaggccctgctgaccaagtgcgcctacctgcaggccagaaactgccaggtggagagcaagtacctggccggcctgagaagactgcaggaggccctgggcgacgaggccagcgagtgcagcgagctgctgagacagctggtgcaggaggccctgcagtgggaggccggcgaggccagcagcgacagcatcgagctgagccccatcagcaagtacgacgagtacggcttcctgaccgtgcccgactacgaggtggaggacctgaagctgctggccaagatccaggccctggagagcagaagccaccacctgctgggcctggaggccgtggacagacccctgagagagagatgggccgccctgggcgacctggtgcccagcgccgagctgaagcagctgctgagagccggcgtgcccagagagcacagacccagagtgtggagatggctggtgcacctgagagtgcagcacctgcacacccccggctgctaccaggagctgctgagcagaggccaggccagagagcaccccgccgccagacagatcgagctggacctgaacagaaccttccccaacaacaagcacttcacctgccccaccagcagcttccccgacaagctgagaagagtgctgctggccttcagctggcagaaccccaccatcggctactgccagggcctgaacagactggccgccatcgccctgctggtgctggaggaggaggagagcgccttctggtgcctggtggccatcgtggagaccatcatgcccgccgactactactgcaacaccctgaccgccagccaggtggaccagagagtgctgcaggacctgctgagcgagaagctgcccagactgatggcccacctgggccagcaccacgtggacctgagcctggtgaccttcaactggttcctggtggtgttcgccgacagcctgatcagcaacatcctgctgagagtgtgggacgccttcctgtacgagggcaccaaggtggtgttcagatacgccctggccatcttcaagtacaacgagaaggagatcctgagactgcagaacggcctggagatctaccagtacctgagattcttcaccaagaccatcagcaacagcagaaagctgatgaacatcgccttcaacgacatgaaccccttcagaatgaagcagctgagacagctgagaatggtgcacagagagagactggaggccgagctgagagagctggagcagctgaaggccgagtacctggagagaagagccagcagaagaagagccgtgagcgagggctgcgccagcgaggacgaggtggagggcgaggcctag

SEQ ID NO: 101936 - DNA, 1407 bp, Artificial Sequence
  Description of Artificial Sequence: Synthetic coding sequence
atggaggcctacagaacccagaactgcttcctgaacagcgagatccaccaggtgaccaagatctggagaaaggtggccgagaaggagaaggccctgctgaccaagtgcgcctacctgcaggccagaaactgccaggtggagagcaagtacctggccggcctgagaagactgcaggaggccctgggcgacgaggccagcgagtgcagcgagctgctgagacagctggtgcaggaggccctgcagtgggaggccggcgaggccagcagcgacagcatcgagctgagccccatcagcaagtacgacgagtacggcttcctgaccgtgcccgactacgaggtggaggacctgaagctgctggccaagatccaggccctggagagcagaagccaccacctgctgggcctggaggccgtggacagacccctgagagagagatgggccgccctgggcgacctggtgcccagcgccgagctgaagcagctgctgagagccggcgtgcccagagagcacagacccagagtgtggagatggctggtgcacctgagagtgcagcacctgcacacccccggctgctaccaggagctgctgagcagaggccaggccagagagcaccccgccgccagacagatcgagctggacctgaacagaaccttccccaacaacaagcacttcacctgccccaccagcagcttccccgacaagctgagaagagtgctgctggccttcagctggcagaaccccaccatcggctactgccagggcctgaacagactggccgccatcgccctgctggtgctggaggaggaggagagcgccttctggtgcctggtggccatcgtggagaccatcatgcccgccgactactactgcaacaccctgaccgccagccaggtggaccagagagtgctgcaggacctgctgagcgagaagctgcccagactgatggcccacctgggccagcaccacgtggacctgagcctggtgaccttcaactggttcctggtggtgttcgccgacagcctgatcagcaacatcctgctgagagtgtgggacgccttcctgtacgagggcaccaaggtggtgttcagatacgccctggccatcttcaagtacaacgagaaggagatcctgagactgcagaacggcctggagatctaccagtacctgagattcttcaccaagaccatcagcaacagcagaaagctgatgaacatcgccttcaacgacatgaaccccttcagaatgaagcagctgagacagctgagaatggtgcacagagagagactggaggccgagctgagagagctggagcagctgaaggccgagtacctggagagaagagccagcagaagaagagccgtgagcgagggctgcgccagcgaggacgaggtggagggcgaggcctag

SEQ ID NO: 101937 - DNA, 2583 bp, Artificial Sequence
  Description of Artificial Sequence: Synthetic coding sequence
atggagggcgccggcgagaacgcccccgagagcagcagcagcgcccccggcagcgaggagagcgccagagacccccaggtgcccccccccgaggaggagagcggcgactgcgccagaagcctggaggccgtgcccaagaagctgtgcggctacctgagcaagttcggcggcaagggccccatcagaggctggaagagcagatggttcttctacgacgagagaaagtgccagctgtactacagcagaaccgcccaggacgccaaccccctggacagcatcgacctgagcagcgccgtgttcgactgcaaggccgacgccgaggagggcatcttcgagatcaagacccccagcagagtgatcaccctgaaggccgccaccaagcaggccatgctgtactggctgcagcagctgcagatgaagagatgggagttccacaacagcccccccgccccccccgccacccccgacgccgccctggccggcaacggccccgtgctgcacctggagctgggccaggaggaggccgagctggaggagttcctgtgccccgtgaagaccccccccggcctggtgggcgtggccgccgccctgcagcccttccccgccctgcagaacatcagcctgaagcacctgggcaccgagatccagaacaccatgcacaacatcagaggcaacaagcaggcccagggcaccggccacgagccccccggcgaggacagcccccagagcggcgagccccagagagaggagcagcccctggccagcgacgccagcacccccggcagagagcccgaggacagccccaagcccgcccccaagcccagcctgaccatcagcttcgcccagaaggccaagagacagaacaacaccttccccttcttcagcgagggcatcaccagaaacagaaccgcccaggagaaggtggccgccctggagcagcaggtgctgatgctgaccaaggagctgaagagccagaaggagctggtgaagatcctgcacaaggccctggaggccgcccagcaggagaagagagccagcagcgcctacctggccgccgccgaggacaaggacagactggagctggtgagacacaaggtgagacagatcgccgagctgggcagaagagtggaggccctggagcaggagagagagagcctggcccacaccgccagcctgagagagcagcaggtgcaggagctgcagcagcacgtgcagctgctgatggacaagaaccacgccaagcagcaggtgatctgcaagctgagcgagaaggtgacccaggacttcacccacccccccgaccagagccccctgagacccgacgccgccaacagagacttcctgagccagcagggcaagatcgagcacctgaaggacgacatggaggcctacagaacccagaactgcttcctgaacagcgagatccaccaggtgaccaagatctggagaaaggtggccgagaaggagaaggccctgctgaccaagtgcgcctacctgcaggccagaaactgccaggtggagagcaagtacctggccggcctgagaagactgcaggaggccctgggcgacgaggccagcgagtgcagcgagctgctgagacagctggtgcaggaggccctgcagtgggaggccggcgaggccagcagcgacagcatcgagctgagccccatcagcaagtacgacgagtacggcttcctgaccgtgcccgactacgaggtggaggacctgaagctgctggccaagatccaggccctggagagcagaagccaccacctgctgggcctggaggccgtggacagacccctgagagagagatgggccgccctgggcgacctggtgcccagcgccgagctgaagcagctgctgagagccggcgtgcccagagagcacagacccagagtgtggagatggctggtgcacctgagagtgcagcacctgcacacccccggctgctaccaggagctgctgagcagaggccaggccagagagcaccccgccgccagacagatcgagctggacctgaacagaaccttccccaacaacaagcacttcacctgccccaccagcagcttccccgacaagctgagaagagtgctgctggccttcagctggcagaaccccaccatcggctactgccagggcctgaacagactggccgccatcgccctgctggtgctggaggaggaggagagcgccttctggtgcctggtggccatcgtggagaccatcatgcccgccgactactactgcaacaccctgaccgccagccaggtggaccagagagtgctgcaggacctgctgagcgagaagctgcccagactgatggcccacctgggccagcaccacgtggacctgagcctggtgaccttcaactggttcctggtggtgttcgccgacagcctgatcagcaacatcctgctgagagtgtgggacgccttcctgtacgagggcaccaaggtggtgttcagatacgccctggccatcttcaagtacaacgagaaggagatcctgagactgcagaacggcctggagatctaccagtacctgagattcttcaccaagaccatcagcaacagcagatag

SEQ ID NO: 101938 - DNA, 2754 bp, Artificial Sequence
  Description of Artificial Sequence: Synthetic coding sequence
atggagggcgccggcgagaacgcccccgagagcagcagcagcgcccccggcagcgaggagagcgccagagacccccaggtgcccccccccgaggaggagagcggcgactgcgccagaagcctggaggccgtgcccaagaagctgtgcggctacctgagcaagttcggcggcaagggccccatcagaggctggaagagcagatggttcttctacgacgagagaaagtgccagctgtactacagcagaaccgcccaggacgccaaccccctggacagcatcgacctgagcagcgccgtgttcgactgcaaggccgacgccgaggagggcatcttcgagatcaagacccccagcagagtgatcaccctgaaggccgccaccaagcaggccatgctgtactggctgcagcagctgcagatgaagagatgggagttccacaacagcccccccgccccccccgccacccccgacgccgccctggccggcaacggccccgtgctgcacctggagctgggccaggaggaggccgagctggaggagttcctgtgccccgtgaagaccccccccggcctggtgggcgtggccgccgccctgcagcccttccccgccctgcagaacatcagcctgaagcacctgggcaccgagatccagaacaccatgcacaacatcagaggcaacaagcaggcccagggcaccggccacgagccccccggcgaggacagcccccagagcggcgagccccagagagaggagcagcccctggccagcgacgccagcacccccggcagagagcccgaggacagccccaagcccgcccccaagcccagcctgaccatcagcttcgcccagaaggccaagagacagaacaacaccttccccttcttcagcgagggcatcaccagaaacagaaccgcccaggagaaggtggccgccctggagcagcaggtgctgatgctgaccaaggagctgaagagccagaaggagctggtgaagatcctgcacaaggccctggaggccgcccagcaggagaagagagccagcagcgcctacctggccgccgccgaggacaaggacagactggagctggtgagacacaaggtgagacagatcgccgagctgggcagaagagtggaggccctggagcaggagagagagagcctggcccacaccgccagcctgagagagcagcaggtgcaggagctgcagcagcacgtgcagctgctgatggacaagaaccacgccaagcagcaggtgatctgcaagctgagcgagaaggtgacccaggacttcacccacccccccgaccagagccccctgagacccgacgccgccaacagagacttcctgagccagcagggcaagatcgagcacctgaaggacgacatggaggcctacagaacccagaactgcttcctgaacagcgagatccaccaggtgaccaagatctggagaaaggtggccgagaaggagaaggccctgctgaccaagtgcgcctacctgcaggccagaaactgccaggtggagagcaagtacctggccggcctgagaagactgcaggaggccctgggcgacgaggccagcgagtgcagcgagctgctgagacagctggtgcaggaggccctgcagtgggaggccggcgaggccagcagcgacagcatcgagctgagccccatcagcaagtacgacgagtacggcttcctgaccgtgcccgactacgaggtggaggacctgaagctgctggccaagatccaggccctggagagcagaagccaccacctgctgggcctggaggccgtggacagacccctgagagagagatgggccgccctgggcgacctggtgcccagcgccgagctgaagcagctgctgagagccggcgtgcccagagagcacagacccagagtgtggagatggctggtgcacctgagagtgcagcacctgcacacccccggctgctaccaggagctgctgagcagaggccaggccagagagcaccccgccgccagacagatcgagctggacctgaacagaaccttccccaacaacaagcacttcacctgccccaccagcagcttccccgacaagctgagaagagtgctgctggccttcagctggcagaaccccaccatcggctactgccagggcctgaacagactggccgccatcgccctgctggtgctggaggaggaggagagcgccttctggtgcctggtggccatcgtggagaccatcatgcccgccgactactactgcaacaccctgaccgccagccaggtggaccagagagtgctgcaggacctgctgagcgagaagctgcccagactgatggcccacctgggccagcaccacgtggacctgagcctggtgaccttcaactggttcctggtggtgttcgccgacagcctgatcagcaacatcctgctgagagtgtgggacgccttcctgtacgagggcaccaagtacaacgagaaggagatcctgagactgcagaacggcctggagatctaccagtacctgagattcttcaccaagaccatcagcaacagcagaaagctgatgaacatcgccttcaacgacatgaaccccttcagaatgaagcagctgagacagctgagaatggtgcacagagagagactggaggccgagctgagagagctggagcagctgaaggccgagtacctggagagaagagccagcagaagaagagccgtgagcgagggctgcgccagcgaggacgaggtggagggcgaggcctag

SEQ ID NO: 101939 - DNA, 1287 bp, Artificial Sequence
  Description of Artificial Sequence: Synthetic coding sequence
atgcccagcggctgctacgtgcccagaagcgagcccagactgctgcccgcccccccccccgccggcgccagagtgggcgccctgagaagcgcccagggcgacggccccaccagcggccactgggacggcggcgccgagaaggccgacttcaacgccaagagaaagaagaaggtggccgagatccaccaggccctgaacagcgaccccaccgacgtggccgccctgagaagaatggccatcagcgagggcggcctgctgaccgacgagatcagaagaaaggtgtggcccaagctgctgaacgtgaacgccaacgaccccccccccatcagcggcaagaacctgagacagatgagcaaggactaccagcaggtgctgctggacgtgagaagaagcctgagaagattcccccccggcatgcccgaggagcagagagagggcctgcaggaggagctgatcgacatcatcctgctgatcctggagagaaacccccagctgcactactaccagggctaccacgacatcgtggtgaccttcctgctggtggtgggcgagagactggccaccagcctggtggagaagctgagcacccaccacctgagagacttcatggaccccaccatggacaacaccaagcacatcctgaactacctgatgcccatcatcgaccaggtgaaccccgagctgcacgacttcatgcagagcgccgaggtgggcaccatcttcgccctgagctggctgatcacctggttcggccacgtgctgagcgacttcagacacgtggtgagactgtacgacttcttcctggcctgccaccccctgatgcccatctacttcgccgccgtgatcgtgctgtacagagagcaggaggtgctggactgcgactgcgacatggccagcgtgcaccacctgctgagccagatcccccaggacctgccctacgagaccctgatcagcagagccggcgacctgttcgtgcagttcccccccagcgagctggccagagaggccgccgcccagcagcaggccgagagaaccgccgccagcaccttcaaggacttcgagctggccagcgcccagcagagacccgacatggtgctgagacagagattcagaggcctgctgagacccgaggacagaaccaaggacgtgctgaccaagcccagaaccaacagattcgtgaagctggccgtgatgggcctgaccgtggccctgggcgccgccgccctggccgtggtgaagagcgccctggagtgggcccccaagttccagctgcagctgttcccctag

SEQ ID NO: 101940 - DNA, 1212 bp, Artificial Sequence
  Description of Artificial Sequence: Synthetic coding sequence
atggccctgagaagcgcccagggcgacggccccaccagcggccactgggacggcggcgccgagaaggccgacttcaacgccaagagaaagaagaaggtggccgagatccaccaggccctgaacagcgaccccaccgacgtggccgccctgagaagaatggccatcagcgagggcggcctgctgaccgacgagatcagaagaaaggtgtggcccaagctgctgaacgtgaacgccaacgaccccccccccatcagcggcaagaacctgagacagatgagcaaggactaccagcaggtgctgctggacgtgagaagaagcctgagaagattcccccccggcatgcccgaggagcagagagagggcctgcaggaggagctgatcgacatcatcctgctgatcctggagagaaacccccagctgcactactaccagggctaccacgacatcgtggtgaccttcctgctggtggtgggcgagagactggccaccagcctggtggagaagctgagcacccaccacctgagagacttcatggaccccaccatggacaacaccaagcacatcctgaactacctgatgcccatcatcgaccaggtgaaccccgagctgcacgacttcatgcagagcgccgaggtgggcaccatcttcgccctgagctggctgatcacctggttcggccacgtgctgagcgacttcagacacgtggtgagactgtacgacttcttcctggcctgccaccccctgatgcccatctacttcgccgccgtgatcgtgctgtacagagagcaggaggtgctggactgcgactgcgacatggccagcgtgcaccacctgctgagccagatcccccaggacctgccctacgagaccctgatcagcagagccggcgacctgttcgtgcagttcccccccagcgagctggccagagaggccgccgcccagcagcaggccgagagaaccgccgccagcaccttcaaggacttcgagctggccagcgcccagcagagacccgacatggtgctgagacagagattcagaggcctgctgagacccgaggacagaaccaaggacgtgctgaccaagcccagaaccaacagattcgtgaagctggccgtgatgggcctgaccgtggccctgggcgccgccgccctggccgtggtgaagagcgccctggagtgggcccccaagttccagctgcagctgttcccctag

SEQ ID NO: 101941 - DNA, 1212 bp, Artificial Sequence; identical to SEQ ID NO: 101940
  Description of Artificial Sequence: Synthetic coding sequence

SEQ ID NO: 101942 - DNA, 1662 bp, Artificial Sequence; identical to SEQ ID NO: 101924
  Description of Artificial Sequence: Synthetic coding sequence

SEQ ID NO: 101943 - DNA, 1680 bp, Artificial Sequence
  Description of Artificial Sequence: Synthetic coding sequence
atggacagccccggctacaactgcttcgtggacaaggacaagatggacgccgccatccaggacctgggccccaaggagctgagctgcaccgagctgcaggagctgaagcagctggccagacagggctactgggcccagagccacgccctgagaggcaaggtgtaccagagactgatcagagacatcccctgcagaaccgtgacccccgacgccagcgtgtacagcgacatcgtgggcaagatcgtgggcaagcacagcagcagctgcctgcccctgcccgagttcgtggacaacacccaggtgcccagctactgcctgaacgccagaggcgagggcgccgtgagaaagatcctgctgtgcctggccaaccagttccccgacatcagcttctgccccgccctgcccgccgtggtggccctgctgctgcactacagcatcgacgaggccgagtgcttcgagaaggcctgcagaatcctggcctgcaacgaccccggcagaagactgatcgaccagagcttcctggccttcgagagcagctgcatgaccttcggcgacctggtgaacaagtactgccaggccgcccacaagctgatggtggccgtgagcgaggacgtgctgcaggtgtacgccgactggcagagatggctgttcggcgagctgcccctgtgctacttcgccagagtgttcgacgtgttcctggtggagggctacaaggtgctgtacagagtggccctggccatcctgaagttcttccacaaggtgagagccggccagcccctggagagcgacagcgtgaagcaggacatcagaaccttcgtgagagacatcgccaagaccgtgagccccgagaagctgctggagaaggccttcgccatcagactgttcagcagaaaggagatccagctgctgcagatggccaacgagaaggccctgaagcagaagggcatcaccgtgaagcagaagagcgtgagcctgagcaagagacagttcgtgcacctggccgtgcacgccgagaacttcagaagcgagatcgtgagcgtgagagagatgagagacatctggagctgggtgcccgagagattcgccctgtgccagcccctgctgctgttcagcagcctgcagcacggctacagcctggccagattctacttccagtgcgagggccacgagcccaccctgctgctgatcaagaccacccagaaggaggtgtgcggcgcctacctgagcaccgactggagcgagagaaacaagttcggcggcaagctgggcttcttcggcaccggcgagtgcttcgtgttcagactgcagcccgaggtgcagagatacgagtgggtggtgatcaagcaccccgagctgaccaagcccccccccctgatggccgccgagcccaccgcccccctgagccacagcgccagcagcgaccccgccgacagactgagccccttcctggccgccagacacttcaacctgcccagcaagaccgagagcatgttcatggccggcggcagcgactgcctgatcgtgggcggcggcggcggccaggccctgtacatcgacggcgacctgaacagaggcagaaccagccactgcgacaccttcaacaaccagcccctgtgcagcgagaacttcctgatcgccgccgtggaggcctggggcttccaggaccccgacacccagtag

SEQ ID NO: 101944 - DNA, 2067 bp, Artificial Sequence
  Description of Artificial Sequence: Synthetic coding sequence
atggccaccgccagcggcgccagcgacctgagcggcagcggcgcccccccccccggcgtgggcgcccaggccgccgccgccgccgaggaggaggagagagaggtggtgagagtgagagtgaagaagtgcgagagcttcctgccccccgagttcagaagcttcgccgtggacccccagatcaccagcctggacgtgctgcagcacatcctgatcagagccttcgacctgagcggcaagaagaacttcggcatcagctacctgggcagagacagactgggccaggaggtgtacctgagcctgctgagcgactgggacctgagcaccgccttcgccaccgccagcaagccctacctgcagctgagagtggacatcagacccagcgaggacagccccctgctggaggactgggacatcatcagccccaaggacgtgatcggcagcgacgtgctgctggccgagaagagaagcagcctgaccaccgccgccctgcccttcacccagagcatcctgacccaggtgggcagaaccctgagcaaggtgcagcaggtgctgagctggagctacggcgaggacgtgaagcccttcaagccccccctgagcgacgccgagttccacacctacctgaaccacgagggccagctgagcagacccgaggagctgagactgagaatctaccacggcggcgtggagcccagcctgagaaaggtggtgtggagatacctgctgaacgtgtaccccgacggcctgaccggcagagagagaatggactacatgaagagaaagagcagagagtacgagcagctgaagagcgagtgggcccagagagccaaccccgaggacctggagttcatcagaagcaccgtgctgaaggacgtgctgagaaccgacagagcccacccctactacgccggccccgaggacggcccccacctgagagccctgcacgacctgctgaccacctacgccgtgacccacccccaggtgagctactgccagggcatgagcgacctggccagccccatcctggccgtgatggaccacgagggccacgccttcgtgtgcttctgcggcatcatgaagagactggccgccaacttccaccccgacggcagagccatggccaccaagttcgcccacctgaagctgctgctgagacacgccgaccccgacttctaccagtacctgcaggaggccggcgccgacgacctgttcttctgctacagatggctgctgctggagctgaagagagagttcgccttcgacgacgccctgagaatgctggaggtgacctggagcagcctgccccccgacccccccgagcacgaggtggagctggtgggcccccccagccaggtggccgacgccggcttcggcggccacagaggctggcccgtgagacagagacacatgctgagacccgccggcggcggcggcagcaccttcgaggacgccgtggaccacctggccaccgccagccagggccccggcggcggcggcagactgctgagacaggccagcctggacggcctgcagcagctgagagacaacatgggcagcagaagagaccccctggtgcagctgccccaccccgccgccctgatcagcagcaagagcctgagcgagcccctgctgaacagccccgaccccctgctgagcagcttcagccaccccgacagccccagcagcagcagcccccccagcacccaggaggccagccccaccggcgacatggccgtgggcagccccctgatgcaggaggtgggcagccccaaggaccccggcaagagcctgccccccgtgccccccatgggcctgccccccccccaggagttcggcagaggcaaccccttcatgctgttcctgtgcctggccatcctgctggagcacagagaccacatcatgagaaacggcctggactacaacgagctggccatgcacttcgacagactggtgagaaagcaccacctgggcagagtgctgagaagagccagagccctgttcgccgactacctgcagagcgaggtgtgggacagcgaggagggcgccgaggccaccgccgccagctag

SEQ ID NO: 101945 - DNA, 693 bp, Artificial Sequence
  Description of Artificial Sequence: Synthetic coding sequence
atggccaccgccagcggcgccagcgacctgagcggcagcggcgcccccccccccggcgtgggcgcccaggccgccgccgccgccgaggaggaggagagagaggtggtgagagtgagagtgaagcacggcgacggcgcccccggcggcctgccccacgtgttcagcccccagaagtgcgagagcttcctgccccccgagttcagaagcttcgccgtggacccccagatcaccagcctggacgtgctgcagcacatcctgatcagagccttcgacctgagcggcaagaagaacttcggcatcagctacctgggcagagacagactgggccaggaggtgtacctgagcctgctgagcgactgggacctgagcaccgccttcgccaccgccagcaagccctacctgcagctgagagtggacatcagacccagcgaggacagccccctgctggaggactgggacatcatcagccccaaggacgtgatcggcagcgacgtgctgctggccgagaagagaagcagcctgaccaccgccgccctgcccttcacccagagcatcctgacccaggtgggcagaaccctgagcaaggtgcagcaggtgctgagctggagctacggcgaggacgtgaagcccttcaagccccccctgagcgacgccgagttccacacctacctgaaccacgagggccagctgtag

SEQ ID NO: 101946 - DNA, 303 bp, Artificial Sequence
  Description of Artificial Sequence: Synthetic coding sequence
atggccaccgccagcggcgccagcgacctgagcggcagcggcgcccccccccccggcgtgggcgcccaggccgccgccgccgccgaggaggaggagagagaggtggtgagagtgagagtgaagaagtgcgagagcttcctgccccccgagttcagaagcttcgccgtggacccccagatcaccagcctggacgtgctgcagcacatcctgatcagagccttcgacctgagcggccccatcgccagaagactgggccacaaccagccccagagatgccactggctgagaagagtggccggctag

SEQ ID NO: 101947 - DNA, 1305 bp, Artificial Sequence
  Description of Artificial Sequence: Synthetic coding sequence
atggactacatgaagagaaagagcagagagtacgagcagctgaagagcgagtgggcccagagagccaaccccgaggacctggagttcatcagaagcaccgtgctgaaggacgtgctgagaaccgacagagcccacccctactacgccggccccgaggacggcccccacctgagagccctgcacgacctgctgaccacctacgccgtgacccacccccaggtgagctactgccagggcatgagcgacctggccagccccatcctggccgtgatggaccacgagggccacgccttcgtgtgcttctgcggcatcatgaagagactggccgccaacttccaccccgacggcagagccatggccaccaagttcgcccacctgaagctgctgctgagacacgccgaccccgacttctaccagtacctgcaggaggccggcgccgacgacctgttcttctgctacagatggctgctgctggagctgaagagagagttcgccttcgacgacgccctgagaatgctggaggtgacctggagcagcctgccccccgacccccccgagcacgaggtggagctggtgggcccccccagccaggtggccgacgccggcttcggcggccacagaggctggcccgtgagacagagacacatgctgagacccgccggcggcggcggcagcaccttcgaggacgccgtggaccacctggccaccgccagccagggccccggcggcggcggcagactgctgagacaggccagcctggacggcctgcagcagctgagagacaacatgggcagcagaagagaccccctggtgcagctgccccaccccgccgccctgatcagcagcaagagcctgagcgagcccctgctgaacagccccgaccccctgctgagcagcttcagccaccccgacagccccagcagcagcagcccccccagcacccaggaggccagccccaccggcgacatggccgtgggcagccccctgatgcaggaggtgggcagccccaaggaccccggcaagagcctgccccccgtgccccccatgggcctgccccccccccaggagttcggcagaggcaaccccttcatgctgttcctgtgcctggccatcctgctggagcacagagaccacatcatgagaaacggcctggactacaacgagctggccatgcacttcgacagactggtgagaaagcaccacctgggcagagtgctgagaagagccagagccctgttcgccgactacctgcagagcgaggtgtgggacagcgaggagggcgccgaggccaccgccgccagctag

SEQ ID NO: 101948 - DNA, 876 bp, Artificial Sequence
  Description of Artificial Sequence: Synthetic coding sequence
atggacgtggtggaggtggccggcagctggtgggcccaggagagagaggacatcatcatgaagtacgagaagggccacagagccggcctgcccgaggacaagggccccaagcccttcagaagctacaacaacaacgtggaccacctgggcatcgtgcacgagaccgagctgccccccctgaccgccagagaggccaagcagatcagaagagagatcagcagaaagagcaagtgggtggacatgctgggcgactgggagaagtacaagagcagcagaaagctgatcgacagagcctacaagggcatgcccatgaacatcagaggccccatgtggagcgtgctgctgaacatcgaggagatgaagctgaagaaccccggcagataccagatcatgaaggagaagggcaagagaagcagcgagcacatccagagaatcgacagagacgtgagcggcaccctgagaaagcacatcttcttcagagacagatacggcaccaagcagagagagctgctgcacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagccagcccaagaccatgggccaccagagcgccagcagaagaagacccggcgtggccagaggccacgtgttcgccaccggcagcctgatccccggccccggcatgagaaccctgtgcagcagcatcctgggccccctgtag

SEQ ID NO: 101949 - DNA, 1650 bp, Artificial Sequence
  Description of Artificial Sequence: Synthetic coding sequence
atggacgtggtggaggtggccggcagctggtgggcccaggagagagaggacatcatcatgaagtacgagaagggccacagagccggcctgcccgaggacaagggccccaagcccttcagaagctacaacaacaacgtggaccacctgggcatcgtgcacgagaccgagctgccccccctgaccgccagagaggccaagcagatcagaagagagatcagcagaaagagcaagtgggtggacatgctgggcgactgggagaagtacaagagcagcagaaagctgatcgacagagcctacaagggcatgcccatgaacatcagaggccccatgtggagcgtgctgctgaacatcgaggagatgaagctgaagaaccccggcagataccagatcatgaaggagaagggcaagagaagcagcgagcacatccagagaatcgacagagacgtgagcggcaccctgagaaagcacatcttcttcagagacagatacggcaccaagcagagagagctgctgcacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagccagcccaagaccatgggccaccaggacaagaaggacctgtgcggccagtgcagccccctgggctgcctgatcagaatcctgatcgacggcatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgccagattccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagccctgcgcccccaccagcggcccctgcctgtgcggcctgcacctggagagcagccagttcccccccggcttctag

SEQ ID NO: 101950 - DNA, 900 bp, Artificial Sequence
  Description of Artificial Sequence: Synthetic coding sequence
atgggccaccaggacaagaaggacctgtgcggccagtgcagccccctgggctgcctgatcagaatcctgatcgacggcatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgccagattccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagccctgcgcccccaccagcggcccctgcctgtgcggcctgcacctggagagcagccagttcccccccggcttctag

SEQ ID NO: 101951 - DNA, 1584 bp, Artificial Sequence
  Description of Artificial Sequence: Synthetic coding sequence
atggacgtggtggaggtggccggcagctggtgggcccaggagagagaggacatcatcatgaagtacgagaagggccacagagccggcctgcccgaggacaagggccccaagcccttcagaagctacaacaacaacgtggaccacctgggcatcgtgcacgagaccgagctgccccccctgaccgccagagaggccaagcagatcagaagagagatcagcagaaagagcaagtgggtggacatgctgggcgactgggagaagtacaagagcagcagaaagctgatcgacagagcctacaagggcatgcccatgaacatcagaggccccatgtggagcgtgctgctgaacatcgaggagatgaagctgaagaaccccggcagataccagatcatgaaggagaagggcaagagaagcagcgagcacatccagagaatcgacagagacgtgagcggcaccctgagaaagcacatcttcttcagagacagatacggcaccaagcagagagagctgctgcacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagccagcccaagaccatgggccaccagatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgccagattccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagccctgcgcccccaccagcggcccctgcctgtgcggcctgcacctggagagcagccagttcccccccggcttctag

SEQ ID NO: 101952 - DNA, 1650 bp, Artificial Sequence; identical to SEQ ID NO: 101949
  Description of Artificial Sequence: Synthetic coding sequence

SEQ ID NO: 101953 - DNA, 1584 bp, Artificial Sequence
  Description of Artificial Sequence: Synthetic coding sequence
atggacgtggtggaggtggccggcagctggtgggcccaggagagagaggacatcatcatgaagtacgagaagggccacagagccggcctgcccgaggacaagggccccaagcccttcagaagctacaacaacaacgtggaccacctgggcatcgtgcacgagaccgagctgccccccctgaccgccagagaggccaagcagatcagaagagagatcagcagaaagagcaagtgggtggacatgctgggcgactgggagaagtacaagagcagcagaaagctgatcgacagagcctacaagggcatgcccatgaacatcagaggccccatgtggagcgtgctgctgaacatcgaggagatgaagctgaagaaccccggcagataccagatcatgaaggagaagggcaagagaagcagcgagcacatccagagaatcgacagagacatcagcggcaccctgagaaagcacatgttcttcagagacagatacggcaccaagcagagagagctgctgcacatcctgctggcctacgaggagtacaaccccgaggtgggctactgcagagacctgagccacatcgccgccctgttcctgctgtacttccccgaggaggacgccttctgggccctggtgcagctgctggccagcgagagacacagcctgcagggcttccacagccccaacggcggcaccgtgcagggcctgcaggaccagcaggagcacgtggtggccaccagccagagcaagaccatgggccaccagatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgccagattccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagcagtacgcccccaccagcggcccctgcctgtgcggcctgcacctggagagcagccagttcccccccggcttctag

SEQ ID NO: 101954 - DNA, 1650 bp, Artificial Sequence
  Description of Artificial Sequence: Synthetic coding sequence
atggacgtggtggaggtggccggcagctggtgggcccaggagagagaggacatcatcatgaagtacgagaagggccacagagccggcctgcccgaggacaagggccccaagcccttcagaagctacaacaacaacgtggaccacctgggcatcgtgcacgagaccgagctgccccccctgaccgccagagaggccaagcagatcagaagagagatcagcagaaagagcaagtgggtggacatgctgggcgactgggagaagtacaagagcagcagaaagctgatcgacagagcctacaagggcatgcccatgaacatcagaggccccatgtggagcgtgctgctgaacatcgaggagatgaagctgaagaaccccggcagataccagatcatgaaggagaagggcaagagaagcagcgagcacatccagagaatcgacagagacatcagcggcaccctgagaaagcacatgttcttcagagacagatacggcaccaagcagagagagctgctgcacatcctgctggcctacgaggagtacaaccccgaggtgggctactgcagagacctgagccacatcgccgccctgttcctgctgtacttccccgaggaggacgccttctgggccctggtgcagctgctggccagcgagagacacagcctgcagggcttccacagccccaacggcggcaccgtgcagggcctgcaggaccagcaggagcacgtggtggccaccagccagagcaagaccatgggccaccaggacaagaaggacctgtgcggccagtgcagccccctgggctgcctgatcagaatcctgatcgacggcatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgccagattccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagcagtacgcccccaccagcggcccctgcctgtgcggcctgcacctggagagcagccagttcccccccggcttctag

SEQ ID NO: 101955 - DNA, 1650 bp, Artificial Sequence; identical to SEQ ID NO: 101954
  Description of Artificial Sequence: Synthetic coding sequence

SEQ ID NO: 101956 - DNA, 1650 bp, Artificial Sequence
  Description of Artificial Sequence: Synthetic coding sequence
atggacgtggtggaggtggccggcagctggtgggcccaggagagagaggacatcatcatgaagtacgagaagggccacagagccggcctgcccgaggacaagggccccaagcccttcagaagctacaacaacaacgtggaccacctgggcatcgtgcacgagaccgagctgccccccctgaccgccagagaggccaagcagatcagaagagagatcagcagaaagagcaagtgggtggacatgctgggcgactgggagaagtacaagagcagcagaaagctgatcgacagagcctacaagggcatgcccatgaacatcagaggccccatgtggagcgtgctgctgaacatcgaggagatgaagctgaagaaccccggcagataccagatcatgaaggagaagggcaagagaagcagcgagcacatccagagaatcgacagagacatcagcggcaccctgagaaagcacatgttcttcagagacagatacggcaccaagcagagagagctgctgcacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagccagagcaagaccatgggccaccaggacaagaaggacctgtgcggccagtgcagccccctgggctgcctgatcagaatcctgatcgacggcatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgcctggttccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagcagtgcgcccccaccagcggcccctgcctgtgcggcctgcacctggagagcagccagttcccccccggcttctag

SEQ ID NO: 101957 - DNA, 1584 bp, Artificial Sequence
  Description of Artificial Sequence: Synthetic coding sequence
atggacgtggtggaggtggccggcagctggtgggcccaggagagagaggacatcatcatgaagtacgagaagggccacagagccggcctgcccgaggacaagggccccaagcccttcagaagctacaacaacaacgtggaccacctgggcatcgtgcacgagaccgagctgccccccctgaccgccagagaggccaagcagatcagaagagagatcagcagaaagagcaagtgggtggacatgctgggcgactgggagaagtacaagagcagcagaaagctgatcgacagagcctacaagggcatgcccatgaacatcagaggccccatgtggagcgtgctgctgaacatcgaggagatgaagctgaagaaccccggcagataccagatcatgaaggagaagggcaagagaagcagcgagcacatccagagaatcgacagagacatcagcggcaccctgagaaagcacatgttcttcagagacagatacggcaccaagcagagagagctgctgcacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagccagagcaagaccatgggccaccagatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgcctggttccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagcagtgcgcccccaccagcggcccctgcctgtgcggcctgcacctggagagcagccagttcccccccggcttctag

SEQ ID NO: 101958 - DNA, 1650 bp, Artificial Sequence; identical to SEQ ID NO: 101956
  Description of Artificial Sequence: Synthetic coding sequence

SEQ ID NO: 101959 - DNA, 1650 bp, Artificial Sequence
  Description of Artificial Sequence: Synthetic coding sequence
atggacgtggtggaggtggccggcagctggtgggcccaggagagagaggacatcatcatgaagtacgagaagggccacagagccggcctgcccgaggacaagggccccaagcccttcagaagctacaacaacaacgtggaccacctgggcatcgtgcacgagaccgagctgccccccctgaccgccagagaggccaagcagatcagaagagagatcagcagaaagagcaagtgggtggacatgctgggcgactgggagaagtacaagagcagcagaaagctgatcgacagagcctacaagggcatgcccatgaacatcagaggccccatgtggagcgtgctgctgaacaccgaggagatgaagctgaagaaccccggcagataccagatcatgaaggagaagggcaagagaagcagcgagcacatccagagaatcgacagagacgtgagcggcaccctgagaaagcacatcttcttcagagacagatacggcaccaagcagagagagctgctgcacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagccagcccaagaccatgggccaccaggacaagaaggacctgtgcggccagtgcagccccctgggctgcctgatcagaatcctgatcgacggcatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgccagattccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagccctgcgcccccaccagcggcccctgcctgtgcggcctgcacctggagagcagccagttcccccccggcttctag

SEQ ID NO: 101960 - DNA, 876 bp, Artificial Sequence
  Description of Artificial Sequence: Synthetic coding sequence
atggacgtggtggaggtggccggcagctggtgggcccaggagagagaggacatcatcatgaagtacgagaagggccacagagccggcctgcccgaggacaagggccccaagcccttcagaagctacaacaacaacgtggaccacctgggcatcgtgcacgagaccgagctgccccccctgaccgccagagaggccaagcagatcagaagagagatcagcagaaagagcaagtgggtggacatgctgggcgactgggagaagtacaagagcagcagaaagctgatcgacagagcctacaagggcatgcccatgaacatcagaggccccatgtggagcgtgctgctgaacaccgaggagatgaagctgaagaaccccggcagataccagatcatgaaggagaagggcaagagaagcagcgagcacatccagagaatcgacagagacgtgagcggcaccctgagaaagcacatcttcttcagagacagatacggcaccaagcagagagagctgctgcacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagccagcccaagaccatgggccaccagagcgccagcagaagaagacccggcgtggccagaggccacgtgttcgccaccggcagcctgatccccggccccggcatgagaaccctgtgcagcagcatcctgggccccctgtag

SEQ ID NO: 101961 - DNA, 900 bp, Artificial Sequence; identical to SEQ ID NO: 101950
  Description of Artificial Sequence: Synthetic coding sequence

SEQ ID NO: 101962 - DNA, 1410 bp, Artificial Sequence
  Description of Artificial Sequence: Synthetic coding sequence
atgctgggcgactgggagaagtacaagagcagcagaaagctgatcgacagagcctacaagggcatgcccatgaacatcagaggccccatgtggagcgtgctgctgaacaccgaggagatgaagctgaagaaccccggcagataccagatcatgaaggagaagggcaagagaagcagcgagcacatccagagaatcgacagagacgtgagcggcaccctgagaaagcacatcttcttcagagacagatacggcaccaagcagagagagctgctgcacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagccagcccaagaccatgggccaccaggacaagaaggacctgtgcggccagtgcagccccctgggctgcctgatcagaatcctgatcgacggcatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgccagattccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagccctgcgcccccaccagcggcccctgcctgtgcggcctgcacctggagagcagccagttcccccccggcttctag

SEQ ID NO: 101963 - DNA, 1650 bp, Artificial Sequence
  Description of Artificial Sequence: Synthetic coding sequence
atggacgtggtggaggtggccggcagctggtgggcccaggagagagaggacatcatcatgaagtacgagaagggccacagagccggcctgcccgaggacaagggccccaagcccttcagaagctacaacaacaacgtggaccacctgggcatcgtgcacgagaccgagctgccccccctgaccgccagagaggccaagcagatcagaagagagatcagcagaaagagcaagtgggtggacatgctgggcgactgggagaagtacaagagcagcagaaagctgatcgacagagcctacaagggcatgcccatgaacatcagaggccccatgtggagcgtgctgctgaacatcgaggagatgaagctgaagaaccccggcagataccagatcatgaaggagaagggcaagagaagcagcgagcacatccagagaatcgacagagacatcagcggcaccctgagaaagcacatgttcttcagagacagatacggcaccaagcagagagagctgctgcacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagccagcccaagaccatgggccaccaggacaagaaggacctgtgcggccagtgcagccccctgggctgcctgatcagaatcctgatcgacggcatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgccagattccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagcagtgcgcccccaccagcggcccctgcctgtgcggcctgcacctggagagcagccagttcccccccggcttctag

SEQ ID NO: 101964 - DNA, 1650 bp, Artificial Sequence; identical to SEQ ID NO: 101963
  Description of Artificial Sequence: Synthetic coding sequence

SEQ ID NO: 101965 - DNA, 1584 bp, Artificial Sequence
  Description of Artificial Sequence: Synthetic coding sequence
atggacgtggtggaggtggccggcagctggtgggcccaggagagagaggacatcatcatgaagtacgagaagggccacagagccggcctgcccgaggacaagggccccaagcccttcagaagctacaacaacaacgtggaccacctgggcatcgtgcacgagaccgagctgccccccctgaccgccagagaggccaagcagatcagaagagagatcagcagaaagagcaagtgggtggacatgctgggcgactgggagaagtacaagagcagcagaaagctgatcgacagagcctacaagggcatgcccatgaacatcagaggccccatgtggagcgtgctgctgaacatcgaggagatgaagctgaagaaccccggcagataccagatcatgaaggagaagggcaagagaagcagcgagcacatccagagaatcgacagagacatcagcggcaccctgagaaagcacatgttcttcagagacagatacggcaccaagcagagagagctgctgcacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagccagcccaagaccatgggccaccagatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgccagattccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagcagtgcgcccccaccagcggcccctgcctgtgcggcctgcacctggagagcagccagttcccccccggcttctag

SEQ ID NO: 101966 - DNA, 1584 bp, Artificial Sequence; identical to SEQ ID NO: 101965
  Description of Artificial Sequence: Synthetic coding sequence

SEQ ID NO: 101967 - DNA, 1410 bp, Artificial Sequence
  Description of Artificial Sequence: Synthetic coding sequence
atgctgggcgactgggagaagtacaagagcagcagaaagctgatcgacagagcctacaagggcatgcccatgaacatcagaggccccatgtggagcgtgctgctgaacatcgaggagatgaagctgaagaaccccggcagataccagatcatgaaggagaagggcaagagaagcagcgagcacatccagagaatcgacagagacatcagcggcaccctgagaaagcacatgttcttcagagacagatacggcaccaagcagagagagctgctgcacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagccagcccaagaccatgggccaccaggacaagaaggacctgtgcggccagtgcagccccctgggctgcctgatcagaatcctgatcgacggcatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgccagattccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagcagtgcgcccccaccagcggcccctgcctgtgcggcctgcacctggagagcagccagttcccccccggcttctag

SEQ ID NO: 101968 - DNA, 1410 bp, Artificial Sequence
  Description of Artificial Sequence: Synthetic coding sequence
atgctgggcgactgggagaagtacaagagcagcagaaagctgatcgacagagcctacaagggcatgcccatgaacatcagaggccccatgtggagcgtgctgctgaacatcgaggagatgaagctgaagaaccccggcagataccagatcatgaaggagaagggcaagagaagcagcgagcacatccagagaatcgacagagacatcagcggcaccctgagaaagcacatgttcttcagagacagatacggcaccaagcagagagagctgctgcacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagccagcccaagaccatgggccaccaggacaagaaggacctgtgcggccagtgcagccccctgggctgcctgatcagaatcctgatcgacggcatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgcctggttccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagcagtgcgcccccaccagcggcccctgcctgtgcggcctgcacctggagagcagccagttcccccccggcttctag

SEQ ID NO: 101969 - DNA, 1650 bp, Artificial Sequence
  Description of Artificial Sequence: Synthetic coding sequence
atggacgtggtggaggtggccggcagctggtgggcccaggagagagaggacatcatcatgaagtacgagaagggccaccaggccggcctgcccgaggacaagggccccaagcccttcagaagctacaacaacaacgtggaccacctgggcatcgtgcacgagaccgagctgccccccctgaccgccagagaggccaagcagatcagaagagagatcagcagaaagagcaagtgggtggacatgctgggcgactgggagaagtacaagagcagcagaaagctgatcgacagagcctacaagggcatgcccatgaacatcagaggccccatgtggagcgtgctgctgaacatcgaggagatgaagctgaagaaccccggcagataccagatcatgaaggagaagggcaagagaagcagcgagcacatccagagaatcgacagagacatcagcggcaccctgagaaagcacatgttcttcagagacagatacggcaccaagcagagagagctgctgcacatcctgctggcctacgaggagtacaaccccgaggtgggctactgcagagacctgagccacatcgccgccctgttcctgctgtacctgcccgaggaggacgccttctgggccctggtgcagctgctggccagcgagagacacagcctgcagggcttccacagccccaacggcggcaccgtgcagggcctgcaggaccagcaggagcacgtggtggccaccagccagcccaagaccatgggccaccaggacaagaaggacctgtgcggccagtgcagccccctgggctgcctgatcagaatcctgatcgacggcatcagcctgggcctgaccctgagactgtgggacgtgtacctggtggagggcgagcaggccctgatgcccatcaccagaatcgccttcaaggtgcagcagaagagactgaccaagaccagcagatgcggcccctgggccagattctgcaacagattcgtggacacctgggccagagacgaggacaccgtgctgaagcacctgagagccagcatgaagaagctgaccagaaagcagggcgacctgcccccccccgccaagcccgagcagggcagcagcgccagcagacccgtgcccgccagcagaggcggcaagaccctgtgcaagggcgacagacaggccccccccggcccccccgccagattccccagacccatctggagcgccagcccccccagagcccccagaagcagcaccccctgccccggcggcgccgtgagagaggacacctaccccgtgggcacccagggcgtgcccagccccgccctggcccagggcggcccccagggcagctggagattcctgcagtggaacagcatgcccagactgcccaccgacctggacgtggagggcccctggttcagacactacgacttcagacagagctgctgggtgagagccatcagccaggaggaccagctggccccctgctggcaggccgagcaccccgccgagagagtgagaagcgccttcgccgcccccagcaccgacagcgaccagggcacccccttcagagccagagacgagcagcagtgcgcccccaccagcggcccctgcctgtgcggcctgcacctggagagcagccagttcccccccggcttctag

SEQ ID NO: 101970 - DNA, 1410 bp, Artificial Sequence; identical to SEQ ID NO: 101968
  Description of Artificial Sequence: Synthetic coding sequence

SEQ ID NO: 101971 - DNA, 3708 bp, Artificial Sequence
  Description of Artificial Sequence: Synthetic coding sequence
atggagccccccagctgcatccaggacgagcccttcccccaccccctggagcccgagcccggcgtgagcgcccagcccggccccggcaagcccagcgacaagagattcagactgtggtacgtgggcggcagctgcctggaccacagaaccaccctgcccatgctgccctggctgatggccgagatcagaagaagaagccagaagcccgaggccggcggctgcggcgcccccgccgccagagaggtgatcctggtgctgagcgcccccttcctgagatgcgtgcccgcccccggcgccggcgccagcggcggcaccagccccagcgccacccagcccaaccccgccgtgttcatcttcgagcacaaggcccagcacatcagcagattcatccacaacagccacgacctgacctacttcgcctacctgatcaaggcccagcccgacgaccccgagagccagatggcctgccacgtgttcagagccaccgaccccagccaggtgcccgacgtgatcagcagcatcagacagctgagcaaggccgccatgaaggaggacgccaagcccagcaaggacaacgaggacgccttctacaacagccagaagttcgaggtgctgtactgcggcaaggtgaccgtgacccacaagaaggcccccagcagcctgatcgacgactgcatggagaagttcagcctgcacgagcagcagagactgaagatccagggcgagcagagaggccccgaccccggcgaggacctggccgacctggaggtggtggtgcccggcagccccggcgactgcctgcccgaggaggccgacggcaccgacacccacctgggcctgcccgccggcgccagccagcccgccctgaccagcagcagagtgtgcttccccgagagaatcctggaggacagcggcttcgacgagcagcaggagttcagaagcagatgcagcagcgtgaccggcgtgcagagaagagtgcacgagggcagccagaagagccagcccagaagaagacacgccagcgcccccagccacgtgcagcccagcgacagcgagaagaacagaaccatgctgttccaggtgggcagattcgagatcaacctgatcagccccgacaccaagagcgtggtgctggagaagaacttcaaggacatcagcagctgcagccagggcatcaagcacgtggaccacttcggcttcatctgcagagagagccccgagcccggcctgagccagtacatctgctacgtgttccagtgcgccagcgagagcctggtggacgaggtgatgctgaccctgaagcaggccttcagcaccgccgccgccctgcagagcgccaagacccagatcaagctgtgcgaggcctgccccatgcacagcctgcacaagctgtgcgagagaatcgagggcctgtacccccccagagccaagctggtgatccagagacacctgagcagcctgaccgacaacgagcaggccgacatcttcgagagagtgcagaagatgaagcccgtgagcgaccaggaggagaacgagctggtgatcctgcacctgagacagctgtgcgaggccaagcagaagacccacgtgcacatcggcgagggccccagcaccatcagcaacagcaccatccccgagaacgccaccagcagcggcagattcaagctggacatcctgaagaacaaggccaagagaagcctgaccagcagcctggagaacatcttcagcagaggcgccaacagaatgagaggcagactgggcagcgtggacagcttcgagagaagcaacagcctggccagcgagaaggactacagccccggcgacagcccccccggcaccccccccgccagcccccccagcagcgcctggcagaccttccccgaggaggacagcgacagcccccagttcagaagaagagcccacaccttcagccacccccccagcagcaccaagagaaagctgaacctgcaggacggcagagcccagggcgtgagaagccccctgctgagacagagcagcagcgagcagtgcagcgacggcgagggcagaaagagaaccagcagcacctgcagcaacgagagcctgagcgtgggcggcaccagcgtgacccccagaagaatcagctggagacagagaatcttcctgagagtggccagccccatgaacaagagccccagcgccatgcagcagcaggacggcctggacagaaacgagctgctgcccctgagccccctgagccccaccatggaggaggagcccctggtggtgttcctgagcggcgaggacgaccccgagaagatcgaggagagaaagaagagcaaggagctgagaagcctgtggagaaaggccatccaccagcagatcctgctgctgagaatggagaaggagaaccagaagctggaggccagcagagacgagctgcagagcagaaaggtgaagctggactacgaggaggtgggcgcctgccagaaggaggtgctgatcacctgggacaagaagctgctgaactgcagagccaagatcagatgcgacatggaggacatccacaccctgctgaaggagggcgtgcccaagagcagaagaggcgagatctggcagttcctggccctgcagtacagactgagacacagactgcccaacaagcagcagccccccgacatcagctacaaggagctgctgaagcagctgaccgcccagcagcacgccatcctggtggacctgggcagaaccttccccacccacccctacttcagcgtgcagctgggccccggccagctgagcctgttcaacctgctgaaggcctacagcctgctggacaaggaggtgggctactgccagggcatcagcttcgtggccggcgtgctgctgctgcacatgagcgaggagcaggccttcgagatgctgaagttcctgatgtacgacctgggcttcagaaagcagtacagacccgacatgatgagcctgcagatccagatgtaccagctgagcagactgctgcacgactaccacagagacctgtacaaccacctggaggagaacgagatcagccccagcctgtacgccgccccctggttcctgaccctgttcgccagccagttcagcctgggcttcgtggccagagtgttcgacatcatcttcctgcagggcaccgaggtgatcttcaaggtggccctgagcctgctgagcagccaggagaccctgatcatggagtgcgagagcttcgagaacatcgtggagttcctgaagaacaccctgcccgacatgaacaccagcgagatggagaagatcatcacccaggtgttcgagatggacatcagcaagcagctgcacgcctacgaggtggagtaccacgtgctgcaggacgagctgcaggagagcagctacagctgcgaggacagcgagaccctggagaagctggagagagccaacagccagctgaagagacagaacatggacctgctggagaagctgcaggtggcccacaccaagatccaggccctggagagcaacctggagaacctgctgaccagagagaccaagatgaagagcctgatcagaaccctggagcaggagaagatggcctaccagaagaccgtggagcagctgagaaagctgctgcccgccgacgccctggtgaactgcgacctgctgctgagagacctgaactgcaaccccaacaacaaggccaagatcggcaacaagccctag

SEQ ID NO: 101972 - DNA, 3897 bp, Artificial Sequence
  Description of Artificial Sequence: Synthetic coding sequence
atggagccccccagctgcatccaggacgagcccttcccccaccccctggagcccgagcccggcgtgagcgcccagcccggccccggcaagcccagcgacaagagattcagactgtggtacgtgggcggcagctgcctggaccacagaaccaccctgcccatgctgccctggctgatggccgagatcagaagaagaagccagaagcccgaggccggcggctgcggcgcccccgccgccagagaggtgatcctggtgctgagcgcccccttcctgagatgcgtgcccgcccccggcgccggcgccagcggcggcaccagccccagcgccacccagcccaaccccgccgtgttcatcttcgagcacaaggcccagcacatcagcagattcatccacaacagccacgacctgacctacttcgcctacctgatcaaggcccagcccgacgaccccgagagccagatggcctgccacgtgttcagagccaccgaccccagccaggtgcccgacgtgatcagcagcatcagacagctgagcaaggccgccatgaaggaggacgccaagcccagcaaggacaacgaggacgccttctacaacagccagaagttcgaggtgctgtactgcggcaaggtgaccgtgacccacaagaaggcccccagcagcctgatcgacgactgcatggagaagttcagcctgcacgagcagcagagactgaagatccagggcgagcagagaggccccgaccccggcgaggacctggccgacctggaggtggtggtgcccggcagccccggcgactgcctgcccgaggaggccgacggcaccgacacccacctgggcctgcccgccggcgccagccagcccgccctgaccagcagcagagtgtgcttccccgagagaatcctggaggacagcggcttcgacgagcagcaggagttcagaagcagatgcagcagcgtgaccggcgtgcagagaagagtgcacgagggcagccagaagagccagcccagaagaagacacgccagcgcccccagccacgtgcagcccagcgacagcgagaagaacagaaccatgctgttccaggtgggcagattcgagatcaacctgatcagccccgacaccaagagcgtggtgctggagaagaacttcaaggacatcagcagctgcagccagggcatcaagcacgtggaccacttcggcttcatctgcagagagagccccgagcccggcctgagccagtacatctgctacgtgttccagtgcgccagcgagagcctggtggacgaggtgatgctgaccctgaagcaggccttcagcaccgccgccgccctgcagagcgccaagacccagatcaagctgtgcgaggcctgccccatgcacagcctgcacaagctgtgcgagagaatcgagggcctgtacccccccagagccaagctggtgatccagagacacctgagcagcctgaccgacaacgagcaggccgacatcttcgagagagtgcagaagatgaagcccgtgagcgaccaggaggagaacgagctggtgatcctgcacctgagacagctgtgcgaggccaagcagaagacccacgtgcacatcggcgagggccccagcaccatcagcaacagcaccatccccgagaacgccaccagcagcggcagattcaagctggacatcctgaagaacaaggccaagagaagcctgaccagcagcctggagaacatcttcagcagaggcgccaacagaatgagaggcagactgggcagcgtggacagcttcgagagaagcaacagcctggccagcgagaaggactacagccccggcgacagcccccccggcaccccccccgccagcccccccagcagcgcctggcagaccttccccgaggaggacagcgacagcccccagttcagaagaagagcccacaccttcagccacccccccagcagcaccaagagaaagctgaacctgcaggacggcagagcccagggcgtgagaagccccctgctgagacagagcagcagcgagcagtgcagcaacctgagcagcgtgagaagaatgtacaaggagagcaacagcagcagcagcctgcccagcctgcacaccagcttcagcgcccccagcttcaccgcccccagcttcctgaagagcttctaccagaacagcggcagactgagcccccagtacgagaacgagatcagacaggacaccgccagcgagagcagcgacggcgagggcagaaagagaaccagcagcacctgcagcaacgagagcctgagcgtgggcggcaccagcgtgacccccagaagaatcagctggagacagagaatcttcctgagagtggccagccccatgaacaagagccccagcgccatgcagcagcaggacggcctggacagaaacgagctgctgcccctgagccccctgagccccaccatggaggaggagcccctggtggtgttcctgagcggcgaggacgaccccgagaagatcgaggagagaaagaagagcaaggagctgagaagcctgtggagaaaggccatccaccagcagatcctgctgctgagaatggagaaggagaaccagaagctggaggccagcagagacgagctgcagagcagaaaggtgaagctggactacgaggaggtgggcgcctgccagaaggaggtgctgatcacctgggacaagaagctgctgaactgcagagccaagatcagatgcgacatggaggacatccacaccctgctgaaggagggcgtgcccaagagcagaagaggcgagatctggcagttcctggccctgcagtacagactgagacacagactgcccaacaagcagcagccccccgacatcagctacaaggagctgctgaagcagctgaccgcccagcagcacgccatcctggtggacctgggcagaaccttccccacccacccctacttcagcgtgcagctgggccccggccagctgagcctgttcaacctgctgaaggcctacagcctgctggacaaggaggtgggctactgccagggcatcagcttcgtggccggcgtgctgctgctgcacatgagcgaggagcaggccttcgagatgctgaagttcctgatgtacgacctgggcttcagaaagcagtacagacccgacatgatgagcctgcagatccagatgtaccagctgagcagactgctgcacgactaccacagagacctgtacaaccacctggaggagaacgagatcagccccagcctgtacgccgccccctggttcctgaccctgttcgccagccagttcagcctgggcttcgtggccagagtgttcgacatcatcttcctgcagggcaccgaggtgatcttcaaggtggccctgagcctgctgagcagccaggagaccctgatcatggagtgcgagagcttcgagaacatcgtggagttcctgaagaacaccctgcccgacatgaacaccagcgagatggagaagatcatcacccaggtgttcgagatggacatcagcaagcagctgcacgcctacgaggtggagtaccacgtgctgcaggacgagctgcaggagagcagctacagctgcgaggacagcgagaccctggagaagctggagagagccaacagccagctgaagagacagaacatggacctgctggagaagctgcaggtggcccacaccaagatccaggccctggagagcaacctggagaacctgctgaccagagagaccaagatgaagagcctgatcagaaccctggagcaggagaagatggcctaccagaagaccgtggagcagctgagaaagctgctgcccgccgacgccctggtgaactgcgacctgctgctgagagacctgaactgcaaccccaacaacaaggccaagatcggcaacaagccctag

SEQ ID NO: 101973 - DNA, 849 bp, Artificial Sequence
  Description of Artificial Sequence: Synthetic coding sequence
gacaacgagcaggccgacatcttcgagagagtgcagaagatgaagcccgtgagcgaccaggaggagaacgagctggtgatcctgcacctgagacagctgtgcgaggccaagcagaagacccacgtgcacatcggcgagggccccagcaccatcagcaacagcaccatccccgagaacgccaccagcagcggcagattcaagctggacatcctgaagaacaaggccaagagaagcctgaccagcagcctggagaacatcttcagcagaggcgccaacagaatgagaggcagactgggcagcgtggacagcttcgagagaagcaacagcctggccagcgagaaggactacagccccggcgacagcccccccggcaccccccccgccagcccccccagcagcgcctggcagaccttccccgaggaggacagcgacagcccccagttcagaagaagagcccacaccttcagccacccccccagcagcaccaagagaaagctgaacctgcaggacggcagagcccagggcgtgagaagccccctgctgagacagagcagcagcgagcagtgcagcgacggcgagggcagaaagagaaccagcagcacctgcagcaacgagagcctgagcgtgggcggcaccagcgtgacccccagaagaatcagctggagacagagaatcttcctgagagtggccagccccatgaacaagagccccagcgccatgcagcagcaggacggcctggacagaaacgagctgctgcccctgagccccctgagccccaccatggaggaggagcccctggtggtgttcctgagcggcgaggacgaccccgagaagatcgaggagagatag

SEQ ID NO: 101974 - DNA, 1389 bp, Artificial Sequence
  Description of Artificial Sequence: Synthetic coding sequence
atgaacaagagccccagcgccatgcagcagcaggacggcctggacagaaacgagctgctgcccctgagccccctgagccccaccatggaggaggagcccctggtggtgttcctgagcggcgaggacgaccccgagaagatcgaggagagaaagaagagcaaggagctgagaagcctgtggagaaaggccatccaccagcagatcctgctgctgagaatggagaaggagaaccagaagctggagggcgtgcccaagagcagaagaggcgagatctggcagttcctggccctgcagtacagactgagacacagactgcccaacaagcagcagccccccgacatcagctacaaggagctgctgaagcagctgaccgcccagcagcacgccatcctggtggacctgggcagaaccttccccacccacccctacttcagcgtgcagctgggccccggccagctgagcctgttcaacctgctgaaggcctacagcctgctggacaaggaggtgggctactgccagggcatcagcttcgtggccggcgtgctgctgctgcacatgagcgaggagcaggccttcgagatgctgaagttcctgatgtacgacctgggcttcagaaagcagtacagacccgacatgatgagcctgcagatccagatgtaccagctgagcagactgctgcacgactaccacagagacctgtacaaccacctggaggagaacgagatcagccccagcctgtacgccgccccctggttcctgaccctgttcgccagccagttcagcctgggcttcgtggccagagtgttcgacatcatcttcctgcagggcaccgaggtgatcttcaaggtggccctgagcctgctgagcagccaggagaccctgatcatggagtgcgagagcttcgagaacatcgtggagttcctgaagaacaccctgcccgacatgaacaccagcgagatggagaagatcatcacccaggtgttcgagatggacatcagcaagcagctgcacgcctacgaggtggagtaccacgtgctgcaggacgagctgcaggagagcagctacagctgcgaggacagcgagaccctggagaagctggagagagccaacagccagctgaagagacagaacatggacctgctggagaagctgcaggtggcccacaccaagatccaggccctggagagcaacctggagaacctgctgaccagagagaccaagatgaagagcctgatcagaaccctggagcaggagaagatggcctaccagaagaccgtggagcagctgagaaagctgctgcccgccgacgccctggtgaactgcgacctgctgctgagagacctgaactgcaaccccaacaacaaggccaagatcggcaacaagccctag

SEQ ID NO: 101975 - DNA, 3873 bp, Artificial Sequence
  Description of Artificial Sequence: Synthetic coding sequence
atggagccccccagctgcatccaggacgagcccttcccccaccccctggagcccgagcccggcgtgagcgcccagcccggccccggcaagcccagcgacaagagattcagactgtggtacgtgggcggcagctgcctggaccacagaaccaccctgcccatgctgccctggctgatggccgagatcagaagaagaagccagaagcccgaggccggcggctgcggcgcccccgccgccagagaggtgatcctggtgctgagcgcccccttcctgagatgcgtgcccgcccccggcgccggcgccagcggcggcaccagccccagcgccacccagcccaaccccgccgtgttcatcttcgagcacaaggcccagcacatcagcagattcatccacaacagccacgacctgacctacttcgcctacctgatcaaggcccagcccgacgaccccgagagccagatggcctgccacgtgttcagagccaccgaccccagccaggtgcccgacgtgatcagcagcatcagacagctgagcaaggccgccatgaaggaggacgccaagcccagcaaggacaacgaggacgccttctacaacagccagaagttcgaggtgctgtactgcggcaaggtgaccgtgacccacaagaaggcccccagcagcctgatcgacgactgcatggagaagttcagcctgcacgagcagcagagactgaagatccagggcgagcagagaggccccgaccccggcgaggacctggccgacctggaggtggtggtgcccggcagccccggcgactgcctgcccgaggaggccgacggcaccgacacccacctgggcctgcccgccggcgccagccagcccgccctgaccagcagcagagtgtgcttccccgagagaatcctggaggacagcggcttcgacgagcagcaggagttcagaagcagatgcagcagcgtgaccggcgtgcagagaagagtgcacgagggcagccagaagagccagcccagaagaagacacgccagcgcccccagccacgtgcagcccagcgacagcgagaagaacagaaccatgctgttccaggtgggcagattcgagatcaacctgatcagccccgacaccaagagcgtggtgctggagaagaacttcaaggacatcagcagctgcagccagggcatcaagcacgtggaccacttcggcttcatctgcagagagagccccgagcccggcctgagccagtacatctgctacgtgttccagtgcgccagcgagagcctggtggacgaggtgatgctgaccctgaagcaggccttcagcaccgccgccgccctgcagagcgccaagacccagatcaagctgtgcgaggcctgccccatgcacagcctgcacaagctgtgcgagagaatcgagggcctgtacccccccagagccaagctggtgatccagagacacctgagcagcctgaccgacaacgagcaggccgacatcttcgagagagtgcagaagatgaagcccgtgagcgaccaggaggagaacgagctggtgatcctgcacctgagacagctgtgcgaggccaagcagaagacccacgtgcacatcggcgagggccccagcaccatcagcaacagcaccatccccgagaacgccaccagcagcggcagattcaagctggacatcctgaagaacaaggccaagagaagcctgaccagcagcctggagaacatcttcagcagaggcgccaacagaatgagaggcagactgggcagcgtggacagcttcgagagaagcaacagcctggccagcgagaaggactacagccccggcgacagcccccccggcaccccccccgccagcccccccagcagcgcctggcagaccttccccgaggaggacagcgacagcccccagttcagaagaagagcccacaccttcagccacccccccagcagcaccaagagaaagctgaacctgcaggacggcagagcccagggcgtgagaagccccctgctgagacagagcagcagcgagcagtgcagcaacctgagcagcgtgagaagaatgtacaaggagagcaacagcagcagcagcctgcccagcctgcacaccagcttcagcgcccccagcttcaccgcccccagcttcctgaagagcttctaccagaacagcggcagactgagcccccagtacgagaacgagatcagcgacggcgagggcagaaagagaaccagcagcacctgcagcaacgagagcctgagcgtgggcggcaccagcgtgacccccagaagaatcagctggagacagagaatcttcctgagagtggccagccccatgaacaagagccccagcgccatgcagcagcaggacggcctggacagaaacgagctgctgcccctgagccccctgagccccaccatggaggaggagcccctggtggtgttcctgagcggcgaggacgaccccgagaagatcgaggagagaaagaagagcaaggagctgagaagcctgtggagaaaggccatccaccagcagatcctgctgctgagaatggagaaggagaaccagaagctggaggccagcagagacgagctgcagagcagaaaggtgaagctggactacgaggaggtgggcgcctgccagaaggaggtgctgatcacctgggacaagaagctgctgaactgcagagccaagatcagatgcgacatggaggacatccacaccctgctgaaggagggcgtgcccaagagcagaagaggcgagatctggcagttcctggccctgcagtacagactgagacacagactgcccaacaagcagcagccccccgacatcagctacaaggagctgctgaagcagctgaccgcccagcagcacgccatcctggtggacctgggcagaaccttccccacccacccctacttcagcgtgcagctgggccccggccagctgagcctgttcaacctgctgaaggcctacagcctgctggacaaggaggtgggctactgccagggcatcagcttcgtggccggcgtgctgctgctgcacatgagcgaggagcaggccttcgagatgctgaagttcctgatgtacgacctgggcttcagaaagcagtacagacccgacatgatgagcctgcagatccagatgtaccagctgagcagactgctgcacgactaccacagagacctgtacaaccacctggaggagaacgagatcagccccagcctgtacgccgccccctggttcctgaccctgttcgccagccagttcagcctgggcttcgtggccagagtgttcgacatcatcttcctgcagggcaccgaggtgatcttcaaggtggccctgagcctgctgagcagccaggagaccctgatcatggagtgcgagagcttcgagaacatcgtggagttcctgaagaacaccctgcccgacatgaacaccagcgagatggagaagatcatcacccaggtgttcgagatggacatcagcaagcagctgcacgcctacgaggtggagtaccacgtgctgcaggacgagctgcaggagagcagctacagctgcgaggacagcgagaccctggagaagctggagagagccaacagccagctgaagagacagaacatggacctgctggagaagctgcaggtggcccacaccaagatccaggccctggagagcaacctggagaacctgctgaccagagagaccaagatgaagagcctgatcagaaccctggagcaggagaagatggcctaccagaagaccgtggagcagctgagaaagctgctgcccgccgacgccctggtgaactgcgacctgctgctgagagacctgaactgcaaccccaacaacaaggccaagatcggcaacaagccctag

SEQ ID NO: 101976 - DNA, 1197 bp, Artificial Sequence
  Description of Artificial Sequence: Synthetic coding sequence
atgcacttcagcaccgtgaccagagacatggaggccttcaccgccagcagcctgagcagcctgggcgccgccggcggcttccccggcgccgccagccccggcgccgacccctacggccccagagagccccccccccccccccccagatacgacccctgcgccgccgccgcccccggcgcccccggcccccccccccccccccacgcctaccccttcgcccccgccgccggcgccgccaccagcgccgccgccgagcccgagggccccggcgccagctgcgccgccgccgccaaggcccccgtgaagaagaacgccaaggtggccggcgtgagcgtgcagctggagatgaaggccctgtgggacgagttcaaccagctgggcaccgagatgatcgtgaccaaggccggcagaagaatgttccccaccttccaggtgaagctgttcggcatggaccccatggccgactacatgctgctgatggacttcgtgcccgtggacgacaagagatacagatacgccttccacagcagcagctggctggtggccggcaaggccgaccccgccacccccggcagagtgcactaccaccccgacagccccgccaagggcgcccagtggatgaagcagatcgtgagcttcgacaagctgaagctgaccaacaacctgctggacgacaacggccacatcatcctgaacagcatgcacagataccagcccagattccacgtggtgtacgtggaccccagaaaggacagcgagaagtacgccgaggagaacttcaagaccttcgtgttcgaggagaccagattcaccgccgtgaccgcctaccagaaccacagaatcacccagctgaagatcgccagcaaccccttcgccaagggcttcagagactgcgaccccgaggactggcccagaaaccacagacccggcgccctgcccctgatgagcgccttcgccagaagcagaaaccccgtggccagccccacccagcccagcggcaccgagaagggcggccacgtgctgaaggacaaggaggtgaaggccgagaccagcagaaacacccccgagagagaggtggagctgctgagagacgccggcggctgcgtgaacctgggcctgccctgccccgccgagtgccagcccttcaacacccagggcctggtggccggcagaaccgccggcgacagactgtgctag

SEQ ID NO: 101977 - DNA, 1488 bp, Artificial Sequence
  Description of Artificial Sequence: Synthetic coding sequence
atgcacttcagcaccgtgaccagagacatggaggccttcaccgccagcagcctgagcagcctgggcgccgccggcggcttccccggcgccgccagccccggcgccgacccctacggccccagagagccccccccccccccccccagatacgacccctgcgccgccgccgcccccggcgcccccggcccccccccccccccccacgcctaccccttcgcccccgccgccggcgccgccaccagcgccgccgccgagcccgagggccccggcgccagctgcgccgccgccgccaaggcccccgtgaagaagaacgccaaggtggccggcgtgagcgtgcagctggagatgaaggccctgtgggacgagttcaaccagctgggcaccgagatgatcgtgaccaaggccggcagaagaatgttccccaccttccaggtgaagctgttcggcatggaccccatggccgactacatgctgctgatggacttcgtgcccgtggacgacaagagatacagatacgccttccacagcagcagctggctggtggccggcaaggccgaccccgccacccccggcagagtgcactaccaccccgacagccccgccaagggcgcccagtggatgaagcagatcgtgagcttcgacaagctgaagctgaccaacaacctgctggacgacaacggccacatcatcctgaacagcatgcacagataccagcccagattccacgtggtgtacgtggaccccagaaaggacagcgagaagtacgccgaggagaacttcaagaccttcgtgttcgaggagaccagattcaccgccgtgaccgcctaccagaaccacagaatcacccagctgaagatcgccagcaaccccttcgccaagggcttcagagactgcgaccccgaggactggcccagaaaccacagacccggcgccctgcccctgatgagcgccttcgccagaagcagaaaccccgtggccagccccacccagcccagcggcaccgagaaggacgccgccgaggccagaagagagttccagagagacgccggcggccccgccgtgctgggcgaccccgcccaccccccccagctgctggccagagtgctgagccccagcctgcccggcgccggcggcgccggcggcctggtgcccctgcccggcgcccccggcggcagacccagcccccccaaccccgagctgagactggaggcccccggcgccagcgagcccctgcaccaccacccctacaagtaccccgccgccgcctacgaccactacctgggcgccaagagcagacccgccccctaccccctgcccggcctgagaggccacggctaccacccccacgcccacccccaccaccaccaccaccccgtgagccccgccgccgccgccgccgccgccgccgccgccgccgccgccgccgccaacatgtacagcagcgccggcgccgccccccccggcagctacgactactgccccagatag

SEQ ID NO: 101978 - DNA, 1119 bp, Artificial Sequence
  Description of Artificial Sequence: Synthetic coding sequence
atgcacttcagcaccgtgaccagagacatggaggccttcaccgccagcagcctgagcagcctgggcgccgccggcggcttccccggcgccgccagccccggcgccgacccctacggccccagagagccccccccccccccccccagatacgacccctgcgccgccgccgcccccggcgcccccggcccccccccccccccccacgcctaccccttcgcccccgccgccggcgccgccaccagcgccgccgccgagcccgagggccccggcgccagctgcgccgccgccgccaaggcccccgtgaagaagaacgccaaggtggccggcgtgagcgtgcagctggagatgaaggccctgtgggacgagttcaaccagctgggcaccgagatgatcgtgaccaaggccggcagaagaatgttccccaccttccaggtgaagctgttcggcatggaccccatggccgactacatgctgctgatggacttcgtgcccgtggacgacaagagatacagatacgccttccacagcagcagctggctggtggccggcaaggccgaccccgccacccccggcagagtgcactaccaccccgacagccccgccaagggcgcccagtggatgaagcagatcgtgagcttcgacaagctgaagctgaccaacaacctgctggacgacaacggccacatcatcctgaacagcatgcacagataccagcccagattccacgtggtgtacgtggaccccagaaaggacagcgagaagtacgccgaggagaacttcaagaccttcgtgttcgaggagaccagattcaccgccgtgaccgcctaccagaaccacagaatcacccagctgaagatcgccagcaaccccttcgccaagggcttcagagactgcgaccccgaggactggcccagaaaccacagacccggcgccctgcccctgatgagcgccttcgccagaagcagaaaccccgtggccagccccacccagcccagcggcaccgagaagggcctggtgaccgagggcagcggcctgcagcccggcctgctggacgtgctgctgaagccccccagcaagaagagcgagagcctgagacccccccactgcaaggacacctag

SEQ ID NO: 101979 - DNA, 1158 bp, Artificial Sequence
  Description of Artificial Sequence: Synthetic coding sequence
atggccgccttcctgagcgccggcctgggcatcctggcccccagcgagacctaccccctgcccaccaccagcagcggctgggagcccagactgggcagccccttccccagcggcccctgcaccagcagcaccggcgcccaggccgtggccgagcccaccggccagggccccaagaaccccagagtgagcagagtgaccgtgcagctggagatgaagcccctgtgggaggagttcaaccagctgggcaccgagatgatcgtgaccaaggccggcagaagaatgttcccccccttccaggtgaagatcctgggcatggacagcctggccgactacgccctgctgatggacttcatccccctggacgacaagagatacagatacgccttccacagcagcgcctggctggtggccggcaaggccgaccccgccacccccggcagagtgcacttccaccccgacagccccgccaagggcgcccagtggatgagacagatcgtgagcttcgacaagctgaagctgaccaacaacctgctggacgacaacggccacatcatcctgaacagcatgcacagataccagcccagattccacgtggtgttcgtggaccccagaaaggacagcgagagatacgcccaggagaacttcaagagcttcatcttcaccgagacccagttcaccgccgtgaccgcctaccagaaccacagaatcacccagctgaagatcgccagcaaccccttcgccaagggcttcagagagagcgacctggacagctggcccgtggcccccagacccctgctgagcgtgcccgccagaagccacagcagcctgagcccctgcgtgctgaagggcgccaccgacagagagaaggaccccaacaaggccagcgccagcaccagcaagacccccgcctggctgcaccaccagctgctgcccccccccgaggtgctgctggcccccgccacctacagacccgtgacctaccagagcctgtacagcggcgcccccagccacctgggcatccccagaaccagacccgccccctaccccctgcccaacatcagagccgacagagaccagggcggcctgcccctgcccgccggcctgggcctgctgagccccaccgtggtgtgcctgggccccggccaggacagccagtag

SEQ ID NO: 101980 - DNA, 2454 bp, Artificial Sequence
  Description of Artificial Sequence: Synthetic coding sequence
atgatggacggccccagaagcgacgtgggcagatggggcggcaaccccctgcagccccccaccacccccagccccgagcccgagcccgagcccgacggcagaagcagaagaggcggcggcagaagcttctgggccagatgctgcggctgctgcagctgcagaaacgccgccgacgacgactggggccccgagcccagcgacagcagaggcagaggcagcagcagcggcaccagaagacccggcagcagaggcagcgacagcagaagacccgtgagcagaggcagcggcgtgaacgccgccggcgacggcaccatcagagagggcatgctggtggtgaacggcgtggacctgctgagcagcagaagcgaccagaacagaagagagcaccacaccgacgagtacgagtacgacgagctgatcgtgagaagaggccagcccttccacatgctgctgctgctgagcagaacctacgagagcagcgacagaatcaccctggagctgctgatcggcaacaaccccgaggtgggcaagggcacccacgtgatcatccccgtgggcaagggcggcagcggcggctggaaggcccaggtggtgaaggccagcggccagaacctgaacctgagagtgcacaccagccccaacgccatcatcggcaagttccagttcaccgtgagaacccagagcgacgccggcgagttccagctgcccttcgaccccagaaacgagatctacatcctgttcaacccctggtgccccgaggacatcgtgtacgtggaccacgaggactggagacaggagtacgtgctgaacgagagcggcagaatctactacggcaccgaggcccagatcggcgagagaacctggaactacggccagttcgaccacggcgtgctggacgcctgcctgtacatcctggacagaagaggcatgccctacggcggcagaggcgaccccgtgaacgtgagcagagtgatcagcgccatggtgaacagcctggacgacaacggcgtgctgatcggcaactggagcggcgactacagcagaggcaccaaccccagcgcctgggtgggcagcgtggagatcctgctgagctacctgagaaccggctacagcgtgccctacggccagtgctgggtgttcgccggcgtgaccaccaccgtgctgagatgcctgggcctggccaccagaaccgtgaccaacttcaacagcgcccacgacaccgacaccagcctgaccatggacatctacttcgacgagaacatgaagcccctggagcacctgaaccacgacagcgtgtggaacttccacgtgtggaacgactgctggatgaagagacccgacctgcccagcggcttcgacggctggcaggtggtggacgccaccccccaggagaccagcagcggcatcttctgctgcggcccctgcagcgtggagagcatcaagaacggcctggtgtacatgaagtacgacacccccttcatcttcgccgaggtgaacagcgacaaggtgtactggcagagacaggacgacggcagcttcaagatcgtgtacgtggaggagaaggccatcggcaccctgatcgtgaccaaggccatcagcagcaacatgagagaggacatcacctacctgtacaagcaccccgagggcagcgacgccgagagaaaggccgtggagaccgccgccgcccacggcagcaagcccaacgtgtacgccaacagaggcagcgccgaggacgtggccatgcaggtggaggcccaggacgccgtgatgggccaggacctgatggtgagcgtgatgctgatcaaccacagcagcagcagaagaaccgtgaagctgcacctgtacctgagcgtgaccttctacaccggcgtgagcggcaccatcttcaaggagaccaagaaggaggtggagctggcccccggcgccagcgacagagtgaccatgcccgtggcctacaaggagtacagaccccacctggtggaccagggcgccatgctgctgaacgtgagcggccacgtgaaggagagcggccaggtgctggccaagcagcacaccttcagactgagaacccccgacctgagcctgaccctgctgggcgccgccgtggtgggccaggagtgcgaggtgcagatcgtgttcaagaaccccctgcccgtgaccctgaccaacgtggtgttcagactggagggcagcggcctgcagagacccaagatcctgaacgtgggcgacatcggcggcaacgagaccgtgaccctgagacagagcttcgtgcccgtgagacccggccccagacagctgatcgccagcctggacagcccccagctgagccaggtgcacggcgtgatccaggtggacgtggcccccgcccccggcgacggcggcttcttcagcgacgccggcggcgacagccacctgggcgagaccatccccatggccagcagaggcggcgcctag

SEQ ID NO: 101981 - DNA, 1200 bp, Artificial Sequence
  Description of Artificial Sequence: Synthetic coding sequence
atgcacaagtaccagcccagagtgcacgtgatcagaaaggacttcagcagcgacctgagccccaccaagcccgtgcccgtgggcgacggcgtgaagaccttcaacttccccgagaccgtgttcaccaccgtgaccgcctaccagaaccagcagatcaccagactgaagatcgacagaaaccccttcgccaagggcttcagagacagcggcagaaacagaaccggcctggaggccatcatggagacctacgccttctggagaccccccgtgagaaccctgaccttcgaggacttcaccaccatgcagaagcagcaggccagcaagaagaccagccagggctacaccgtgaaccagcacagcagcgagaccgacgccatcgagctgtacgagagaagagtgtggctgatggagagaagaggcagcaccggcaccagccccaccaccagcagcaccggcacccccagccccagcgccagcagccacctgctgagccccagctgcagcccccccaccttccacctggcccccaacaccttcaacgtgggctgcagagagagccagctgtgcaacctgaacctgagcgactaccccccctgcgccagaagcaacatggccgccctgcagagctaccccggcctgagcgacagcggctacaacagactgcagagcggcaccaccagcgccacccagcccagcgagaccttcatgccccagagaacccccagcctgatcagcggcatccccaccccccccagcctgcccggcaacagcaagatggaggcctacggcggccagctgggcagcttccccaccagccagttccagtacgtgatgcaggccggcaacgccgccagcagcagcagcagcccccacatgttcggcggcagccacatgcagcagagcagctacaacgccttcagcctgcacaacccctacaacctgtacggctacaacttccccaccagccccagactggccgccagccccgagaagctgagcgccagccagagcaccctgctgtgcagcagccccagcaacggcgccttcggcgagagacagtacctgcccagcggcatggagcacagcatgcacatgatcagccccagccccaacaaccagcaggccaccaacacctgcgacggcagacagtacggcgccgtgcccggcagcagcagccagatgagcgtgcacatggtgtag

SEQ ID NO: 101982 - DNA, 1809 bp, Artificial Sequence
  Description of Artificial Sequence: Synthetic coding sequence
atgagcgagagaagaagaagcgccgtggccctgagcagcagagcccacgccttcagcgtggaggccctgatcggcagcaacaagaagagaaagctgagagactgggaggagaagggcctggacctgagcatggaggccctgagccccgccggccccctgggcgacaccgaggacgccgccgcccacggcctggagccccaccccgacagcgagcagagcaccggcagcgacagcgaggtgctgaccgagagaaccagctgcagcttcagcacccacaccgacctggccagcggcgccgccggccccgtgcccgccgccatgagcagcatggaggagatccaggtggagctgcagtgcgccgacctgtggaagagattccacgacatcggcaccgagatgatcatcaccaaggccggcagaagaatgttccccgccatgagagtgaagatcaccggcctggacccccaccagcagtactacatcgccatggacatcgtgcccgtggacaacaagagatacagatacgtgtaccacagcagcaagtggatggtggccggcaacgccgacagccccgtgccccccagagtgtacatccaccccgacagcctggccagcggcgacacctggatgagacaggtggtgagcttcgacaagctgaagctgaccaacaacgagctggacgaccagggccacatcatcctgcacagcatgcacaagtaccagcccagagtgcacgtgatcagaaaggacttcagcagcgacctgagccccaccaagcccgtgcccgtgggcgacggcgtgaagaccttcaacttccccgagaccgtgttcaccaccgtgaccgcctaccagaaccagcagatcaccagactgaagatcgacagaaaccccttcgccaagggcttcagagacagcggcagaaacagaaccggcctggaggccatcatggagacctacgccttctggagaccccccgtgagaaccctgaccttcgaggacttcaccaccatgcagaagcagcagggcggcagcaccggcaccagccccaccaccagcagcaccggcacccccagccccagcgccagcagccacctgctgagccccagctgcagcccccccaccttccacctggcccccaacaccttcaacgtgggctgcagagagagccagctgtgcaacctgaacctgagcgactaccccccctgcgccagaagcaacatggccgccctgcagagctaccccggcctgagcgacagcggctacaacagactgcagagcggcaccaccagcgccacccagcccagcgagaccttcatgccccagagaacccccagcctgatcagcggcatccccaccccccccagcctgcccggcaacagcaagatggaggcctacggcggccagctgggcagcttccccaccagccagttccagtacgtgatgcaggccggcaacgccgccagcagcagcagcagcccccacatgttcggcggcagccacatgcagcagagcagctacaacgccttcagcctgcacaacccctacaacctgtacggctacaacttccccaccagccccagactggccgccagccccgagaagctgagcgccagccagagcaccctgctgtgcagcagccccagcaacggcgccttcggcgagagacagtacctgcccagcggcatggagcacagcatgcacatgatcagccccagccccaacaaccagcaggccaccaacacctgcgacggcagacagtacggcgccgtgcccggcagcagcagccagatgagcgtgcacatggtgtag

SEQ ID NO: 101983 - DNA, 762 bp, Artificial Sequence
  Description of Artificial Sequence: Synthetic coding sequence
agagtgagaaccggcctggaggccatcatggagacctacgccttctggagaccccccgtgagaaccctgaccttcgaggacttcaccaccatgcagaagcagcaggccagcaagaagaccagccagggctacaccgtgaaccagcacagcagcgagaccgacgccatcgagctgtacgagagaagagtgtggctgatggagagaagaggcagcaccggcaccagccccaccaccagcagcaccggcacccccagccccagcgccagcagccacctgctgagccccagctgcagcccccccaccttccacctggcccccaacaccttcaacgtgggctgcagagagagccagctgtgcaacctgaacctgagcgactaccccccctgcgccagaagcaacatggccgccctgcagagctaccccggcctgagcgacagcggctacaacagactgcagagcggcaccaccagcgccacccagcccagcgagaccttcatgccccagagaacccccagcctgatcagcggcatccccaccccccccagcctgcccaccgccagatggaagcccaccgtggccagctggggccccttccccctgcccagcttcagcatgagctgcagacaggccatgctgccccccgccccccaccaccacacctgcagcggcgccgccacctgcagcagagcccccaccatgcccagccccttcaccaccctgaccacctgcatggacaccatcagccccctgcccctgggctag

SEQ ID NO: 101984 - DNA, 993 bp, Artificial Sequence
  Description of Artificial Sequence: Synthetic coding sequence
ggcagaaacagaaccggcctggaggccatcatggagacctacgccttctggagaccccccgtgagaaccctgaccttcgaggacttcaccaccatgcagaagcagcaggccagcaagaagaccagccagggctacaccgtgaaccagcacagcagcgagaccgacgccatcgagctgtacgagagaagagtgtggctgatggagagaagaggcagcaccggcaccagccccaccaccagcagcaccggcacccccagccccagcgccagcagccacctgctgagccccagctgcagcccccccaccttccacctggcccccaacaccttcaacgtgggctgcagagagagccagctgtgcaacctgaacctgagcgactaccccccctgcgccagaagcaacatggccgccctgcagagctaccccggcctgagcgacagcggctacaacagactgcagagcggcaccaccagcgccacccagcccagcgagaccttcatgccccagagaacccccagcctgatcagcggcatccccaccccccccagcctgcccggcaacagcaagatggaggcctacggcggccagctgggcagcttccccaccagccagttccagtacgtgatgcaggccggcaacgccgccagcagcagcagcagcccccacatgttcggcggcagccacatgcagcagagcagctacaacgccttcagcctgcacaacccctacaacctgtacggctacaacttccccaccagccccagactggccgccagccccgagaagctgagcgccagccagagcaccctgctgtgcagcagccccagcaacggcgccttcggcgagagacagtacctgcccagcggcatggagcacagcatgcacatgatcagccccagccccaacaaccagcaggccaccaacacctgcgacggcagacagtacggcgccgtgcccggcagcagcagccagatgagcgtgcacatggtgtag

SEQ ID NO: 101985 - DNA, 1347 bp, Artificial Sequence
  Description of Artificial Sequence: Synthetic coding sequence
atggccatgagcgagctgggcaccagaaagcccagcgacggcaccgtgagccacctgctgaacgtggtggagagcgagctgcaggccggcagagagaagggcgaccccaccgagaagcagctgcagatcatcctggaggacgcccccctgtggcagagattcaaggaggtgaccaacgagatgatcgtgaccaagaacggcagaagaatgttccccgtgctgaagatcagcgtgaccggcctggaccccaacgccatgtacagcctgctgctggacttcgtgcccaccgacagccacagatggaagtacgtgaacggcgagtgggtgcccgccggcaagcccgaggtgagcagccacagctgcgtgtacatccaccccgacagccccaacttcggcgcccactggatgaaggcccccatcagcttcagcaaggtgaagctgaccaacaagctgaacggcggcggccagatcatgctgaacagcctgcacaagtacgagccccaggtgcacatcgtgagagtgggcagcgcccacagaatggtgaccaactgcagcttccccgagacccagttcatcgccgtgaccgcctaccagaacgaggagatcaccgccctgaagatcaagtacaaccccttcgccaaggccttcctggacgccaaggagagaaaccacctgagagacgtgcccgaggccatcagcgagagccagcacgtgacctacagccacctgggcggctggatcttcagcaaccccgacggcgtgtgcaccgccggcaacagcaactaccagtacgccgcccccctgcccctgcccgccccccacacccaccacggctgcgagcactacagcggcctgagaggccacagacaggccccctaccccagcgcctacatgcacagaaaccacagccccagcgtgaacctgatcgagagcagcagcaacaacctgcaggtgttcagcggccccgacagctggaccagcctgagcagcaccccccacgccagcatcctgagcgtgccccacaccaacggccccatcaaccccggccccagcccctacccctgcctgtggaccatcagcaacggcgccggcggccccagcggccccggccccgaggtgcacgccagcacccccggcgccttcctgctgggcaaccccgccgtgaccagcccccccagcgtgctgagcacccaggcccccaccagcgccggcgtggaggtgctgggcgagcccagcctgaccagcatcgccgtgagcacctggaccgccgtggccagccaccccttcgccggctggggcggccccggcgccggcggccaccacagccccagcagcctggacggctag

SEQ ID NO: 101986 - DNA, 978 bp, Artificial Sequence
  Description of Artificial Sequence: Synthetic coding sequence
atgatcgtgaccaagaacggcagaagaatgttccccgtgctgaagatcagcgtgaccggcctggaccccaacgccatgtacagcctgctgctggacttcgtgcccaccgacagccacagatggaagtacgtgaacggcgagtgggtgcccgccggcaagcccgaggtgagcagccacagctgcgtgtacatccaccccgacagccccaacttcggcgcccactggatgaaggcccccatcagcttcagcaaggtgaagctgaccaacaagctgaacggcggcggccagatcatgctgaacagcctgcacaagtacgagccccaggtgcacatcgtgagagtgggcagcgcccacagaatggtgaccaactgcagcttccccgagacccagttcatcgccgtgaccgcctaccagaacgaggagatcaccgccctgaagatcaagtacaaccccttcgccaaggccttcctggacgccaaggagagaaaccacctgagagacgtgcccgaggccatcagcgagagccagcacgtgacctacagccacctgaacctgatcgagagcagcagcaacaacctgcaggtgttcagcggccccgacagctggaccagcctgagcagcaccccccacgccagcatcctgagcgtgccccacaccaacggccccatcaaccccggccccagcccctacccctgcctgtggaccatcagcaacggcgccggcggccccagcggccccggccccgaggtgcacgccagcacccccggcgccttcctgctgggcaaccccgccgtgaccagcccccccagcgtgctgagcacccaggcccccaccagcgccggcgtggaggtgctgggcgagcccagcctgaccagcatcgccgtgagcacctggaccgccgtggccagccaccccttcgccggctggggcggccccggcgccggcggccaccacagccccagcagcctggacggctag

SEQ ID NO: 101987 - DNA, 957 bp, Artificial Sequence
  Description of Artificial Sequence: Synthetic coding sequence
tgaagaatgttccccgtgctgaagatcagcgtgaccggcctggaccccaacgccatgtacagcctgctgctggacttcgtgcccaccgacagccacagatggaagtacgtgaacggcgagtgggtgcccgccggcaagcccgaggtgagcagccacagctgcgtgtacatccaccccgacagccccaacttcggcgcccactggatgaaggcccccatcagcttcagcaaggtgaagctgaccaacaagctgaacggcggcggccagatcatgctgaacagcctgcacaagtacgagccccaggtgcacatcgtgagagtgggcagcgcccacagaatggtgaccaactgcagcttccccgagacccagttcatcgccgtgaccgcctaccagaacgaggagatcaccgccctgaagatcaagtacaaccccttcgccaaggccttcctggacgccaaggagagaaaccacctgagagacgtgcccgaggccatcagcgagagccagcacgtgacctacagccacctgaacctgatcgagagcagcagcaacaacctgcaggtgttcagcggccccgacagctggaccagcctgagcagcaccccccacgccagcatcctgagcgtgccccacaccaacggccccatcaaccccggccccagcccctacccctgcctgtggaccatcagcaacggcgccggcggccccagcggccccggccccgaggtgcacgccagcacccccggcgccttcctgctgggcaaccccgccgtgaccagcccccccagcgtgctgagcacccaggcccccaccagcgccggcgtggaggtgctgggcgagcccagcctgaccagcatcgccgtgagcacctggaccgccgtggccagccaccccttcgccggctggggcggccccggcgccggcggccaccacagccccagcagcctggacggctag

SEQ ID NO: 101988 - DNA, 846 bp, Artificial Sequence
  Description of Artificial Sequence: Synthetic coding sequence
tgaaaggagagagagctgaactggttctacagaagacagagagtgctgttcgcccacgtgtaccccaccttcaccaacaccagctgcctgtgcaagtgcaagatcaccgccctgaagatcaagtacaaccccttcgccaaggccttcctggacgccaaggagagaaaccacctgagagacgtgcccgaggccatcagcgagagccagcacgtgacctacagccacctgggcggctggatcttcagcaaccccgacggcgtgtgcaccgccggcaacagcaactaccagtacgccgcccccctgcccctgcccgccccccacacccaccacggctgcgagcactacagcggcctgagaggccacagacaggccccctaccccagcgcctacatgcacagaaaccacagccccagcgtgaacctgatcgagagcagcagcaacaacctgcaggtgttcagcggccccgacagctggaccagcctgagcagcaccccccacgccagcatcctgagcgtgccccacaccaacggccccatcaaccccggccccagcccctacccctgcctgtggaccatcagcaacggcgccggcggccccagcggccccggccccgaggtgcacgccagcacccccggcgccttcctgctgggcaaccccgccgtgaccagcccccccagcgtgctgagcacccaggcccccaccagcgccggcgtggaggtgctgggcgagcccagcctgaccagcatcgccgtgagcacctggaccgccgtggccagccaccccttcgccggctggggcggccccggcgccggcggccaccacagccccagcagcctggacggctag

SEQ ID NO: 101989 - DNA, 1344 bp, Artificial Sequence
  Description of Artificial Sequence: Synthetic coding sequence
atggagttcaccgccagccccaagccccagctgagcagcagagccaacgccttcagcatcgccgccctgatgagcagcggcggcagcaaggagaaggaggccaccgagaacaccatcaagcccctggagcagttcgtggagaagagcagctgcgcccagcccctgggcgagctgaccagcctggacgcccacggcgagttcggcggcggcagcggcagcagccccagcagcagcagcctgtgcaccgagcccctgatccccaccacccccatcatccccagcgaggagatggccaagatcgcctgcagcctggagaccaaggagctgtgggacaagttccacgagctgggcaccgagatgatcatcaccaagagcggcagaagaatgttccccaccatcagagtgagcttcagcggcgtggaccccgaggccaagtacatcgtgctgatggacatcgtgcccgtggacaacaagagatacagatacgcctaccacagaagcagctggctggtggccggcaaggccgacccccccctgcccgccagactgtacgtgcaccccgacagccccttcaccggcgagcagctgctgaagcagatggtgagcttcgagaaggtgaagctgaccaacaacgagctggaccagcacggccacatcatcctgaacagcatgcacaagtaccagcccagagtgcacatcatcaagaagaaggaccacaccgccagcctgctgaacctgaagagcgaggagttcagaaccttcatcttccccgagaccgtgttcaccgccgtgaccgcctaccagaaccagctgatcaccaagctgaagatcgacagcaaccccttcgccaagggcttcagagacagcagcagactgaccgacatcgagagagagagcgtggagagcctgatccagaagcacagctacgccagaagccccatcagaacctacggcggcgaggaggacgtgctgggcgacgagagccagaccacccccaacagaggcagcgccttcaccaccagcgacaacctgagcctgagcagctgggtgagcagcagcagcagcttccccggcttccagcacccccagagcctgaccgccctgggcaccagcaccgccagcatcgccacccccatcccccaccccatccagggcagcctgcccccctacagcagactgggcatgcccctgacccccagcgccatcgccagcagcatgcagggcagcggccccaccttccccagcttccacatgcccagataccaccactacttccagcagggcccctacgccgccatccagggcctgagacacagcagcgccgtgatgacccccttcgtgtag

SEQ ID NO: 101990 - DNA, 1608 bp, Artificial Sequence
  Description of Artificial Sequence: Synthetic coding sequence
atgggcatcgtggagcccggctgcggcgacatgctgaccggcaccgagcccatgcccggcagcgacgagggcagagcccccggcgccgacccccagcacagatacttctaccccgagcccggcgcccaggacgccgacgagagaagaggcggcggcagcctgggcagcccctaccccggcggcgccctggtgcccgccccccccagcagattcctgggcgcctacgcctacccccccagaccccaggccgccggcttccccggcgccggcgagagcttccccccccccgccgacgccgagggctaccagcccggcgagggctacgccgcccccgaccccagagccggcctgtaccccggccccagagaggactacgccctgcccgccggcctggaggtgagcggcaagctgagagtggccctgaacaaccacctgctgtggagcaagttcaaccagcaccagaccgagatgatcatcaccaagcagggcagaagaatgttccccttcctgagcttcaccgtggccggcctggagcccaccagccactacagaatgttcgtggacgtggtgctggtggaccagcaccactggagataccagagcggcaagtgggtgcagtgcggcaaggccgagggcagcatgcccggcaacagactgtacgtgcaccccgacagccccaacaccggcgcccactggatgagacaggaggtgagcttcggcaagctgaagctgaccaacaacaagggcgccagcaacaacgtgacccagatgatcgtgctgcagagcctgcacaagtaccagcccagactgcacatcgtggaggtgaacgacggcgagcccgaggccgcctgcaacgccagcaacacccacatcttcaccttccaggagacccagttcatcgccgtgaccgcctaccagaacgccgagatcacccagctgaagatcgacaacaaccccttcgccaagggcttcagagagaacttcgagagcatgtacaccagcgtggacaccagcatccccagcccccccggccccaactgccagttcctgggcggcgaccactacagccccctgctgcccaaccagtaccccgtgcccagcagattctaccccgacctgcccggccaggccaaggacgtggtgccccaggcctactggctgggcgcccccagagaccacagctacgaggccgagttcagagccgtgagcatgaagcccgccttcctgcccagcgcccccggccccaccatgagctactacagaggccaggaggtgctggcccccggcgccggctggcccgtggccccccagtacccccccaagatgggccccgccagctggttcagacccatgagaaccctgcccatggagcccggccccggcggcagcgagggcagaggccccgaggaccagggcccccccctggtgtggaccgagatcgcccccatcagacccgagagcagcgacagcggcctgggcgagggcgacagcaagagaagaagagtgagcccctaccccagcagcggcgacagcagcagccccgccggcgcccccagccccttcgacaaggaggccgagggccagttctacaactacttccccaactag

SEQ ID NO: 101991 - DNA, 1203 bp, Artificial Sequence
  Description of Artificial Sequence: Synthetic coding sequence
atgttccccagcgtgagagtgaaggtgaagggcctggaccccggcaagcagtaccacgtggccatcgacgtggtgcccgtggacagcaagagatacagatacgtgtaccacagcagccagtggatggtggccggcaacaccgaccacctgtgcatcatccccagattctacgtgcaccccgacagcccctgcagcggcgagacctggatgagacagatcatcagcttcgacagaatgaagctgaccaacaacgagatggacgacaagggccacatcatcctgcagagcatgcacaagtacaagcccagagtgcacgtgatcgagcagggcagcagcgtggacctgagccagatccagagcctgcccaccgagggcgtgaagaccttcagcttcaaggagaccgagttcaccaccgtgaccgcctaccagaaccagcagatcaccaagctgaagatcgagagaaaccccttcgccaagggcttcagagacaccggcagaaacagaggcgtgctggacggcctgctggagacctacccctggagacccagcttcaccctggacttcaagaccttcggcgccgacacccagagcggcagcagcggcagcagccccgtgaccagcagcggcggcgcccccagccccctgaacagcctgctgagccccctgtgcttcagccccatgttccacctgcccaccagcagcctgggcatgccctgccccgaggcctacctgcccaacgtgaacctgcccctgtgctacaagatctgccccaccaacttctggcagcagcagcccctggtgctgcccgcccccgagagactggccagcagcaacagcagccagagcctggcccccctgatgatggaggtgcccatgctgagcagcctgggcgtgaccaacagcaagagcggcagcagcgaggacagcagcgaccagtacctgcaggcccccaacagcaccaaccagatgctgtacggcctgcagagccccggcaacatcttcctgcccaacagcatcacccccgaggccctgagctgcagcttccaccccagctacgacttctacagatacaacttcagcatgcccagcagactgatcagcggcagcaaccacctgaaggtgaacgacgacagccaggtgagcttcggcgagggcaagtgcaaccacgtgcactggtaccccgccatcaaccactacctgtag

SEQ ID NO: 101992 - DNA, 1563 bp, Artificial Sequence
  Description of Artificial Sequence: Synthetic coding sequence
atggccctgagcagcagagccagagccttcagcgtggaggccctggtgggcagacccagcaagagaaagctgcaggaccccatccaggccgagcagcccgagctgagagagaagaagggcggcgaggaggaggaggagagaagaagcagcgccgccggcaagagcgagcccctggagaagcagcccaagaccgagcccagcaccagcgccagcagcggctgcggcagcgacagcggctacggcaacagcagcgagagcctggaggagaaggacatccagatggagctgcagggcagcgagctgtggaagagattccacgacatcggcaccgagatgatcatcaccaaggccggcagaagaatgttccccagcgtgagagtgaaggtgaagggcctggaccccggcaagcagtaccacgtggccatcgacgtggtgcccgtggacagcaagagatacagatacgtgtaccacagcagccagtggatggtggccggcaacaccgaccacctgtgcatcatccccagattctacgtgcaccccgacagcccctgcagcggcgagacctggatgagacagatcatcagcttcgacagaatgaagctgaccaacaacgagatggacgacaagggccacatcatcctgcagagcatgcacaagtacaagcccagagtgcacgtgatcgagcagggcagcagcgtggacctgagccagatccagagcctgcccaccgagggcgtgaagaccttcagcttcaaggagaccgagttcaccaccgtgaccgcctaccagaaccagcagatcaccaagctgaagatcgagagaaaccccttcgccaagggcttcagagacaccggcagaaacagaggcgtgctggacggcctgctggagacctacccctggagacccagcttcaccctggacttcaagaccttcggcgccgacacccagagcggcagcagcggcagcagccccgtgaccagcagcggcggcgcccccagccccctgaacagcctgctgagccccctgtgcttcagccccatgttccacctgcccaccagcagcctgggcatgccctgccccgaggcctacctgcccaacgtgaacctgcccctgtgctacaagatctgccccaccaacttctggcagcagcagcccctggtgctgcccgcccccgagagactggccagcagcaacagcagccagagcctggcccccctgatgatggaggtgcccatgctgagcagcctgggcgtgaccaacagcaagagcggcagcagcgaggacagcagcgaccagtacctgcaggcccccaacagcaccaaccagatgctgtacggcctgcagagccccggcaacatcttcctgcccaacagcatcacccccgaggccctgagctgcagcttccaccccagctacgacttctacagatacaacttcagcatgcccagcagactgatcagcggcagcaaccacctgaaggtgaacgacgacagccaggtgagcttcggcgagggcaagtgcaaccacgtgcactggtaccccgccatcaaccactacctgtag

SEQ ID NO: 101993 - DNA, 1563 bp, Artificial Sequence; identical to SEQ ID NO: 101992
  Description of Artificial Sequence: Synthetic coding sequence

SEQ ID NO: 101994 - DNA, 1203 bp, Artificial Sequence; identical to SEQ ID NO: 101991
  Description of Artificial Sequence: Synthetic coding sequence

SEQ ID NO: 101995 - DNA, 2232 bp, Artificial Sequence
  Description of Artificial Sequence: Synthetic coding sequence
atgagcctgagcatgagagaccccgtgatccccggcaccagcatggcctaccaccccttcctgccccacagagcccccgacttcgccatgagcgccgtgctgggccaccagccccccttcttccccgccctgaccctgccccccaacggcgccgccgccctgagcctgcccggcgccctggccaagcccatcatggaccagctggtgggcgccgccgagaccggcatccccttcagcagcctgggcccccaggcccacctgagacccctgaagaccatggagcccgaggaggaggtggaggacgaccccaaggtgcacctggaggccaaggagctgtgggaccagttccacaagagaggcaccgagatggtgatcaccaagagcggcagaagaatgttcccccccttcaaggtgagatgcagcggcctggacaagaaggccaagtacatcctgctgatggacatcatcgccgccgacgactgcagatacaagttccacaacagcagatggatggtggccggcaaggccgaccccgagatgcccaagagaatgtacatccaccccgacagccccgccaccggcgagcagtggatgagcaaggtggtgaccttccacaagctgaagctgaccaacaacatcagcgacaagcacggcttcaccctggccttccccagcgaccacgccacctggcagggcaactacagcttcggcacccagaccatcctgaacagcatgcacaagtaccagcccagattccacatcgtgagagccaacgacatcctgaagctgccctacagcaccttcagaacctacctgttccccgagaccgagttcatcgccgtgaccgcctaccagaacgacaagatcacccagctgaagatcgacaacaaccccttcgccaagggcttcagagacaccggcaacggcagaagagagaagagaaagcagctgaccctgcagagcatgagagtgttcgacgagagacacaagaaggagaacggcaccagcgacgagagcagcagcgagcaggccgccttcaactgcttcgcccaggccagcagccccgccgccagcaccgtgggcaccagcaacctgaaggacctgtgccccagcgagggcgagagcgacgccgaggccgagagcaaggaggagcacggccccgaggcctgcgacgccgccaagatcagcaccaccaccagcgaggagccctgcagagacaagggcagccccgccgtgaaggcccacctgttcgccgccgagagacccagagacagcggcagactggacaaggccagccccgacagcagacacagccccgccaccatcagcagcagcaccagaggcctgggcgccgaggagagaagaagccccgtgagagagggcaccgcccccgccaaggtggaggaggccagagccctgcccggcaaggaggccttcgcccccctgaccgtgcagaccgacgccgccgccgcccacctggcccagggccccctgcccggcctgggcttcgcccccggcctggccggccagcagttcttcaacggccaccccctgttcctgcaccccagccagttcgccatgggcggcgccttcagcagcatggccgccgccggcatgggccccctgctggccaccgtgagcggcgccagcaccggcgtgagcggcctggacagcaccgccatggccagcgccgccgccgcccagggcctgagcggcgccagcgccgccaccctgcccttccacctgcagcagcacgtgctggccagccagggcctggccatgagccccttcggcagcctgttcccctacccctacacctacatggccgccgccgccgccgccagcagcgccgccgccagcagcagcgtgcacagacaccccttcctgaacctgaacaccatgagacccagactgagatacagcccctacagcatccccgtgcccgtgcccgacggcagcagcctgctgaccaccgccctgcccagcatggccgccgccgccggccccctggacggcaaggtggccgccctggccgccagccccgccagcgtggccgtggacagcggcagcgagctgaacagcagaagcagcaccctgagcagcagcagcatgagcctgagccccaagctgtgcgccgagaaggaggccgccaccagcgagctgcagagcatccagagactggtgagcggcctggaggccaagcccgacagaagcagaagcgccagcccctag

SEQ ID NO: 101996 - DNA, 2172 bp, Artificial Sequence
  Description of Artificial Sequence: Synthetic coding sequence
atgagcctgagcatgagagaccccgtgatccccggcaccagcatggcctaccaccccttcctgccccacagagcccccgacttcgccatgagcgccgtgctgggccaccagccccccttcttccccgccctgaccctgccccccaacggcgccgccgccctgagcctgcccggcgccctggccaagcccatcatggaccagctggtgggcgccgccgagaccggcatccccttcagcagcctgggcccccaggcccacctgagacccctgaagaccatggagcccgaggaggaggtggaggacgaccccaaggtgcacctggaggccaaggagctgtgggaccagttccacaagagaggcaccgagatggtgatcaccaagagcggcagaagaatgttcccccccttcaaggtgagatgcagcggcctggacaagaaggccaagtacatcctgctgatggacatcatcgccgccgacgactgcagatacaagttccacaacagcagatggatggtggccggcaaggccgaccccgagatgcccaagagaatgtacatccaccccgacagccccgccaccggcgagcagtggatgagcaaggtggtgaccttccacaagctgaagctgaccaacaacatcagcgacaagcacggcttcaccatcctgaacagcatgcacaagtaccagcccagattccacatcgtgagagccaacgacatcctgaagctgccctacagcaccttcagaacctacctgttccccgagaccgagttcatcgccgtgaccgcctaccagaacgacaagatcacccagctgaagatcgacaacaaccccttcgccaagggcttcagagacaccggcaacggcagaagagagaagagaaagcagctgaccctgcagagcatgagagtgttcgacgagagacacaagaaggagaacggcaccagcgacgagagcagcagcgagcaggccgccttcaactgcttcgcccaggccagcagccccgccgccagcaccgtgggcaccagcaacctgaaggacctgtgccccagcgagggcgagagcgacgccgaggccgagagcaaggaggagcacggccccgaggcctgcgacgccgccaagatcagcaccaccaccagcgaggagccctgcagagacaagggcagccccgccgtgaaggcccacctgttcgccgccgagagacccagagacagcggcagactggacaaggccagccccgacagcagacacagccccgccaccatcagcagcagcaccagaggcctgggcgccgaggagagaagaagccccgtgagagagggcaccgcccccgccaaggtggaggaggccagagccctgcccggcaaggaggccttcgcccccctgaccgtgcagaccgacgccgccgccgcccacctggcccagggccccctgcccggcctgggcttcgcccccggcctggccggccagcagttcttcaacggccaccccctgttcctgcaccccagccagttcgccatgggcggcgccttcagcagcatggccgccgccggcatgggccccctgctggccaccgtgagcggcgccagcaccggcgtgagcggcctggacagcaccgccatggccagcgccgccgccgcccagggcctgagcggcgccagcgccgccaccctgcccttccacctgcagcagcacgtgctggccagccagggcctggccatgagccccttcggcagcctgttcccctacccctacacctacatggccgccgccgccgccgccagcagcgccgccgccagcagcagcgtgcacagacaccccttcctgaacctgaacaccatgagacccagactgagatacagcccctacagcatccccgtgcccgtgcccgacggcagcagcctgctgaccaccgccctgcccagcatggccgccgccgccggccccctggacggcaaggtggccgccctggccgccagccccgccagcgtggccgtggacagcggcagcgagctgaacagcagaagcagcaccctgagcagcagcagcatgagcctgagccccaagctgtgcgccgagaaggaggccgccaccagcgagctgcagagcatccagagactggtgagcggcctggaggccaagcccgacagaagcagaagcgccagcccctag

SEQ ID NO: 101997 - DNA, 1803 bp, Artificial Sequence
  Description of Artificial Sequence: Synthetic coding sequence
atgagcctgagcatgagagaccccgtgatccccggcaccagcatggcctaccaccccttcctgccccacagagcccccgacttcgccatgagcgccgtgctgggccaccagccccccttcttccccgccctgaccctgccccccaacggcgccgccgccctgagcctgcccggcgccctggccaagcccatcatggaccagctggtgggcgccgccgagaccggcatccccttcagcagcctgggcccccaggcccacctgagacccctgaagaccatggagcccgaggaggaggtggaggacgaccccaaggtgcacctggaggccaaggagctgtgggaccagttccacaagagaggcaccgagatggtgatcaccaagagcggcagaagaatgttcccccccttcaaggtgagatgcagcggcctggacaagaaggccaagtacatcctgctgatggacatcatcgccgccgacgactgcagatacaagttccacaacagcagatggatggtggccggcaaggccgaccccgagatgcccaagagaatgtacatccaccccgacagccccgccaccggcgagcagtggatgagcaaggtggtgaccttccacaagctgaagctgaccaacaacatcagcgacaagcacggcttcaccctggccttccccagcgaccacgccacctggcagggcaactacagcttcggcacccagaccatcctgaacagcatgcacaagtaccagcccagattccacatcgtgagagccaacgacatcctgaagctgccctacagcaccttcagaacctacctgttccccgagaccgagttcatcgccgtgaccgcctaccagaacgacaagatcacccagctgaagatcgacaacaaccccttcgccaagggcttcagagacaccggcaacggcagaagagagaagagaaagcagctgaccctgcagagcatgagagtgttcgacgagagacacaagaaggagaacggcaccagcgacgagagcagcagcgagcaggccgccttcaactgcttcgcccaggccagcagccccgccgccagcaccgtgggcaccagcaacctgaaggacctgtgccccagcgagggcgagagcgacgccgaggccgagagcaaggaggagcacggccccgaggcctgcgacgccgccaagatcagcaccaccaccagcgaggagccctgcagagacaagggcagccccgccgtgaaggcccacctgttcgccgccgagagacccagagacagcggcagactggacaaggccagccccgacagcagacacagccccgccaccatcagcagcagcaccagaggcctgggcgccgaggagagaagaagccccgtgagagagggcaccgcccccgccaaggtggaggaggccagagccctgcccggcaaggaggccttcgcccccctgaccgtgcagaccgacgccgccgccgccgccgccagcagcagcgtgcacagacaccccttcctgaacctgaacaccatgagacccagactgagatacagcccctacagcatccccgtgcccgtgcccgacggcagcagcctgctgaccaccgccctggccgccagccccgccagcgtggccgtggacagcggcagcgagctgaacagcagaagcagcaccctgagcagcagcagcatgagcctgagccccaagctgtgcgccgagaaggaggccgccaccagcgagctgcagagcatccagagactggtgagcggcctggaggccaagcccgacagaagcagaagcgccagcccctag

SEQ ID NO: 101998 - DNA, 1638 bp, Artificial Sequence
  Description of Artificial Sequence: Synthetic coding sequence
atgctgcaggacaagggcctgagcgagagcgaggaggccttcagagcccccggccccgccctgggcgaggccagcgccgccaacgcccccgagcccgccctggccgcccccggcctgagcggcgccgccctgggcagcccccccggccccggcgccgacgtggtggccgccgccgccgccgagcagaccatcgagaacatcaaggtgggcctgcacgagaaggagctgtggaagaagttccacgaggccggcaccgagatgatcatcaccaaggccggcagaagaatgttccccagctacaaggtgaaggtgaccggcatgaaccccaagaccaagtacatcctgctgatcgacatcgtgcccgccgacgaccacagatacaagttctgcgacaacaagtggatggtggccggcaaggccgagcccgccatgcccggcagactgtacgtgcaccccgacagccccgccaccggcgcccactggatgagacagctggtgagcttccagaagctgaagctgaccaacaaccacctggaccccttcggccacatcatcctgaacagcatgcacaagtaccagcccagactgcacatcgtgaaggccgacgagaacaacgccttcggcagcaagaacaccgccttctgcacccacgtgttccccgagaccagcttcatcagcgtgaccagctaccagaaccacaagatcacccagctgaagatcgagaacaaccccttcgccaagggcttcagaggcagcgacgacagcgacctgagagtggccagactgcagagcaaggagtaccccgtgatcagcaagagcatcatgagacagagactgatcagcccccagctgagcgccacccccgacgtgggccccctgctgggcacccaccaggccctgcagcactaccagcacgagaacggcgcccacagccagctggccgagccccaggacctgcccctgagcaccttccccacccagagagacagcagcctgttctaccactgcctgaagagaagagacggcaccagacacctggacctgccctgcaagagaagctacctggaggcccccagcagcgtgggcgaggaccactacttcagaagcccccccccctacgaccagcagatgctgagccccagctactgcagcgaggtgacccccagagaggcctgcatgtacagcggcagcggccccgagatcgccggcgtgagcggcgtggacgacctgccccccccccccctgagctgcaacatgtggaccagcgtgagcccctacaccagctacagcgtgcagaccatggagaccgtgccctaccagcccttccccacccacttcaccgccaccaccatgatgcccagactgcccaccctgagcgcccagagcagccagccccccggcaacgcccacttcagcgtgtacaaccagctgagccagagccaggtgagagagagaggccccagcgccagcttccccagagagagaggcctgccccagggctgcgagagaaagccccccagcccccacctgaacgccgccaacgagttcctgtacagccagaccttcagcctgagcagagagagcagcctgcagtaccacagcggcatgggcaccgtggagaactggaccgacggctag

SEQ ID NO: 101999 - DNA, 1641 bp, Artificial Sequence
  Description of Artificial Sequence: Synthetic coding sequence
atgctgcaggacaagggcctgagcgagagcgaggaggccttcagagcccccggccccgccctgggcgaggccagcgccgccaacgcccccgagcccgccctggccgcccccggcctgagcggcgccgccctgggcagcccccccggccccggcgccgacgtggtggccgccgccgccgccgagcagaccatcgagaacatcaaggtgggcctgcacgagaaggagctgtggaagaagttccacgaggccggcaccgagatgatcatcaccaaggccggcagaagaatgttccccagctacaaggtgaaggtgaccggcatgaaccccaagaccaagtacatcctgctgatcgacatcgtgcccgccgacgaccacagatacaagttctgcgacaacaagtggatggtggccggcaaggccgagcccgccatgcccggcagactgtacgtgcaccccgacagccccgccaccggcgcccactggatgagacagctggtgagcttccagaagctgaagctgaccaacaaccacctggaccccttcggccacatcatcctgaacagcatgcacaagtaccagcccagactgcacatcgtgaaggccgacgagaacaacgccttcggcagcaagaacaccgccttctgcacccacgtgttccccgagaccagcttcatcagcgtgaccagctaccagaaccacaagatcacccagctgaagatcgagaacaaccccttcgccaagggcttcagaggcagcgacgacagcgacctgagagtggccagactgcagagcaaggagtaccccgtgatcagcaagagcatcatgagacagagactgatcagcccccagctgagcgccacccccgacgtgggccccctgctgggcacccaccaggccctgcagcactaccagcacgagaacggcgcccacagccagctggccgagccccaggacctgcccctgagcaccttccccacccagagagacagcagcctgttctaccactgcctgaagagaagagccgacggcaccagacacctggacctgccctgcaagagaagctacctggaggcccccagcagcgtgggcgaggaccactacttcagaagcccccccccctacgaccagcagatgctgagccccagctactgcagcgaggtgacccccagagaggcctgcatgtacagcggcagcggccccgagatcgccggcgtgagcggcgtggacgacctgccccccccccccctgagctgcaacatgtggaccagcgtgagcccctacaccagctacagcgtgcagaccatggagaccgtgccctaccagcccttccccacccacttcaccgccaccaccatgatgcccagactgcccaccctgagcgcccagagcagccagccccccggcaacgcccacttcagcgtgtacaaccagctgagccagagccaggtgagagagagaggccccagcgccagcttccccagagagagaggcctgccccagggctgcgagagaaagccccccagcccccacctgaacgccgccaacgagttcctgtacagccagaccttcagcctgagcagagagagcagcctgcagtaccacagcggcatgggcaccgtggagaactggaccgacggctag

SEQ ID NO: 102000 - DNA, 1557 bp, Artificial Sequence
  Description of Artificial Sequence: Synthetic coding sequence
atggccgacgccgacgagggcttcggcctggcccacacccccctggagcccgacgccaaggacctgccctgcgacagcaagcccgagagcgccctgggcgcccccagcaagagccccagcagcccccaggccgccttcacccagcagggcatggagggcatcaaggtgttcctgcacgagagagagctgtggctgaagttccacgaggtgggcaccgagatgatcatcaccaaggccggcagaagaatgttccccagctacaaggtgaaggtgaccggcctgaaccccaagaccaagtacatcctgctgatggacatcgtgcccgccgacgaccacagatacaagttcgccgacaacaagtggagcgtgaccggcaaggccgagcccgccatgcccggcagactgtacgtgcaccccgacagccccgccaccggcgcccactggatgagacagctggtgagcttccagaagctgaagctgaccaacaaccacctggaccccttcggccacatcatcctgaacagcatgcacaagtaccagcccagactgcacatcgtgaaggccgacgagaacaacggcttcggcagcaagaacaccgccttctgcacccacgtgttccccgagaccgccttcatcgccgtgaccagctaccagaaccacaagatcacccagctgaagatcgagaacaaccccttcgccaagggcttcagaggcagcgacgacatggagctgcacagaatgagcagaatgcagagcaaggagtaccccgtggtgcccagaagcaccgtgagacagaaggtggccagcaaccacagccccttcagcagcgagagcagagccctgagcaccagcagcaacctgggcagccagtaccagtgcgagaacggcgtgagcggccccagccaggacctgctgcccccccccaacccctaccccctgccccaggagcacagccagatctaccactgcaccaagagaaaggaggaggagtgcagcaccaccgaccacccctacaagaagccctacatggagaccagccccagcgaggaggacagcttctacagaagcagctacccccagcagcagggcctgggcgccagctacagaaccgagagcgcccagagacaggcctgcatgtacgccagcagcgccccccccagcgagcccgtgcccagcctggaggacatcagctgcaacacctggcccagcatgcccagctacagcagctgcaccgtgaccaccgtgcagcccatggacagactgccctaccagcacttcagcgcccacttcaccagcggccccctggtgcccagactggccggcatggccaaccacggcagcccccagctgggcgagggcatgttccagcaccagaccagcgtggcccaccagcccgtggtgagacagtgcggcccccagaccggcctgcagagccccggcaccctgcagccccccgagttcctgtacagccacggcgtgcccagaaccctgagcccccaccagtaccacagcgtgcacggcgtgggcatggtgcccgagtggagcgacaacagctag

SEQ ID NO: 102001 - DNA, 1407 bp, Artificial Sequence
  Description of Artificial Sequence: Synthetic coding sequence
atggagggcatcaaggtgttcctgcacgagagagagctgtggctgaagttccacgaggtgggcaccgagatgatcatcaccaaggccggcagaagaatgttccccagctacaaggtgaaggtgaccggcctgaaccccaagaccaagtacatcctgctgatggacatcgtgcccgccgacgaccacagatacaagttcgccgacaacaagtggagcgtgaccggcaaggccgagcccgccatgcccggcagactgtacgtgcaccccgacagccccgccaccggcgcccactggatgagacagctggtgagcttccagaagctgaagctgaccaacaaccacctggaccccttcggccacatcatcctgaacagcatgcacaagtaccagcccagactgcacatcgtgaaggccgacgagaacaacggcttcggcagcaagaacaccgccttctgcacccacgtgttccccgagaccgccttcatcgccgtgaccagctaccagaaccacaagatcacccagctgaagatcgagaacaaccccttcgccaagggcttcagaggcagcgacgacatggagctgcacagaatgagcagaatgcagagcaaggagtaccccgtggtgcccagaagcaccgtgagacagaaggtggccagcaaccacagccccttcagcagcgagagcagagccctgagcaccagcagcaacctgggcagccagtaccagtgcgagaacggcgtgagcggccccagccaggacctgctgcccccccccaacccctaccccctgccccaggagcacagccagatctaccactgcaccaagagaaaggaggaggagtgcagcaccaccgaccacccctacaagaagccctacatggagaccagccccagcgaggaggacagcttctacagaagcagctacccccagcagcagggcctgggcgccagctacagaaccgagagcgcccagagacaggcctgcatgtacgccagcagcgccccccccagcgagcccgtgcccagcctggaggacatcagctgcaacacctggcccagcatgcccagctacagcagctgcaccgtgaccaccgtgcagcccatggacagactgccctaccagcacttcagcgcccacttcaccagcggccccctggtgcccagactggccggcatggccaaccacggcagcccccagctgggcgagggcatgttccagcaccagaccagcgtggcccaccagcccgtggtgagacagtgcggcccccagaccggcctgcagagccccggcaccctgcagccccccgagttcctgtacagccacggcgtgcccagaaccctgagcccccaccagtaccacagcgtgcacggcgtgggcatggtgcccgagtggagcgacaacagctag

SEQ ID NO: 102002 - DNA, 1557 bp, Artificial Sequence; identical to SEQ ID NO: 102000
  Description of Artificial Sequence: Synthetic coding sequence

SEQ ID NO: 102003 - DNA, 1269 bp, Artificial Sequence
  Description of Artificial Sequence: Synthetic coding sequence
atggacatcgtgcccgccgacgaccacagatacaagttcgccgacaacaagtggagcgtgaccggcaaggccgagcccgccatgcccggcagactgtacgtgcaccccgacagccccgccaccggcgcccactggatgagacagctggtgagcttccagaagctgaagctgaccaacaaccacctggaccccttcggccacatcatcctgaacagcatgcacaagtaccagcccagactgcacatcgtgaaggccgacgagaacaacggcttcggcagcaagaacaccgccttctgcacccacgtgttccccgagaccgccttcatcgccgtgaccagctaccagaaccacaagatcacccagctgaagatcgagaacaaccccttcgccaagggcttcagaggcagcgacgacatggagctgcacagaatgagcagaatgcagagcaaggagtaccccgtggtgcccagaagcaccgtgagacagaaggtggccagcaaccacagccccttcagcagcgagagcagagccctgagcaccagcagcaacctgggcagccagtaccagtgcgagaacggcgtgagcggccccagccaggacctgctgcccccccccaacccctaccccctgccccaggagcacagccagatctaccactgcaccaagagaaaggaggaggagtgcagcaccaccgaccacccctacaagaagccctacatggagaccagccccagcgaggaggacagcttctacagaagcagctacccccagcagcagggcctgggcgccagctacagaaccgagagcgcccagagacaggcctgcatgtacgccagcagcgccccccccagcgagcccgtgcccagcctggaggacatcagctgcaacacctggcccagcatgcccagctacagcagctgcaccgtgaccaccgtgcagcccatggacagactgccctaccagcacttcagcgcccacttcaccagcggccccctggtgcccagactggccggcatggccaaccacggcagcccccagctgggcgagggcatgttccagcaccagaccagcgtggcccaccagcccgtggtgagacagtgcggcccccagaccggcctgctgcacaacagacacttcctggagaaggagagagagagaggcgagagagagagaagaagagagaccgtggccaagagaacccccagaaccagattcttcatcagccccaacgtgcacatctgcacccagggcagatggatgctgatctag

SEQ ID NO: 102004 - DNA, 1050 bp, Artificial Sequence
  Description of Artificial Sequence: Synthetic coding sequence
atggccgacgccgacgagggcttcggcctggcccacacccccctggagcccgacgccaaggacctgccctgcgacagcaagcccgagagcgccctgggcgcccccagcaagagccccagcagcccccaggccgccttcacccagcagggcatggagggcatcaaggtgttcctgcacgagagagagctgtggctgaagttccacgaggtgggcaccgagatgatcatcaccaaggccggcagaagaatgttccccagctacaaggtgaaggtgaccggcctgaaccccaagaccaagtacatcctgctgatggacatcgtgcccgccgacgaccacagatacaagttcgccgacaacaagtggagcgtgaccggcaaggccgagcccgccatgcccggcagactgtacgtgcaccccgacagccccgccaccggcgcccactggatgagacagctggtgagcttccagaagctgaagctgaccaacaaccacctggaccccttcggccacatcatcctgaacagcatgcacaagtaccagcccagactgcacatcgtgaaggccgacgagaacaacggcttcggcagcaagaacaccgccttctgcacccacgtgttccccgagaccgccttcatcgccgtgaccagctaccagaaccacaagatcacccagctgaagatcgagaacaaccccttcgccaagggcttcagaggcagcgacgacatggagctgcacagaatgagcagaatgcagagcaaggagtaccccgtggtgcccagaagcaccgtgagacagaaggtggccagcaaccacagccccttcagcagcgagagcagagccctgagcaccagcagcaacctgggcagccagtaccagtgcgagaacggcgtgagcggccccagccaggacctgctgcccccccccaacccctaccccctgccccaggagcacagccagatctaccactgcaccaagagaaagggcgagtgcgaccacccctggagcatctgcttcctgagctacctgttcctgagcctgggctggggctag

SEQ ID NO: 102005 - DNA, 1311 bp, Artificial Sequence
  Description of Artificial Sequence: Synthetic coding sequence
atgtaccaccccagagagctgtaccccagcctgggcgccggctacagactgggccccgcccagcccggcgccgacagcagcttcccccccgccctggccgagggctacagataccccgagctggacacccccaagctggactgcttcctgagcggcatggaggccgcccccagaaccctggccgcccacccccccctgcccctgctgccccccgccatgggcaccgagcccgcccccagcgcccccgaggccctgcacagcctgcccggcgtgagcctgagcctggagaacagagagctgtggaaggagttcagcagcgtgggcaccgagatgatcatcaccaaggccggcagaagaatgttccccgcctgcagagtgagcgtgaccggcctggaccccgaggccagatacctgttcctgctggacgtgatccccgtggacggcgccagatacagatggcagggcagaagatgggagcccagcggcaaggccgagcccagactgcccgacagagtgtacatccaccccgacagccccgccaccggcgcccactggatgagacagcccgtgagcttccacagagtgaagctgaccaacagcaccctggacccccacggccacctgatcctgcacagcatgcacaagtaccagcccagaatccacctggtgagagccgcccagctgtgcagccagcactggggcggcatggccagcttcagattccccgagaccaccttcatcagcgtgaccgcctaccagaacccccagatcacccagctgaagatcgccgccaaccccttcgccaagggcttcagagagaacggcagaaactgcaagagagagagagacgccagagtgaagagaaagctgagaggccccgagcccgccgccaccgaggcctacggcagcggcgacacccccggcggcccctgcgacagcaccctgggcggcgacatcagagagagcgaccccgagcaggcccccgcccccggcgaggccaccgccgcccccgcccccctgtgcggcggccccagcgccgaggcctacctgctgcaccccgccgccttccacggcgcccccagccacctgcccaccagaagccccagcttccccgaggcccccgacagcggcagaagcgccccctacagcgccgccttcctggagctgccccacggcagcggcggcagcggctaccccgccgccccccccgccgtgcccttcgccccccacttcctgcagggcggccccttccccctgccctacaccgcccccggcggctacctggacgtgggcagcaagcccatgtactag

SEQ ID NO: 102006 - DNA, 1311 bp, Artificial Sequence; identical to SEQ ID NO: 102005
  Description of Artificial Sequence: Synthetic coding sequence

SEQ ID NO: 102007 - DNA, 888 bp, Artificial Sequence
  Description of Artificial Sequence: Synthetic coding sequence
atgtaccaccccagagagctgtaccccagcctgggcgccggctacagactgggccccgcccagcccggcgccgacagcagcttcccccccgccctggccgagggctacagataccccgagctggacacccccaagctggactgcttcctgagcggcatggaggccgcccccagaaccctggccgcccacccccccctgcccctgctgccccccgccatgggcaccgagcccgcccccagcgcccccgaggccctgcacagcctgcccggcgtgagcctgagcctggagaacagagagctgtggaaggagttcagcagcgtgggcaccgagatgatcatcaccaaggccggcagaagaatgttccccgcctgcagagtgagcgtgaccggcctggaccccgaggccagatacctgttcctgctggacgtgatccccgtggacggcgccagatacagatggcagggcagaagatgggagcccagcggcaaggccgagcccagactgcccgacagagtgtacatccaccccgacagccccgccaccggcgcccactggatgagacagcccgtgagcttccacagagtgaagctgaccaacagcaccctggacccccacggccacctgatcctgcacagcatgcacaagtaccagcccagaatccacctggtgagagccgcccagctgtgcagccagcactggggcggcatggccagcttcagattccccgagaccaccttcatcagcgtgaccgcctaccagaacccccagatcacccagctgaagatcgccgccaaccccttcgccaagggcttcagagagaacggcagaaactgcaagagatgggagctgttcatccacctgttcatgcacagcaccaacgtgtactag

SEQ ID NO: 102008 - DNA, 1974 bp, Artificial Sequence
  Description of Artificial Sequence: Synthetic coding sequence
atggagatggagaccaccgagcccgagcccgactgcgtggtgcagccccccagcccccccgacgacttcagctgccagatgagactgagcgagaagatcacccccctgaagacctgcttcaagaagaaggaccagaagagactgggcaccggcaccctgagaagcctgagacccatcctgaacaccctgctggagagcggcagcctggacggcgtgttcagaagcagaaaccagagcaccgacgagaacagcctgcacgagcccatgatgaagaaggccatggagatcaacagcagctgcccccccgccgagaacaacatgagcgtgctgatccccgacagaaccaacgtgggcgaccagatccccgaggcccaccccagcaccgaggcccccgagagagtggtgcccatccaggaccacagcttccccagcgagaccctgagcggcaccgtggccgacagcacccccgcccacttccagaccgacctgctgcaccccgtgagcagcgacgtgcccaccagccccgactgcctggacaaggtgatcgactacgtgcccggcatcttccaggagaacagcttcaccatccagtacatcctggacaccagcgacaagctgagcaccgagctgttccaggacaagagcgaggaggccagcctggacctggtgttcgagctggtgaaccagctgcagtaccacacccaccaggagaacggcatcgagatctgcatggacttcctgcagggcacctgcatctacggcagagactgcctgaagcaccacaccgtgctgccctaccactggcagatcaagagaaccaccacccagaagtggcagagcgtgttcaacgacagccaggagcacctggagagattctactgcaaccccgagaacgacagaatgagaatgaagtacggcggccaggagttctgggccgacctgaacgccatgaacgtgtacgagaccaccgagttcgaccagctgagaagactgagcaccccccccagcagcaacgtgaacagcatctaccacaccgtgtggaagttcttctgcagagaccacttcggctggagagagtaccccgagagcgtgatcagactgatcgaggaggccaacagcagaggcctgaaggaggtgagattcatgatgtggaacaaccactacatcctgcacaacagcttcttcagaagagagatcaagagaagacccctgttcagaagctgcttcatcctgctgccctacctgcagaccctgggcggcgtgcccacccaggcccccccccccctggaggccaccagcagcagccagatcatctgccccgacggcgtgaccagcgccaacttctaccccgagacctgggtgtacatgcaccccagccaggacttcatccaggtgcccgtgagcgccgaggacaagagctacagaatcatctacaacctgttccacaagaccgtgcccgagttcaagtacagaatcctgcagatcctgagagtgcagaaccagttcctgtgggagaagtacaagagaaagaaggagtacatgaacagaaagatgttcggcagagacagaatcatcaacgagagacacctgttccacggcaccagccaggacgtggtggacggcatctgcaagcacaacttcgaccccagagtgtgcggcaagcacgccaccatgttcggccagggcagctacttcgccaagaaggccagctacagccacaacttcagcaagaagagcagcaagggcgtgcacttcatgttcctggccaaggtgctgaccggcagatacaccatgggcagccacggcatgagaagacccccccccgtgaaccccggcagcgtgaccagcgacctgtacgacagctgcgtggacaacttcttcgagccccagatcttcgtgatcttcaacgacgaccagagctacccctacttcgtgatccagtacgaggaggtgagcaacaccgtgagcatctag

SEQ ID NO: 102009 - DNA, 1974 bp, Artificial Sequence; identical to SEQ ID NO: 102008
  Description of Artificial Sequence: Synthetic coding sequence

SEQ ID NO: 102010 - DNA, 1521 bp, Artificial Sequence
  Description of Artificial Sequence: Synthetic coding sequence
atggagatggagaccaccgagcccgagcccgactgcgtggtgcagccccccagcccccccgacgacttcagctgccagatgagactgagcgagaagatcacccccctgaagacctgcttcaagaagaaggaccagaagagactgggcaccggcaccctgagaagcctgagacccatcctgaacaccctgctggagagcggcagcctggacggcgtgttcagaagcagaaaccagagcaccgacgagaacagcctgcacgagcccatgatgaagaaggccatggagatcaacagcagctgcccccccgccgagaacaacatgagcgtgctgatccccgacagaaccaacgtgggcgaccagatccccgaggcccaccccagcaccgaggcccccgagagagtggtgcccatccaggaccacagcttccccagcgagaccctgagcggcaccgtggccgacagcacccccgcccacttccagaccgacctgctgcaccccgtgagcagcgacgtgcccaccagccccgactgcctggacaaggtgatcgactacgtgcccggcatcttccaggagaacagcttcaccatccagtacatcctggacaccagcgacaagctgagcaccgagctgttccaggacaagagcgaggaggccagcctggacctggtgttcgagctggtgaaccagctgcagtaccacacccaccaggagaacggcatcgagatctgcatggacttcctgcagggcacctgcatctacggcagagactgcctgaagcaccacaccgtgctgccctaccactggcagatcaagagaaccaccacccagaagtggcagagcgtgttcaacgacagccaggagcacctggagagattctactgcaaccccgagaacgacagaatgagaatgaagtacggcggccaggagttctgggccgacctgaacgccatgaacgtgtacgagaccaccgagttcgaccagctgagaagactgagcaccccccccagcagcaacgtgaacagcatctaccacaccgtgtggaagttcttctgcagagaccacttcggctggagagagtaccccgagagcgtgatcagactgatcgaggaggccaacagcagaggcctgaaggaggtgagattcatgatgtggaacaaccactacatcctgcacaacagcttcttcagaagagagatcaagagaagacccctgttcagaagctgcttcatcctgctgccctacctgcagaccctgggcggcgtgcccacccaggcccccccccccctggaggccaccagcagcagccagatcatctgccccgacggcgtgaccagcgccaacttctaccccgagacctgggtgtacatgcaccccagccaggacttcatccaggtgcccgtgagcgccgaggacaagagctacagaatcatctacaacctgttccacaagaccgtgcccgagttcaagtacagaatcctgcagatcctgagagtgcagaaccagttcctgtgggagaagtag

SEQ ID NO: 102011 - DNA, 1965 bp, Artificial Sequence
  Description of Artificial Sequence: Synthetic coding sequence
atggagatggagaccaccgagcccgagcccgactgcgtggtgcagccccccagcccccccgacgacttcagctgccagatgagactgagcgagaagatcacccccctgaagacctgcttcaagaagaaggaccagaagagactgggcaccggcaccctgagaagcctgagacccatcctgaacaccctgctggagagcggcagcctggacggcgtgttcagaagcagaaaccagagcaccgacgagaacagcctgcacgagcccatgatgaagaaggccatggagatcaacagcagctgcccccccgccgagaacaacatgagcgtgctgatccccgacagaaccaacgtgggcgaccagatccccgaggcccaccccagcaccgaggcccccgagagagtggtgcccatccaggaccacagcttccccagcgagaccctgagcggcaccgtggccgacagcacccccgcccacttccagaccgacctgctgcaccccgtgagcagcgacgtgcccaccagccccgactgcctggacaaggtgatcgactacgtgcccggcatcttccaggagaacagcttcaccatccagtacatcctggacaccagcgacaagctgagcaccgagctgttccaggacaagagcgaggaggccagcctggacctggtgttcgagctggtgaaccagctgcagtaccacacccaccaggagaacggcatcgagatctgcatggacttcctgcagggcacctgcatctacggcagagactgcctgaagcaccacaccgtgctgccctaccactggcagatcaagagaaccaccacccagaagtggcagagcgtgttcaacgacagccaggagcacctggagagattctactgcaaccccgagaacgacagaatgagaatgaagtacggcggccaggagttctgggccgacctgaacgccatgaacgtgtacgagaccaccgagttcgaccagctgagaagactgagcaccccccccagcagcaacgtgaacagcatctaccacaccgtgtggaagttcttctgcagagaccacttcggctggagagagtaccccgagagcgtgatcagactgatcgaggaggccaacagcagaggcctgaaggaggtgagattcatgatgtggaacaaccactacatcctgcacaacagcttcttcagaagagagatcaagagaagacccctgttcagaagctgcttcatcctgctgccctacctgcagaccctgggcggcgtgcccacccaggcccccccccccctggaggccaccagcagcagccagatcatctgccccgacggcgtgaccagcgccaacttctaccccgagacctgggtgtacatgcaccccagccaggacttcatccaggtgcccgtgagcgccgaggacaagagctacagaatcatctacaacctgttccacaagaccgtgcccgagttcaagtacagaatcctgcagatcctgagagtgcagaaccagttcctgtgggagaagtacaagagaaagaaggagtacatgaacagaaagatgttcggcagagacagaatcatcaacgagagacacctgttccacggcaccagccaggacgtggtggacggcatctgcaagcacaacttcgaccccagagtgtgcggcaagcacgccaccatgttcggccagggcagctacttcgccaagaaggccagctacagccacaacttcagcaagaagagcagcaagggcgtgcacttcatgttcctggccaaggtgctgaccggcagatacaccatgggcagccacggcatgagaagacccccccccgtgaaccccggcagcgtgaccagcgacctgtacgacagctgcgtggacaacttcttcgagccccagatcttcgtgatcttcaacgacgaccagagctacccctacttcgtgatccagtacgaggaggtgagcaacacctag

SEQ ID NO: 102012 - DNA, 1974 bp, Artificial Sequence; identical to SEQ ID NO: 102008
  Description of Artificial Sequence: Synthetic coding sequence

SEQ ID NO: 102013 - DNA, 1974 bp, Artificial Sequence; identical to SEQ ID NO: 102008
  Description of Artificial Sequence: Synthetic coding sequence

SEQ ID NO: 102014 - DNA, 1662 bp, Artificial Sequence
  Description of Artificial Sequence: Synthetic coding sequence
atgggcgccctggagatgcaggacgaggaggacagaatcgaggccctgaagcaggtggccgacaagctgcccagacccaacctgctgctgctgaagcacctggtgtacgtgctgcacctgatcagcaagaacagcgaggtgaacagaatggacagcagcaacctggccatctgcatcggccccaacatgctgaccctggagaacgaccagagcctgagcttcgaggcccagaaggacctgaacaacaaggtgaagaccctggtggagttcctgatcgacaactgcttcgagatcttcggcgagaacatccccgtgcacagcagcatcaccagcgacgacagcctggagcacaccgacagcagcgacgtgagcaccctgcagaacgacagcgcctacgacagcaacgaccccgacgtggagagcaacagcagcagcggcatcagcagccccagcagacagccccaggtgcccatggccaccgccgccggcctggacagcgccggcccccaggacgccagagaggtgagccccgagcccatcgtgagcaccgtggccagactgaagagcagcctggcccagcccgacagaagatacagcgagcccagcatgcccagcagccaggagtgcctggagagcagagtgaccaaccagaccctgaccaagagcgagggcgacttccccgtgcccagagtgggcagcagactggagagcgaggaggccgaggaccccttccccgaggaggtgttccccgccgtgcagggcaagaccaagagacccgtggacctgaagatcaagaacctggcccccggcagcgtgctgcccagagccctggtgctgaaggccttcagcagcagcagcctggacgccagcagcgacagcagccccgtggccagccccagcagccccaagagaaacttcttcagcagacaccagagcttcaccaccaagaccgagaagggcaagcccagcagagagatcaagaagcacagcatgagcttcaccttcgccccccacaagaaggtgctgaccaagaacctgagcgccggcagcggcaagagccaggacttcaccagagaccacgtgcccagaggcgtgagaaaggagagccagctggccggcagaatcgtgcaggagaacggctgcgagacccacaaccagaccgccagaggcttctgcctgagaccccacgccctgagcgtggacgacgtgttccagggcgccgactgggagagacccggcagcccccccagctacgaggaggccatgcagggccccgccgccagactggtggccagcgagagccagaccgtgggcagcatgaccgtgggcagcatgagagccagaatgctggaggcccactgcctgctgccccccctgccccccgcccaccacgtggaggacagcagacacagaggcagcaaggagcccctgcccggccacggcctgagccccctgcccgagagatggaagcagagcagaaccgtgcacgccagcggcgacagcctgggccacgtgagcggccccggcagacccgagctgctgcccctgagaaccgtgagcgagagcgtgcagagaaacaagagagactgcctggtgagaagatgcagccagcccgtgttcgaggccgaccagttccagtacgccaaggagagctacatctag

SEQ ID NO: 102015 - DNA, 801 bp, Artificial Sequence
  Description of Artificial Sequence: Synthetic coding sequence
atgaagctgagaagcagccacaacgccagcaagaccctgaacgccaacaacatggagaccctgatcgagtgccagagcgagggcgacatcaaggagcaccccctgctggccagctgcgagagcgaggacagcatctgccagctgatcgaggtgaagaagagaaagaaggtgctgagctggcccttcctgatgagaagactgagccccgccagcgacttcagcggcgccctggagaccgacctgaaggccagcctgttcgaccagcccctgagcatcatctgcggcgacagcgacaccctgcccagacccatccaggacatcctgaccatcctgtgcctgaagggccccagcaccgagggcatcttcagaagagccgccaacgagaaggccagaaaggagctgaaggaggagctgaacagcggcgacgccgtggacctggagagactgcccgtgcacctgctggccgtggtgttcaaggacttcctgagaagcatccccagaaagctgctgagcagcgacctgttcgaggagtggatgggcgccctggagatgcaggacgaggaggacagaatcgaggccctgaagcaggtggccgacaagctgcccagacccaacctgctgctgctgaagcacctggtgtacgtgctgcacctgatcagcaagaacagcgaggtgaacagaatggacagcagcaacctggccatctgcatcggccccaacatgctgaccctggagaacgaccagagcctgagcttcgaggcccagaaggacctgaacaacaaggtgtgcagcgcctactag

SEQ ID NO: 102016 - DNA, 2196 bp, Artificial Sequence
  Description of Artificial Sequence: Synthetic coding sequence
atgaagctgagaagcagccacaacgccagcaagaccctgaacgccaacaacatggagaccctgatcgagtgccagagcgagggcgacatcaaggagcaccccctgctggccagctgcgagagcgaggacagcatctgccagctgatcgaggtgaagaagagaaagaaggtgctgagctggcccttcctgatgagaagactgagccccgccagcgacttcagcggcgccctggagaccgacctgaaggccagcctgttcgaccagcccctgagcatcatctgcggcgacagcgacaccctgcccagacccatccaggacatcctgaccatcctgtgcctgaagggccccagcaccgagggcatcttcagaagagccgccaacgagaaggccagaaaggagctgaaggaggagctgaacagcggcgacgccgtggacctggagagactgcccgtgcacctgctggccgtggtgttcaaggacttcctgagaagcatccccagaaagctgctgagcagcgacctgttcgaggagtggatgggcgccctggagatgcaggacgaggaggacagaatcgaggccctgaagcaggtggccgacaagctgcccagacccaacctgctgctgctgaagcacctggtgtacgtgctgcacctgatcagcaagaacagcgaggtgaacagaatggacagcagcaacctggccatctgcatcggccccaacatgctgaccctggagaacgaccagagcctgagcttcgaggcccagaaggacctgaacaacaaggtgaagaccctggtggagttcctgatcgacaactgcttcgagatcttcggcgagaacatccccgtgcacagcagcatcaccagcgacgacagcctggagcacaccgacagcagcgacgtgagcaccctgcagaacgacagcgcctacgacagcaacgaccccgacgtggagagcaacagcagcagcggcatcagcagccccagcagacagccccaggtgcccatggccaccgccgccggcctggacagcgccggcccccaggacgccagagaggtgagccccgagcccatcgtgagcaccgtggccagactgaagagcagcctggcccagcccgacagaagatacagcgagcccagcatgcccagcagccaggagtgcctggagagcagagtgaccaaccagaccctgaccaagagcgagggcgacttccccgtgcccagagtgggcagcagactggagagcgaggaggccgaggaccccttccccgaggaggtgttccccgccgtgcagggcaagaccaagagacccgtggacctgaagatcaagaacctggcccccggcagcgtgctgcccagagccctggtgctgaaggccttcagcagcagcagcctggacgccagcagcgacagcagccccgtggccagccccagcagccccaagagaaacttcttcagcagacaccagagcttcaccaccaagaccgagaagggcaagcccagcagagagatcaagaagcacagcatgagcttcaccttcgccccccacaagaaggtgctgaccaagaacctgagcgccggcagcggcaagagccaggacttcaccagagaccacgtgcccagaggcgtgagaaaggagagccagctggccggcagaatcgtgcaggagaacggctgcgagacccacaaccagaccgccagaggcttctgcctgagaccccacgccctgagcgtggacgacgtgttccagggcgccgactgggagagacccggcagcccccccagctacgaggaggccatgcagggccccgccgccagactggtggccagcgagagccagaccgtgggcagcatgaccgtgggcagcatgagagccagaatgctggaggcccactgcctgctgccccccctgccccccgcccaccacgtggaggacagcagacacagaggcagcaaggagcccctgcccggccacggcctgagccccctgcccgagagatggaagcagagcagaaccgtgcacgccagcggcgacagcctgggccacgtgagcggccccggcagacccgagctgctgcccctgagaaccgtgagcgagagcgtgcagagaaacaagagagactgcctggtgagaagatgcagccagcccgtgttcgaggccgaccagttccagtacgccaaggagagctacatctag

SEQ ID NO: 102017 - DNA, 828 bp, Artificial Sequence
  Description of Artificial Sequence: Synthetic coding sequence
atggccaccgccgccggcctggacagcgccggcccccaggacgccagagaggtgagccccgagcccatcgtgagcaccgtggccagactgaagagcagcctggcccagcccgacagaagatacagcgagcccagcatgcccagcagccaggagtgcctggagagcagagtgaccaaccagaccctgaccaagagcgagggcgacttccccgtgcccagagtgggcagcagactggagagcgaggaggccgaggaccccttccccgaggaggtgttccccgccgtgcagggcaagaccaagagacccgtggacctgaagatcaagaacctggcccccggcagcgtgctgcccagagccctggtgctgaaggccttcagcagcagcagcctggacgccagcagcgacagcagccccgtggccagccccagcagccccaagagaaacttcttcagcagacaccagagcttcaccaccaagaccgagaagggcaagcccagcagagagatcaagaagcacagcatgagcttcaccttcgccccccacaagaaggtgctgaccaagaacctgagcgccggcagcggcaagagccaggacttcaccagagaccacgtgcccagaggcgtgagaaaggagagccagctggccggcagaatcgtgcaggagaacggctgcgagacccacaaccagaccgccagaggcttctgcctgagaccccacgccctgagcgtggacgacgtgttccagggcgccgactgggagagacccggcagcccccccagctacgaggaggccatgcagggccccgccgccagaccctggggcgcctag

SEQ ID NO: 102018 - DNA, 327 bp, Artificial Sequence
  Description of Artificial Sequence: Synthetic coding sequence
atgaccagaaagatcttcaccaacaccagagagagatggagacagcagaacgtgaacagcgccttcgccaagctgagaaagctgatccccacccacccccccgacaagaagctgagcaagaacgagaccctgagactggccatgagatacatcaacttcctggtgaaggtgctgggcgagcagagcctgcagcagaccggcgtggccgcccagggcaacatcctgggcctgttcccccagggcccccacctgcccggcctggaggacagaaccctgctggagaactaccaggtgcccagccccggccccagccaccacatcccctag

SEQ ID NO: 102019 - DNA, 780 bp, Artificial Sequence
  Description of Artificial Sequence: Synthetic coding sequence
atggccagcccccagggcggccagatcgccatcgccatgagactgagaaaccagctgcagagcgtgtacaagatggaccccctgagaaacgaggaggaggtgagagtgaagatcaaggacctgaacgagcacatcgtgtgctgcctgtgcgccggctacttcgtggacgccaccaccatcaccgagtgcctgcacaccttctgcaagagctgcatcgtgaagtacctgcagaccagcaagtactgccccatgtgcaacatcaagatccacgagacccagcccctgctgaacctgaagctggacagagtgatgcaggacatcgtgtacaagctggtgcccggcctgcaggacagcgaggagaagagaatcagagagttctaccagagcagaggcctggacagagtgacccagcccaccggcgaggagcccgccctgagcaacctgggcctgcccttcagcagcttcgaccacagcaaggcccactactacagatacgacgagcagctgaacctgtgcctggagagactgagcagcggcaaggacaagaacaagagcgtgctgcagaacaagtacgtgagatgcagcgtgagagccgaggtgagacacctgagaagagtgctgtgccacagactgatgctgaacccccagcacgtgcagctgctgttcgacaacgaggtgctgcccgaccacatgaccatgaagcagatctggctgagcagatggttcggcaagcccagccccctgctgctgcagtacagcgtgaaggagaagagaagatag

SEQ ID NO: 102020 - DNA, 876 bp, Artificial Sequence
  Description of Artificial Sequence: Synthetic coding sequence
atggaggcccccgccagcgcccagaccccccacccccacgagcccatcagcttcggcatcgaccagatcctgaacagccccgaccaggacagcgcccccgcccccagaggccccgacggcgccagctacctgggcggcccccccggcggcagacccggcgccacctaccccagcctgcccgccagcttcgccggcctgggcgcccccttcgaggacgccggcagctacagcgtgaacctgagcctggcccccgccggcgtgatcagagtgcccgcccacagacccctgcccggcgccgtgcccccccccctgcccagcgccctgcccgccatgcccagcgtgcccaccgtgagcagcctgggcggcctgaacttcccctggatggagagcagcagaagattcgtgaaggacagattcaccgccgccgccgccctgacccccttcaccgtgaccagaagaatcggccacccctaccagaacagaaccccccccaagagaaagaagcccagaaccagcttcagcagagtgcagatctgcgagctggagaagagattccacagacagaagtacctggccagcgccgagagagccgccctggccaagagcctgaagatgaccgacgcccaggtgaagacctggttccagaacagaagaaccaagtggagaagacagaccgccgaggagagagaggccgagagacagcaggccagcagactgatgctgcagctgcagcacgacgccttccagaagagcctgaacgacagcatccagcccgaccccctgtgcctgcacaacagcagcctgttcgccctgcagaacctgcagccctgggaggaggacagcagcaaggtgcccgccgtgaccagcctggtgtag

SEQ ID NO: 102021 - DNA, 312 bp, Artificial Sequence
  Description of Artificial Sequence: Synthetic coding sequence
atggccgagagctggagcggccaggccctgcaggccctgcccgccaccgtgctgggcgccctgggcagcgagttcctgagagagtgggaggcccaggacatgagagtgaccctgttcaagctgctgctgctgtggctggtgctgagcctgctgggcatccagctggcctggggcttctacggcaacaccgtgaccggcctgtaccacagacccggcctgggcggccagaacggcagcacccccgacggcagcacccacttccccagctgggagatggccgccaacgagcccctgaagacccacagagagtag

SEQ ID NO: 102022 - DNA, 387 bp, Artificial Sequence
  Description of Artificial Sequence: Synthetic coding sequence
atggccagcgaggccagcgtgagactgggcgtgccccccggcagactgtggatccagagacccggcatctacgaggacgaggagggcagaacctgggtgaccgtggtggtgagattcaaccccagcagaagagagtgggccagagccagccagggcagcagatacgagcccagcatcaccgtgcacctgtggcagatggccgtgcacaccagagagctgctgagcagcggccagatgcccttcagccagctgcccgccgtgtggcagctgtaccccggcagaaagtacagagccgccgacagcagcttctgggagatcgccgaccacggccagatcgacagcatggagcagctggtgctgacctaccagcccgagagaaaggactag

SEQ ID NO: 102023 - DNA, 387 bp, Artificial Sequence; identical to SEQ ID NO: 102022
  Description of Artificial Sequence: Synthetic coding sequence

SEQ ID NO: 102024 - DNA, 4776 bp, Artificial Sequence
  Description of Artificial Sequence: Synthetic coding sequence
atgggcaacgccgagagccagcacgtggagcacgagttctacggcgagaagcacgccagcctgggcagaaagcacaccagcagaagcctgagactgagccacaagaccagaagaaccagacacgccagcagcggcaaggtgatccacagaaacagcgaggtgagcaccagaagcagcagcacccccagcatcccccagagcctggccgagaacggcctggagcccttcagccaggacggcaccctggaggacttcggcagccccatctgggtggacagagtggacatgggcctgagacccgtgagctacaccgacagcagcgtgacccccagcgtggacagcagcatcgtgctgaccgccgccagcgtgcagagcatgcccgacaccgaggagagcagactgtacggcgacgacgccacctacctggccgagggcggcagaagacagcacagctacaccagcaacggccccaccttcatggagaccgccagcttcaagaagaagagaagcaagagcgccgacatctggagagaggacagcctggagttcagcctgagcgacctgagccaggagcacctgaccagcaacgaggagatcctgggcagcgccgaggagaaggactgcgaggaggccagaggcatggagaccagagccagccccagacagctgagcacctgccagagagccaacagcctgggcgacctgtacgcccagaagaacagcggcgtgaccgccaacggcggccccggcagcaagttcgccggctactgcagaaacctggtgagcgacatccccaacctggccaaccacaagatgccccccgccgccgccgaggagacccccccctacagcaactacaacaccctgccctgcagaaagagccactgcctgagcgagggcgccaccaacccccagatcagccacagcaacagcatgcagggcagaagagccaagaccacccaggacgtgaacgccggcgagggcagcgagttcgccgacagcggcatcgagggcgccaccaccgacaccgacctgctgagcagaagaagcaacgccaccaacagcagctacagccccaccaccggcagagccttcgtgggcagcgacagcggcagcagcagcaccggcgacgccgccagacagggcgtgtacgagaacttcagaagagagctggagatgagcaccaccaacagcgagagcctggaggaggccggcagcgcccacagcgacgagcagagcagcggcaccctgagcagccccggccagagcgacatcctgctgaccgccgcccagggcaccgtgagaaaggccggcgccctggccgtgaagaacttcctggtgcacaagaagaacaagaaggtggagagcgccaccagaagaaagtggaagcactactgggtgagcctgaagggctgcaccctgttcttctacgagagcgacggcagaagcggcatcgaccacaacagcatccccaagcacgccgtgtgggtggagaacagcatcgtgcaggccgtgcccgagcaccccaagaaggacttcgtgttctgcctgagcaacagcctgggcgacgccttcctgttccagaccaccagccagaccgagctggagaactggatcaccgccatccacagcgcctgcgccaccgccgtggccagacaccaccacaaggaggacaccctgagactgctgaagagcgagatcaagaagctggagcagaagatcgacatggacgagaagatgaagaagatgggcgagatgcagctgagcagcgtgaccgacagcaagaagaagaagaccatcctggaccagatcttcgtgtgggagcagaacctggagcagttccagatggacctgttcagattcagatgctacctggccagcctgcagggcggcgagctgcccaaccccaagagactgctggccttcgccagcagacccaccaaggtggccatgggcagactgggcatcttcagcgtgagcagcttccacgccctggtggccgccagaaccggcgagaccggcgtgagaagaagaacccaggccatgagcagaagcgccagcaagagaagaagcagattcagcagcctgtggggcctggacaccaccagcaagaagaagcagggcagacccagcatcaaccaggtgttcggcgagggcaccgaggccgtgaagaagagcctggagggcatcttcgacgacatcgtgcccgacggcaagagagagaaggaggtggtgctgcccaacgtgcaccagcacaaccccgactgcgacatctgggtgcacgagtacttcacccccagctggttctgcctgcccaacaaccagcccgccctgaccgtggtgagacccggcgacaccgccagagacaccctggagctgatctgcaagacccaccagctggaccacagcgcccactacctgagactgaagttcctgatcgagaacaagatgcagctgtacgtgccccagcccgaggaggacatctacgagctgctgtacaaggagatcgagatctgccccaaggtgacccagagcatccacatcgagaagagcgacaccgccgccgacacctacggcttcagcctgagcagcgtggaggaggacggcatcagaagactgtacgtgaacagcgtgaaggagaccggcctggccagcaagaagggcctgaaggccggcgacgagatcctggagatcaacaacagagccgccgacgccctgaacagcagcatgctgaaggacttcctgagccagcccagcctgggcctgctggtgagaacctaccccgagctggaggagggcgtggagctgctggagagccccccccacagagtggacggccccgccgacctgggcgagagccccctggccttcctgaccagcaaccccggccacagcctgtgcagcgagcagggcagcagcgccgagaccgcccccgaggagaccgagggccccgacctggagagcagcgacgagaccgaccacagcagcaagagcaccgagcaggtggccgccttctgcagaagcctgcacgagatgaaccccagcgaccagagccccagcccccaggacagcaccggcccccagctggccaccatgagacagctgagcgacgccgacaagctgagaaaggtgatctgcgagctgctggagaccgagagaacctacgtgaaggacctgaactgcctgatggagagatacctgaagcccctgcagaaggagaccttcctgacccaggacgagctggacgtgctgttcggcaacctgaccgagatggtggagttccaggtggagttcctgaagaccctggaggacggcgtgagactggtgcccgacctggagaagctggagaaggtggaccagttcaagaaggtgctgttcagcctgggcggcagcttcctgtactacgccgacagattcaagctgtacagcgccttctgcgccagccacaccaaggtgcccaaggtgctggtgaaggccaagaccgacaccgccttcaaggccttcctggacgcccagaaccccaagcagcagcacagcagcaccctggagagctacctgatcaagcccatccagagaatcctgaagtaccccctgctgctgagagagctgttcgccctgaccgacgccgagagcgaggagcactaccacctggacgtggccatcaagaccatgaacaaggtggccagccacatcaacgagatgcagaagatccacgaggagttcggcgccgtgttcgaccagctgatcgccgagcagaccggcgagaagaaggaggtggccgacctgagcatgggcgacctgctgctgcacaccaccgtgatctggctgaacccccccgccagcctgggcaagtggaagaaggagcccgagctggccgccttcgtgttcaagaccgccgtggtgctggtgtacaaggacggcagcaagcagaagaagaagctggtgggcagccacagactgagcatctacgaggactgggaccccttcagattcagacacatgatccccaccgaggccctgcaggtgagagccctggccagcgccgacgccgaggccaacgccgtgtgcgagatcgtgcacgtgaagagcgagagcgagggcagacccgagagagtgttccacctgtgctgcagcagccccgagagcagaaaggacttcctgaaggccgtgcacagcatcctgagagacaagcacagaagacagctgctgaagaccgagagcctgcccagcagccagcagtacgtgcccttcggcggcaagagactgtgcgccctgaagggcgccagacccgccatgagcagagccgtgagcgcccccagcaagagcctgggcagaagaagaagaagactggccagaaacagattcaccatcgacagcgacgccgtgagcgccagcagccccgagaaggagagccagcagccccccggcggcggcgacaccgacagatgggtggaggagcagttcgacctggcccagtacgaggagcaggacgacatcaaggagaccgacatcctgagcgacgacgacgagttctgcgagagcgtgaagggcgccagcgtggacagagacctgcaggagagactgcaggccaccagcatcagccagagagagagaggcagaaagaccctggacagccacgccagcagaatggcccagctgaagaagcaggccgccctgagcggcatcaacggcggcctggagagcgccagcgaggaggtgatctgggtgagaagagaggacttcgcccccagcagaaagctgaacaccgagatctag

SEQ ID NO: 102025 - DNA, 3216 bp, Artificial Sequence
  Description of Artificial Sequence: Synthetic coding sequence
atggagaccgccagcttcaagaagaagagaagcaagagcgccgacatctggagagaggacagcctggagttcagcctgagcgacctgagccaggagcacctgaccagcaacgaggagatcctgggcagcgccgaggagaaggactgcgaggaggccagaggcatggagaccagagccagccccagacagctgagcacctgccagagagccaacagcctgggcgacctgtacgcccagaagaacagcggcgtgaccgccaacggcggccccggcagcaagttcgccggctactgcagaaacctggtgagcgacatccccaacctggccaaccacaagatgccccccgccgccgccgaggagacccccccctacagcaactacaacaccctgccctgcagaaagagccactgcctgagcgagggcgccaccaacccccagatcagccacagcaacagcatgcagggcagaagagccaagaccacccaggacgtgaacgccggcgagggcagcgagttcgccgacagcggcatcgagggcgccaccaccgacaccgacctgctgagcagaagaagcaacgccaccaacagcagctacagccccaccaccggcagagccttcgtgggcagcgacagcggcagcagcagcaccggcgacgccgccagacagggcgtgtacgagaacttcagaagagagctggagatgagcaccaccaacagcgagagcctggaggaggccggcagcgcccacagcgacgagcagagcagcggcaccctgagcagccccggccagagcgacatcctgctgaccgccgcccagggcaccgtgagaaaggccggcgccctggccgtgaagaacttcctggtgcacaagaagaacaagaaggtggagagcgccaccagaagaaagtggaagcactactgggtgagcctgaagggctgcaccctgttcttctacgagagcgacggcagaagcggcatcgaccacaacagcatccccaagcacgccgtgtgggtggagaacagcatcgtgcaggccgtgcccgagcaccccaagaaggacttcgtgttctgcctgagcaacagcctgggcgacgccttcctgttccagaccaccagccagaccgagctggagaactggatcaccgccatccacagcgcctgcgccaccgccgtggccagacaccaccacaaggaggacaccctgagactgctgaagagcgagatcaagaagctggagcagaagatcgacatggacgagaagatgaagaagatgggcgagatgcagctgagcagcgtgaccgacagcaagaagaagaagaccatcctggaccagatcttcgtgtgggagcagaacctggagcagttccagatggacctgttcagattcagatgctacctggccagcctgcagggcggcgagctgcccaaccccaagagactgctggccttcgccagcagacccaccaaggtggccatgggcagactgggcatcttcagcgtgagcagcttccacgccctggtggccgccagaaccggcgagaccggcgtgagaagaagaacccaggccatgagcagaagcgccagcaagagaagaagcagattcagcagcctgtggggcctggacaccaccagcaagaagaagcagggcagacccagcatcaaccaggtgttcggcgagggcaccgaggccgtgaagaagagcctggagggcatcttcgacgacatcgtgcccgacggcaagagagagaaggaggtggtgctgcccaacgtgcaccagcacaaccccgactgcgacatctgggtgcacgagtacttcacccccagctggttctgcctgcccaacaaccagcccgccctgaccgtggtgagacccggcgacaccgccagagacaccctggagctgatctgcaagacccaccagctggaccacagcgcccactacctgagactgaagttcctgatcgagaacaagatgcagctgtacgtgccccagcccgaggaggacatctacgagctgctgtacaaggagatcgagatctgccccaaggtgacccagagcatccacatcgagaagagcgacaccgccgccgacacctacggcttcagcctgagcagcgtggaggaggacggcatcagaagactgtacgtgaacagcgtgaaggagaccggcctggccagcaagaagggcctgaaggccggcgacgagatcctggagatcaacaacagagccgccgacgccctgaacagcagcatgctgaaggacttcctgagccagcccagcctgggcctgctggtgagaacctaccccgagctggaggagggcgtggagctgctggagagccccccccacagagtggacggccccgccgacctgggcgagagccccctggccttcctgaccagcaaccccggccacagcctgtgcagcgagcagggcagcagcgccgagaccgcccccgaggagaccgagggccccgacctggagagcagcgacgagaccgaccacagcagcaagagcaccgagcaggtggccgccttctgcagaagcctgcacgagatgaaccccagcgaccagagccccagcccccaggacagcaccggcccccagctggccaccatgagacagctgagcgacgccgacaagctgagaaaggtgatctgcgagctgctggagaccgagagaacctacgtgaaggacctgaactgcctgatggagagatacctgaagcccctgcagaaggagaccttcctgacccaggacgagctggacgtgctgttcggcaacctgaccgagatggtggagttccaggtggagttcctgaagaccctggaggacggcgtgagactggtgcccgacctggagaagctggagaaggtggaccagttcaagaaggtgctgttcagcctgggcggcagcttcctgtactacgccgacagattcaagctgtacagcgccttctgcgcccacaagagcagccagggccccggcgagagccaggacagacacggcttccagggcatcctgggctgccccgagcccgaggccgccgccctgatccacgccggcgtggtgccccaccaggcccaccccgaggacccccaggtgcccaccagcgcccagggcgccgtgagacccgacagatgcggcgagagaggcgccctgccccccggcagaggccaccaggaccacgagcagggctgccagagccaccagtag

SEQ ID NO: 102026 - DNA, 678 bp, Artificial Sequence
  Description of Artificial Sequence: Synthetic coding sequence
atgggcaacgccgagagccagcacgtggagcacgagttctacggcgagaagcacgccagcctgggcagaaagcacaccagcagaagcctgagactgagccacaagaccagaagaaccagacacgccagcagcggcaaggtgatccacagaaacagcgaggtgagcaccagaagcagcagcacccccagcatcccccagagcctggccgagaacggcctggagcccttcagccaggacggcaccctggaggacttcggcagccccatctgggtggacagagtggacatgggcctgagacccgtgagctacaccgacagcagcgtgacccccagcgtggacagcagcatcgtgctgaccgccgccagcgtgcagagcatgcccgacaccgaggagagcagactgtacggcgacgacgccacctacctggccgagggcggcagaagacagcacagctacaccagcaacggccccaccttcatggagaccgccagcttcaagaagaagagaagcaagagcgccgacatctggagagaggacagcctggagttcagcctgagcgacctgagccaggagcacctgaccagcaacgaggagatcctgggcagcgccgaggagaaggactgcgaggaggccagaggcatggagaccagagccagccccagacagctgagcacctag

SEQ ID NO: 102027 - DNA, 4596 bp, Artificial Sequence
  Description of Artificial Sequence: Synthetic coding sequence
atgggcaacgccgagagccagcacgtggagcacgagttctacggcgagaagcacgccagcctgggcagaaagcacaccagcagaagcctgagactgagccacaagaccagaagaaccagacacgccagcagcggcaaggtgatccacagaaacagcgaggtgagcaccagaagcagcagcacccccagcatcccccagagcctggccgagaacggcctggagcccttcagccaggacggcaccctggaggacttcggcagccccatctgggtggacagagtggacatgggcctgagacccgtgagctacaccgacagcagcgtgacccccagcgtggacagcagcatcgtgctgaccgccgccagcgtgcagagcatgcccgacaccgaggagagcagactgtacggcgacgacgccacctacctggccgagggcggcagaagacagcacagctacaccagcaacggccccaccttcatggagaccgccagcttcaagaagaagagaagcaagagcgccgacatctggagagaggacagcctggagttcagcctgagcgacctgagccaggagcacctgaccagcaacgaggagatcctgggcagcgccgaggagaaggactgcgaggaggccagaggcatggagaccagagccagccccagacagctgagcacctgccagagagccaacagcctgggcgacctgtacgcccagaagaacagcggcgtgaccgccaacggcggccccggcagcaagttcgccggctactgcagaaacctggtgagcgacatccccaacctggccaaccacaagatgccccccgccgccgccgaggagacccccccctacagcaactacaacaccctgccctgcagaaagagccactgcctgagcgagggcgccaccaacccccagatcagccacagcaacagcatgcagggcagaagagccaagaccacccaggacgtgaacgccggcgagggcagcgagttcgccgacagcggcatcgagggcgccaccaccgacaccgacctgctgagcagaagaagcaacgccaccaacagcagctacagccccaccaccggcagagccttcgtgggcagcgacagcggcagcagcagcaccggcgacgccgccagacagggcgtgtacgagaacttcagaagagagctggagatgagcaccaccaacagcgagagcctggaggaggccggcagcgcccacagcgacgagcagagcagcggcaccctgagcagccccggccagagcgacatcctgctgaccgccgcccagggcaccgtgagaaaggccggcgccctggccgtgaagaacttcctggtgcacaagaagaacaagaaggtggagagcgccaccagaagaaagtggaagcactactgggtgagcctgaagggctgcaccctgttcttctacgagagcgacggcagaagcggcatcgaccacaacagcatccccaagcacgccgtgtgggtggagaacagcatcgtgcaggccgtgcccgagcaccccaagaaggacttcgtgttctgcctgagcaacagcctgggcgacgccttcctgttccagaccaccagccagaccgagctggagaactggatcaccgccatccacagcgcctgcgccaccgccgtggccagacaccaccacaaggaggacaccctgagactgctgaagagcgagatcaagaagctggagcagaagatcgacatggacgagaagatgaagaagatgggcgagatgcagctgagcagcgtgaccgacagcaagaagaagaagaccatcctggaccagatcttcgtgtgggagcagaacctggagcagttccagatggacctgttcagattcagatgctacctggccagcctgcagggcggcgagctgcccaaccccaagagactgctggccttcgccagcagacccaccaaggtggccatgggcagactgggcatcttcagcgtgagcagcttccacgccctggtggccgccagaaccggcgagaccggcgtgagaagaagaacccaggccatgagcagaagcgccagcaagagaagaagcagattcagcagcctgtggggcctggacaccaccagcaagaagaagcagggcagacccagcatcaaccagagagagaaggaggtggtgctgcccaacgtgcaccagcacaaccccgactgcgacatctgggtgcacgagtacttcacccccagctggttctgcctgcccaacaaccagcccgccctgaccgtggtgagacccggcgacaccgccagagacaccctggagctgatctgcaagctgtacaaggagatcgagatctgccccaaggtgacccagagcatccacatcgagaagagcgacaccgccgccgacacctacggcttcagcctgagcagcgtggaggaggacggcatcagaagactgtacgtgaacagcgtgaaggagaccggcctggccagcaagaagggcctgaaggccggcgacgagatcctggagatcaacaacagagccgccgacgccctgaacagcagcatgctgaaggacttcctgagccagcccagcctgggcctgctggtgagaacctaccccgagctggaggagggcgtggagctgctggagagccccccccacagagtggacggccccgccgacctgggcgagagccccctggccttcctgaccagcaaccccggccacagcctgtgcagcgagcagggcagcagcgccgagaccgcccccgaggagaccgagggccccgacctggagagcagcgacgagaccgaccacagcagcaagagcaccgagcaggtggccgccttctgcagaagcctgcacgagatgaaccccagcgaccagagccccagcccccaggacagcaccggcccccagctggccaccatgagacagctgagcgacgccgacaagctgagaaaggtgatctgcgagctgctggagaccgagagaacctacgtgaaggacctgaactgcctgatggagagatacctgaagcccctgcagaaggagaccttcctgacccaggacgagctggacgtgctgttcggcaacctgaccgagatggtggagttccaggtggagttcctgaagaccctggaggacggcgtgagactggtgcccgacctggagaagctggagaaggtggaccagttcaagaaggtgctgttcagcctgggcggcagcttcctgtactacgccgacagattcaagctgtacagcgccttctgcgccagccacaccaaggtgcccaaggtgctggtgaaggccaagaccgacaccgccttcaaggccttcctggacgcccagaaccccaagcagcagcacagcagcaccctggagagctacctgatcaagcccatccagagaatcctgaagtaccccctgctgctgagagagctgttcgccctgaccgacgccgagagcgaggagcactaccacctggacgtggccatcaagaccatgaacaaggtggccagccacatcaacgagatgcagaagatccacgaggagttcggcgccgtgttcgaccagctgatcgccgagcagaccggcgagaagaaggaggtggccgacctgagcatgggcgacctgctgctgcacaccaccgtgatctggctgaacccccccgccagcctgggcaagtggaagaaggagcccgagctggccgccttcgtgttcaagaccgccgtggtgctggtgtacaaggacggcagcaagcagaagaagaagctggtgggcagccacagactgagcatctacgaggactgggaccccttcagattcagacacatgatccccaccgaggccctgcaggtgagagccctggccagcgccgacgccgaggccaacgccgtgtgcgagatcgtgcacgtgaagagcgagagcgagggcagacccgagagagtgttccacctgtgctgcagcagccccgagagcagaaaggacttcctgaaggccgtgcacagcatcctgagagacaagcacagaagacagctgctgaagaccgagagcctgcccagcagccagcagtacgtgcccttcggcggcaagagactgtgcgccctgaagggcgccagacccgccatgagcagagccgtgagcgcccccagcaagagcctgggcagaagaagaagaagactggccagaaacagattcaccatcgacagcgacgccgtgagcgccagcagccccgagaaggagagccagcagccccccggcggcggcgacaccgacagatgggtggaggagcagttcgacctggcccagtacgaggagcaggacgacatcaaggagaccgacatcctgagcgacgacgacgagttctgcgagagcgtgaagggcgccagcgtggacagagacctgcaggagagactgcaggccaccagcatcagccagagagagagaggcagaaagaccctggacagccacgccagcagaatggcccagctgaagaagcaggccgccctgagcggcatcaacggcggcctggagagcgccagcgaggaggtgatctgggtgagaagagaggacttcgcccccagcagaaagctgaacaccgagatctag

SEQ ID NO: 102028 - DNA, 2493 bp, Artificial Sequence
  Description of Artificial Sequence: Synthetic coding sequence
atgggcagcatgttcagaagcgaggaggtggccctggtgcagctgttcctgcccaccgccgccgcctacacctgcgtgagcagactgggcgagctgggcctggtggagttcagagacctgaacgccagcgtgagcgccttccagagaagattcgtggtggacgtgagaagatgcgaggagctggagaagaccttcaccttcctgcaggaggaggtgagaagagccggcctggtgctgcccccccccaagggcagactgcccgcccccccccccagagacctgctgagaatccaggaggagaccgagagactggcccaggagctgagagacgtgagaggcaaccagcaggccctgagagcccagctgcaccagctgcagctgcacgccgccgtgctgagacagggccacgagccccagctggccgccgcccacaccgacggcgccagcgagagaacccccctgctgcaggcccccggcggcccccaccaggacctgagagtgaacttcgtggccggcgccgtggagccccacaaggcccccgccctggagagactgctgtggagagcctgcagaggcttcctgatcgccagcttcagagagctggagcagcccctggagcaccccgtgaccggcgagcccgccacctggatgaccttcctgatcagctactggggcgagcagatcggccagaagatcagaaagatcaccgactgcttccactgccacgtgttccccttcctgcagcaggaggaggccagactgggcgccctgcagcagctgcagcagcagagccaggagctgcaggaggtgctgggcgagaccgagagattcctgagccaggtgctgggcagagtgctgcagctgctgccccccggccaggtgcaggtgcacaagatgaaggccgtgtacctggccctgaaccagtgcagcgtgagcaccacccacaagtgcctgatcgccgaggcctggtgcagcgtgagagacctgcccgccctgcaggaggccctgagagacagcagcatggaggagggcgtgagcgccgtggcccacagaatcccctgcagagacatgccccccaccctgatcagaaccaacagattcaccgccagcttccagggcatcgtggacgcctacggcgtgggcagataccaggaggtgaaccccgccccctacaccatcatcaccttccccttcctgttcgccgtgatgttcggcgacgtgggccacggcctgctgatgttcctgttcgccctggccatggtgctggccgagaacagacccgccgtgaaggccgcccagaacgagatctggcagaccttcttcagaggcagatacctgctgctgctgatgggcctgttcagcatctacaccggcttcatctacaacgagtgcttcagcagagccaccagcatcttccccagcggctggagcgtggccgccatggccaaccagagcggctggagcgacgccttcctggcccagcacaccatgctgaccctggaccccaacgtgaccggcgtgttcctgggcccctaccccttcggcatcgaccccatctggagcctggccgccaaccacctgagcttcctgaacagcttcaagatgaagatgagcgtgatcctgggcgtggtgcacatggccttcggcgtggtgctgggcgtgttcaaccacgtgcacttcggccagagacacagactgctgctggagaccctgcccgagctgaccttcctgctgggcctgttcggctacctggtgttcctggtgatctacaagtggctgtgcgtgtgggccgccagagccgccagcgcccccagcatcctgatccacttcatcaacatgttcctgttcagccacagccccagcaacagactgctgtaccccagacaggaggtggtgcaggccaccctggtggtgctggccctggccatggtgcccatcctgctgctgggcacccccctgcacctgctgcacagacacagaagaagactgagaagaagacccgccgacagacaggaggagaacaaggccggcctgctggacctgcccgacgccagcgtgaacggctggagcagcgacgaggagaaggccggcggcctggacgacgaggaggaggccgagctggtgcccagcgaggtgctgatgcaccaggccatccacaccatcgagttctgcctgggctgcgtgagcaacaccgccagctacctgagactgtgggccctgagcctggcccacgcccagctgagcgaggtgctgtgggccatggtgatgagaatcggcctgggcctgggcagagaggtgggcgtggccgccgtggtgctggtgcccatcttcgccgccttcgccgtgatgaccgtggccatcctgctggtgatggagggcctgagcgccttcctgcacgccctgagactgcactgggtggagttccagaacaagttctacagcggcaccggctacaagctgagccccttcaccttcgccgccaccgacgactag

SEQ ID NO: 102029 - DNA, 657 bp, Artificial Sequence
  Description of Artificial Sequence: Synthetic coding sequence
atgggcagcatgttcagaagcgaggaggtggccctggtgcagctgttcctgcccaccgccgccgcctacacctgcgtgagcagactgggcgagctgggcctggtggagttcagagacctgaacgccagcgtgagcgccttccagagaagattcgtggtggacgtgagaagatgcgaggagctggagaagaccttcaccttcctgcaggaggaggtgagaagagccggcctggtgctgcccccccccaagggcagactgcccgcccccccccccagagacctgctgagaatccaggaggagaccgagagactggcccaggagctgagagacgtgagaggcaaccagcaggccctgagagcccagctgcaccagctgcagctgcacgccgccgtgctgagacagggccacgagccccagctggccgccgcccacaccgacggcgccagcgagagaacccccctgctgcaggcccccggcggcccccaccaggacctgagagtgaacttcgtggccggcgccgtggagccccacaaggcccccgccctggagagactgctgtggagagcctgcagaggcttcctgatcgccagcttcagagagctggagcagcccctggagcaccccgtgaccggcgagcccgccacctggatgacctag

SEQ ID NO: 102030 - DNA, 186 bp, Artificial Sequence
  Description of Artificial Sequence: Synthetic coding sequence
gacgacgaggaggaggccgagctggtgcccagcgaggtgctgatgcaccaggccatccacaccatcgagttctgcctgggctgcgtgagcaacaccgccagctacctgagactgtgggccctgagcctggcccacgccagatggaacagcagaaccagcagcacccaggccagagccaccagctag

SEQ ID NO: 102031 - DNA, 1845 bp, Artificial Sequence
  Description of Artificial Sequence: Synthetic coding sequence
atgaccttcctgatcagctactggggcgagcagatcggccagaagatcagaaagatcaccgactgcttccactgccacgtgttccccttcctgcagcaggaggaggccagactgggcgccctgcagcagctgcagcagcagagccaggagctgcaggaggtgctgggcgagaccgagagattcctgagccaggtgctgggcagagtgctgcagctgctgccccccggccaggtgcaggtgcacaagatgaaggccgtgtacctggccctgaaccagtgcagcgtgagcaccacccacaagtgcctgatcgccgaggcctggtgcagcgtgagagacctgcccgccctgcaggaggccctgagagacagcagcatggaggagggcgtgagcgccgtggcccacagaatcccctgcagagacatgccccccaccctgatcagaaccaacagattcaccgccagcttccagggcatcgtggacgcctacggcgtgggcagataccaggaggtgaaccccgccccctacaccatcatcaccttccccttcctgttcgccgtgatgttcggcgacgtgggccacggcctgctgatgttcctgttcgccctggccatggtgctggccgagaacagacccgccgtgaaggccgcccagaacgagatctggcagaccttcttcagaggcagatacctgctgctgctgatgggcctgttcagcatctacaccggcttcatctacaacgagtgcttcagcagagccaccagcatcttccccagcggctggagcgtggccgccatggccaaccagagcggctggagcgacgccttcctggcccagcacaccatgctgaccctggaccccaacgtgaccggcgtgttcctgggcccctaccccttcggcatcgaccccatctggagcctggccgccaaccacctgagcttcctgaacagcttcaagatgaagatgagcgtgatcctgggcgtggtgcacatggccttcggcgtggtgctgggcgtgttcaaccacgtgcacttcggccagagacacagactgctgctggagaccctgcccgagctgaccttcctgctgggcctgttcggctacctggtgttcctggtgatctacaagtggctgtgcgtgtgggccgccagagccgccagcgcccccagcatcctgatccacttcatcaacatgttcctgttcagccacagccccagcaacagactgctgtaccccagacaggaggtggtgcaggccaccctggtggtgctggccctggccatggtgcccatcctgctgctgggcacccccctgcacctgctgcacagacacagaagaagactgagaagaagacccgccgacagacaggaggagaacaaggccggcctgctggacctgcccgacgccagcgtgaacggctggagcagcgacgaggagaaggccggcggcctggacgacgaggaggaggccgagctggtgcccagcgaggtgctgatgcaccaggccatccacaccatcgagttctgcctgggctgcgtgagcaacaccgccagctacctgagactgtgggccctgagcctggcccacgcccagctgagcgaggtgctgtgggccatggtgatgagaatcggcctgggcctgggcagagaggtgggcgtggccgccgtggtgctggtgcccatcttcgccgccttcgccgtgatgaccgtggccatcctgctggtgatggagggcctgagcgccttcctgcacgccctgagactgcactgggtggagttccagaacaagttctacagcggcaccggctacaagctgagccccttcaccttcgccgccaccgacgactag

SEQ ID NO: 102032 - DNA, 357 bp, Artificial Sequence
  Description of Artificial Sequence: Synthetic coding sequence
atggtgcccatcctgctgctgggcacccccctgcacctgctgcacagacacagaagaagactgagaagaagacccgccgacagacaggaggagaacaaggccggcctgctggacctgcccgacgccagcgtgaacggctggagcagcgacgaggagaaggccggcggcctggacgacgaggaggaggccgagctggtgcccagcgaggtgctgatgcaccaggccatccacaccatcgagttctgcctgggctgcgtgagcaacaccgccagctacctgagactgtgggccctgagcctggcccacgccagatggaacagcagaaccagcagcacccaggccagagccaccagctag

SEQ ID NO: 102033 - DNA, 1671 bp, Artificial Sequence
  Description of Artificial Sequence: Synthetic coding sequence
atggagggccccctgagcgtgttcggcgacagaagcaccggcgagaccatcagaagccagaacgtgatggccgccgccagcatcgccaacatcgtgaagagcagcctgggccccgtgggcctggacaagatgctggtggacgacatcggcgacgtgaccatcaccaacgacggcgccaccatcctgaagctgctggaggtggagcaccccgccgccaaggtgctgtgcgagctggccgacctgcaggacaaggaggtgggcgacggcaccaccagcgtggtgatcatcgccgccgagctgctgaagaacgccgacgagctggtgaagcagaagatccaccccaccagcgtgatcagcggctacagactggcctgcaaggaggccgtgagatacatcaacgagaacctgatcgtgaacaccgacgagctgggcagagactgcctgatcaacgccgccaagaccagcatgagcagcaagatcatcggcatcaacggcgacttcttcgccaacatggtggtggacgccgtgctggccatcaagtacaccgacatcagaggccagcccagataccccgtgaacagcgtgaacatcctgaaggcccacggcagaagccagatggagagcatgctgatcagcggctacgccctgaactgcgtggtgggcagccagggcatgcccaagagaatcgtgaacgccaagatcgcctgcctggacttcagcctgcagaagaccaagatgaagctgggcgtgcaggtggtgatcaccgaccccgagaagctggaccagatcagacagagagagagcgacatcaccaaggagagaatccagaagatcctggccaccggcgccaacgtgatcctgaccaccggcggcatcgacgacatgtgcctgaagtacttcgtggaggccggcgccatggccgtgagaagagtgctgaagagagacctgaagagaatcgccaaggccagcggcgccaccatcctgagcaccctggccaacctggagggcgaggagaccttcgaggccgccatgctgggccaggccgaggaggtggtgcaggagagaatctgcgacgacgagctgatcctgatcaagaacaccaaggccagaaccagcgccagcatcatcctgagaggcgccaacgacttcatgtgcgacgagatggagagaagcctgcacgacgccctgtgcgtggtgaagagagtgctggagagcaagagcgtggtgcccggcggcggcgccgtggaggccgccctgagcatctacctggagaactacgccaccagcatgggcagcagagagcagctggccatcgccgagttcgccagaagcctgctggtgatccccaacaccctggccgtgaacgccgcccaggacagcaccgacctggtggccaagctgagagccttccacaacgaggcccaggtgaaccccgagagaaagaacctgaagtggatcggcctggacctgagcaacggcaagcccagagacaacaagcaggccggcgtgttcgagcccaccatcgtgaaggtgaagagcctgaagttcgccaccgaggccgccatcaccatcctgagaatcgacgacctgatcaagctgcaccccgagagcaaggacgacaagcacggcagctacgaggacgccgtgcacagcggcgccctgaacgactag

SEQ ID NO: 102034 - DNA, 1206 bp, Artificial Sequence
  Description of Artificial Sequence: Synthetic coding sequence
atgagcagcaagatcatcggcatcaacggcgacttcttcgccaacatggtggtggacgccgtgctggccatcaagtacaccgacatcagaggccagcccagataccccgtgaacagcgtgaacatcctgaaggcccacggcagaagccagatggagagcatgctgatcagcggctacgccctgaactgcgtggtgggcagccagggcatgcccaagagaatcgtgaacgccaagatcgcctgcctggacttcagcctgcagaagaccaagatgaagctgggcgtgcaggtggtgatcaccgaccccgagaagctggaccagatcagacagagagagagcgacatcaccaaggagagaatccagaagatcctggccaccggcgccaacgtgatcctgaccaccggcggcatcgacgacatgtgcctgaagtacttcgtggaggccggcgccatggccgtgagaagagtgctgaagagagacctgaagagaatcgccaaggccagcggcgccaccatcctgagcaccctggccaacctggagggcgaggagaccttcgaggccgccatgctgggccaggccgaggaggtggtgcaggagagaatctgcgacgacgagctgatcctgatcaagaacaccaaggccagaaccagcgccagcatcatcctgagaggcgccaacgacttcatgtgcgacgagatggagagaagcctgcacgacgccctgtgcgtggtgaagagagtgctggagagcaagagcgtggtgcccggcggcggcgccgtggaggccgccctgagcatctacctggagaactacgccaccagcatgggcagcagagagcagctggccatcgccgagttcgccagaagcctgctggtgatccccaacaccctggccgtgaacgccgcccaggacagcaccgacctggtggccaagctgagagccttccacaacgaggcccaggtgaaccccgagagaaagaacctgaagtggatcggcctggacctgagcaacggcaagcccagagacaacaagcaggccggcgtgttcgagcccaccatcgtgaaggtgaagagcctgaagttcgccaccgaggccgccatcaccatcctgagaatcgacgacctgatcaagctgcaccccgagagcaaggacgacaagcacggcagctacgaggacgccgtgcacagcggcgccctgaacgactag

SEQ ID NO: 102035 - DNA, 1302 bp, Artificial Sequence
  Description of Artificial Sequence: Synthetic coding sequence
atggagggccccctgagcgtgttcggcgacagaagcaccggcgagaccatcagaagccagaacgtgatggccgccgccagcatcgccaacatcgtgaagagcagcctgggccccgtgggcctggacaagatgctggtggacgacatcggcgacgtgaccatcaccaacgacggcgccaccatcctgaagctgctggaggtggagcaccccgccgccaaggtgctgtgcgagctggccgacctgcaggacaaggaggtgggcgacggcaccaccagcgtggtgatcatcgccgccgagctgctgaagaacgccgacgagctggtgaagcagaagatccaccccaccagcgtgatcagcggctacagactggcctgcaaggaggccgtgagatacatcaacgagaacctgatcgtgaacaccgacgagctgggcagagactgcctgatcaacgccgccaagaccagcatgagcagcaagatcatcggcatcaacggcgacttcttcgccaacatggtggtggacgccgtgctggccatcaagtacaccgacatcagaggccagcccagataccccgtgaacagcgtgaacatcctgaaggcccacggcagaagccagatggagagcatgctgatcagcggctacgccctgaactgcgtggtgggcagccagggcatgcccaagagaatcgtgaacgccaagatcgcctgcctggacttcagcctgcagaagaccaagatgaagctgggcgtgcaggtggtgatcaccgaccccgagaagctggaccagatcagacagagagagagcgacatcaccaaggagagaatccagaagatcctggccaccggcgccaacgtgatcctgaccaccggcggcatcgacgacatgtgcctgaagtacttcgtggaggccggcgccatggccgtgagaagagtgctgaagagagacctgaagagaatcgccaaggccagcggcgccaccatcctgagcaccctggccaacctggagggcgaggagaccttcgaggccgccatgctgggccaggccgaggaggtggtgcaggagagaatctgcgacgacgagctgatcctgatcaagaacaccaaggccagaaccagcgccagcatcatcctgagaggcgccaacgacttcatgtgcgacgagatggagagaagcctgcacgacgccctgtgcgtggtgaagagagtgctggagagcaagagcgtggtgcccggcggcggcgccgtggaggccgccctgagcatctacctggagaactacgccaccagcatggactggagctag

SEQ ID NO: 102036 - DNA, 648 bp, Artificial Sequence
  Description of Artificial Sequence: Synthetic coding sequence
atgctggccggccagctggaggccagagaccccaaggagggcacccaccccgaggacccctgccccggcgccggcgccgtgatggagaagaccgccgtggccgccgaggtgctgaccgaggactgcaacaccggcgagatgccccccctgcagcagcagatcatcagactgcaccaggagctgggcagacagaagagcctgtgggccgacgtgcacggcaagctgagaagccacatcgacgccctgagagagcagaacatggagctgagagagaagctgagagccctgcagctgcagagatggaaggccagaaagaagagcgccgccagcccccacgccggccaggagagccacaccctggccctggagcccgccttcggcaagatcagccccctgagcgccgacgaggagaccatccccaagtacgccggccacaagaaccagagcgccaccctgctgggccagagaagcagcagcaacaacagcgccccccccaagcccatgagcctgaagatcgagagaatcagcagctggaagacccccccccaggagaacagagacaagaacctgagcagaagaagacaggacagaagagccacccccaccggcagacccaccccctgcgccgagagaagaggcggcgtgtag

SEQ ID NO: 102037 - DNA, 981 bp, Artificial Sequence
  Description of Artificial Sequence: Synthetic coding sequence
atggagaagacccccgccgccgccgaggtgcccagagaggacagcaacgccggcgagatgcccagcctgcagcagcagatcaccagcctgcaccaggagctgggcagacagcagagcctgtgggccgacatccacagaaagctgcagagccacatggacgccctgagaaagcagaacagagagctgagagaggagctgagaggcctgcagagacagcagtgggaggccggcaagaagcccgccgccagcccccacgccggcagagagagccacaccctggccctggagcccgccttcggcaagatcagccacctgagcgccgacgaggacaccacccccaagtacgccggcagaaagagccagagcgccaccctgctgggccagagatggagcagcaaccacctggccccccccaagcccatgagcctgaagaccgagagaatcaacagcggcaagacccccccccaggaggacagagagaagagcccccccggcagaagacaggacagaagccccgcccccaccggcagacccacccccggcgccgagagaagaggcgtgagcgaggacggcaagatcatgcaccccagcagcagaagcccccagaacagcggcggcagaaagagccccgtgcaggccagccaggccaccaccctgcaggagcagaccgccgccgccagaggcgccgacagaagcagcagcgtgctgggcagcagcgagggcggcttcctgagcagagtgcaggccgacgagttcgccagcagcgcccccgacagcgccgagagacagaacctgcccgtgaacccccccagcagcctggagatcgcccaggccatggacaccaagatgaagaaggaggaggtgcaggaggagaagagacaccccaagggcaaggccgacgactgcagaagaagcggcttccccagcgagttccccggcgccctgcacgccgcccccagcagacaggacatgggcccctag

SEQ ID NO: 102038 - DNA, 1326 bp, Artificial Sequence
  Description of Artificial Sequence: Synthetic coding sequence
atggcccccaagggcatcctgggcagcttccccaccgccatgaacctgagcctggagggcaaggtgaaggagaccgtgcacaacgccttctgggaccacctgaaggagcagctgagcgccaccccccccgacttcagctgcgccctggagctgctgaaggagatcaaggagatcctgctgagcctgctgctgcccagacagaacagactgagaatcgagatcgaggaggccctggacatggacctgctgaagcaggaggccgagcacggcgccctgaaggtgctgtacctgagcaagtacgtgctgaacatgatggccctgctgtgcgcccccgtgagagacgaggccgtgcagaagctggagaacatcaccgaccccgtgtggctgctgagaggcatcttccaggtgctgggcagaatgaagatggacatggtgaactacaccatccagagcctgcagccccacctgcaggagcacagcatccagtacgagagagccaagttccaggagctgctgaacaagcagcccagcctgctgaaccacaccaccaagtggctgacccaggccgccggcgacctgaccatgagcccccccacctgccccgacaccagcgacagcagcagcgtggccggccccagccccaacgaggccgccaacaaccccgagcccctgagccccaccatggtgctgtgccagggcttcctgaacctgctgctgtgggacctggagaacgaggagttccccgagaccctgctgatggacagaaccagactgcaggagctgaagagccagctgcaccagctgaccgtgatggccagcgtgctgctggtggccagcagcttcagcggcagcgtgctgttcggcagcccccagttcgtggacaagctgaagagaatcaccaagagcctgctggaggacttccacagcagacccgaggaggccatcctgaccgtgagcgagcaggtgagccaggagatccaccagagcctgaagaacatgggcctggtggccctgagcagcgacaacaccgccagcctgatgggccagctgcagaacatcgccaagaaggagaactgcgtgtgcagcgtgatcgaccagagaatccacctgttcctgaagtgctgcctggtgctgggcgtgcagagaagcctgctggacctgcccggcggcctgaccctgatcgaggccgagctggccgagctgggccagaagttcgtgaacctgacccaccacaaccagcaggtgttcggcccctactacaccgagatcctgaagaccctgatcagccccgcccaggccctggagaccaaggtggagagcgtgtag

SEQ ID NO: 102039 - DNA, 1551 bp, Artificial Sequence
  Description of Artificial Sequence: Synthetic coding sequence
atgaccagaggcggcggcggcggcgacaccatcagcaagatgcccgacgtgaaggagagcgtgccccccaagtaccccggcgacagcgagggcagaagctgcaagcccgagaccagcggccccccccaggaggacaagagcggcagcgaggaccccccccccttcctgagcgtgaccggcctgaccgagaccgtgaacgaggtgagcaagctgagcaacaagatcggcatgaactgcgactactacatggaggagaaggtgctgccccccagcagcctggagggcaaggtgaaggagaccgtgcacaacgccttctgggaccacctgaaggagcagctgagcgccaccccccccgacttcagctgcgccctggagctgctgaaggagatcaaggagatcctgctgagcctgctgctgcccagacagaacagactgagaatcgagatcgaggaggccctggacatggacctgctgaagcaggaggccgagcacggcgccctgaaggtgctgtacctgagcaagtacgtgctgaacatgatggccctgctgtgcgcccccgtgagagacgaggccgtgcagaagctggagaacatcaccgaccccgtgtggctgctgagaggcatcttccaggtgctgggcagaatgaagatggacatggtgaactacaccatccagagcctgcagccccacctgcaggagcacagcatccagtacgagagagccaagttccaggagctgctgaacaagcagcccagcctgctgaaccacaccaccaagtggctgacccaggccgccggcgacctgaccatgagcccccccacctgccccgacaccagcgacagcagcagcgtggccggccccagccccaacgaggccgccaacaaccccgagcccctgagccccaccatggtgctgtgccagggcttcctgaacctgctgctgtgggacctggagaacgaggagttccccgagaccctgctgatggacagaaccagactgcaggagctgaagagccagctgcaccagctgaccgtgatggccagcgtgctgctggtggccagcagcttcagcggcagcgtgctgttcggcagcccccagttcgtggacaagctgaagagaatcaccaagagcctgctggaggacttccacagcagacccgaggaggccatcctgaccgtgagcgagcaggtgagccaggagatccaccagagcctgaagaacatgggcctggtggccctgagcagcgacaacaccgccagcctgatgggccagctgcagaacatcgccaagaaggagaactgcgtgtgcagcgtgatcgaccagagaatccacctgttcctgaagtgctgcctggtgctgggcgtgcagagaagcctgctggacctgcccggcggcctgaccctgatcgaggccgagctggccgagctgggccagaagttcgtgaacctgacccaccacaaccagcaggtgttcggcccctactacaccgagatcctgaagaccctgatcagccccgcccaggccctggagaccaaggtggagagcgtgtag

SEQ ID NO: 102040 - DNA, 822 bp, Artificial Sequence
  Description of Artificial Sequence: Synthetic coding sequence
ggcctgagccacagagccaccccccagcccgccgccccccccagatggtacgcccccggcagacaggccgccagacccaccgagagaacccccgtggacgaccccagaagaggcagaagaagcctggagggcaaggtgaaggagaccgtgcacaacgccttctgggaccacctgaaggagcagctgagcgccaccccccccgacttcagctgcgccctggagctgctgaaggagatcaaggagatcctgctgagcctgctgctgcccagacagaacagactgagaatcgagatcgaggaggccctggacatggacctgctgaagcaggaggccgagcacggcgccctgaaggtgctgtacctgagcaagtacgtgctgaacatgatggccctgctgtgcgcccccgtgagagacgaggccgtgcagaagctggagaacatcaccgaccccgtgtggctgctgagaggcatcttccaggtgctgggcagaatgaagatggacatggtgaactacaccatccagagcctgcagccccacctgcaggagcacagcatccagtacgagagagccaagttccaggagctgctgaacaagcagcccagcctgctgaaccacaccaccaagtggctgacccaggccgccggcgacctgaccatgagcccccccacctgccccgacaccagcgacagcagcagcgtggccggccccagccccaacgaggccgccaacaaccccgagcccctgagccccaccatggtgctgtgccagggcttcctgaacctgctgctgtgggacctggagaacgaggagttccccgagtag

SEQ ID NO: 102041 - DNA, 1326 bp, Artificial Sequence; identical to SEQ ID NO: 102038
  Description of Artificial Sequence: Synthetic coding sequence

SEQ ID NO: 102042 - DNA, 312 bp, Artificial Sequence
  Description of Artificial Sequence: Synthetic coding sequence
atggcccccaagggcatcctgggcagcttccccaccgccatgaacctgagcctggagggcaaggtgaaggagaccgtgcacaacgccttctgggaccacctgaaggagcagctgagcgccaccccccccgacttcagctgcgccctggagctgctgaaggagatcaaggagatcctgctgagcctgctgctgcccagacagaacagactgagaatcgagatcgaggaggccctggacatggacctgctgaagcaggaggccgagcacggcgccctgaaggtgctgtacctgagcaagtacgtgctgaactag

SEQ ID NO: 102043 - DNA, 1512 bp, Artificial Sequence
  Description of Artificial Sequence: Synthetic coding sequence
atgcccgacgtgaaggagagcgtgccccccaagtaccccggcgacagcgagggcagaagctgcaagcccgagaccagcggccccccccaggaggacaagagcggcagcgaggaccccccccccttcctgagcgtgaccggcctgaccgagaccgtgaacgaggtgagcaagctgagcaacaagatcggcatgaactgcgactactacatggaggagaaggtgctgccccccagcagcctggagggcaaggtgaaggagaccgtgcacaacgccttctgggaccacctgaaggagcagctgagcgccaccccccccgacttcagctgcgccctggagctgctgaaggagatcaaggagatcctgctgagcctgctgctgcccagacagaacagactgagaatcgagatcgaggaggccctggacatggacctgctgaagcaggaggccgagcacggcgccctgaaggtgctgtacctgagcaagtacgtgctgaacatgatggccctgctgtgcgcccccgtgagagacgaggccgtgcagaagctggagaacatcaccgaccccgtgtggctgctgagaggcatcttccaggtgctgggcagaatgaagatggacatggtgaactacaccatccagagcctgcagccccacctgcaggagcacagcatccagtacgagagagccaagttccaggagctgctgaacaagcagcccagcctgctgaaccacaccaccaagtggctgacccaggccgccggcgacctgaccatgagcccccccacctgccccgacaccagcgacagcagcagcgtggccggccccagccccaacgaggccgccaacaaccccgagcccctgagccccaccatggtgctgtgccagggcttcctgaacctgctgctgtgggacctggagaacgaggagttccccgagaccctgctgatggacagaaccagactgcaggagctgaagagccagctgcaccagctgaccgtgatggccagcgtgctgctggtggccagcagcttcagcggcagcgtgctgttcggcagcccccagttcgtggacaagctgaagagaatcaccaagagcctgctggaggacttccacagcagacccgaggaggccatcctgaccgtgagcgagcaggtgagccaggagatccaccagagcctgaagaacatgggcctggtggccctgagcagcgacaacaccgccagcctgatgggccagctgcagaacatcgccaagaaggagaactgcgtgtgcagcgtgatcgaccagagaatccacctgttcctgaagtgctgcctggtgctgggcgtgcagagaagcctgctggacctgcccggcggcctgaccctgatcgaggccgagctggccgagctgggccagaagttcgtgaacctgacccaccacaaccagcaggtgttcggcccctactacaccgagatcctgaagaccctgatcagccccgcccaggccctggagaccaaggtggagagcgtgtag

SEQ ID NO: 102044 - DNA, 1413 bp, Artificial Sequence
  Description of Artificial Sequence: Synthetic coding sequence
atgaccagaggcggcggcggcggcgtgctgagcgtgaccggcctgaccgagaccgtgaacgaggtgagcaagctgagcaacaagatcggcatgaactgcgactactacatggaggagaaggtgctgccccccagcagcctggagggcaaggtgaaggagaccgtgcacaacgccttctgggaccacctgaaggagcagctgagcgccaccccccccgacttcagctgcgccctggagctgctgaaggagatcaaggagatcctgctgagcctgctgctgcccagacagaacagactgagaatcgagatcgaggaggccctggacatggacctgctgaagcaggaggccgagcacggcgccctgaaggtgctgtacctgagcaagtacgtgctgaacatgatggccctgctgtgcgcccccgtgagagacgaggccgtgcagaagctggagaacatcaccgaccccgtgtggctgctgagaggcatcttccaggtgctgggcagaatgaagatggacatggtgaactacaccatccagagcctgcagccccacctgcaggagcacagcatccagtacgagagagccaagttccaggagctgctgaacaagcagcccagcctgctgaaccacaccaccaagtggctgacccaggccgccggcgacctgaccatgagcccccccacctgccccgacaccagcgacagcagcagcgtggccggccccagccccaacgaggccgccaacaaccccgagcccctgagccccaccatggtgctgtgccagggcttcctgaacctgctgctgtgggacctggagaacgaggagttccccgagaccctgctgatggacagaaccagactgcaggagctgaagagccagctgcaccagctgaccgtgatggccagcgtgctgctggtggccagcagcttcagcggcagcgtgctgttcggcagcccccagttcgtggacaagctgaagagaatcaccaagagcctgctggaggacttccacagcagacccgaggaggccatcctgaccgtgagcgagcaggtgagccaggagatccaccagagcctgaagaacatgggcctggtggccctgagcagcgacaacaccgccagcctgatgggccagctgcagaacatcgccaagaaggagaactgcgtgtgcagcgtgatcgaccagagaatccacctgttcctgaagtgctgcctggtgctgggcgtgcagagaagcctgctggacctgcccggcggcctgaccctgatcgaggccgagctggccgagctgggccagaagttcgtgaacctgacccaccacaaccagcaggtgttcggcccctactacaccgagatcctgaagaccctgatcagccccgcccaggccctggagaccaaggtggagagcgtgtag

SEQ ID NO: 102045 - DNA, 1398 bp, Artificial Sequence
  Description of Artificial Sequence: Synthetic coding sequence
atgaccagaggcggcggcggcggcggcctgaccgagaccgtgaacgaggtgagcaagctgagcaacaagatcggcatgaactgcgactactacatggaggagaaggtgctgccccccagcagcctggagggcaaggtgaaggagaccgtgcacaacgccttctgggaccacctgaaggagcagctgagcgccaccccccccgacttcagctgcgccctggagctgctgaaggagatcaaggagatcctgctgagcctgctgctgcccagacagaacagactgagaatcgagatcgaggaggccctggacatggacctgctgaagcaggaggccgagcacggcgccctgaaggtgctgtacctgagcaagtacgtgctgaacatgatggccctgctgtgcgcccccgtgagagacgaggccgtgcagaagctggagaacatcaccgaccccgtgtggctgctgagaggcatcttccaggtgctgggcagaatgaagatggacatggtgaactacaccatccagagcctgcagccccacctgcaggagcacagcatccagtacgagagagccaagttccaggagctgctgaacaagcagcccagcctgctgaaccacaccaccaagtggctgacccaggccgccggcgacctgaccatgagcccccccacctgccccgacaccagcgacagcagcagcgtggccggccccagccccaacgaggccgccaacaaccccgagcccctgagccccaccatggtgctgtgccagggcttcctgaacctgctgctgtgggacctggagaacgaggagttccccgagaccctgctgatggacagaaccagactgcaggagctgaagagccagctgcaccagctgaccgtgatggccagcgtgctgctggtggccagcagcttcagcggcagcgtgctgttcggcagcccccagttcgtggacaagctgaagagaatcaccaagagcctgctggaggacttccacagcagacccgaggaggccatcctgaccgtgagcgagcaggtgagccaggagatccaccagagcctgaagaacatgggcctggtggccctgagcagcgacaacaccgccagcctgatgggccagctgcagaacatcgccaagaaggagaactgcgtgtgcagcgtgatcgaccagagaatccacctgttcctgaagtgctgcctggtgctgggcgtgcagagaagcctgctggacctgcccggcggcctgaccctgatcgaggccgagctggccgagctgggccagaagttcgtgaacctgacccaccacaaccagcaggtgttcggcccctactacaccgagatcctgaagaccctgatcagccccgcccaggccctggagaccaaggtggagagcgtgtag

SEQ ID NO: 102046 - DNA, 165 bp, Artificial Sequence
  Description of Artificial Sequence: Synthetic coding sequence
atgaccagaggcggcggcggcggcgacaccatcagcaagatgcccgacgtgaaggagagcgtgccccccaagtaccccggcgacagcgagggcagaagctgcaagcccgagaccagcggccccccccaggaggacaagagcggcagcgaggacccccccccctag

SEQ ID NO: 102047 - DNA, 165 bp, Artificial Sequence; identical to SEQ ID NO: 102046
  Description of Artificial Sequence: Synthetic coding sequence

SEQ ID NO: 102048 - DNA, 597 bp, Artificial Sequence
  Description of Artificial Sequence: Synthetic coding sequence
atgttcttcgagagacacctggagaacctgctgaagcacttcatccccggcaccaccgaccccgccgtgatcctggacctgctgcccctgtgcagaaactacgtgagaagagtgcacgtggaccagttcctgccccccgtgcagctgcccgcccagctgagacccggcgaccagagcgacagcggcagcgagggcgagatggaggagcccaccgtggaccactaccagctgggcgacctggtggccggcctgagccacctggaggagctggacctggtgtacgacgtgaaggactgcggcatgaacttcgagtggaacctgttcctgttcacctacagagactgcctgagcctggccgccgccatcaaggcctgccacaccctgaaggacggcggcaagcagctgctggagggcatgagcgacaacaagaccctgctggagttcgacctgagactgagcgacgtggcccaggagagcgagtacctgatcggccaggccctgtacgccaacagagaggccgccagacagagagccctgaaccccagccacttcatgagcaccatcaccgccaacggccccgagaacagcgtgggctag

SEQ ID NO: 102049 - DNA, 597 bp, Artificial Sequence; identical to SEQ ID NO: 102048
  Description of Artificial Sequence: Synthetic coding sequence

SEQ ID NO: 102050 - DNA, 1506 bp, Artificial Sequence
  Description of Artificial Sequence: Synthetic coding sequence
atgcaggacaccgtgaccaccagcgccctgctggaccccagccacagcagcgtgagcacccaggacaacagcagcaccggcggccacaccagcagcaccagcccccagctgagcaagcccagcatcacccccgtgcccgccaagagcagaaacccccaccccagagccaacatcagaagaatgagaagaatcatcgccgaggaccccgagtggagcctggccatcgtgcccctgctgaccgagctgtgcatccagcacatcatcagaaacttccagaagaaccccatcctgaagcagatgctgcccgagcaccagcagaaggtgctgaaccacctgagccccgacctgcccctggccgtgaccgccaacctgatcgacagcgagaactactggctgagatgctgcatgcacagatggcccgtgtgccacgtggcccaccacggcggcagctggaagagaatgttcttcgagagacacctggagaacctgctgaagcacttcatccccggcaccaccgaccccgccgtgatcctggacctgctgcccctgtgcagaaactacgtgagaagagtgcacgtggaccagttcctgccccccgtgcagctgcccgcccagctgagacccggcgaccagagcgacagcggcagcgagggcgagatggaggagcccaccgtggaccactaccagctgggcgacctggtggccggcctgagccacctggaggagctggacctggtgtacgacgtgaaggactgcggcatgaacttcgagtggaacctgttcctgttcacctacagagactgcctgagcctggccgccgccatcaaggcctgccacaccctgaagatcttcaagctgaccagaagcaaggtggacgacgacaaggccagaatcatcatcagaagcctgctggaccaccccgtgctggaggagctggacctgagccagaacctgatcggcgacagaggcgccagaggcgccgccaagctgctgagccacagcagactgagagtgctgaacctggccaacaaccaggtgagagcccccggcgcccagagcctggcccacgccctggcccacaacaccaacctgatcagcctgaacctgagactgaactgcatcgaggacgagggcggccaggccctggcccacgccctgcagaccaacaagtgcctgaccaccctgcacctgggcggcaacgagctgagcgagcccaccgccaccctgctgagccaggtgctggccatcaacaccaccctgaccagcatcaacctgagctgcaaccacatcggcctggacggcggcaagcagctgctggagggcatgagcgacaacaagaccctgctggagttcgacctgagactgagcgacgtggcccaggagagcgagtacctgatcggccaggccctgtacgccaacagagaggccgccagacagagagccctgaaccccagccacttcatgagcaccatcaccgccaacggccccgagaacagcgtgggctag

SEQ ID NO: 102051 - DNA, 597 bp, Artificial Sequence
  Description of Artificial Sequence: Synthetic coding sequence
atggagaagagaggcagaggcgtgaagagcagccccatccagacccccaaccagaccccccagcaggcccccgtgacccccagaaaggagagaagacccagcatgttcgagaaggaggcctacacccagatcctgagagagagactgagagagagcatccacaacgtgcagtacgtggagccccccttcgacgacagcatcgccgacatcggcaaggagtggaagagcgccctggccaagctgaagttcgccaacagctacagaatggagcccctgaagaagttccaggcccacagcgtggagaccaaggtgcagcagatcctgaccgagagcctgaaggacgtgaagtacgacgacaaggtgttcagccacctgagcctggagctggccgacagaatcctgctggccgtgaaggagttcggctaccacagatacaagttcatcatcaaggtgctgttcatccagaagaccggccaggccatcaacatcgccagcagatggatctgggacatcgcctgggacagctgggtggccgccaagcacgaggccgagagctacgtggccctggtgctggtgttcgccctgtactacgagtag

SEQ ID NO: 102052 - DNA, 666 bp, Artificial Sequence
  Description of Artificial Sequence: Synthetic coding sequence
atggccagcagacccctgccccccggcagacaggaggaggagaacgccaaggacagcggcagaaagcccagccccgtgagacccagaggctgcctgcccagcatcgacgaggccagacccgccggccccggccccgcccccgccagcagaagaggcagcatgctgggcctggccgccagcttcagcagaagaaacagcctggtgggccccggcgccggccccggcggccagagacccagcctgggccccgtgccccccctgggcagcagagtgagcttcagcggcctgcccctggcccccgccagatgggtggcccccagctacagaaccgagcccgtgcccggcgagagatgggaggccgccagagcccagagagccctggaggccgccctggccgccggcctgcacgacgcctgctacagcagcgacgaggccgccagactggtgagagagctgtgcgagcaggtgcacgtgagactgagagagctgagcccccccagatacaagctggtgtgcagcgtggtgctgggccccagagccggccagggcgtgcacgtggtgagcagagccctgtgggacgtggccagagacggcctggccagcgtgagctacaccaacaccagcctgttcgccgtggccaccgtgcacggcctgtactgcgagtag

SEQ ID NO: 102053 - DNA, 666 bp, Artificial Sequence; identical to SEQ ID NO: 102052
  Description of Artificial Sequence: Synthetic coding sequence

SEQ ID NO: 102054 - DNA, 1074 bp, Artificial Sequence
  Description of Artificial Sequence: Synthetic coding sequence
atggagagaatgagcgacagcgccgacaagcccatcgacaacgacgccgagggcgtgtggagccccgacatcgagcagagcttccaggaggccctggccatctaccccccctgcggcagaagaaagatcatcctgagcgacgagggcaagatgtacggcagaaacgagctgatcgccagatacatcaagctgagaaccggcaagaccagaaccagaaagcaggtgagcagccacatccaggtgctggccagaagaaagagcagagacttccacagcaagctgaaggtgaccagcatggaccagaccgccaaggacaaggccctgcagcacatggccgccatgagcagcgcccagatcgtgagcgccaccgccatccacaacaagctgggcctgcccggcatccccagacccaccttccccggcgcccccggcttctggcccggcatgatccagaccggccagcccggcagcagccaggacgtgaagcccttcgtgcagcaggcctaccccatccagcccgccgtgaccgcccccatccccggcttcgagcccgccagcgcccccgcccccagcgtgcccgcctggcagggcagaagcatcggcaccaccaagctgagactggtggagttcagcgccttcctggagcagcagagagaccccgacagcgccgacctgaactgcaacatccaggacgacgccggcgccttctacggcgtgaccagccagtacgagagcagcgagaacatgaccgtgacctgcagcaccaaggtgtgcagcttcggcaagcaggtggtggagaaggtggagaccgagtacgccagattcgagaacggcagattcgtgtacagaatcaacagaagccccatgtgcgagtacatgatcaacttcatccacaagctgaagcacctgcccgagaagtacatgatgaacagcgtgctggagaacttcaccatcctgctggtggtgaccaacagagacacccaggagaccctgctgtgcatggcctgcgtgttcgaggtgagcaacagcgagcacggcgcccagcaccacatctacagactggtgaaggactag

SEQ ID NO: 102055 - DNA, 1236 bp, Artificial Sequence
  Description of Artificial Sequence: Synthetic coding sequence
atggagagaatgagcgacagcgccgacaagcccatcgacaacgacgccgagggcgtgtggagccccgacatcgagcagagcttccaggaggccctggccatctaccccccctgcggcagaagaaagatcatcctgagcgacgagggcaagatgtacggcagaaacgagctgatcgccagatacatcaagctgagaaccggcaagaccagaaccagaaagcaggtgagcagccacatccaggtgctggccagaagaaagagcagagacttccacagcaagctgaaggaccagaccgccaaggacaaggccctgcagcacatggccgccatgagcagcgcccagatcgtgagcgccaccgccatccacaacaagctgggcctgcccggcatccccagacccaccttccccggcgcccccggcttctggcccggcatgatccagaccggccagcccggcagcagccaggacgtgaagcccttcgtgcagcaggcctaccccatccagcccgccgtgaccgcccccatccccggcttcgagcccgccagcgcccccgcccccagcgtgcccgcctggcagggcagaagcatcggcaccaccaagctgagactggtggagttcagcgccttcctggagcagcagagagaccccgacagctacaacaagcacctgttcgtgcacatcggccacgccaaccacagctacagcgaccccctgctggagagcgtggacatcagacagatctacgacaagttccccgagaagaagggcggcctgaaggagctgttcggcaagggcccccagaacgccttcttcctggtgaagttctgggccgacctgaactgcaacatccaggacgacgccggcgccttctacggcgtgaccagccagtacgagagcagcgagaacatgaccgtgacctgcagcaccaaggtgtgcagcttcggcaagcaggtggtggagaaggtggagaccgagtacgccagattcgagaacggcagattcgtgtacagaatcaacagaagccccatgtgcgagtacatgatcaacttcatccacaagctgaagcacctgcccgagaagtacatgatgaacagcgtgctggagaacttcaccatcctgctggtggtgaccaacagagacacccaggagaccctgctgtgcatggcctgcgtgttcgaggtgagcaacagcgagcacggcgcccagcaccacatctacagactggtgaaggactag

SEQ ID NO: 102056 - DNA, 1281 bp, Artificial Sequence
  Description of Artificial Sequence: Synthetic coding sequence
atcgagcccagcagctggagcggcagcgagagccccgccgagaacatggagagaatgagcgacagcgccgacaagcccatcgacaacgacgccgagggcgtgtggagccccgacatcgagcagagcttccaggaggccctggccatctaccccccctgcggcagaagaaagatcatcctgagcgacgagggcaagatgtacggcagaaacgagctgatcgccagatacatcaagctgagaaccggcaagaccagaaccagaaagcaggtgagcagccacatccaggtgctggccagaagaaagagcagagacttccacagcaagctgaaggaccagaccgccaaggacaaggccctgcagcacatggccgccatgagcagcgcccagatcgtgagcgccaccgccatccacaacaagctgggcctgcccggcatccccagacccaccttccccggcgcccccggcttctggcccggcatgatccagaccggccagcccggcagcagccaggacgtgaagcccttcgtgcagcaggcctaccccatccagcccgccgtgaccgcccccatccccggcttcgagcccgccagcgcccccgcccccagcgtgcccgcctggcagggcagaagcatcggcaccaccaagctgagactggtggagttcagcgccttcctggagcagcagagagaccccgacagctacaacaagcacctgttcgtgcacatcggccacgccaaccacagctacagcgaccccctgctggagagcgtggacatcagacagatctacgacaagttccccgagaagaagggcggcctgaaggagctgttcggcaagggcccccagaacgccttcttcctggtgaagttctgggccgacctgaactgcaacatccaggacgacgccggcgccttctacggcgtgaccagccagtacgagagcagcgagaacatgaccgtgacctgcagcaccaaggtgtgcagcttcggcaagcaggtggtggagaaggtggagaccgagtacgccagattcgagaacggcagattcgtgtacagaatcaacagaagccccatgtgcgagtacatgatcaacttcatccacaagctgaagcacctgcccgagaagtacatgatgaacagcgtgctggagaacttcaccatcctgctggtggtgaccaacagagacacccaggagaccctgctgtgcatggcctgcgtgttcgaggtgagcaacagcgagcacggcgcccagcaccacatctacagactggtgaaggactag

SEQ ID NO: 102057 - DNA, 993 bp, Artificial Sequence
  Description of Artificial Sequence: Synthetic coding sequence
atgagatacgtgctgagctggtgcgtgaccgtgaccttcaaggaccagaccgccaaggacaaggccctgcagcacatggccgccatgagcagcgcccagatcgtgagcgccaccgccatccacaacaagctgggcctgcccggcatccccagacccaccttccccggcgcccccggcttctggcccggcatgatccagaccggccagcccggcagcagccaggacgtgaagcccttcgtgcagcaggcctaccccatccagcccgccgtgaccgcccccatccccggcttcgagcccgccagcgcccccgcccccagcgtgcccgcctggcagggcagaagcatcggcaccaccaagctgagactggtggagttcagcgccttcctggagcagcagagagaccccgacagctacaacaagcacctgttcgtgcacatcggccacgccaaccacagctacagcgaccccctgctggagagcgtggacatcagacagatctacgacaagttccccgagaagaagggcggcctgaaggagctgttcggcaagggcccccagaacgccttcttcctggtgaagttctgggccgacctgaactgcaacatccaggacgacgccggcgccttctacggcgtgaccagccagtacgagagcagcgagaacatgaccgtgacctgcagcaccaaggtgtgcagcttcggcaagcaggtggtggagaaggtggagaccgagtacgccagattcgagaacggcagattcgtgtacagaatcaacagaagccccatgtgcgagtacatgatcaacttcatccacaagctgaagcacctgcccgagaagtacatgatgaacagcgtgctggagaacttcaccatcctgctggtggtgaccaacagagacacccaggagaccctgctgtgcatggcctgcgtgttcgaggtgagcaacagcgagcacggcgcccagcaccacatctacagactggtgaaggactag

SEQ ID NO: 102058 - DNA, 207 bp, Artificial Sequence
  Description of Artificial Sequence: Synthetic coding sequence
atcgagcccagcagctggagcggcagcgagagccccgccgagaacatggagagaatgagcgacagcgccgacaagcccatcgacaacgacgccgagggcgtgtggagccccgacatcgagcagagcttccaggaggccctggccatctaccccccctgcggcagaagaaagatcatcctgagcgacgagggcaagatgtacggctag

SEQ ID NO: 102059 - DNA, 1281 bp, Artificial Sequence; identical to SEQ ID NO: 102056
  Description of Artificial Sequence: Synthetic coding sequence

SEQ ID NO: 102060 - DNA, 1344 bp, Artificial Sequence
  Description of Artificial Sequence: Synthetic coding sequence
atgggcgagcccagagccggcgccgccctggacgacggcagcggctggaccggcagcgaggagggcagcgaggagggcaccggcggcagcgagggcgccggcggcgacggcggccccgacgccgagggcgtgtggagccccgacatcgagcagagcttccaggaggccctggccatctaccccccctgcggcagaagaaagatcatcctgagcgacgagggcaagatgtacggcagaaacgagctgatcgccagatacatcaagctgagaaccggcaagaccagaaccagaaagcaggtgagcagccacatccaggtgctggccagaagaaagagcagagagatccagagcaagctgaaggaccaggtgagcaaggacaaggccttccagaccatggccaccatgagcagcgcccagctgatcagcgcccccagcctgcaggccaagctgggccccaccggcccccaggccagcgagctgttccagttctggagcggcggcagcggccccccctggaacgtgcccgacgtgaagcccttcagccagacccccttcaccctgagcctgaccccccccagcaccgacctgcccggctacgagcccccccaggccctgagccccctgcccccccccacccccagcccccccgcctggcaggccagaggcctgggcaccgccagactgcagctggtggagttcagcgccttcgtggagccccccgacgccgtggacagctaccagagacacctgttcgtgcacatcagccagcactgccccagccccggcgccccccccctggagagcgtggacgtgagacagatctacgacaagttccccgagaagaagggcggcctgagagagctgtacgacagaggccccccccacgccttcttcctggtgaagttctgggccgacctgaactggggccccagcggcgaggaggccggcgccggcggcagcatcagcagcggcggcttctacggcgtgagcagccagtacgagagcctggagcacatgaccctgacctgcagcagcaaggtgtgcagcttcggcaagcaggtggtggagaaggtggagaccgagagagcccagctggaggacggcagattcgtgtacagactgctgagaagccccatgtgcgagtacctggtgaacttcctgcacaagctgagacagctgcccgagagatacatgatgaacagcgtgctggagaacttcaccatcctgcaggtggtgaccaacagagacacccaggagctgctgctgtgcaccgcctacgtgttcgaggtgagcaccagcgagagaggcgcccagcaccacatctacagactggtgagagactag

SEQ ID NO: 102061 - DNA, 1353 bp, Artificial Sequence
  Description of Artificial Sequence: Synthetic coding sequence
atgggcgagcccagagccggcgccgccctggacgacggcagcggctggaccggcagcgaggagggcagcgaggagggcaccggcggcagcgagggcgccggcggcgacggcggccccgacgccgagggcgtgtggagccccgacatcgagcagagcttccaggaggccctggccatctaccccccctgcggcagaagaaagatcatcctgagcgacgagggcaagatgtacggcagaaacgagctgatcgccagatacatcaagctgagaaccggcaagaccagaaccagaaagcaggtgagcagccacatccaggtgctggccagaagaaagagcagagagatccagagcaagctgaaggaccaggtgagcaaggacaaggccttccagaccatggccaccatgagcagcgcccagctgatcagcgcccccagcctgcaggccaagctgggccccaccggcccccaggtggtgcaggccagcgagctgttccagttctggagcggcggcagcggccccccctggaacgtgcccgacgtgaagcccttcagccagacccccttcaccctgagcctgaccccccccagcaccgacctgcccggctacgagcccccccaggccctgagccccctgcccccccccacccccagcccccccgcctggcaggccagaggcctgggcaccgccagactgcagctggtggagttcagcgccttcgtggagccccccgacgccgtggacagctaccagagacacctgttcgtgcacatcagccagcactgccccagccccggcgccccccccctggagagcgtggacgtgagacagatctacgacaagttccccgagaagaagggcggcctgagagagctgtacgacagaggccccccccacgccttcttcctggtgaagttctgggccgacctgaactggggccccagcggcgaggaggccggcgccggcggcagcatcagcagcggcggcttctacggcgtgagcagccagtacgagagcctggagcacatgaccctgacctgcagcagcaaggtgtgcagcttcggcaagcaggtggtggagaaggtggagaccgagagagcccagctggaggacggcagattcgtgtacagactgctgagaagccccatgtgcgagtacctggtgaacttcctgcacaagctgagacagctgcccgagagatacatgatgaacagcgtgctggagaacttcaccatcctgcaggtggtgaccaacagagacacccaggagctgctgctgtgcaccgcctacgtgttcgaggtgagcaccagcgagagaggcgcccagcaccacatctacagactggtgagagactag

SEQ ID NO: 102062 - DNA, 960 bp, Artificial Sequence
  Description of Artificial Sequence: Synthetic coding sequence
atggccaccatgagcagcgcccagctgatcagcgcccccagcctgcaggccaagctgggccccaccggcccccaggtggtgcaggccagcgagctgttccagttctggagcggcggcagcggccccccctggaacgtgcccgacgtgaagcccttcagccagacccccttcaccctgagcctgaccccccccagcaccgacctgcccggctacgagcccccccaggccctgagccccctgcccccccccacccccagcccccccgcctggcaggccagaggcctgggcaccgccagactgcagctggtggagttcagcgccttcgtggagccccccgacgccgtggacagctaccagagacacctgttcgtgcacatcagccagcactgccccagccccggcgccccccccctggagagcgtggacgtgagacagatctacgacaagttccccgagaagaagggcggcctgagagagctgtacgacagaggccccccccacgccttcttcctggtgaagttctgggccgacctgaactggggccccagcggcgaggaggccggcgccggcggcagcatcagcagcggcggcttctacggcgtgagcagccagtacgagagcctggagcacatgaccctgacctgcagcagcaaggtgtgcagcttcggcaagcaggtggtggagaaggtggagaccgagagagcccagctggaggacggcagattcgtgtacagactgctgagaagccccatgtgcgagtacctggtgaacttcctgcacaagctgagacagctgcccgagagatacatgatgaacagcgtgctggagaacttcaccatcctgcaggtggtgaccaacagagacacccaggagctgctgctgtgcaccgcctacgtgttcgaggtgagcaccagcgagagaggcgcccagcaccacatctacagactggtgagagactag

SEQ ID NO: 102063 - DNA, 1356 bp, Artificial Sequence
  Description of Artificial Sequence: Synthetic coding sequence
atgggcgagcccagagccggcgccgccctggacgacggcagcggctggaccggcagcgaggagggcagcgaggagggcaccggcggcagcgagggcgccggcggcgacggcggccccgacgccgagggcgtgtggagccccgacatcgagcagagcttccaggaggccctggccatctaccccccctgcggcagaagaaagatcatcctgagcgacgagggcaagatgtacggcagaaacgagctgatcgccagatacatcaagctgagaaccggcaagaccagaaccagaaagcaggtgagcagccacatccaggtgctggccagaagaaagagcagagagatccagagcaagctgaaggccctgaacgtggaccaggtgagcaaggacaaggccttccagaccatggccaccatgagcagcgcccagctgatcagcgcccccagcctgcaggccaagctgggccccaccggcccccaggccagcgagctgttccagttctggagcggcggcagcggccccccctggaacgtgcccgacgtgaagcccttcagccagacccccttcaccctgagcctgaccccccccagcaccgacctgcccggctacgagcccccccaggccctgagccccctgcccccccccacccccagcccccccgcctggcaggccagaggcctgggcaccgccagactgcagctggtggagttcagcgccttcgtggagccccccgacgccgtggacagctaccagagacacctgttcgtgcacatcagccagcactgccccagccccggcgccccccccctggagagcgtggacgtgagacagatctacgacaagttccccgagaagaagggcggcctgagagagctgtacgacagaggccccccccacgccttcttcctggtgaagttctgggccgacctgaactggggccccagcggcgaggaggccggcgccggcggcagcatcagcagcggcggcttctacggcgtgagcagccagtacgagagcctggagcacatgaccctgacctgcagcagcaaggtgtgcagcttcggcaagcaggtggtggagaaggtggagaccgagagagcccagctggaggacggcagattcgtgtacagactgctgagaagccccatgtgcgagtacctggtgaacttcctgcacaagctgagacagctgcccgagagatacatgatgaacagcgtgctggagaacttcaccatcctgcaggtggtgaccaacagagacacccaggagctgctgctgtgcaccgcctacgtgttcgaggtgagcaccagcgagagaggcgcccagcaccacatctacagactggtgagagactag

SEQ ID NO: 102064 - DNA, 1356 bp, Artificial Sequence; identical to SEQ ID NO: 102063
  Description of Artificial Sequence: Synthetic coding sequence

SEQ ID NO: 102065 - DNA, 1353 bp, Artificial Sequence; identical to SEQ ID NO: 102061
  Description of Artificial Sequence: Synthetic coding sequence

SEQ ID NO: 102066 - DNA, 1308 bp, Artificial Sequence
  Description of Artificial Sequence: Synthetic coding sequence
atcgccagcaacagctggaacgccagcagcagccccggcgaggccagagaggacggccccgagggcctggacaagggcctggacaacgacgccgagggcgtgtggagccccgacatcgagcagagcttccaggaggccctggccatctaccccccctgcggcagaagaaagatcatcctgagcgacgagggcaagatgtacggcagaaacgagctgatcgccagatacatcaagctgagaaccggcaagaccagaaccagaaagcaggtgagcagccacatccaggtgctggccagaaagaaggtgagagagtaccaggtgggcatcaaggccatgaacctggaccaggtgagcaaggacaaggccctgcagagcatggccagcatgagcagcgcccagatcgtgagcgccagcgtgctgcagaacaagttcagcccccccagccccctgccccaggccgtgttcagcaccagcagcagattctggagcagcccccccctgctgggccagcagcccggccccagccaggacatcaagcccttcgcccagcccgcctaccccatccagccccccctgccccccaccctgagcagctacgagcccctggcccccctgcccagcgccgccgccagcgtgcccgtgtggcaggacagaaccatcgccagcagcagactgagactgctggagtacagcgccttcatggaggtgcagagagaccccgacacctacagcaagcacctgttcgtgcacatcggccagaccaaccccgccttcagcgacccccccctggaggccgtggacgtgagacagatctacgacaagttccccgagaagaagggcggcctgaaggagctgtacgagaagggcccccccaacgccttcttcctggtgaagttctgggccgacctgaacagcaccatccaggagggccccggcgccttctacggcgtgagcagccagtacagcagcgccgacagcatgaccatcagcgtgagcaccaaggtgtgcagcttcggcaagcaggtggtggagaaggtggagaccgagtacgccagactggagaacggcagattcgtgtacagaatccacagaagccccatgtgcgagtacatgatcaacttcatccacaagctgaagcacctgcccgagaagtacatgatgaacagcgtgctggagaacttcaccatcctgcaggtggtgaccagcagagacagccaggagaccctgctggtgatcgccttcgtgttcgaggtgagcaccagcgagcacggcgcccagcaccacgtgtacaagctggtgaaggactag

SEQ ID NO: 102067 - DNA, 1356 bp, Artificial Sequence
  Description of Artificial Sequence: Synthetic coding sequence
ctgagcagacccgtgggcagcggccccgagcccagagccaccagcaccatcgccagcaacagctggaacgccagcagcagccccggcgaggccagagaggacggccccgagggcctggacaagggcctggacaacgacgccgagggcgtgtggagccccgacatcgagcagagcttccaggaggccctggccatctaccccccctgcggcagaagaaagatcatcctgagcgacgagggcaagatgtacggcagaaacgagctgatcgccagatacatcaagctgagaaccggcaagaccagaaccagaaagcaggtgagcagccacctgcaggtgctggccagaagaaagagcagagagatccagagcaagctgaagagcagcccccaggaccaggtgagcaaggacaaggccctgcagagcatggccagcatgagcagcgcccagatcgtgagcgccagcgtgctgcagaacaagttcagcccccccagccccctgccccaggccgtgttcagcaccagcagcagattctggagcagcccccccctgctgggccagcagcccggccccagccaggacatcaagcccttcgcccagcccgcctaccccatccagccccccctgccccccaccctgagcagctacgagcccctggcccccctgcccagcgccgccgccagcgtgcccgtgtggcaggacagaaccatcgccagcagcagactgagactgctggagtacagcgccttcatggaggtgcagagagaccccgacacctacagcaagcacctgttcgtgcacatcggccagaccaaccccgccttcagcgacccccccctggaggccgtggacgtgagacagatctacgacaagttccccgagaagaagggcggcctgaaggagctgtacgagaagggcccccccaacgccttcttcctggtgaagttctgggccgacctgaacagcaccatccaggagggccccggcgccttctacggcgtgagcagccagtacagcagcgccgacagcatgaccatcagcgtgagcaccaaggtgtgcagcttcggcaagcaggtggtggagaaggtggagaccgagtacgccagactggagaacggcagattcgtgtacagaatccacagaagccccatgtgcgagtacatgatcaacttcatccacaagctgaagcacctgcccgagaagtacatgatgaacagcgtgctggagaacttcaccatcctgcaggtggtgaccagcagagacagccaggagaccctgctggtgatcgccttcgtgttcgaggtgagcaccagcgagcacggcgcccagcaccacgtgtacaagctggtgaaggactag

SEQ ID NO: 102068 - DNA, 1176 bp, Artificial Sequence
  Description of Artificial Sequence: Synthetic coding sequence
ctggagggcaccgccggcaccatcaccagcaacgagtggagcagccccaccagccccgagggcagcaccgccagcggcggcagccaggccctggacaagcccatcgacaacgacgccgagggcgtgtggagccccgacatcgagcagagcttccaggaggccctggccatctaccccccctgcggcagaagaaagatcatcctgagcgacgagggcaagatgtacggcagaaacgagctgatcgccagatacatcaagctgagaaccggcaagaccagaaccagaaagcaggtgagcagccacatccaggtgctggccagaagaaaggccagagagatccaggccaagctgaagttctggcagggcgccctgcccggccaggccggcaccagccacgacgtgaagcccttcagccagcagacctacgccgtgcagccccccctgcccctgcccggcttcgagagccccgccggccccgcccccagccccagcgccccccccgcccccccctggcagggcagaagcgtggccagcagcaagctgtggatgctggagttcagcgccttcctggagcagcagcaggaccccgacacctacaacaagcacctgttcgtgcacatcggccagagcagccccagctacagcgacccctacctggaggccgtggacatcagacagatctacgacaagttccccgagaagaagggcggcctgaaggacctgttcgagagaggccccagcaacgccttcttcctggtgaagttctgggccgacctgaacaccaacatcgaggacgagggcagcagcttctacggcgtgagcagccagtacgagagccccgagaacatgatcatcacctgcagcaccaaggtgtgcagcttcggcaagcaggtggtggagaaggtggagaccgagtacgccagatacgagaacggccactacagctacagaatccacagaagccccctgtgcgagtacatgatcaacttcatccacaagctgaagcacctgcccgagaagtacatgatgaacagcgtgctggagaacttcaccatcctgcaggtggtgaccaacagagacacccaggagaccctgctgtgcatcgcctacgtgttcgaggtgagcgccagcgagcacggcgcccagcaccacatctacagactggtgaaggagtag

SEQ ID NO: 102069 - DNA, 1305 bp, Artificial Sequence
  Description of Artificial Sequence: Synthetic coding sequence
ctggagggcaccgccggcaccatcaccagcaacgagtggagcagccccaccagccccgagggcagcaccgccagcggcggcagccaggccctggacaagcccatcgacaacgacgccgagggcgtgtggagccccgacatcgagcagagcttccaggaggccctggccatctaccccccctgcggcagaagaaagatcatcctgagcgacgagggcaagatgtacggcagaaacgagctgatcgccagatacatcaagctgagaaccggcaagaccagaaccagaaagcaggtgagcagccacatccaggtgctggccagaagaaaggccagagagatccaggccaagctgaaggaccaggccgccaaggacaaggccctgcagagcatggccgccatgagcagcgcccagatcatcagcgccaccgccttccacagcagcatggccctggccagaggccccggcagacccgccgtgagcggcttctggcagggcgccctgcccggccaggccggcaccagccacgacgtgaagcccttcagccagcagacctacgccgtgcagccccccctgcccctgcccggcttcgagagccccgccggccccgcccccagccccagcgccccccccgcccccccctggcagggcagaagcgtggccagcagcaagctgtggatgctggagttcagcgccttcctggagcagcagcaggaccccgacacctacaacaagcacctgttcgtgcacatcggccagagcagccccagctacagcgacccctacctggaggccgtggacatcagacagatctacgacaagttccccgagaagaagggcggcctgaaggacctgttcgagagaggccccagcaacgccttcttcctggtgaagttctgggccgacctgaacaccaacatcgaggacgagggcagcagcttctacggcgtgagcagccagtacgagagccccgagaacatgatcatcacctgcagcaccaaggtgtgcagcttcggcaagcaggtggtggagaaggtggagaccgagtacgccagatacgagaacggccactacagctacagaatccacagaagccccctgtgcgagtacatgatcaacttcatccacaagctgaagcacctgcccgagaagtacatgatgaacagcgtgctggagaacttcaccatcctgcaggtggtgaccaacagagacacccaggagaccctgctgtgcatcgcctacgtgttcgaggtgagcgccagcgagcacggcgcccagcaccacatctacagactggtgaaggagtag

SEQ ID NO: 102070 - DNA, 918 bp, Artificial Sequence
  Description of Artificial Sequence: Synthetic coding sequence
atggccgccatgagcagcgcccagatcatcagcgccaccgccttccacagcagcatggccctggccagaggccccggcagacccgccgtgagcggcttctggcagggcgccctgcccggccaggccggcaccagccacgacgtgaagcccttcagccagcagacctacgccgtgcagccccccctgcccctgcccggcttcgagagccccgccggccccgcccccagccccagcgccccccccgcccccccctggcagggcagaagcgtggccagcagcaagctgtggatgctggagttcagcgccttcctggagcagcagcaggaccccgacacctacaacaagcacctgttcgtgcacatcggccagagcagccccagctacagcgacccctacctggaggccgtggacatcagacagatctacgacaagttccccgagaagaagggcggcctgaaggacctgttcgagagaggccccagcaacgccttcttcctggtgaagttctgggccgacctgaacaccaacatcgaggacgagggcagcagcttctacggcgtgagcagccagtacgagagccccgagaacatgatcatcacctgcagcaccaaggtgtgcagcttcggcaagcaggtggtggagaaggtggagaccgagtacgccagatacgagaacggccactacagctacagaatccacagaagccccctgtgcgagtacatgatcaacttcatccacaagctgaagcacctgcccgagaagtacatgatgaacagcgtgctggagaacttcaccatcctgcaggtggtgaccaacagagacacccaggagaccctgctgtgcatcgcctacgtgttcgaggtgagcgccagcgagcacggcgcccagcaccacatctacagactggtgaaggagtag

SEQ ID NO: 102071 - DNA, 219 bp, Artificial Sequence
  Description of Artificial Sequence: Synthetic coding sequence
ctggagggcaccgccggcaccatcaccagcaacgagtggagcagccccaccagccccgagggcagcaccgccagcggcggcagccaggccctggacaagcccatcgacaacgacgccgagggcgtgtggagccccgacatcgagcagagcttccaggaggccctggccatctaccccccctgcggcagaagaaagatcatcctgagcgacgagggctag

SEQ ID NO: 102072 - DNA, 69 bp, Artificial Sequence
  Description of Artificial Sequence: Synthetic coding sequence
ctggagggcaccgccggcaccatcaccagcaacgagtggagcagccccaccagccccgagggcagctag

SEQ ID NO: 102073 - DNA, 528 bp, Artificial Sequence
  Description of Artificial Sequence: Synthetic coding sequence
ctggagggcaccgccggcaccatcaccagcaacgagtggagcagccccaccagccccgagggcagcaccgccagcggcggcagccaggccctggacaagcccatcgacaacgacgccgagggcgtgtggagccccgacatcgagcagagcttccaggaggccctggccatctaccccccctgcggcagaagaaagatcatcctgagcgacgagggcaagatgtacggcagaaacgagctgatcgccagatacatcaagctgagaaccggcaagaccagaaccagaaagcaggtgagcagccacatccaggtgctggccagaagaaaggccagagagatccaggccaagctgaaggaccaggccgccaaggacaaggccctgcagagcatggccgccatgagcagcgcccagatcatcagcgccaccgccttccacagcagcatggccctggccagaggccccggcagacccgccgtgagcggcttctggcagggcgccctgcccggccaggccggcaccagccactag

SEQ ID NO: 102074 - DNA, 3099 bp, Artificial Sequence
  Description of Artificial Sequence: Synthetic coding sequence
atgtgcaacgaggagaccgagatcaaggaggcccagagctaccagaacagccccgtgagcagcgccaccaaccaggacgccggctacggcagccccttcagcgagagcagcgaccagctggcccacttcaagggcagcagcagcagagaggagaaggaggacccccagtgccccgacagcgtgagctacccccaggacagcctggcccagatcaaggccgtgtacgccaacctgttcagcgagagctgctggagcagcctggccctggacctgaagaagagcggcagcaccaccagcaccaacgacgccagccagaaggagagcagcgcccccacccccaccccccccacctgccccgtgagcaccaccggccccaccaccagcacccccagcaccagctgcagcagcagcaccagccacagcagcaccaccagcaccagcagcagcagcggctacgactggcaccaggccgccctggccaagaccctgcagcagaccagcagctacggcctgctgcccgagcccagcctgttcagcaccgtgcagctgtacagacagaacaacaagctgtacggcagcgtgttcaccggcgccagcaagttcagatgcaaggactgcagcgccgcctacgacaccctggtggagctgaccgtgcacatgaacgagaccggccactacagagacgacaacagagacaaggacagcgagaagaccaagagatggagcaagcccagaaagagaagcctgatggagatggagggcaaggaggacgcccagaaggtgctgaagtgcatgtactgcggccacagcttcgagagcctgcaggacctgagcgtgcacatgatcaagaccaagcactaccagaaggtgcccctgaaggagcccgtgcccgccatcaccaagctggtgcccagcaccaagaagagagccctgcaggacctggcccccccctgcagccccgagcccgccggcatggccgccgaggtggccctgagcgagagcgccaaggaccagaaggccgccaacccctacgtgacccccaacaacagatacggctaccagaacggcgccagctacacctggcagttcgaggccagaaaggcccagatcctgaagtgcatggagtgcggcagcagccacgacaccctgcagcagctgaccgcccacatgatggtgaccggccacttcctgaaggtgaccaccagcgccagcaagaagggcaagcagctggtgctggaccccgtggtggaggagaagatccagagcatccccctgccccccaccacccacaccagactgcccgccagcagcatcaagaagcagcccgacagccccgccggcagcaccaccagcgaggagaagaaggagcccgagaaggagaagccccccgtggccggcgacgccgagaagatcaaggaggagagcgaggacagcctggagaagttcgagcccagcaccctgtacccctacctgagagaggaggacctggacgacagccccaagggcggcctggacatcctgaagagcctggagaacaccgtgagcaccgccatcagcaaggcccagaacggcgcccccagctggggcggctaccccagcatccacgccgcctaccagctgcccggcaccgtgaagcccctgcccgccgccgtgcagagcgtgcaggtgcagcccagctacgccggcggcgtgaagagcctgagcagcgccgagcacaacgccctgctgcacagccccggcagcctgaccccccccccccacaagagcaacgtgagcgccatggaggagctggtggagaaggtgaccggcaaggtgaacatcaagaaggaggagagaccccccgagaaggagaagagcagcctggccaaggccgccagccccatcgccaaggagaacaaggacttccccaagaccgaggaggtgagcggcaagccccagaagaagggccccgaggccgagaccggcaaggccaagaaggagggccccctggacgtgcacacccccaacggcaccgagcccctgaaggccaaggtgaccaacggctgcaacaacctgggcatcatcatggaccacagccccgagcccagcttcatcaaccccctgagcgccctgcagagcatcatgaacacccacctgggcaaggtgagcaagcccgtgagccccagcctggaccccctggccatgctgtacaagatcagcaacagcatgctggacaagcccgtgtaccccgccacccccgtgaagcaggccgacgccatcgacagatactactacgagaacagcgaccagcccatcgacctgaccaagagcaagaacaagcccctggtgagcagcgtggccgacagcgtggccagccccctgagagagagcgccctgatggacatcagcgacatggtgaagaacctgaccggcagactgacccccaagagcagcacccccagcaccgtgagcgagaagagcgacgccgacggcagcagcttcgaggaggccctggacgagctgagccccgtgcacaagagaaagggcagacagagcaactggaacccccagcacctgctgatcctgcaggcccagttcgccagcagcctgagagagaccaccgagggcaagtacatcatgagcgacctgggcccccaggagagagtgcacatcagcaagttcaccggcctgagcatgaccaccatcagccactggctggccaacgtgaagtaccagctgagaagaaccggcggcaccaagttcctgaagaacctggacaccggccaccccgtgttcttctgcaacgactgcgccagccagttcagaaccgccagcacctacatcagccacctggagacccacctgggcttcagcctgaaggacctgagcaagctgcccctgaaccagatccaggagcagcagaacgtgagcaaggtgctgaccaacaagaccctgggccccctgggcgccaccgaggaggacctgggcagcaccttccagtgcaagctgtgcaacagaaccttcgccagcaagcacgccgtgaagctgcacctgagcaagacccacggcaagagccccgaggaccacctgatctacgtgaccgagctggagaagcagtag

SEQ ID NO: 102075 - DNA, 237 bp, Artificial Sequence
  Description of Artificial Sequence: Synthetic coding sequence
atgtgcaacgaggagaccgagatcaaggaggcccagagctaccagaacagccccgtgagcagcgccaccaaccaggacgccggctacggcagccccttcagcgagagcagcgaccagctggcccacttcaagggcagcagcagcagagaggagaaggaggacccccagtgccccgacagcgtgagctacccccaggacagcctggcccagatcaaggccgtgtacgccaacctgtag

SEQ ID NO: 102076 - DNA, 321 bp, Artificial Sequence
  Description of Artificial Sequence: Synthetic coding sequence
atgtgcaacgaggagaccgagatcaaggaggcccagagctaccagaacagccccgtgagcagcgccaccaaccaggacgccggctacggcagccccttcagcgagagcagcgaccagctggcccacttcaagggcagcagcagcagagaggagaaggaggacccccagtgccccgacagcgtgagctacccccaggacagcctggcccagatcaaggccgtgtacgccaacctgttcagcgagagctgctggagcagcctggccctggacctgaagaagagcggcagcaccaccagcaccaacgacgccagccagaagtag

SEQ ID NO: 102077 - DNA, 3096 bp, Artificial Sequence
  Description of Artificial Sequence: Synthetic coding sequence
atgatggccgccgccctgctgcactacaccggctacgcccaggaggagcagctgaaggaggaggaggagatcaaggaggaggaggaggaggaggacagcggcagcgtggcccagctgcagggcggcaacgacaccggcaccgacgaggagctggagaccggccccgagcagaagggctgcttcagctaccagaacagccccggcagccacctgagcaaccaggacgccgagaacgagagcctgctgagcgacgccagcgaccaggtgagcgacatcaagagcgtgtgcggcagagacgccagcgacaagaaggcccacacccacgtgagactgcccaacgaggcccacaactgcatggacaagatgaccgccgtgtacgccaacatcctgagcgacagctactggagcggcctgggcctgggcttcaagctgagcaacagcgagagaagaaactgcgacaccagaaacggcagcaacaagagcgacttcgactggcaccaggacgccctgagcaagagcctgcagcagaacctgcccagcagaagcgtgagcaagcccagcctgttcagcagcgtgcagctgtacagacagagcagcaagatgtgcggcaccgtgttcaccggcgccagcagattcagatgcagacagtgcagcgccgcctacgacaccctggtggagctgaccgtgcacatgaacgagaccggccactaccaggacgacaacagaaagaaggacaagctgagacccaccagctacagcaagcccagaaagagagccttccaggacatggacaaggaggacgcccagaaggtgctgaagtgcatgttctgcggcgacagcttcgacagcctgcaggacctgagcgtgcacatgatcaagaccaagcactaccagaaggtgcccctgaaggagcccgtgcccaccatcagcagcaagatggtgacccccgccaagaagagagtgttcgacgtgaacagaccctgcagccccgacagcaccaccggcagcttcgccgacagcttcagcagccagaagaacgccaacctgcagctgagcagcaacaacagatacggctaccagaacggcgccagctacacctggcagttcgaggcctgcaagagccagatcctgaagtgcatggagtgcggcagcagccacgacaccctgcagcagctgaccacccacatgatggtgaccggccacttcctgaaggtgaccagcagcgccagcaagaagggcaagcagctggtgctggaccccctggccgtggagaagatgcagagcctgagcgaggcccccaacagcgacagcctggcccccaagcccagcagcaacagcgccagcgactgcaccgccagcaccaccgagctgaagaaggagagcaagaaggagagacccgaggagaccagcaaggacgagaaggtggtgaagagcgaggactacgaggaccccctgcagaagcccctggaccccaccatcaagtaccagtacctgagagaggaggacctggaggacggcagcaagggcggcggcgacatcctgaagagcctggagaacaccgtgaccaccgccatcaacaaggcccagaacggcgcccccagctggagcgcctaccccagcatccacgccgcctaccagctgagcgagggcaccaagccccccctgcccatgggcagccaggtgctgcagatcagacccaacctgaccaacaagctgagacccatcgcccccaagtggaaggtgatgcccctggtgagcatgcccacccacctggccccctacacccaggtgaagaaggagagcgaggacaaggacgaggccgtgaaggagtgcggcaaggagagcccccacgaggaggccagcagcttcagccacagcgagggcgacagcttcagaaagagcgagaccccccccgaggccaagaagaccgagctgggccccctgaaggaggaggagaagctgatgaaggagggcagcgagaaggagaagccccagcccctggagcccaccagcgccctgagcaacggctgcgccctggccaaccacgcccccgccctgccctgcatcaaccccctgagcgccctgcagagcgtgctgaacaaccacctgggcaaggccaccgagcccctgagaagccccagctgcagcagccccagcagcagcaccatcagcatgttccacaagagcaacctgaacgtgatggacaagcccgtgctgagccccgccagcaccagaagcgccagcgtgagcagaagatacctgttcgagaacagcgaccagcccatcgacctgaccaagagcaagagcaagaaggccgagagcagccaggcccagagctgcatgagccccccccagaagcacgccctgagcgacatcgccgacatggtgaaggtgctgcccaaggccaccacccccaagcccgccagcagcagcagagtgccccccatgaagctggagatggacgtgagaagattcgaggacgtgagcagcgaggtgagcaccctgcacaagagaaagggcagacagagcaactggaacccccagcacctgctgatcctgcaggcccagttcgccagcagcctgttccagaccagcgagggcaagtacctgctgagcgacctgggcccccaggagagaatgcagatcagcaagttcaccggcctgagcatgaccaccatcagccactggctggccaacgtgaagtaccagctgagaaagaccggcggcaccaagttcctgaagaacatggacaagggccaccccatcttctactgcagcgactgcgccagccagttcagaacccccagcacctacatcagccacctggagagccacctgggcttccagatgaaggacatgaccagactgagcgtggaccagcagagcaaggtggagcaggagatcagcagagtgagcagcgcccagagaagccccgagaccatcgccgccgaggaggacaccgacagcaagttcaagtgcaagctgtgctgcagaaccttcgtgagcaagcacgccgtgaagctgcacctgagcaagacccacagcaagagccccgagcaccacagccagttcgtgaccgacgtggacgaggagtag

SEQ ID NO: 102078 - DNA, 3105 bp, Artificial Sequence
  Description of Artificial Sequence: Synthetic coding sequence
atgcccagaagaaagcagcaggcccccaagagagccgccggctacgcccaggaggagcagctgaaggaggaggaggagatcaaggaggaggaggaggaggaggacagcggcagcgtggcccagctgcagggcggcaacgacaccggcaccgacgaggagctggagaccggccccgagcagaagggctgcttcagctaccagaacagccccggcagccacctgagcaaccaggacgccgagaacgagagcctgctgagcgacgccagcgaccaggtgagcgacatcaagagcgtgtgcggcagagacgccagcgacaagaaggcccacacccacgtgagactgcccaacgaggcccacaactgcatggacaagatgaccgccgtgtacgccaacatcctgagcgacagctactggagcggcctgggcctgggcttcaagctgagcaacagcgagagaagaaactgcgacaccagaaacggcagcaacaagagcgacttcgactggcaccaggacgccctgagcaagagcctgcagcagaacctgcccagcagaagcgtgagcaagcccagcctgttcagcagcgtgcagctgtacagacagagcagcaagatgtgcggcaccgtgttcaccggcgccagcagattcagatgcagacagtgcagcgccgcctacgacaccctggtggagctgaccgtgcacatgaacgagaccggccactaccaggacgacaacagaaagaaggacaagctgagacccaccagctacagcaagcccagaaagagagccttccaggacatggacaaggaggacgcccagaaggtgctgaagtgcatgttctgcggcgacagcttcgacagcctgcaggacctgagcgtgcacatgatcaagaccaagcactaccagaaggtgcccctgaaggagcccgtgcccaccatcagcagcaagatggtgacccccgccaagaagagagtgttcgacgtgaacagaccctgcagccccgacagcaccaccggcagcttcgccgacagcttcagcagccagaagaacgccaacctgcagctgagcagcaacaacagatacggctaccagaacggcgccagctacacctggcagttcgaggcctgcaagagccagatcctgaagtgcatggagtgcggcagcagccacgacaccctgcagcagctgaccacccacatgatggtgaccggccacttcctgaaggtgaccagcagcgccagcaagaagggcaagcagctggtgctggaccccctggccgtggagaagatgcagagcctgagcgaggcccccaacagcgacagcctggcccccaagcccagcagcaacagcgccagcgactgcaccgccagcaccaccgagctgaagaaggagagcaagaaggagagacccgaggagaccagcaaggacgagaaggtggtgaagagcgaggactacgaggaccccctgcagaagcccctggaccccaccatcaagtaccagtacctgagagaggaggacctggaggacggcagcaagggcggcggcgacatcctgaagagcctggagaacaccgtgaccaccgccatcaacaaggcccagaacggcgcccccagctggagcgcctaccccagcatccacgccgcctaccagctgagcgagggcaccaagccccccctgcccatgggcagccaggtgctgcagatcagacccaacctgaccaacaagctgagacccatcgcccccaagtggaaggtgatgcccctggtgagcatgcccacccacctggccccctacacccaggtgaagaaggagagcgaggacaaggacgaggccgtgaaggagtgcggcaaggagagcccccacgaggaggccagcagcttcagccacagcgagggcgacagcttcagaaagagcgagaccccccccgaggccaagaagaccgagctgggccccctgaaggaggaggagaagctgatgaaggagggcagcgagaaggagaagccccagcccctggagcccaccagcgccctgagcaacggctgcgccctggccaaccacgcccccgccctgccctgcatcaaccccctgagcgccctgcagagcgtgctgaacaaccacctgggcaaggccaccgagcccctgagaagccccagctgcagcagccccagcagcagcaccatcagcatgttccacaagagcaacctgaacgtgatggacaagcccgtgctgagccccgccagcaccagaagcgccagcgtgagcagaagatacctgttcgagaacagcgaccagcccatcgacctgaccaagagcaagagcaagaaggccgagagcagccaggcccagagctgcatgagccccccccagaagcacgccctgagcgacatcgccgacatggtgaaggtgctgcccaaggccaccacccccaagcccgccagcagcagcagagtgccccccatgaagctggagatggacgtgagaagattcgaggacgtgagcagcgaggtgagcaccctgcacaagagaaagggcagacagagcaactggaacccccagcacctgctgatcctgcaggcccagttcgccagcagcctgttccagaccagcgagggcaagtacctgctgagcgacctgggcccccaggagagaatgcagatcagcaagttcaccggcctgagcatgaccaccatcagccactggctggccaacgtgaagtaccagctgagaaagaccggcggcaccaagttcctgaagaacatggacaagggccaccccatcttctactgcagcgactgcgccagccagttcagaacccccagcacctacatcagccacctggagagccacctgggcttccagatgaaggacatgaccagactgagcgtggaccagcagagcaaggtggagcaggagatcagcagagtgagcagcgcccagagaagccccgagaccatcgccgccgaggaggacaccgacagcaagttcaagtgcaagctgtgctgcagaaccttcgtgagcaagcacgccgtgaagctgcacctgagcaagacccacagcaagagccccgagcaccacagccagttcgtgaccgacgtggacgaggagtag

SEQ ID NO: 102079 - DNA, 3246 bp, Artificial Sequence
  Description of Artificial Sequence: Synthetic coding sequence
atgcccagaagaaagcagcaggcccccagaagagccgccgcctacgtgagcgaggagctgaaggccgccgccctggtggacgagggcctggaccccgaggagcacaccgccgacggcgagcccagcgccaagtacatgtgccccgagaaggagctggccagagcctgccccagctaccagaacagccccgccgccgagttcagctgccacgagatggacagcgagagccacatcagcgagaccagcgacagaatggccgacttcgagagcggcagcatcaagaacgaggaggagaccaaggaggtgaccgtgcccctggaggacaccaccgtgagcgacagcctggagcagatgaaggccgtgtacaacaacttcctgagcaacagctactggagcaacctgaacctgaacctgcaccagcccagcagcgagaagaacaacggcagcagcagcagcagcagcagcagcagcagcagctgcggcagcggcagcttcgactggcaccagagcgccatggccaagaccctgcagcaggtgagccagagcagaatgctgcccgagcccagcctgttcagcaccgtgcagctgtacagacagagcagcaagctgtacggcagcatcttcaccggcgccagcaagttcagatgcaaggactgcagcgccgcctacgacaccctggtggagctgaccgtgcacatgaacgagaccggccactacagagacgacaaccacgagaccgacaacaacaaccccaagagatggagcaagcccagaaagagaagcctgctggagatggagggcaaggaggacgcccagaaggtgctgaagtgcatgtactgcggccacagcttcgagagcctgcaggacctgagcgtgcacatgatcaagaccaagcactaccagaaggtgcccctgaaggagcccgtgacccccgtggccgccaagatcatccccgccaccagaaagaaggccagcctggagctggagctgcccagcagccccgacagcaccggcggcacccccaaggccaccatcagcgacaccaacgacgccctgcagaagaacagcaacccctacatcacccccaacaacagatacggccaccagaacggcgccagctacgcctggcacttcgaggccagaaagagccagatcctgaagtgcatggagtgcggcagcagccacgacaccctgcaggagctgaccgcccacatgatggtgaccggccacttcatcaaggtgaccaacagcgccatgaagaagggcaagcccatcgtggagacccccgtgacccccaccatcaccaccctgctggacgagaaggtgcagagcgtgcccctggccgccaccaccttcaccagccccagcaacacccccgccagcatcagccccaagctgaacgtggaggtgaagaaggaggtggacaaggagaaggccgtgaccgacgagaagcccaagcagaaggacaagcccggcgaggaggaggagaagtgcgacatcagcagcaagtaccactacctgaccgagaacgacctggaggagagccccaagggcggcctggacatcctgaagagcctggagaacaccgtgaccagcgccatcaacaaggcccagaacggcacccccagctggggcggctaccccagcatccacgccgcctaccagctgcccaacatgatgaagctgagcctgggcagcagcggcaagagcacccccctgaagcccatgttcggcaacagcgagatcgtgagccccaccaagaaccagaccctggtgagcccccccagcagccagaccagccccatgcccaagaccaacttccacgccatggaggagctggtgaagaaggtgaccgagaaggtggccaaggtggaggagaagatgaaggagcccgacggcaagctgagcccccccaagagagccacccccagcccctgcagcagcgaggtgggcgagcccatcaagatggaggccagcagcgacggcggcttcagaagccaggagaacagccccagcccccccagagacggctgcaaggacggcagccccctggccgagcccgtggagaacggcaaggagctggtgaagcccctggccagcagcctgagcggcagcaccgccatcatcaccgaccacccccccgagcagcccttcgtgaaccccctgagcgccctgcagagcgtgatgaacatccacctgggcaaggccgccaagcccagcctgcccgccctggaccccatgagcatgctgttcaagatgagcaacagcctggccgagaaggccgccgtggccacccccccccccctgcagagcaagaaggccgaccacctggacagatacttctaccacgtgaacaacgaccagcccatcgacctgaccaagggcaagagcgacaagggctgcagcctgggcagcgtgctgctgagccccaccagcaccgcccccgccaccagcagcagcaccgtgaccaccgccaagaccagcgccgtggtgagcttcatgagcaacagccccctgagagagaacgccctgagcgacatcagcgacatgctgaagaacctgaccgagagccacaccagcaagagcagcacccccagcagcatcagcgagaagagcgacatcgacggcgccaccctggaggaggccgaggagagcacccccgcccagaagagaaagggcagacagagcaactggaacccccagcacctgctgatcctgcaggcccagttcgccgccagcctgagacagaccagcgagggcaagtacatcatgagcgacctgagcccccaggagagaatgcacatcagcagattcaccggcctgagcatgaccaccatcagccactggctggccaacgtgaagtaccagctgagaagaaccggcggcaccaagttcctgaagaacctggacaccggccaccccgtgttcttctgcaacgactgcgccagccagatcagaacccccagcacctacatcagccacctggagagccacctgggcttcagactgagagacctgagcaagctgagcaccgagcagatcaacagccagatcgcccagaccaagagccccagcgagaagatggtgaccagcagccccgaggaggacctgggcaccagctaccagtgcaagctgtgcaacagaaccttcgccagcaagcacgccgtgaagctgcacctgagcaagacccacggcaagagccccgaggaccacctgctgtacgtgagcgagctggagaagcagtag

SEQ ID NO: 102080 - DNA, 1896 bp, Artificial Sequence
  Description of Artificial Sequence: Synthetic coding sequence
atgaacttcaacaccatcctggaggagatcctgatcaagagaagccagcagaagaagaagaccagccccctgaactacaaggagagactgttcgtgctgaccaagagcatgctgacctactacgagggcagagccgagaagaagtacagaaagggcttcatcgacgtgagcaagatcaagtgcgtggagatcgtgaagaacgacgacggcgtgatcccctgccagaacaagtaccccttccaggtggtgcacgacgccaacaccctgtacatcttcgcccccagcccccagagcagagacctgtgggtgaagaagctgaaggaggagatcaagaacaacaacaacatcatgatcaagtaccaccccaagttctggaccgacggcagctaccagtgctgcagacagaccgagaagctggcccccggctgcgagaagtacaacctgttcgagagcagcatcagaaaggccctgccccccgcccccgagaccaagaagagaagaccccccccccccatccccctggaggaggaggacaacagcgaggagatcgtggtggccatgtacgacttccaggccgccgagggccacgacctgagactggagagaggccaggagtacctgatcctggagaagaacgacgtgcactggtggagagccagagacaagtacggcaacgagggctacatccccagcaactacgtgaccggcaagaagagcaacaacctggaccagtacgagtggtactgcagaaacatgaacagaagcaaggccgagcagctgctgagaagcgaggacaaggagggcggcttcatggtgagagacagcagccagcccggcctgtacaccgtgagcctgtacaccaagttcggcggcgagggcagcagcggcttcagacactaccacatcaaggagaccaccaccagccccaagaagtactacctggccgagaagcacgccttcggcagcatccccgagatcatcgagtaccacaagcacaacgccgccggcctggtgaccagactgagataccccgtgagcgtgaagggcaagaacgcccccaccaccgccggcttcagctacgagaagtgggagatcaaccccagcgagctgaccttcatgagagagctgggcagcggcctgttcggcgtggtgagactgggcaagtggagagcccagtacaaggtggccatcaaggccatcagagagggcgccatgtgcgaggaggacttcatcgaggaggccaaggtgatgatgaagctgacccaccccaagctggtgcagctgtacggcgtgtgcacccagcagaagcccatctacatcgtgaccgagttcatggagagaggctgcctgctgaacttcctgagacagagacagggccacttcagcagagacgtgctgctgagcatgtgccaggacgtgtgcgagggcatggagtacctggagagaaacagcttcatccacagagacctggccgccagaaactgcctggtgagcgaggccggcgtggtgaaggtgagcgacttcggcatggccagatacgtgctggacgaccagtacaccagcagcagcggcgccaagttccccgtgaagtggtgcccccccgaggtgttcaactacagcagattcagcagcaagagcgacgtgtggagcttcggcgtgctgatgtgggaggtgttcaccgagggcagaatgcccttcgagaagtacaccaactacgaggtggtgaccatggtgaccagaggccacagactgtaccagcccaagctggccagcaactacgtgtacgaggtgatgctgagatgctggcaggagaagcccgagggcagacccagcttcgaggacctgctgagaaccatcgacgagctggtggagtgcgaggagaccttcggcagatag

SEQ ID NO: 102081 - DNA, 2094 bp, Artificial Sequence
  Description of Artificial Sequence: Synthetic coding sequence
atgggcttccagccccccgccgccctgctgctgagactgttcctgctgcagggcatcctgagactgctgtggggcgacctggccttcatcccccccttcatcagaatgagcggccccgccgtgagcgccagcctggtgggcgacaccgagggcgtgaccgtgagcctggccgtgctgcaggacgaggccggcatcctgcccatccccacctgcggcgtgctgaacaacgagaccgaggactggagcgtgaccgtgatccccggcgccaaggtgctggaggtgaccgtgagatggaagagaggcctggactggtgcagcagcaacgagaccgacagcttcagcgagagcccctgcatcctgcagaccctgctggtgagcgccagccacaacagcagctgcagcgcccacctgctgatccaggtggagatctacgccaacagcagcctgacccacaacgccagcgagaacgtgaccgtgatccccaaccaggtgtaccagcccctgggcccctgcccctgcaacctgaccgccggcgcctgcgacgtgagatgctgctgcgaccaggagtgcagcagcaacctgaccaccctgttcagaagaagctgcttcaccggcgtgttcggcggcgacgtgaacccccccttcgaccagctgtgcagcgccggcaccaccaccagaggcgtgcccgactggttccccttcctgtgcgtgcagagccccctggccaacacccccttcctgggctacttctaccacggcgccgtgagccccaagcaggacagcagcttcgaggtgtacgtggacaccgacgccaaggacttcgccgacttcggctacaagcagggcgaccccatcatgaccgtgaagaaggcctacttcaccatcccccaggtgagcctggccggccagtgcatgcagaacgcccccgtggccttcctgcacaacttcgacgtgaagtgcgtgaccaacctggagctgtaccaggagagagacggcatcatcaacgccaagatcaagaacgtggccctgggcggcatcgtgacccccaaggtgatctacgaggaggccaccgacctggacaagttcatcaccaacaccgagacccccctgaacaacggcagcacccccagaatcgtgaacgtggaggagcactacatcttcaagtggaacaacaacaccatcagcgagatcaacgtgaagatcttcagagccgagatcaacgcccaccagaagggcatcatgacccagagattcgtggtgaagttcctgagctacaacagcggcaacgaggaggagctgagcggcaaccccggctaccagctgggcaagcccgtgagagccctgaacatcaacagaatgaacaacgtgaccaccctgcacctgtggcagagcgccggcagaggcctgtgcaccagcgccaccttcaagcccatcctgttcggcgagaacgtgctgagcggctgcctgctggaggtgggcatcaacgagaactgcacccagctgagagagaacgccgtggagagactggacagcctgatccaggccacccacgtggccatgagaggcaacagcgactacgccgacctgagcgacggctggctggagatcatcagagtggacgcccccgaccccggcgccgaccccctggccagcagcgtgaacggcatgtgcctggacatccccgcccacctgagcatcagaatcctgatcagcgacgccggcgccgtggagggcatcacccagcaggagatcctgggcgtggagaccagattcagcagcgtgaactggcagtaccagtgcggcctgacctgcgagcacaaggccgacctgctgcccatcagcgccagcgtgcagttcatcaagatccccgcccagctgccccaccccctgaccagattccagatcaactacaccgagtacgactgcaacagaaacgaggtgtgctggccccagctgctgtacccctggacccagtactaccagggcgagctgcacagccagtgcgtggccaagggcctgctgctgctgctgttcctgaccctggccctgttcctgagcaacccctggaccagaatctgcaaggcctacagctag

SEQ ID NO: 102082 - DNA, 2091 bp, Artificial Sequence
  Description of Artificial Sequence: Synthetic coding sequence
atgggcttccagccccccgccgccctgctgctgagactgttcctgctgcagggcatcctgagactgctgtggggcgacctggccttcatcccccccttcatcagaatgagcggccccgccgtgagcgccagcctggtgggcgacaccgagggcgtgaccgtgagcctggccgtgctgcaggacgaggccggcatcctgcccatccccacctgcggcgtgctgaacaacgagaccgaggactggagcgtgaccgtgatccccggcgccgtgctggaggtgaccgtgagatggaagagaggcctggactggtgcagcagcaacgagaccgacagcttcagcgagagcccctgcatcctgcagaccctgctggtgagcgccagccacaacagcagctgcagcgcccacctgctgatccaggtggagatctacgccaacagcagcctgacccacaacgccagcgagaacgtgaccgtgatccccaaccaggtgtaccagcccctgggcccctgcccctgcaacctgaccgccggcgcctgcgacgtgagatgctgctgcgaccaggagtgcagcagcaacctgaccaccctgttcagaagaagctgcttcaccggcgtgttcggcggcgacgtgaacccccccttcgaccagctgtgcagcgccggcaccaccaccagaggcgtgcccgactggttccccttcctgtgcgtgcagagccccctggccaacacccccttcctgggctacttctaccacggcgccgtgagccccaagcaggacagcagcttcgaggtgtacgtggacaccgacgccaaggacttcgccgacttcggctacaagcagggcgaccccatcatgaccgtgaagaaggcctacttcaccatcccccaggtgagcctggccggccagtgcatgcagaacgcccccgtggccttcctgcacaacttcgacgtgaagtgcgtgaccaacctggagctgtaccaggagagagacggcatcatcaacgccaagatcaagaacgtggccctgggcggcatcgtgacccccaaggtgatctacgaggaggccaccgacctggacaagttcatcaccaacaccgagacccccctgaacaacggcagcacccccagaatcgtgaacgtggaggagcactacatcttcaagtggaacaacaacaccatcagcgagatcaacgtgaagatcttcagagccgagatcaacgcccaccagaagggcatcatgacccagagattcgtggtgaagttcctgagctacaacagcggcaacgaggaggagctgagcggcaaccccggctaccagctgggcaagcccgtgagagccctgaacatcaacagaatgaacaacgtgaccaccctgcacctgtggcagagcgccggcagaggcctgtgcaccagcgccaccttcaagcccatcctgttcggcgagaacgtgctgagcggctgcctgctggaggtgggcatcaacgagaactgcacccagctgagagagaacgccgtggagagactggacagcctgatccaggccacccacgtggccatgagaggcaacagcgactacgccgacctgagcgacggctggctggagatcatcagagtggacgcccccgaccccggcgccgaccccctggccagcagcgtgaacggcatgtgcctggacatccccgcccacctgagcatcagaatcctgatcagcgacgccggcgccgtggagggcatcacccagcaggagatcctgggcgtggagaccagattcagcagcgtgaactggcagtaccagtgcggcctgacctgcgagcacaaggccgacctgctgcccatcagcgccagcgtgcagttcatcaagatccccgcccagctgccccaccccctgaccagattccagatcaactacaccgagtacgactgcaacagaaacgaggtgtgctggccccagctgctgtacccctggacccagtactaccagggcgagctgcacagccagtgcgtggccaagggcctgctgctgctgctgttcctgaccctggccctgttcctgagcaacccctggaccagaatctgcaaggcctacagctag

SEQ ID NO: 102083 - DNA, 1824 bp, Artificial Sequence
  Description of Artificial Sequence: Synthetic coding sequence
atgagaaccccccagctggccctgctgcaggtgttcttcctggtgttccccgacggcgtgagaccccagcccagcagcagccccagcggcgccgtgcccaccagcctggagctgcagagaggcaccgacggcggcaccctgcagagccccagcgaggccaccgccaccagacccgccgtgcccggcctgcccaccgtggtgcccaccctggtgacccccagcgcccccggcaacagaaccgtggacctgttccccgtgctgcccatctgcgtgtgcgacctgacccccggcgcctgcgacatcaactgctgctgcgacagagactgctacctgctgcaccccagaaccgtgttcagcttctgcctgcccggcagcgtgagaagcagcagctgggtgtgcgtggacaacagcgtgatcttcagaagcaacagccccttccccagcagagtgttcatggacagcaacggcatcagacagttctgcgtgcacgtgaacaacagcaacctgaactacttccagaagctgcagaaggtgaacgccaccaacttccaggccctggccgccgagttcggcggcgagagcttcaccagcaccttccagacccagagcccccccagcttctacagagccggcgaccccatcctgacctacttccccaagtggagcgtgatcagcctgctgagacagcccgccggcgtgggcgccggcggcctgtgcgccgagagcaaccccgccggcttcctggagagcaagagcaccacctgcaccagattcttcaagaacctggccagcagctgcaccctggacagcgccctgaacgccgccagctactacaacttcaccgtgctgaaggtgcccagaagcatgaccgacccccagaacatggagttccaggtgcccgtgatcctgaccagccaggccaacgcccccctgctggccggcaacacctgccagaacgtggtgagccaggtgacctacgagatcgagaccaacggcaccttcggcatccagaaggtgagcgtgagcctgggccagaccaacctgaccgtggagcccggcgccagcctgcagcagcacttcatcctgagattcagagccttccagcagagcaccgccgccagcctgaccagccccagaagcggcaaccccggctacatcgtgggcaagcccctgctggccctgaccgacgacatcagctacagcatgaccctgctgcagagccagggcaacggcagctgcagcgtgaagagacacgaggtgcagttcggcgtgaacgccatcagcggctgcaagctgagactgaagaaggccgactgcagccacctgcagcaggagatctaccagaccctgcacggcagacccagacccgagtacgtggccatcttcggcaacgccgaccccgcccagaagggcggctggaccagaatcctgaacagacactgcagcatcagcgccatcaactgcaccagctgctgcctgatccccgtgagcctggagatccaggtgctgtgggcctacgtgggcctgctgagcaacccccaggcccacgtgagcggcgtgagattcctgtaccagtgccagagcatccaggacagccagcaggtgaccgaggtgagcctgaccaccctggtgaacttcgtggacatcacccagaagccccagccccccagaggccagcccaagatggactggaagtggcccttcgacttcttccccttcaaggtggccttcagcagaggcgtgttcagccagaagtgcagcgtgagccccatcctgatcctgtgcctgctgctgctgggcgtgctgaacctggagaccatgtag

SEQ ID NO: 102084 - DNA, 1290 bp, Artificial Sequence
  Description of Artificial Sequence: Synthetic coding sequence
atggacagcaacggcatcagacagttctgcgtgcacgtgaacaacagcaacctgaactacttccagaagctgcagaaggtgaacgccaccaacttccaggccctggccgccgagttcggcggcgagagcttcaccagcaccttccagacccagagcccccccagcttctacagagccggcgaccccatcctgacctacttccccaagtggagcgtgatcagcctgctgagacagcccgccggcgtgggcgccggcggcctgtgcgccgagagcaaccccgccggcttcctggagagcaagagcaccacctgcaccagattcttcaagaacctggccagcagctgcaccctggacagcgccctgaacgccgccagctactacaacttcaccgtgctgaaggtgcccagaagcatgaccgacccccagaacatggaggtgacctacgagatcgagaccaacggcaccttcggcatccagaaggtgagcgtgagcctgggccagaccaacctgaccgtggagcccggcgccagcctgcagcagcacttcatcctgagattcagagccttccagcagagcaccgccgccagcctgaccagccccagaagcggcaaccccggctacatcgtgggcaagcccctgctggccctgaccgacgacatcagctacagcatgaccctgctgcagagccagggcaacggcagctgcagcgtgaagagacacgaggtgcagttcggcgtgaacgccatcagcggctgcaagctgagactgaagaaggccgactgcagccacctgcagcaggagatctaccagaccctgcacggcagacccagacccgagtacgtggccatcttcggcaacgccgaccccgcccagaagggcggctggaccagaatcctgaacagacactgcagcatcagcgccatcaactgcaccagctgctgcctgatccccgtgagcctggagatccaggtgctgtgggcctacgtgggcctgctgagcaacccccaggcccacgtgagcggcgtgagattcctgtaccagtgccagagcatccaggacagccagcaggtgaccgaggtgagcctgaccaccctggtgaacttcgtggacatcacccagaagccccagccccccagaggccagcccaagatggactggaagtggcccttcgacttcttccccttcaaggtggccttcagcagaggcgtgttcagccagaagtgcagcgtgagccccatcctgatcctgtgcctgctgctgctgggcgtgctgaacctggagaccatgtag

SEQ ID NO: 102085 - DNA, 1332 bp, Artificial Sequence
  Description of Artificial Sequence: Synthetic coding sequence
atgagaaccccccagctggccctgctgcaggtgttcttcctggtgttccccgacggcgtgagaccccagcccagcagcagccccagcggcgccgtgcccaccagcctggagctgcagagaggcaccgacggcggcaccctgcagagccccagcgaggccaccgccaccagacccgccgtgcccggcctgcccaccgtggtgcccaccctggtgacccccagcgcccccggcaacagaaccgtggacctgttccccgtgctgcccatctgcgtgtgcgacctgacccccggcgcctgcgacatcaactgctgctgcgacagagactgctacctgctgcaccccagaaccgtgttcagcttctgcctgcccggcagcgtgagaagcagcagctgggtgtgcgtggacaacagcgtgatcttcagaagcaacagccccttccccagcagagtgttcatggacagcaacggcatcagacagttctgcgtgcacgtgaacaacagcaacctgaactacttccagaagctgcagaaggtgaacgccaccaacttccaggccctggccgccgagttcggcggcgagagcttcaccagcaccttccagacccagagcccccccagcttctacagagccggcgaccccatcctgacctacttccccaagtggagcgtgatcagcctgctgagacagcccgccggcgtgggcgccggcggcctgtgcgccgagagcaaccccgccggcttcctggagagcaagagcaccacctgcaccagattcttcaagaacctggccagcagctgcaccctggacagcgccctgaacgccgccagctactacaacttcaccgtgctgaaggtgcccagaagcatgaccgacccccagaacatggagttccaggtgcccgtgatcctgaccagccaggccaacgcccccctgctggccggcaacacctgccagaacgtggtgagccaggtgacctacgagatcgagaccaacggcaccttcggcatccagaaggtgagcgtgagcctgggccagaccaacctgaccgtggagcccggcgccagcctgcagcagcacttcatcctgagattcagagccttccagcagagcaccgccgccagcctgaccagccccagaagcggcaaccccggctacatcgtgggcaagcccctgctggccctgaccgacgacatcagctacagcgtgagcttcctggagctgggcggcctgctgcagcccaacgagaagagctgcaagggcttccagacctacgtgagactggccaagggcgaggagttcttcgtgcactacaacgaggtgctgatctactag

SEQ ID NO: 102086 - DNA, 1878 bp, Artificial Sequence
  Description of Artificial Sequence: Synthetic coding sequence
atgagactggagaccgccgaggcctacgtgggccccggcggccccgagtgccccatgagaaccccccagctggccctgctgcaggtgttcttcctggtgttccccgacggcgtgagaccccagcccagcagcagccccagcggcgccgtgcccaccagcctggagctgcagagaggcaccgacggcggcaccctgcagagccccagcgaggccaccgccaccagacccgccgtgcccggcctgcccaccgtggtgcccaccctggtgacccccagcgcccccggcaacagaaccgtggacctgttccccgtgctgcccatctgcgtgtgcgacctgacccccggcgcctgcgacatcaactgctgctgcgacagagactgctacctgctgcaccccagaaccgtgttcagcttctgcctgcccggcagcgtgagaagcagcagctgggtgtgcgtggacaacagcgtgatcttcagaagcaacagccccttccccagcagagtgttcatggacagcaacggcatcagacagttctgcgtgcacgtgaacaacagcaacctgaactacttccagaagctgcagaaggtgaacgccaccaacttccaggccctggccgccgagttcggcggcgagagcttcaccagcaccttccagacccagagcccccccagcttctacagagccggcgaccccatcctgacctacttccccaagtggagcgtgatcagcctgctgagacagcccgccggcgtgggcgccggcggcctgtgcgccgagagcaaccccgccggcttcctggagagcaagagcaccacctgcaccagattcttcaagaacctggccagcagctgcaccctggacagcgccctgaacgccgccagctactacaacttcaccgtgctgaaggtgcccagaagcatgaccgacccccagaacatggagttccaggtgcccgtgatcctgaccagccaggccaacgcccccctgctggccggcaacacctgccagaacgtggtgagccaggtgacctacgagatcgagaccaacggcaccttcggcatccagaaggtgagcgtgagcctgggccagaccaacctgaccgtggagcccggcgccagcctgcagcagcacttcatcctgagattcagagccttccagcagagcaccgccgccagcctgaccagccccagaagcggcaaccccggctacatcgtgggcaagcccctgctggccctgaccgacgacatcagctacagcatgaccctgctgcagagccagggcaacggcagctgcagcgtgaagagacacgaggtgcagttcggcgtgaacgccatcagcggctgcaagctgagactgaagaaggccgactgcagccacctgcagcaggagatctaccagaccctgcacggcagacccagacccgagtacgtggccatcttcggcaacgccgaccccgcccagaagggcggctggaccagaatcctgaacagacactgcagcatcagcgccatcaactgcaccagctgctgcctgatccccgtgagcctggagatccaggtgctgtgggcctacgtgggcctgctgagcaacccccaggcccacgtgagcggcgtgagattcctgtaccagtgccagagcatccaggacagccagcaggtgaccgaggtgagcctgaccaccctggtgaacttcgtggacatcacccagaagccccagccccccagaggccagcccaagatggactggaagtggcccttcgacttcttccccttcaaggtggccttcagcagaggcgtgttcagccagaagtgcagcgtgagccccatcctgatcctgtgcctgctgctgctgggcgtgctgaacctggagaccatgtag

SEQ ID NO: 102087 - DNA, 1380 bp, Artificial Sequence
  Description of Artificial Sequence: Synthetic coding sequence
atgagaaccccccagctggccctgctgcaggtgttcttcctggtgttccccgacggcgtgagaccccagcccagcagcagccccagcggcgccgtgcccaccagcctggagctgcagagaggcaccgacggcggcaccctgcagagccccagcgaggccaccgccaccagacccgccgtgcccggcctgcccaccgtggtgcccaccctggtgacccccagcgcccccggcaacagaaccgtggacctgttccccgtgctgcccatctgcgtgtgcgacctgacccccggcgcctgcgacatcaactgctgctgcgacagagactgctacctgctgcaccccagaaccgtgttcagcttctgcctgcccggcagcgtgagaagcagcagctgggtgtgcgtggacaacagcgtgatcttcagaagcaacagccccttccccagcagagtgttcatggacagcaacggcatcagacagttctgcgtgcacgtgaacaactgcttcctggagagcaagagcaccacctgcaccagattcttcaagaacctggccagcagctgcaccctggacagcgccctgaacgccgccagctactacaacttcaccgtgctgaaggtgcccagaagcatgaccgacccccagaacatggaggccttccagcagagcaccgccgccagcctgaccagccccagaagcggcaaccccggctacatcgtgggcaagcccctgctggccctgaccgacgacatcagctacagcatgaccctgctgcagagccagggcaacggcagctgcagcgtgaagagacacgaggtgcagttcggcgtgaacgccatcagcggctgcaagctgagactgaagaaggccgactgcagccacctgcagcaggagatctaccagaccctgcacggcagacccagacccgagtacgtggccatcttcggcaacgccgaccccgcccagaagggcggctggaccagaatcctgaacagacactgcagcatcagcgccatcaactgcaccagctgctgcctgatccccgtgagcctggagatccaggtgctgtgggcctacgtgggcctgctgagcaacccccaggcccacgtgagcggcgtgagattcctgtaccagtgccagagcatccaggacagccagcaggtgaccgaggtgagcctgaccaccctggtgaacttcgtggacatcacccagaagccccagccccccagaggccagcccaagatggactggaagtggcccttcgacttcttccccttcaaggtggccttcagcagaggcgtgttcagccagaagtgcagcgtgagccccatcctgatcctgtgcctgctgctgctgggcgtgctgaacctggagaccatgtag

SEQ ID NO: 102088 - DNA, 6468 bp, Artificial Sequence
  Description of Artificial Sequence: Synthetic coding sequence
atgaactacagcagcttcctgagaatctgggtgagcttcatcttcgccctggtgcagcaccaggcccagcccagagagctgatgtaccccttctggcagaacgacaccaagacccccaaggtggacgacggcagcagcagcgagatcaagctggccatccccgtgttcttcttcggcgtgccctacagaaccgtgtacgtgaacaacaacggcgtggtgagcttcaacgtgctggtgagccagttcacccccgagagcttccccctgaccgacggcagagccttcgtggcccccttctgggccgacgtgcacaacggcatcagaggcgagatctactacagagagaccatggagcccgccatcctgaagagagccaccaaggacatcagaaagtacttcaaggacatggccaccttcagcgccacctgggtgttcatcgtgacctgggaggaggtgaccttctacggcggcagcagcaccacccccgtgaacaccttccaggccgtgctggtgagcgacggcagctacaccttcaccctgttcaactactacgagatcaactggaccaccggcaccgccagcggcggcgaccccctgaccggcctgggcggcgtgatggcccaggccggcttcaacggcggcaacctgaccaacttcttcagcctgcccggcagcagaacccccgagatcgtgaacatccaggagaccaccaacgtgaacgtgcccggcagatgggccttcaaggtggacggcaaggagatcgaccccgccaacggctgcaccagcagaggccagttcctgagaagaggcgaggtgttctgggacgacctgaactgcaccgtgaagtgcagatgcctggacttcaacaacgagatctactgccaggaggccagctgcagcccctacgaggtgtgcgagcccaagggcaagttcttctactgcagcgccgtggagaccagcacctgcgtggtgttcggcgagccccactaccacaccttcgacggcttcctgttccacttccagggcagctgcgcctacctgctggccagacagtgcctgcagaccagcagcctgcccttcttcagcgtggaggccaagaacgagcacagaagaggcagcgccgtgagctgggtgaaggagctgagcgtggaggtgaacggctacaagatcctgatccccaagggcagctacggcagagtgaaggtgaacgacctggtgaccagcctgcccgtgaccctggacctgggcaccgtgaagatctaccagagcggcatcagcaccgccgtggagaccgacttcggcctgctggtgaccttcgacggccagcactacgccagcatcagcgtgcccggcagctacatcaacagcacctgcggcctgtgcggcaactacaacaagaaccccctggacgacttcctgagacccgacggcagacccgccatgagcgtgctggacctgggcgagagctggagagtgtaccacgccgactggaagtgcgacagcggctgcgtggacaactgcacccagtgcgacgccgccaccgaggccctgtacttcggcagcgactactgcggcttcctgaacaagaccgacggccccctgtgggagtgcggcaccgtggtggaccccaccgccttcgtgcacagctgcgtgtacgacctgtgcagcgtgagagacaacggcaccctgctgtgccaggccatccaggcctacgccctggtgtgccaggccctgggcatccccatcggcgactggagaacccagaccggctgcgtgagcaccgtgcagtgccccagcttcagccactacagcgtgtgcaccagcagctgccccgacacctgcagcgacctgaccgccagcagaaactgcgccaccccctgcaccgagggctgcgagtgcaaccagggcttcgtgctgagcaccagccagtgcgtgcccctgcacaagtgcggctgcgacttcgacggccactactacaccatgggcgagttcttctgggccaccgccaactgcaccgtgcagtgcctgtgcgaggagggcggcgacgtgtactgcttcaacaagacctgcggcagcggcgaggtgtgcgccgtggaggacggctaccagggctgcttccccaagagagagaccgtgtgcctgctgagccagaaccaggtgctgcacaccttcgacggcgccagctacgccttccccagcgagttcagctacaccctgctgaagacctgccccgagagacccgagtacctggagatcgacatcaacaagaagaagcccgacgccggccccgcctggctgagaggcctgagaatcctggtggccgaccaggaggtgaagatcggcggcatcggcgccagcgaggtgaagctgaacggccaggaggtggagctgcccttcttccaccccagcggcaagctggagatctacagaaacaagaacagcaccaccgtggagagcaagggcgtggtgaccgtgcagtacagcgacatcggcctgctgtacatcagactgagcaccacctacttcaactgcaccggcggcctgtgcggcttctacaacgccaacgccagcgacgagttctgcctgcccaacggcaagtgcaccgacaacctggccgtgttcctggagagctggaccaccttcgaggagatctgcaacggcgagtgcggcgacctgctgaaggcctgcaacaacgacagcgagctgctgaagttctacagaagcagaagcagatgcggcatcatcaacgaccccagcaacagcagcttcctggagtgccacggcgtggtgaacgtgaccgcctactacagaacctgcctgttcagactgtgccagagcggcggcaacgagagcgagctgtgcgacagcgtggccagatacgccagcgcctgcaagaacgccgacgtggaggtgggcccctggagaacctacgacttctgccccctggagtgccccgagaacagccacttcgaggagtgcatcacctgcaccgagacctgcgagaccctgaccctgggccccatctgcgtggacagctgcagcgagggctgccagtgcgacgagggctacgccctgctgggcagccagtgcgtgaccagaagcgagtgcggctgcaacttcgagggccaccagctggccaccaacgagaccttctgggtggacctggactgccagatcttctgctactgcagcggcaccgacaacagagtgcactgcgagaccatcccctgcaaggacgacgagtactgcatggaggagggcggcctgtactactgccaggccagaaccgacgccagctgcatcgtgagcggctacggccactacctgaccttcgacggcttccccttcgacttccagaccagctgccccctgatcctgtgcaccaccggcagcagacccagcagcgacagcttccccaagttcgtggtgaccgccaagaacgaggacagagaccccagcctggccctgtgggtgaagcaggtggacgtgaccgtgttcggctacagcatcgtgatccacagagcctacaagcacaccgtgctggtgaacagcgagagactgtacctgcccctgaagctgggccagggcaagatcaacatcttcagcttcggcttccacgtggtggtggagaccgacttcggcctgaaggtggtgtacgactggaagaccttcctgagcatcaccgtgcccagaagcatgcagaacagcacctacggcctgtgcggcagatacaacggcaaccccgacgacgacctggagatgcccatgggcctgctggccagcagcgtgaacgagttcggccagagctgggtgaagagagacaccttctgccaggtgggctgcggcgacagatgccccagctgcgccaaggtggagggcttcagcaaggtgcagcagctgtgcagcctgatccccaaccagaacgccgccttcagcaagtgccacagcaaggtgaaccccaccttcttctacaagaactgcctgttcgacagctgcatcgacggcggcgccgtgcagaccgcctgcagctggctgcagaactacgccagcacctgccagacccagggcatcaccgtgaccggctggagaaactacaccagctgcaccgtgacctgcccccccaacagccactacgagagctgcgtgagcgtgtgccagcccagatgcgccgccatcagactgaagagcgactgcagccactactgcgtggagggctgccactgcgacgccggctacgtgctgaacggcaagagctgcatcctgccccacagctgcggctgctacagcgacggcaagtactacgagcccaagcagctgttctggaacagcgactgcaccagaagatgcagatgcttcagaagaaacgtgatccagtgcgaccccagacagtgcaagagcgacgaggagtgcgccctgagaaacggcgtgagaggctgcttcagcaccaagaccagctactgcctggccgccggcggcggcgtgttcagaaccttcgacggcgccttcctgagattccccgccaactgcgccttcgtgctgagcaccatctgccagaagctgcccgacatcagcttccagctgatcatcaacttcgacaagtggagcgcccccaacctgaccatcatcagccccgtgtacttctacatcaacgaggagcagatcctgatcaacgacagaaacaccgtgaaggtgaacggcacccaggtgaacgtgcccttcatcaccggcctggccaccaagatctacagcagcgagggcttcctggtgatcgacaccagccccgacatccagatctactacaacggcttcaacgtgatcaagatcagcatcagcgagagactgcagaacaaggtgtgcggcctgtgcggcaacttcaacggcgacctgaccgacgactacgtgaccctgagaggcaagcccgtggtgagcagcgtggtgctggcccagagctggaagaccaacggcatgcagaagagacccctggcccccagctgcaacgagctgcagttcagccagtacgccgccatgtgcgacaacgtgcacatccagaagatgcagggcgacggctactgcctgaagctgaccgacatgaagggcttcttccagccctgctacggcctgctggaccccctgcccttctacgagagctgctacctggacggctgctacagccacaagaagttccagctgtgcggcagcctggccgcctacggcgaggcctgcagaagcttcggcatcctgagcaccgagtggatcgagaaggagaactgcagcggcgtggtggaggacccctgcgtgggcgccgactgccccaacagaacctgcgagctgggcaacggcagagagctgtgcggctgcatcgagccccccccctacggcaacaacagccacgacatcatcgacgccgaggtgacctgcaaggccgcccagatggaggtgagcatcagcaagtgcaagctgttccagctgggcttcgagagagagggcgtgagaatcaacgacagacagtgcaccggcatcgagggcgaggacttcatcagcttccagatcaacaacaccaagggcaactgcggcaacatcgtgcagagcaacggcacccacatcatgtacaagaacaccctgtggatcgagagcgccaacaacaccggcaacatcatcaccagagacagaaccatcaacgtggagttcagctgcgcctacgagctggacatcaagatcagcctggacagcgtggtgaagcccatgctgagcgtgatcaacctgaccgtgcccacccaggagggcagcttcatcaccaagatggccctgtacaagaacgccagctacaagcacccctacagacagggcgaggtggtgctgaccaccagagacgtgctgtacgtgggcgtgttcgtggtgggcgccgacgccacccacctgatcctgaccctgaacaagtgctacgccacccccaccagagacagcaacgacaagctgagatacttcatcatcgagggcggctgccagaacctgaaggacaacaccatcggcatcgaggagaacgccgtgagcctgacctgcagattccacgtgaccgtgttcaagttcatcggcgactacgacgaggtgcacctgcactgcgccgtgagcctgtgcgacagcgagaagtacagctgcaagatcacctgcccccacaacagcagaatcgccaccgactacaccaaggagcccaaggagcagatcatcagcgtgggccccatcagaagaaagagactggactggtgcgaggacaacggcggctgcgagcagatctgcaccagcagagtggacggccccctgtgcagctgcgtgaccggcaccctgcaggaggacggcaagagctgcagagccagcaacagcagcatggagctgcaggtgtggaccctgctgctgatcatgatccagatcagcctgtggcacttcgtgtacaagagcggcaccaccagctag

SEQ ID NO: 102089 - DNA, 6468 bp, Artificial Sequence; identical to SEQ ID NO: 102088
  Description of Artificial Sequence: Synthetic coding sequence

SEQ ID NO: 102090 - DNA, 1257 bp, Artificial Sequence
  Description of Artificial Sequence: Synthetic coding sequence
atggccaagctgctgcagcccccccccaagttcctgcccagcgagtggcacatcgccaacaagaaccagtaccacagagccgacgcccagagaagcagaagcgagagactggtggccgagagccagagactggtggacgagatcgagaagaccaccagaaagagccagagcgacgtgaacaagaagctggagcagagactggaggaggtgcagttctggaagaaggagctggacgacaagctggagcagctggtgaacgtgaccgacgacctgctgatctacaagatcagactggagaaggccctggagaccctgaaggagcccctgcacatcaccgagacctgcctggcctacagagagaagagaatcggcatcgacctggtgcacgacaccgtggagcacgagctgatcaaggaggccgagatcatccagggcatcatggccctgctgaccagaaccctggaggaggccagcgagcagatcagaatgaacagaagcgccaagtacaacctggagaaggacctgaaggacaagttcgtggccctgaccatcgacgacatctgcttcagcctgaacaacaacagccccaacatcagatacagcgagaacgccgtgagaatcgagcccaacagcgtgagcctggaggactggctggacttcagcagcaccaacgtggagaaggccgacaagcagagaaacaacagcctgatgctgaaggccctggtggacagaatcctgagccagaccgccaacgacctgagaaagcagtgcgacgtggtggacaccgccttcaagaacggcctgaaggacaccaaggacgccagagacaagctggccgaccacctggccaaggtgatggaggagatcgccagccaggagaagaacatcaccgccctggagaaggccatcctggaccaggagggccccgccaaggtggcccacaccagactggagaccagaacccacagacccaacgtggagctgtgcagagacgtggcccagtacagactgatgaaggaggtgcaggagatcacccacaacgtggccagactgaaggagaccctggcccaggcccaggccgagctgaagggcctgcacagaagacagctggccctgcaggaggagatccaggtgaaggagaacaccatctacatcgacgaggtgctgtgcatgcagatgagaaagagcatccccctgagagacggcgaggaccacggcgtgtgggccggcggcctgagacccgacgccgtgtgctag

SEQ ID NO: 102091 - DNA, 819 bp, Artificial Sequence
  Description of Artificial Sequence: Synthetic coding sequence
atggccctgctgaccagaaccctggaggaggccagcgagcagatcagaatgaacagaagcgccaagtacaacctggagaaggacctgaaggacaagttcgtggccctgaccatcgacgacatctgcttcagcctgaacaacaacagccccaacatcagatacagcgagaacgccgtgagaatcgagcccaacagcgtgagcctggaggactggctggacttcagcagcaccaacgtggagaaggccgacaagcagagaaacaacagcctgatgctgaaggccctggtggacagaatcctgagccagaccgccaacgacctgagaaagcagtgcgacgtggtggacaccgccttcaagaacggcctgaaggacaccaaggacgccagagacaagctggccgaccacctggccaaggtgatggaggagatcgccagccaggagaagaacatcaccgccctggagaaggccatcctggaccaggagggccccgccaaggtggcccacaccagactggagaccagaacccacagacccaacgtggagctgtgcagagacgtggcccagtacagactgatgaaggaggtgcaggagatcacccacaacgtggccagactgaaggagaccctggcccaggcccaggccgagctgaagggcctgcacagaagacagctggccctgcaggaggagatccaggtgaaggagaacaccatctacatcgacgaggtgctgtgcatgcagatgagaaagagcatccccctgagagacggcgaggaccacggcgtgtgggccggcggcctgagacccgacgccgtgtgctag

SEQ ID NO: 102092 - DNA, 1473 bp, Artificial Sequence
  Description of Artificial Sequence: Synthetic coding sequence
atggagagagtgggctgcaccctgaccaccacctacgcccaccccagacccacccccaccaacttcctgcccgccatcagcaccatggccagcagctacagagacagattcccccacagcaacctgacccacagcctgagcctgccctggagacccagcacctactacaaggtggccagcaacagccccagcgtggccccctactgcaccagaagccagagagtgagcgagaacaccatgctgcccttcgtgagcaacagaaccaccttcttcaccagatacacccccgacgactggtacagaagcaacctgaccaactaccaggagagcaacaccagcagacacaacagcgagaagctgagagtggacaccagcagactgatccaggacaagtaccagcagaccagaaagacccaggccgacaccacccagaacctgggcgagagagtgaacgacatcggcttctggaagagcgagatcatccacgagctggacgagatgatcggcgagaccaacgccctgaccgacgtgaagaagagactggagagagccctgatggagaccgaggcccccctgcaggtggccagagagtgcctgttccacagagagaagagaatgggcatcgacctggtgcacgacgaggtggaggcccagctgctgaccgaggtggacaccatcctgtgctgccaggagagaatgaagctgcacctggacaaggccatcgcccagctggccgccaacagagccagccagcacgagctggagaaggacctgagcgacaagcagaccgcctacagaatcgacgacaagtgccaccacctgagaaacaccagcgacggcgtgggctacttcagaggcgtggagagagtggacgccaccgtgagcgtgcccgagagctgggccaagttcaccgacgacaacatcctgagaagccagagcgagagagccgccagcgccaagctgagagacgacatcgagaacctgctggtggtgaccgccaacgagatgtggaaccagttcaacaaggtgaacctgagcttcaccaacagaatcgccgagaccgccgacgccaagaacaagatccagacccacctggccaagaccctgcaggagatcttccagaccgagatgaccatcgagagcatcaagaaggccatcaaggacaagaccgccttcctgaaggtggcccagaccagactggacgagagaaccagaagacccaacatcgagctgtgcagagacatggcccagctgagactggtgaacgaggtgcacgaggtggacgacaccatccagaccctgcagcagagactgagagacgccgaggacaccctgcagagcctggtgcacatcaaggccaccctggagtacgacctggccgtgaaggccaacagcctgtacatcgaccaggagaagtgcatgagcatgagaaagagctaccccaacaccctgagactggtgggcttctgctag

SEQ ID NO: 102093 - DNA, 1473 bp, Artificial Sequence; identical to SEQ ID NO: 102092
  Description of Artificial Sequence: Synthetic coding sequence

SEQ ID NO: 102094 - DNA, 444 bp, Artificial Sequence
  Description of Artificial Sequence: Synthetic coding sequence
atggagagagtgggctgcaccctgaccaccacctacgcccaccccagacccacccccaccaacttcctgcccgccatcagcaccatggccagcagctacagagacagattcccccacagcaacctgacccacagcctgagcctgccctggagacccagcacctactacaaggtggccagcaacagccccagcgtggccccctactgcaccagaagccagagagtgagcgagaacaccatgctgcccttcgtgagcaacagaaccaccttcttcaccagatacacccccgacgactggtacagaagcaacctgaccaactaccaggagagcaacaccagcagacacaacagcgagaagctgagagtggacaccagcagactgatccaggacaagtaccagcagaccagaaagacccaggccgacaccacccagaacctgggctag

SEQ ID NO: 102095 - DNA, 423 bp, Artificial Sequence
  Description of Artificial Sequence: Synthetic coding sequence
atggagagagtgggctgcaccctgaccaccacctacgcccaccccagacccacccccaccaacttcctgcccgccatcagcaccatggccagcagctacagagacagattcccccacagcaacctgacccacagcctgagcctgccctggagacccagcacctactacaaggtggccagcaacagccccagcgtggccccctactgcaccagaagccagagagtgagcgagaacaccatgctgcccttcgtgagcaacagaaccaccttcttcaccagatacacccccgacgactggtacagaagcaacctgaccaactaccaggagagcaacaccagcagacacaacagcgagaagctgagagtggacaccagcagactgatccaggacaagtaccagcagaccagaaagacccaggcctag

SEQ ID NO: 102096 - DNA, 249 bp, Artificial Sequence
  Description of Artificial Sequence: Synthetic coding sequence
atggagagagtgggctgcaccctgaccaccacctacgcccaccccagacccacccccaccaacttcctgcccgccatcagcaccatggccagcagctacagagacagattcccccacagcaacctgacccacagcctgagcctgccctggagacccagcacctactacaaggtggccagcaacagccccagcgtggccccctactgcaccagaagccagagagtgagcgagaacaccatgctgccctag

SEQ ID NO: 102097 - DNA, 2514 bp, Artificial Sequence
  Description of Artificial Sequence: Synthetic coding sequence
atggagcccgcccccagcgaggtgagactggccgtgagagaggccatccacgccctgagcagcagcgaggacggcggccacatcttctgcaccctggagagcctgaagagatacctgggcgagatggagccccccgccctgcccagagagaaggaggagttcgccagcgcccacttcagccccgtgctgagatgcctggccagcagactgagccccgcctggctggagctgctgccccacggcagactggaggagctgtgggccagcttcttcctggagggccccgccgaccaggccttcctggtgctgatggagaccatcgagggcgccgccggccccagcttcagactgatgaagatggccagactgctggccagattcctgagagagggcagactggccgtgctgatggaggcccagtgcagacagcagacccagcccggcttcatcctgctgagagagaccctgctgggcaaggtggtggccctgcccgaccacctgggcaacagactgcagcaggagaacctggccgagttcttcccccagaactacttcagactgctgggcgaggaggtggtgagagtgctgcaggccgtggtggacagcctgcagggcggcctggacagcagcgtgagcttcgtgagccaggtgctgggcaaggcctgcgtgcacggcagacagcaggagatcctgggcgtgctggtgcccagactggccgccctgacccagggcagctacctgcaccagagagtgtgctggagactggtggagcaggtgcccgacagagccatggaggccgtgctgaccggcctggtggaggccgccctgggccccgaggtgctgagcagactgctgggcaacctggtggtgaagaacaagaaggcccagttcgtgatgacccagaagctgctgttcctgcagagcagactgaccacccccatgctgcagagcctgctgggccacctggccatggacagccagagaagacccctgctgctgcaggtgctgaaggagctgctggagacctggggcagcagcagcgccatcagacacacccccctgccccagcagagacacgtgagcaaggccgtgctgatctgcctggcccagctgggcgagcccgagctgagagacagcagagacgagctgctggccagcatgatggccggcgtgaagtgcagactggacagcagcctgccccccgtgagaagactgggcatgatcgtggccgaggtggtgagcgccagaatccaccccgagggcccccccctgaagttccagtacgaggaggacgagctgagcctggagctgctggccctggccagcccccagcccgccggcgacggcgccagcgaggccggcaccagcctggtgcccgccaccgccgagccccccgccgagacccccgccgagatcgtggacggcggcgtgccccaggcccagctggccggcagcgacagcgacctggacagcgacgacgagttcgtgccctacgacatgagcggcgacagagagctgaagagcagcaaggcccccgcctacgtgagagactgcgtggaggccctgaccaccagcgaggacatcgagagatgggaggccgccctgagagccctggagggcctggtgtacagaagccccaccgccaccagagaggtgagcgtggagctggccaaggtgctgctgcacctggaggagaagacctgcgtggtgggcttcgccggcctgagacagagagccctggtggccgtgaccgtgaccgaccccgcccccgtggccgactacctgaccagccagttctacgccctgaactacagcctgagacagagaatggacatcctggacgtgctgaccctggccgcccaggagctgagcagacccggctgcctgggcagaaccccccagcccggcagccccagccccaacaccccctgcctgcccgaggccgccgtgagccagcccggcagcgccgtggccagcgactggagagtggtggtggaggagagaatcagaagcaagacccagagactgagcaagggcggccccagacagggccccgccggcagccccagcagattcaacagcgtggccggccacttcttcttccccctgctgcagagattcgacagacccctggtgaccttcgacctgctgggcgaggaccagctggtgctgggcagactggcccacaccctgggcgccctgatgtgcctggccgtgaacaccaccgtggccgtggccatgggcaaggccctgctggagttcgtgtgggccctgagattccacatcgacgcctacgtgagacagggcctgctgagcgccgtgagcagcgtgctgctgagcctgcccgccgccagactgctggaggacctgatggacgagctgctggaggccagaagctggctggccgacgtggccgagaaggaccccgacgaggactgcagaaccctggccctgagagccctgctgctgctgcagagactgaagaacagactgctgccccccgccagcccctag

SEQ ID NO: 102098 - DNA, 1083 bp, Artificial Sequence
  Description of Artificial Sequence: Synthetic coding sequence
atgatggccggcgtgaagtgcagactggacagcagcctgccccccgtgagaagactgggcatgatcgtggccgaggtggtgagcgccagaatccaccccgagggcccccccctgaagttccagtacgaggaggacgagctgagcctggagctgctggccctggccagcccccagcccgccggcgacggcgccagcgaggccggcaccagcctggtgcccgccaccgccgagccccccgccgagacccccgccgagatcgtggacggcggcgtgccccaggcccagctggccggcagcgacagcgacctggacagcgacgacgagttcgtgccctacgacatgagcggcgacagagagctgaagagcagcaaggcccccgcctacgtgagagactgcgtggaggtgctggacgtgctgaccctggccgcccaggagctgagcagacccggctgcctgggcagaaccccccagcccggcagccccagccccaacaccccctgcctgcccgaggccgccgtgagccagcccggcagcgccgtggccagcgactggagagtggtggtggaggagagaatcagaagcaagacccagagactgagcaagggcggccccagacagggccccgccggcagccccagcagattcaacagcgtggccggccacttcttcttccccctgctgcagagattcgacagacccctggtgaccttcgacctgctgggcgaggaccagctggtgctgggcagactggcccacaccctgggcgccctgatgtgcctggccgtgaacaccaccgtggccgtggccatgggcaaggccctgctggagttcgtgtgggccctgagattccacatcgacgcctacgtgagacagggcctgctgagcgccgtgagcagcgtgctgctgagcctgcccgccgccagactgctggaggacctgatggacgagctgctggaggccagaagctggctggccgacgtggccgagaaggaccccgacgaggactgcagaaccctggccctgagagccctgctgctgctgcagagactgaagaacagactgctgccccccgccagcccctag

SEQ ID NO: 102099 - DNA, 3270 bp, Artificial Sequence
  Description of Artificial Sequence: Synthetic coding sequence
atggccgtgttcgacacccccgaggaggccttcggcgtgctgagacccgtgtgcgtgcagctgaccaagacccagaccgtggagaacgtggagcacctgcagaccagactgcaggccgtgagcgacagcgccctgcaggagctgcagcagtacatcctgttccccctgagattcaccctgaagacccccggccccaagagagagagactgatccagagcgtggtggagtgcctgaccttcgtgctgagcagcacctgcgtgaaggagcaggagctgctgcaggagctgttcagcgagctgagcgcctgcctgtacagccccagcagccagaagcccgccgccgtgagcgaggagctgaagctggccgtgatccagggcctgagcaccctgatgcacagcgcctacggcgacatcatcctgaccttctacgagcccagcatcctgcccagactgggcttcgccgtgagcctgctgctgggcctggccgagcaggagaagagcaagcagatcaagatcgccgccctgaagtgcctgcaggtgctgctgctgcagtgcgactgccaggaccaccccagaagcctggacgagctggagcagaagcagctgggcgacctgttcgccagcttcctgcccggcatcagcaccgccctgaccagactgatcaccggcgacttcaagcagggccacagcatcgtggtgagcagcctgaagatcttctacaagaccgtgagcttcatcatggccgacgagcagctgaagagaatcagcaaggtgcaggccaagcccgccgtggagcacagagtggccgagctgatggtgtacagagaggccgactgggtgaagaagaccggcgacaagctgaccatcctgatcaagaagatcatcgagtgcgtgagcgtgcacccccactggaaggtgagactggagctggtggagctggtggaggacctgctgctgaagtgcagccagagcctggtggagtgcgccggccccctgctgaaggccctggtgggcctggtgaacgacgagagccccgagatccaggcccagtgcaacaaggtgctgagacacttcgccgaccagaaggtggtggtgggcaacaaggccctggccgacatcctgagcgagagcctgcacagcctggccaccagcctgcccagactgatgaacagccaggacgaccagggcaagttcagcaccctgagcctgctgctgggctacctgaagctgctgggccccaagatcaacttcgtgctgaacagcgtggcccacctgcagagactgagcaaggccctgatccaggtgctggagctggacgtggccgacatcaagatcgtggaggagagaagatggaacagcgacgacctgaacgccagccccaagaccagcgccacccagccctggaacagaatccagagaagatacttcagattcttcaccgacgagagaatcttcatgctgctgagacaggtgtgccagctgctgggctactacggcaacctgtacctgctggtggaccacttcatggagctgtaccaccagagcgtggtgtacagaaagcaggccgccatgatcctgaacgagctggtgaccggcgccgccggcctggaggtggaggacctgcacgagaagcacatcaagaccaaccccgaggagctgagagagatcgtgaccagcatcctggaggagtacaccagccaggagaactggtacctggtgacctgcctggagaccgaggagatgggcgaggagctgatgatggagcaccccggcctgcaggccatcaccagcggcgagcacacctgccaggtgaccagcttcctggccttcagcaagcccagccccaccatctgcagcatgaacagcaacatctggcagatctgcatccagctggagggcatcggccagttcgcctacgccctgggcaaggacttctgcctgctgctgatgagcgccctgtaccccgtgctggagaaggccggcgaccagaccctgctgatcagccaggtggccaccagcaccatgatggacgtgtgcagagcctgcggctacgacagcctgcagcacctgatcaaccagaacagcgactacctggtgaacggcatcagcctgaacctgagacacctggccctgcacccccacacccccaaggtgctggaggtgatgctgagaaacagcgacgccaacctgctgcccctggtggccgacgtggtgcaggacgtgctggccaccctggaccagttctacgacaagagagccgccagcttcgtgagcgtgctgcacgccctgatggccgccctggcccagtggttccccgacaccggcaacctgggccacctgcaggagcagagcctgggcgaggagggcagccacctgaaccagagacccgccgccctggagaagagcaccaccaccgccgaggacatcgagcagttcctgctgaactacctgaaggagaaggacgtggccgacggcaacgtgagcgacttcgacaacgaggaggaggagcagagcgtgccccccaaggtggacgagaacgacaccagacccgacgtggagccccccctgcccctgcagatccagatcgccatggacgtgatggagagatgcatccacctgctgagcgacaagaacctgcagatcagactgaaggtgctggacgtgctggacctgtgcgtggtggtgctgcagagccacaagaaccagctgctgcccctggcccaccaggcctggcccagcctggtgcacagactgaccagagacgcccccctggccgtgctgagagccttcaaggtgctgagaaccctgggcagcaagtgcggcgacttcctgagaagcagattctgcaaggacgtgctgcccaagctggccggcagcctggtgacccaggcccccatcagcgccagagccggccccgtgtacagccacaccctggccttcaagctgcagctggccgtgctgcagggcctgggccccctgtgcgagagactggacctgggcgagggcgacctgaacaaggtggccgacgcctgcctgatctacctgagcgtgaagcagcccgtgaagctgcaggaggccgccagaagcgtgttcctgcacctgatgaaggtggaccccgacagcacctggttcctgctgaacgagctgtactgccccgtgcagttcacccccccccaccccagcctgcaccccgtgcagctgcacggcgccagcggccagcagaacccctacaccaccaacgtgctgcagctgctgaaggagctgcagtag

SEQ ID NO: 102100 - DNA, 3270 bp, Artificial Sequence; identical to SEQ ID NO: 102099
  Description of Artificial Sequence: Synthetic coding sequence

SEQ ID NO: 102101 - DNA, 3270 bp, Artificial Sequence; identical to SEQ ID NO: 102099
  Description of Artificial Sequence: Synthetic coding sequence

SEQ ID NO: 102102 - DNA, 1527 bp, Artificial Sequence
  Description of Artificial Sequence: Synthetic coding sequence
atggagctggacagcgccctggaggcccccagccaggaggacagcaacctgagcgaggagctgagccacagcgccttcggccaggccttcagcaagatcctgcactgcctggccagacccgaggccagaagaggcaacgtgaaggacgccgtgctgaaggacctgggcgacctgatcgaggccaccgagttcgacagactgttcgagggcaccggcgccagactgagaggcatgcccgagaccctgggccaggtggccaaggccctggagaagtacgccgcccccagcaaggaggaggagggcggcggcgacggccacagcgaggccgccgagaaggccgcccaggtgggcctgctgttcctgaagctgctgggcaaggtggagaccgccaagaacagcctggtgggccccgcctggcagaccggcctgcaccacctggccggccccgtgtacatcttcgccatcacccacagcctggagcagccctggaccacccccagaagcagagaggtggccagagaggtgctgaccagcctgctgcaggtgaccgagtgcggcagcgtggccggcttcctgcacggcgagaacgaggacgagaagggcagactgagcgtgatcctgggcctgctgaagcccgacctgtacaaggagagctggaagaacaaccccgccatcaagcacgtgttcagctggaccctgcagcaggtgaccagaccctggctgagccagcacctggagagagtgctgcccgccagcctggtgatcagcgacgactaccagaccgagaacaagatcctgggcgtgcactgcctgcaccacatcgtgctgaacgtgcccgccgccgacctgctgcagtacaacagagcccaggtgctgtaccacgccatcagcaaccacctgtacacccccgagcaccacctgatccaggccgtgctgctgtgcctgctggacctgttccccatcctggagaagaccctgcactggaagggcgacggcgccagacccaccacccactgcgacgaggtgctgagactgatcctgacccacatggagcccgagcacagactgctgctgagaagaacctacgccagaaacctgcccgccttcgtgaacagactgggcatcctgaccgtgagacacctgaagagactggagagagtgatcatcggctacctggaggtgtacgacggccccgaggaggaggccagactgaagatcctggagaccctgaagctgctgatgcagcacacctggcccagagtgagctgcagactggtggtgctgctgaaggccctgctgaagctgatctgcgacgtggccagagaccccaacctgacccccgagagcgtgaagagcgccctgctgcaggaggccaccgactgcctgatcctgctggacagatgcagccagggcagagtgaagggcctgctggccaagatcccccagagctgcgaggacagaaaggtggtgaactacatcagaaaggtgcagcaggtgagcgagggcgccccctacaacggcacctag

SEQ ID NO: 102103 - DNA, 1527 bp, Artificial Sequence; identical to SEQ ID NO: 102102
  Description of Artificial Sequence: Synthetic coding sequence

SEQ ID NO: 102104 - DNA, 1494 bp, Artificial Sequence
  Description of Artificial Sequence: Synthetic coding sequence
atggagctggacagcgccctggaggcccccagccaggaggacagcaacctgagcgaggagctgagccacagcgccttcggccaggccttcagcaagatcctgcactgcctggccagacccgaggccagaagaggcaacgtgaaggacgccgtgctgaaggacctgggcgacctgatcgaggccaccgagttcgacagactgttcgagggcaccggcgccagactgagaggcatgcccgagaccctgggccaggtggccaaggccctggagaagtacgccgcccccagcaaggaggaggagggcggcggcgacggccacagcgaggccgccgagaaggccgcccaggtgggcctgctgttcctgaagctgctgggcaaggtggagaccgccaagaacagcctggtgggccccgcctggcagaccggcctgcaccacctggccggccccgtgtacatcttcgccatcacccacagcctggagcagccctggaccacccccagaagcagagaggtggccagagaggtgctgaccagcctgctgcaggtgaccgagtgcggcagcgtggccggcttcctgcacggcgagaacgaggacgagaagggcagactgagcgtgatcctgggcctgctgaagcccgacctgtacaaggagagctggaagaacaaccccgccatcaagcacgtgttcagctggaccctgcagcaggtgaccagaccctggctgagccagcacctggagagagtgctgcccgccagcctggtgatcagcgacgactaccagaccgagaacaagatcctgggcgtgcactgcctgcaccacatcgtgctgaacgtgcccgccgccgacctgctgcagtacaacagagcccaggtgctgtaccacgccatcagcaaccacctgtacacccccgagcaccacctgatccaggccgtgctgctgtgcctgctggacctgttccccatcctggagaagaccctgcactggaagggcgacggcgccagacccaccacccactgcgacgaggtgctgagactgatcctgacccacatggagcccgagcacagactgctgctgagaagaacctacgccagaaacctgcccgccttcgtgaacagactggagagagtgatcatcggctacctggaggtgtacgacggccccgaggaggaggccagactgaagatcctggagaccctgaagctgctgatgcagcacacctggcccagagtgagctgcagactggtggtgctgctgaaggccctgctgaagctgatctgcgacgtggccagagaccccaacctgacccccgagagcgtgaagagcgccctgctgcaggaggccaccgactgcctgatcctgctggacagatgcagccagggcagagtgaagggcctgctggccaagatcccccagagctgcgaggacagaaaggtggtgaactacatcagaaaggtgcagcaggtgagcgagggcgccccctacaacggcacctag

SEQ ID NO: 102105 - DNA, 306 bp, Artificial Sequence
  Description of Artificial Sequence: Synthetic coding sequence
atggagctggacagcgccctggaggcccccagccaggaggacagcaacctgagcgaggagctgagccacagcgccttcggccaggccttcagcaagatcctgcactgcctggccagacccgaggccagaagaggcaacgtgaaggacgccgtgctgaaggacctgggcgacctgatcgaggccaccgagttcgacagactgttcgagggcaccggcgccagactgagaggcatgcccgagaccctgggccaggtggccaaggccctggagaagtacgccgcccccagcaaggaggaggagggctag

SEQ ID NO: 102106 - DNA, 2424 bp, Artificial Sequence
  Description of Artificial Sequence: Synthetic coding sequence
atgcccagagcccccagatgcagagccgtgagaagcctgctgagaagccactacagagaggtgctgcccctggccaccttcgtgagaagactgggcccccagggctggagactggtgcagagaggcgaccccgccgccttcagagccctggtggcccagtgcctggtgtgcgtgccctgggacgccagacccccccccgccgcccccagcttcagacaggtgagctgcctgaaggagctggtggccagagtgctgcagagactgtgcgagagaggcgccaagaacgtgctggccttcggcttcgccctgctggacggcgccagaggcggcccccccgaggccttcaccaccagcgtgagaagctacctgcccaacaccgtgaccgacgccctgagaggcagcggcgcctggggcctgctgctgagaagagtgggcgacgacgtgctggtgcacctgctggccagatgcgccctgttcgtgctggtggcccccagctgcgcctaccaggtgtgcggcccccccctgtaccagctgggcgccgccacccaggccagaccccccccccacgccagcggccccagaagaagactgggctgcgagagagcctggaaccacagcgtgagagaggccggcgtgcccctgggcctgcccgcccccggcgccagaagaagaggcggcagcgccagcagaagcctgcccctgcccaagagacccagaagaggcgccgcccccgagcccgagagaacccccgtgggccagggcagctgggcccaccccggcagaaccagaggccccagcgacagaggcttctgcgtggtgagccccgccagacccgccgaggaggccaccagcctggagggcgccctgagcggcaccagacacagccaccccagcgtgggcagacagcaccacgccggcccccccagcaccagcagaccccccagaccctgggacaccccctgcccccccgtgtacgccgagaccaagcacttcctgtacagcagcggcgacaaggagcagctgagacccagcttcctgctgagcagcctgagacccagcctgaccggcgccagaagactggtggagaccatcttcctgggcagcagaccctggatgcccggcacccccagaagactgcccagactgccccagagatactggcagatgagacccctgttcctggagctgctgggcaaccacgcccagtgcccctacggcgtgctgctgaagacccactgccccctgagagccgccgtgacccccgccgccggcgtgtgcgccagagagaagccccagggcagcgtggccgcccccgaggaggaggacaccgaccccagaagactggtgcagctgctgagacagcacagcagcccctggcaggtgtacggcttcgtgagagcctgcctgagaagactggtgccccccggcctgtggggcagcagacacaacgagagaagattcctgagaaacaccaagaagttcatcagcctgggcaagcacgccaagctgagcctgcaggagctgacctggaagatgagcgtgagagactgcgcctggctgagaagaagccccggcgtgggctgcgtgcccgccgccgagcacagactgagagaggagatcctggccaagttcctgcactggctgatgagcgtgtacgtggtggagctgctgagaagcttcttctacgtgaccgagaccaccttccagaagaacagactgttcttctacagaaagagcgtgtggagcaagctgcagagcatcggcatcagacagcacctgaagagagtgcagctgagagagctgagcgaggccgaggtgagacagcacagagaggccagacccgccctgctgaccagcagactgagattcatccccaagcccgacggcctgagacccatcgtgaacatggactacgtggtgggcgccagaaccttcagaagagagaagagagccgagagactgaccagcagagtgaaggccctgttcagcgtgctgaactacgagagagccagaagacccggcctgctgggcgccagcgtgctgggcctggacgacatccacagagcctggagaaccttcgtgctgagagtgagagcccaggaccccccccccgagctgtacttcgtgaaggtggacgtgaccggcgcctacgacaccatcccccaggacagactgaccgaggtgatcgccagcatcatcaagccccagaacacctactgcgtgagaagatacgccgtggtgcagaaggccgcccacggccacgtgagaaaggccttcaagagccacgtgctgagacccgtgcccggcgaccccgccggcctgcaccccctgcacgccgccctgcagcccgtgctgagaagacacggcgagcaggccgtgtgcggcgacagcgccggcagagccgcccccgccttcggcggctag

SEQ ID NO: 102107 - DNA, 3399 bp, Artificial Sequence
  Description of Artificial Sequence: Synthetic coding sequence
atgcccagagcccccagatgcagagccgtgagaagcctgctgagaagccactacagagaggtgctgcccctggccaccttcgtgagaagactgggcccccagggctggagactggtgcagagaggcgaccccgccgccttcagagccctggtggcccagtgcctggtgtgcgtgccctgggacgccagacccccccccgccgcccccagcttcagacaggtgagctgcctgaaggagctggtggccagagtgctgcagagactgtgcgagagaggcgccaagaacgtgctggccttcggcttcgccctgctggacggcgccagaggcggcccccccgaggccttcaccaccagcgtgagaagctacctgcccaacaccgtgaccgacgccctgagaggcagcggcgcctggggcctgctgctgagaagagtgggcgacgacgtgctggtgcacctgctggccagatgcgccctgttcgtgctggtggcccccagctgcgcctaccaggtgtgcggcccccccctgtaccagctgggcgccgccacccaggccagaccccccccccacgccagcggccccagaagaagactgggctgcgagagagcctggaaccacagcgtgagagaggccggcgtgcccctgggcctgcccgcccccggcgccagaagaagaggcggcagcgccagcagaagcctgcccctgcccaagagacccagaagaggcgccgcccccgagcccgagagaacccccgtgggccagggcagctgggcccaccccggcagaaccagaggccccagcgacagaggcttctgcgtggtgagccccgccagacccgccgaggaggccaccagcctggagggcgccctgagcggcaccagacacagccaccccagcgtgggcagacagcaccacgccggcccccccagcaccagcagaccccccagaccctgggacaccccctgcccccccgtgtacgccgagaccaagcacttcctgtacagcagcggcgacaaggagcagctgagacccagcttcctgctgagcagcctgagacccagcctgaccggcgccagaagactggtggagaccatcttcctgggcagcagaccctggatgcccggcacccccagaagactgcccagactgccccagagatactggcagatgagacccctgttcctggagctgctgggcaaccacgcccagtgcccctacggcgtgctgctgaagacccactgccccctgagagccgccgtgacccccgccgccggcgtgtgcgccagagagaagccccagggcagcgtggccgcccccgaggaggaggacaccgaccccagaagactggtgcagctgctgagacagcacagcagcccctggcaggtgtacggcttcgtgagagcctgcctgagaagactggtgccccccggcctgtggggcagcagacacaacgagagaagattcctgagaaacaccaagaagttcatcagcctgggcaagcacgccaagctgagcctgcaggagctgacctggaagatgagcgtgagagactgcgcctggctgagaagaagccccggcgtgggctgcgtgcccgccgccgagcacagactgagagaggagatcctggccaagttcctgcactggctgatgagcgtgtacgtggtggagctgctgagaagcttcttctacgtgaccgagaccaccttccagaagaacagactgttcttctacagaaagagcgtgtggagcaagctgcagagcatcggcatcagacagcacctgaagagagtgcagctgagagagctgagcgaggccgaggtgagacagcacagagaggccagacccgccctgctgaccagcagactgagattcatccccaagcccgacggcctgagacccatcgtgaacatggactacgtggtgggcgccagaaccttcagaagagagaagagagccgagagactgaccagcagagtgaaggccctgttcagcgtgctgaactacgagagagccagaagacccggcctgctgggcgccagcgtgctgggcctggacgacatccacagagcctggagaaccttcgtgctgagagtgagagcccaggaccccccccccgagctgtacttcgtgaaggtggacgtgaccggcgcctacgacaccatcccccaggacagactgaccgaggtgatcgccagcatcatcaagccccagaacacctactgcgtgagaagatacgccgtggtgcagaaggccgcccacggccacgtgagaaaggccttcaagagccacgtgagcaccctgaccgacctgcagccctacatgagacagttcgtggcccacctgcaggagaccagccccctgagagacgccgtggtgatcgagcagagcagcagcctgaacgaggccagcagcggcctgttcgacgtgttcctgagattcatgtgccaccacgccgtgagaatcagaggcaagagctacgtgcagtgccagggcatcccccagggcagcatcctgagcaccctgctgtgcagcctgtgctacggcgacatggagaacaagctgttcgccggcatcagaagagacggcctgctgctgagactggtggacgacttcctgctggtgaccccccacctgacccacgccaagaccttcctgagaaccctggtgagaggcgtgcccgagtacggctgcgtggtgaacctgagaaagaccgtggtgaacttccccgtggaggacgaggccctgggcggcaccgccttcgtgcagatgcccgcccacggcctgttcccctggtgcggcctgctgctggacaccagaaccctggaggtgcagagcgactacagcagctacgccagaaccagcatcagagccagcctgaccttcaacagaggcttcaaggccggcagaaacatgagaagaaagctgttcggcgtgctgagactgaagtgccacagcctgttcctggacctgcaggtgaacagcctgcagaccgtgtgcaccaacatctacaagatcctgctgctgcaggcctacagattccacgcctgcgtgctgcagctgcccttccaccagcaggtgtggaagaaccccaccttcttcctgagagtgatcagcgacaccgccagcctgtgctacagcatcctgaaggccaagaacgccggcatgagcctgggcgccaagggcgccgccggccccctgcccagcgaggccgtgcagtggctgtgccaccaggccttcctgctgaagctgaccagacacagagtgacctacgtgcccctgctgggcagcctgagaaccgcccagacccagctgagcagaaagctgcccggcaccaccctgaccgccctggaggccgccgccaaccccgccctgcccagcgacttcaagaccatcctggactag

SEQ ID NO: 102108 - DNA, 3210 bp, Artificial Sequence
  Description of Artificial Sequence: Synthetic coding sequence
atgcccagagcccccagatgcagagccgtgagaagcctgctgagaagccactacagagaggtgctgcccctggccaccttcgtgagaagactgggcccccagggctggagactggtgcagagaggcgaccccgccgccttcagagccctggtggcccagtgcctggtgtgcgtgccctgggacgccagacccccccccgccgcccccagcttcagacaggtgagctgcctgaaggagctggtggccagagtgctgcagagactgtgcgagagaggcgccaagaacgtgctggccttcggcttcgccctgctggacggcgccagaggcggcccccccgaggccttcaccaccagcgtgagaagctacctgcccaacaccgtgaccgacgccctgagaggcagcggcgcctggggcctgctgctgagaagagtgggcgacgacgtgctggtgcacctgctggccagatgcgccctgttcgtgctggtggcccccagctgcgcctaccaggtgtgcggcccccccctgtaccagctgggcgccgccacccaggccagaccccccccccacgccagcggccccagaagaagactgggctgcgagagagcctggaaccacagcgtgagagaggccggcgtgcccctgggcctgcccgcccccggcgccagaagaagaggcggcagcgccagcagaagcctgcccctgcccaagagacccagaagaggcgccgcccccgagcccgagagaacccccgtgggccagggcagctgggcccaccccggcagaaccagaggccccagcgacagaggcttctgcgtggtgagccccgccagacccgccgaggaggccaccagcctggagggcgccctgagcggcaccagacacagccaccccagcgtgggcagacagcaccacgccggcccccccagcaccagcagaccccccagaccctgggacaccccctgcccccccgtgtacgccgagaccaagcacttcctgtacagcagcggcgacaaggagcagctgagacccagcttcctgctgagcagcctgagacccagcctgaccggcgccagaagactggtggagaccatcttcctgggcagcagaccctggatgcccggcacccccagaagactgcccagactgccccagagatactggcagatgagacccctgttcctggagctgctgggcaaccacgcccagtgcccctacggcgtgctgctgaagacccactgccccctgagagccgccgtgacccccgccgccggcgtgtgcgccagagagaagccccagggcagcgtggccgcccccgaggaggaggacaccgaccccagaagactggtgcagctgctgagacagcacagcagcccctggcaggtgtacggcttcgtgagagcctgcctgagaagactggtgccccccggcctgtggggcagcagacacaacgagagaagattcctgagaaacaccaagaagttcatcagcctgggcaagcacgccaagctgagcctgcaggagctgacctggaagatgagcgtgagagactgcgcctggctgagaagaagccccggcgtgggctgcgtgcccgccgccgagcacagactgagagaggagatcctggccaagttcctgcactggctgatgagcgtgtacgtggtggagctgctgagaagcttcttctacgtgaccgagaccaccttccagaagaacagactgttcttctacagaaagagcgtgtggagcaagctgcagagcatcggcatcagacagcacctgaagagagtgcagctgagagagctgagcgaggccgaggtgagacagcacagagaggccagacccgccctgctgaccagcagactgagattcatccccaagcccgacggcctgagacccatcgtgaacatggactacgtggtgggcgccagaaccttcagaagagagaagagagccgagagactgaccagcagagtgaaggccctgttcagcgtgctgaactacgagagagccagaagacccggcctgctgggcgccagcgtgctgggcctggacgacatccacagagcctggagaaccttcgtgctgagagtgagagcccaggaccccccccccgagctgtacttcgtgaaggtggacgtgaccggcgcctacgacaccatcccccaggacagactgaccgaggtgatcgccagcatcatcaagccccagaacacctactgcgtgagaagatacgccgtggtgcagaaggccgcccacggccacgtgagaaaggccttcaagagccacgtgagcaccctgaccgacctgcagccctacatgagacagttcgtggcccacctgcaggagaccagccccctgagagacgccgtggtgatcgagcagagcagcagcctgaacgaggccagcagcggcctgttcgacgtgttcctgagattcatgtgccaccacgccgtgagaatcagaggcaagagctacgtgcagtgccagggcatcccccagggcagcatcctgagcaccctgctgtgcagcctgtgctacggcgacatggagaacaagctgttcgccggcatcagaagagacggcctgctgctgagactggtggacgacttcctgctggtgaccccccacctgacccacgccaagaccttcctgagctacgccagaaccagcatcagagccagcctgaccttcaacagaggcttcaaggccggcagaaacatgagaagaaagctgttcggcgtgctgagactgaagtgccacagcctgttcctggacctgcaggtgaacagcctgcagaccgtgtgcaccaacatctacaagatcctgctgctgcaggcctacagattccacgcctgcgtgctgcagctgcccttccaccagcaggtgtggaagaaccccaccttcttcctgagagtgatcagcgacaccgccagcctgtgctacagcatcctgaaggccaagaacgccggcatgagcctgggcgccaagggcgccgccggccccctgcccagcgaggccgtgcagtggctgtgccaccaggccttcctgctgaagctgaccagacacagagtgacctacgtgcccctgctgggcagcctgagaaccgcccagacccagctgagcagaaagctgcccggcaccaccctgaccgccctggaggccgccgccaaccccgccctgcccagcgacttcaagaccatcctggactag

SEQ ID NO: 102109 - DNA, 2424 bp, Artificial Sequence; identical to SEQ ID NO: 102106
  Description of Artificial Sequence: Synthetic coding sequence

SEQ ID NO: 102110 - DNA, 372 bp, Artificial Sequence
  Description of Artificial Sequence: Synthetic coding sequence
atgatgctgcccaagcccggcacctactacctgccctgggaggtgagcgccggccaggtgcccgacggcagcaccctgagaaccttcggcagactgtgcctgtacgacatgatccagagcagagtgaccctgatggcccagcacggcagcgaccagcaccaggtgctggtgtgcaccaagctggtggagcccttccacgcccaggtgggcagcctgtacatcgtgctgggcgagctgcagcaccagcaggacagaggcagcgtggtgaaggccagagtgctgacctgcgtggagggcatgaacctgcccctgctggagcaggccatcagagagcagagactgtacaagcaggagagaggcggcagccagtag

SEQ ID NO: 102111 - DNA, 369 bp, Artificial Sequence
  Description of Artificial Sequence: Synthetic coding sequence
atgctgcccaagcccggcacctactacctgccctgggaggtgagcgccggccaggtgcccgacggcagcaccctgagaaccttcggcagactgtgcctgtacgacatgatccagagcagagtgaccctgatggcccagcacggcagcgaccagcaccaggtgctggtgtgcaccaagctggtggagcccttccacgcccaggtgggcagcctgtacatcgtgctgggcgagctgcagcaccagcaggacagaggcagcgtggtgaaggccagagtgctgacctgcgtggagggcatgaacctgcccctgctggagcaggccatcagagagcagagactgtacaagcaggagagaggcggcagccagtag

SEQ ID NO: 102112 - DNA, 5514 bp, Artificial Sequence
  Description of Artificial Sequence: Synthetic coding sequence
atgggcgccatgacccagctgctggccggcgtgttcctggccttcctggccctggccaccgagggcggcgtgctgaagaaggtgatcagacacaagagacagagcggcgtgaacgccaccctgcccgaggagaaccagcccgtggtgttcaaccacgtgtacaacatcaagctgcccgtgggcagccagtgcagcgtggacctggagagcgccagcggcgagaaggacctggccccccccagcgagcccagcgagagcttccaggagcacaccgtggacggcgagaaccagatcgtgttcacccacagaatcaacatccccagaagagcctgcggctgcgccgccgcccccgacgtgaaggagctgctgagcagactggaggagctggagaacctggtgagcagcctgagagagcagtgcaccgccggcgccggctgctgcctgcagcccgccaccggcagactggacaccagacccttctgcagcggcagaggcaacttcagcaccgagggctgcggctgcgtgtgcgagcccggctggaagggccccaactgcagcgagcccgagtgccccggcaactgccacctgagaggcagatgcatcgacggccagtgcatctgcgacgacggcttcaccggcgaggactgcagccagctggcctgccccagcgactgcaacgaccagggcaagtgcgtgaacggcgtgtgcatctgcttcgagggctacgccggcgccgactgcagcagagagatctgccccgtgccctgcagcgaggagcacggcacctgcgtggacggcctgtgcgtgtgccacgacggcttcgccggcgacgactgcaacaagcccctgtgcctgaacaactgctacaacagaggcagatgcgtggagaacgagtgcgtgtgcgacgagggcttcaccggcgaggactgcagcgagctgatctgccccaacgactgcttcgacagaggcagatgcatcaacggcacctgctactgcgaggagggcttcaccggcgaggactgcggcaagcccacctgcccccacgcctgccacacccagggcagatgcgaggagggccagtgcgtgtgcgacgagggcttcgccggcgtggactgcagcgagaagagatgccccgccgactgccacaacagaggcagatgcgtggacggcagatgcgagtgcgacgacggcttcaccggcgccgactgcggcgagctgaagtgccccaacggctgcagcggccacggcagatgcgtgaacggccagtgcgtgtgcgacgagggctacaccggcgaggactgcagccagctgagatgccccaacgactgccacagcagaggcagatgcgtggagggcaagtgcgtgtgcgagcagggcttcaagggctacgactgcagcgacatgagctgccccaacgactgccaccagcacggcagatgcgtgaacggcatgtgcgtgtgcgacgacggctacaccggcgaggactgcagagacagacagtgccccagagactgcagcaacagaggcctgtgcgtggacggccagtgcgtgtgcgaggacggcttcaccggccccgactgcgccgagctgagctgccccaacgactgccacggccagggcagatgcgtgaacggccagtgcgtgtgccacgagggcttcatgggcaaggactgcaaggagcagagatgccccagcgactgccacggccagggcagatgcgtggacggccagtgcatctgccacgagggcttcaccggcctggactgcggccagcacagctgccccagcgactgcaacaacctgggccagtgcgtgagcggcagatgcatctgcaacgagggctacagcggcgaggactgcagcgaggtgagcccccccaaggacctggtggtgaccgaggtgaccgaggagaccgtgaacctggcctgggacaacgagatgagagtgaccgagtacctggtggtgtacacccccacccacgagggcggcctggagatgcagttcagagtgcccggcgaccagaccagcaccatcatccaggagctggagcccggcgtggagtacttcatcagagtgttcgccatcctggagaacaagaagagcatccccgtgagcgccagagtggccacctacctgcccgcccccgagggcctgaagttcaagagcatcaaggagaccagcgtggaggtggagtgggaccccctggacatcgccttcgagacctgggagatcatcttcagaaacatgaacaaggaggacgagggcgagatcaccaagagcctgagaagacccgagaccagctacagacagaccggcctggcccccggccaggagtacgagatcagcctgcacatcgtgaagaacaacaccagaggccccggcctgaagagagtgaccaccaccagactggacgcccccagccagatcgaggtgaaggacgtgaccgacaccaccgccctgatcacctggttcaagcccctggccgagatcgacggcatcgagctgacctacggcatcaaggacgtgcccggcgacagaaccaccatcgacctgaccgaggacgagaaccagtacagcatcggcaacctgaagcccgacaccgagtacgaggtgagcctgatcagcagaagaggcgacatgagcagcaaccccgccaaggagaccttcaccaccggcctggacgcccccagaaacctgagaagagtgagccagaccgacaacagcatcaccctggagtggagaaacggcaaggccgccatcgacagctacagaatcaagtacgcccccatcagcggcggcgaccacgccgaggtggacgtgcccaagagccagcaggccaccaccaagaccaccctgaccggcctgagacccggcaccgagtacggcatcggcgtgagcgccgtgaaggaggacaaggagagcaaccccgccaccatcaacgccgccaccgagctggacacccccaaggacctgcaggtgagcgagaccgccgagaccagcctgaccctgctgtggaagacccccctggccaagttcgacagatacagactgaactacagcctgcccaccggccagtgggtgggcgtgcagctgcccagaaacaccaccagctacgtgctgagaggcctggagcccggccaggagtacaacgtgctgctgaccgccgagaagggcagacacaagagcaagcccgccagagtgaaggccagcaccgccaaggagcccgagatcggcaacctgaacgtgagcgacatcacccccgagagcttcaacctgagctggatggccaccgacggcatcttcgagaccttcaccatcgagatcatcgacagcaacagactgctggagaccgtggagtacaacatcagcggcgccgagagaaccgcccacatcagcggcctgccccccagcaccgacttcatcgtgtacctgagcggcctggcccccagcatcagaaccaagaccatcagcgccaccgccaccaccgaggccctgcccctgctggagaacctgaccatcagcgacatcaacccctacggcttcaccgtgagctggatggccagcgagaacgccttcgacagcttcctggtgaccgtggtggacagcggcaagctgctggacccccaggagttcaccctgagcggcacccagagaaagctggagctgagaggcctgatcaccggcatcggctacgaggtgatggtgagcggcttcacccagggccaccagaccaagcccctgagagccgagatcgtgaccgaggccgagcccgaggtggacaacctgctggtgagcgacgccacccccgacggcttcagactgagctggaccgccgacgagggcgtgttcgacaacttcgtgctgaagatcagagacaccaagaagcagagcgagcccctggagatcaccctgctggcccccgagagaaccagagacatcaccggcctgagagaggccaccgagtacgagatcgagctgtacggcatcagcaagggcagaagaagccagaccgtgagcgccatcgccaccaccgccatgggcagccccaaggaggtgatcttcagcgacatcaccgagaacagcgccaccgtgagctggagagcccccaccgcccaggtggagagcttcagaatcacctacgtgcccatcaccggcggcacccccagcatggtgaccgtggacggcaccaagacccagaccagactggtgaagctgatccccggcgtggagtacctggtgagcatcatcgccatgaagggcttcgaggagagcgagcccgtgagcggcagcttcaccaccgccctggacggccccagcggcctggtgaccgccaacatcaccgacagcgaggccctggccagatggcagcccgccatcgccaccgtggacagctacgtgatcagctacaccggcgagaaggtgcccgagatcaccagaaccgtgagcggcaacaccgtggagtacgccctgaccgacctggagcccgccaccgagtacaccctgagaatcttcgccgagaagggcccccagaagagcagcaccatcaccgccaagttcaccaccgacctggacagccccagagacctgaccgccaccgaggtgcagagcgagaccgccctgctgacctggagaccccccagagccagcgtgaccggctacctgctggtgtacgagagcgtggacggcaccgtgaaggaggtgatcgtgggccccgacaccaccagctacagcctggccgacctgagccccagcacccactacaccgccaagatccaggccctgaacggccccctgagaagcaacatgatccagaccatcttcaccaccatcggcctgctgtaccccttccccaaggactgcagccaggccatgctgaacggcgacaccaccagcggcctgtacaccatctacctgaacggcgacaaggccgaggccctggaggtgttctgcgacatgaccagcgacggcggcggctggatcgtgttcctgagaagaaagaacggcagagagaacttctaccagaactggaaggcctacgccgccggcttcggcgacagaagagaggagttctggctgggcctggacaacctgaacaagatcaccgcccagggccagtacgagctgagagtggacctgagagaccacggcgagaccgccttcgccgtgtacgacaagttcagcgtgggcgacgccaagaccagatacaagctgaaggtggagggctacagcggcaccgccggcgacagcatggcctaccacaacggcagaagcttcagcaccttcgacaaggacaccgacagcgccatcaccaactgcgccctgagctacaagggcgccttctggtacagaaactgccacagagtgaacctgatgggcagatacggcgacaacaaccacagccagggcgtgaactggttccactggaagggccacgagcacagcatccagttcgccgagatgaagctgagacccagcaacttcagaaacctggagggcagaagaaagagagcctag

SEQ ID NO: 102113 - DNA, 4695 bp, Artificial Sequence
  Description of Artificial Sequence: Synthetic coding sequence
atgggcgccatgacccagctgctggccggcgtgttcctggccttcctggccctggccaccgagggcggcgtgctgaagaaggtgatcagacacaagagacagagcggcgtgaacgccaccctgcccgaggagaaccagcccgtggtgttcaaccacgtgtacaacatcaagctgcccgtgggcagccagtgcagcgtggacctggagagcgccagcggcgagaaggacctggccccccccagcgagcccagcgagagcttccaggagcacaccgtggacggcgagaaccagatcgtgttcacccacagaatcaacatccccagaagagcctgcggctgcgccgccgcccccgacgtgaaggagctgctgagcagactggaggagctggagaacctggtgagcagcctgagagagcagtgcaccgccggcgccggctgctgcctgcagcccgccaccggcagactggacaccagacccttctgcagcggcagaggcaacttcagcaccgagggctgcggctgcgtgtgcgagcccggctggaagggccccaactgcagcgagcccgagtgccccggcaactgccacctgagaggcagatgcatcgacggccagtgcatctgcgacgacggcttcaccggcgaggactgcagccagctggcctgccccagcgactgcaacgaccagggcaagtgcgtgaacggcgtgtgcatctgcttcgagggctacgccggcgccgactgcagcagagagatctgccccgtgccctgcagcgaggagcacggcacctgcgtggacggcctgtgcgtgtgccacgacggcttcgccggcgacgactgcaacaagcccctgtgcctgaacaactgctacaacagaggcagatgcgtggagaacgagtgcgtgtgcgacgagggcttcaccggcgaggactgcagcgagctgatctgccccaacgactgcttcgacagaggcagatgcatcaacggcacctgctactgcgaggagggcttcaccggcgaggactgcggcaagcccacctgcccccacgcctgccacacccagggcagatgcgaggagggccagtgcgtgtgcgacgagggcttcgccggcgtggactgcagcgagaagagatgccccgccgactgccacaacagaggcagatgcgtggacggcagatgcgagtgcgacgacggcttcaccggcgccgactgcggcgagctgaagtgccccaacggctgcagcggccacggcagatgcgtgaacggccagtgcgtgtgcgacgagggctacaccggcgaggactgcagccagctgagatgccccaacgactgccacagcagaggcagatgcgtggagggcaagtgcgtgtgcgagcagggcttcaagggctacgactgcagcgacatgagctgccccaacgactgccaccagcacggcagatgcgtgaacggcatgtgcgtgtgcgacgacggctacaccggcgaggactgcagagacagacagtgccccagagactgcagcaacagaggcctgtgcgtggacggccagtgcgtgtgcgaggacggcttcaccggccccgactgcgccgagctgagctgccccaacgactgccacggccagggcagatgcgtgaacggccagtgcgtgtgccacgagggcttcatgggcaaggactgcaaggagcagagatgccccagcgactgccacggccagggcagatgcgtggacggccagtgcatctgccacgagggcttcaccggcctggactgcggccagcacagctgccccagcgactgcaacaacctgggccagtgcgtgagcggcagatgcatctgcaacgagggctacagcggcgaggactgcagcgaggtgagcccccccaaggacctggtggtgaccgaggtgaccgaggagaccgtgaacctggcctgggacaacgagatgagagtgaccgagtacctggtggtgtacacccccacccacgagggcggcctggagatgcagttcagagtgcccggcgaccagaccagcaccatcatccaggagctggagcccggcgtggagtacttcatcagagtgttcgccatcctggagaacaagaagagcatccccgtgagcgccagagtggccacctacctgcccgcccccgagggcctgaagttcaagagcatcaaggagaccagcgtggaggtggagtgggaccccctggacatcgccttcgagacctgggagatcatcttcagaaacatgaacaaggaggacgagggcgagatcaccaagagcctgagaagacccgagaccagctacagacagaccggcctggcccccggccaggagtacgagatcagcctgcacatcgtgaagaacaacaccagaggccccggcctgaagagagtgaccaccaccagactggacgcccccagccagatcgaggtgaaggacgtgaccgacaccaccgccctgatcacctggttcaagcccctggccgagatcgacggcatcgagctgacctacggcatcaaggacgtgcccggcgacagaaccaccatcgacctgaccgaggacgagaaccagtacagcatcggcaacctgaagcccgacaccgagtacgaggtgagcctgatcagcagaagaggcgacatgagcagcaaccccgccaaggagaccttcaccaccggcctggacgcccccagaaacctgagaagagtgagccagaccgacaacagcatcaccctggagtggagaaacggcaaggccgccatcgacagctacagaatcaagtacgcccccatcagcggcggcgaccacgccgaggtggacgtgcccaagagccagcaggccaccaccaagaccaccctgaccggcctgagacccggcaccgagtacggcatcggcgtgagcgccgtgaaggaggacaaggagagcaaccccgccaccatcaacgccgccaccgagctggacacccccaaggacctgcaggtgagcgagaccgccgagaccagcctgaccctgctgtggaagacccccctggccaagttcgacagatacagactgaactacagcctgcccaccggccagtgggtgggcgtgcagctgcccagaaacaccaccagctacgtgctgagaggcctggagcccggccaggagtacaacgtgctgctgaccgccgagaagggcagacacaagagcaagcccgccagagtgaaggccagcaccgccatgggcagccccaaggaggtgatcttcagcgacatcaccgagaacagcgccaccgtgagctggagagcccccaccgcccaggtggagagcttcagaatcacctacgtgcccatcaccggcggcacccccagcatggtgaccgtggacggcaccaagacccagaccagactggtgaagctgatccccggcgtggagtacctggtgagcatcatcgccatgaagggcttcgaggagagcgagcccgtgagcggcagcttcaccaccgccctggacggccccagcggcctggtgaccgccaacatcaccgacagcgaggccctggccagatggcagcccgccatcgccaccgtggacagctacgtgatcagctacaccggcgagaaggtgcccgagatcaccagaaccgtgagcggcaacaccgtggagtacgccctgaccgacctggagcccgccaccgagtacaccctgagaatcttcgccgagaagggcccccagaagagcagcaccatcaccgccaagttcaccaccgacctggacagccccagagacctgaccgccaccgaggtgcagagcgagaccgccctgctgacctggagaccccccagagccagcgtgaccggctacctgctggtgtacgagagcgtggacggcaccgtgaaggaggtgatcgtgggccccgacaccaccagctacagcctggccgacctgagccccagcacccactacaccgccaagatccaggccctgaacggccccctgagaagcaacatgatccagaccatcttcaccaccatcggcctgctgtaccccttccccaaggactgcagccaggccatgctgaacggcgacaccaccagcggcctgtacaccatctacctgaacggcgacaaggccgaggccctggaggtgttctgcgacatgaccagcgacggcggcggctggatcgtgttcctgagaagaaagaacggcagagagaacttctaccagaactggaaggcctacgccgccggcttcggcgacagaagagaggagttctggctgggcctggacaacctgaacaagatcaccgcccagggccagtacgagctgagagtggacctgagagaccacggcgagaccgccttcgccgtgtacgacaagttcagcgtgggcgacgccaagaccagatacaagctgaaggtggagggctacagcggcaccgccggcgacagcatggcctaccacaacggcagaagcttcagcaccttcgacaaggacaccgacagcgccatcaccaactgcgccctgagctacaagggcgccttctggtacagaaactgccacagagtgaacctgatgggcagatacggcgacaacaaccacagccagggcgtgaactggttccactggaagggccacgagcacagcatccagttcgccgagatgaagctgagacccagcaacttcagaaacctggagggcagaagaaagagagcctag

SEQ ID NO: 102114 - DNA, 4968 bp, Artificial Sequence
  Description of Artificial Sequence: Synthetic coding sequence
atgggcgccatgacccagctgctggccggcgtgttcctggccttcctggccctggccaccgagggcggcgtgctgaagaaggtgatcagacacaagagacagagcggcgtgaacgccaccctgcccgaggagaaccagcccgtggtgttcaaccacgtgtacaacatcaagctgcccgtgggcagccagtgcagcgtggacctggagagcgccagcggcgagaaggacctggccccccccagcgagcccagcgagagcttccaggagcacaccgtggacggcgagaaccagatcgtgttcacccacagaatcaacatccccagaagagcctgcggctgcgccgccgcccccgacgtgaaggagctgctgagcagactggaggagctggagaacctggtgagcagcctgagagagcagtgcaccgccggcgccggctgctgcctgcagcccgccaccggcagactggacaccagacccttctgcagcggcagaggcaacttcagcaccgagggctgcggctgcgtgtgcgagcccggctggaagggccccaactgcagcgagcccgagtgccccggcaactgccacctgagaggcagatgcatcgacggccagtgcatctgcgacgacggcttcaccggcgaggactgcagccagctggcctgccccagcgactgcaacgaccagggcaagtgcgtgaacggcgtgtgcatctgcttcgagggctacgccggcgccgactgcagcagagagatctgccccgtgccctgcagcgaggagcacggcacctgcgtggacggcctgtgcgtgtgccacgacggcttcgccggcgacgactgcaacaagcccctgtgcctgaacaactgctacaacagaggcagatgcgtggagaacgagtgcgtgtgcgacgagggcttcaccggcgaggactgcagcgagctgatctgccccaacgactgcttcgacagaggcagatgcatcaacggcacctgctactgcgaggagggcttcaccggcgaggactgcggcaagcccacctgcccccacgcctgccacacccagggcagatgcgaggagggccagtgcgtgtgcgacgagggcttcgccggcgtggactgcagcgagaagagatgccccgccgactgccacaacagaggcagatgcgtggacggcagatgcgagtgcgacgacggcttcaccggcgccgactgcggcgagctgaagtgccccaacggctgcagcggccacggcagatgcgtgaacggccagtgcgtgtgcgacgagggctacaccggcgaggactgcagccagctgagatgccccaacgactgccacagcagaggcagatgcgtggagggcaagtgcgtgtgcgagcagggcttcaagggctacgactgcagcgacatgagctgccccaacgactgccaccagcacggcagatgcgtgaacggcatgtgcgtgtgcgacgacggctacaccggcgaggactgcagagacagacagtgccccagagactgcagcaacagaggcctgtgcgtggacggccagtgcgtgtgcgaggacggcttcaccggccccgactgcgccgagctgagctgccccaacgactgccacggccagggcagatgcgtgaacggccagtgcgtgtgccacgagggcttcatgggcaaggactgcaaggagcagagatgccccagcgactgccacggccagggcagatgcgtggacggccagtgcatctgccacgagggcttcaccggcctggactgcggccagcacagctgccccagcgactgcaacaacctgggccagtgcgtgagcggcagatgcatctgcaacgagggctacagcggcgaggactgcagcgaggtgagcccccccaaggacctggtggtgaccgaggtgaccgaggagaccgtgaacctggcctgggacaacgagatgagagtgaccgagtacctggtggtgtacacccccacccacgagggcggcctggagatgcagttcagagtgcccggcgaccagaccagcaccatcatccaggagctggagcccggcgtggagtacttcatcagagtgttcgccatcctggagaacaagaagagcatccccgtgagcgccagagtggccacctacctgcccgcccccgagggcctgaagttcaagagcatcaaggagaccagcgtggaggtggagtgggaccccctggacatcgccttcgagacctgggagatcatcttcagaaacatgaacaaggaggacgagggcgagatcaccaagagcctgagaagacccgagaccagctacagacagaccggcctggcccccggccaggagtacgagatcagcctgcacatcgtgaagaacaacaccagaggccccggcctgaagagagtgaccaccaccagactggacgcccccagccagatcgaggtgaaggacgtgaccgacaccaccgccctgatcacctggttcaagcccctggccgagatcgacggcatcgagctgacctacggcatcaaggacgtgcccggcgacagaaccaccatcgacctgaccgaggacgagaaccagtacagcatcggcaacctgaagcccgacaccgagtacgaggtgagcctgatcagcagaagaggcgacatgagcagcaaccccgccaaggagaccttcaccaccggcctggacgcccccagaaacctgagaagagtgagccagaccgacaacagcatcaccctggagtggagaaacggcaaggccgccatcgacagctacagaatcaagtacgcccccatcagcggcggcgaccacgccgaggtggacgtgcccaagagccagcaggccaccaccaagaccaccctgaccggcctgagacccggcaccgagtacggcatcggcgtgagcgccgtgaaggaggacaaggagagcaaccccgccaccatcaacgccgccaccgagctggacacccccaaggacctgcaggtgagcgagaccgccgagaccagcctgaccctgctgtggaagacccccctggccaagttcgacagatacagactgaactacagcctgcccaccggccagtgggtgggcgtgcagctgcccagaaacaccaccagctacgtgctgagaggcctggagcccggccaggagtacaacgtgctgctgaccgccgagaagggcagacacaagagcaagcccgccagagtgaaggccagcaccgaggccgagcccgaggtggacaacctgctggtgagcgacgccacccccgacggcttcagactgagctggaccgccgacgagggcgtgttcgacaacttcgtgctgaagatcagagacaccaagaagcagagcgagcccctggagatcaccctgctggcccccgagagaaccagagacatcaccggcctgagagaggccaccgagtacgagatcgagctgtacggcatcagcaagggcagaagaagccagaccgtgagcgccatcgccaccaccgccatgggcagccccaaggaggtgatcttcagcgacatcaccgagaacagcgccaccgtgagctggagagcccccaccgcccaggtggagagcttcagaatcacctacgtgcccatcaccggcggcacccccagcatggtgaccgtggacggcaccaagacccagaccagactggtgaagctgatccccggcgtggagtacctggtgagcatcatcgccatgaagggcttcgaggagagcgagcccgtgagcggcagcttcaccaccgccctggacggccccagcggcctggtgaccgccaacatcaccgacagcgaggccctggccagatggcagcccgccatcgccaccgtggacagctacgtgatcagctacaccggcgagaaggtgcccgagatcaccagaaccgtgagcggcaacaccgtggagtacgccctgaccgacctggagcccgccaccgagtacaccctgagaatcttcgccgagaagggcccccagaagagcagcaccatcaccgccaagttcaccaccgacctggacagccccagagacctgaccgccaccgaggtgcagagcgagaccgccctgctgacctggagaccccccagagccagcgtgaccggctacctgctggtgtacgagagcgtggacggcaccgtgaaggaggtgatcgtgggccccgacaccaccagctacagcctggccgacctgagccccagcacccactacaccgccaagatccaggccctgaacggccccctgagaagcaacatgatccagaccatcttcaccaccatcggcctgctgtaccccttccccaaggactgcagccaggccatgctgaacggcgacaccaccagcggcctgtacaccatctacctgaacggcgacaaggccgaggccctggaggtgttctgcgacatgaccagcgacggcggcggctggatcgtgttcctgagaagaaagaacggcagagagaacttctaccagaactggaaggcctacgccgccggcttcggcgacagaagagaggagttctggctgggcctggacaacctgaacaagatcaccgcccagggccagtacgagctgagagtggacctgagagaccacggcgagaccgccttcgccgtgtacgacaagttcagcgtgggcgacgccaagaccagatacaagctgaaggtggagggctacagcggcaccgccggcgacagcatggcctaccacaacggcagaagcttcagcaccttcgacaaggacaccgacagcgccatcaccaactgcgccctgagctacaagggcgccttctggtacagaaactgccacagagtgaacctgatgggcagatacggcgacaacaaccacagccagggcgtgaactggttccactggaagggccacgagcacagcatccagttcgccgagatgaagctgagacccagcaacttcagaaacctggagggcagaagaaagagagcctag

SEQ ID NO: 102115 - DNA, 6606 bp, Artificial Sequence
  Description of Artificial Sequence: Synthetic coding sequence
atgggcgccatgacccagctgctggccggcgtgttcctggccttcctggccctggccaccgagggcggcgtgctgaagaaggtgatcagacacaagagacagagcggcgtgaacgccaccctgcccgaggagaaccagcccgtggtgttcaaccacgtgtacaacatcaagctgcccgtgggcagccagtgcagcgtggacctggagagcgccagcggcgagaaggacctggccccccccagcgagcccagcgagagcttccaggagcacaccgtggacggcgagaaccagatcgtgttcacccacagaatcaacatccccagaagagcctgcggctgcgccgccgcccccgacgtgaaggagctgctgagcagactggaggagctggagaacctggtgagcagcctgagagagcagtgcaccgccggcgccggctgctgcctgcagcccgccaccggcagactggacaccagacccttctgcagcggcagaggcaacttcagcaccgagggctgcggctgcgtgtgcgagcccggctggaagggccccaactgcagcgagcccgagtgccccggcaactgccacctgagaggcagatgcatcgacggccagtgcatctgcgacgacggcttcaccggcgaggactgcagccagctggcctgccccagcgactgcaacgaccagggcaagtgcgtgaacggcgtgtgcatctgcttcgagggctacgccggcgccgactgcagcagagagatctgccccgtgccctgcagcgaggagcacggcacctgcgtggacggcctgtgcgtgtgccacgacggcttcgccggcgacgactgcaacaagcccctgtgcctgaacaactgctacaacagaggcagatgcgtggagaacgagtgcgtgtgcgacgagggcttcaccggcgaggactgcagcgagctgatctgccccaacgactgcttcgacagaggcagatgcatcaacggcacctgctactgcgaggagggcttcaccggcgaggactgcggcaagcccacctgcccccacgcctgccacacccagggcagatgcgaggagggccagtgcgtgtgcgacgagggcttcgccggcgtggactgcagcgagaagagatgccccgccgactgccacaacagaggcagatgcgtggacggcagatgcgagtgcgacgacggcttcaccggcgccgactgcggcgagctgaagtgccccaacggctgcagcggccacggcagatgcgtgaacggccagtgcgtgtgcgacgagggctacaccggcgaggactgcagccagctgagatgccccaacgactgccacagcagaggcagatgcgtggagggcaagtgcgtgtgcgagcagggcttcaagggctacgactgcagcgacatgagctgccccaacgactgccaccagcacggcagatgcgtgaacggcatgtgcgtgtgcgacgacggctacaccggcgaggactgcagagacagacagtgccccagagactgcagcaacagaggcctgtgcgtggacggccagtgcgtgtgcgaggacggcttcaccggccccgactgcgccgagctgagctgccccaacgactgccacggccagggcagatgcgtgaacggccagtgcgtgtgccacgagggcttcatgggcaaggactgcaaggagcagagatgccccagcgactgccacggccagggcagatgcgtggacggccagtgcatctgccacgagggcttcaccggcctggactgcggccagcacagctgccccagcgactgcaacaacctgggccagtgcgtgagcggcagatgcatctgcaacgagggctacagcggcgaggactgcagcgaggtgagcccccccaaggacctggtggtgaccgaggtgaccgaggagaccgtgaacctggcctgggacaacgagatgagagtgaccgagtacctggtggtgtacacccccacccacgagggcggcctggagatgcagttcagagtgcccggcgaccagaccagcaccatcatccaggagctggagcccggcgtggagtacttcatcagagtgttcgccatcctggagaacaagaagagcatccccgtgagcgccagagtggccacctacctgcccgcccccgagggcctgaagttcaagagcatcaaggagaccagcgtggaggtggagtgggaccccctggacatcgccttcgagacctgggagatcatcttcagaaacatgaacaaggaggacgagggcgagatcaccaagagcctgagaagacccgagaccagctacagacagaccggcctggcccccggccaggagtacgagatcagcctgcacatcgtgaagaacaacaccagaggccccggcctgaagagagtgaccaccaccagactggacgcccccagccagatcgaggtgaaggacgtgaccgacaccaccgccctgatcacctggttcaagcccctggccgagatcgacggcatcgagctgacctacggcatcaaggacgtgcccggcgacagaaccaccatcgacctgaccgaggacgagaaccagtacagcatcggcaacctgaagcccgacaccgagtacgaggtgagcctgatcagcagaagaggcgacatgagcagcaaccccgccaaggagaccttcaccaccggcctggacgcccccagaaacctgagaagagtgagccagaccgacaacagcatcaccctggagtggagaaacggcaaggccgccatcgacagctacagaatcaagtacgcccccatcagcggcggcgaccacgccgaggtggacgtgcccaagagccagcaggccaccaccaagaccaccctgaccggcctgagacccggcaccgagtacggcatcggcgtgagcgccgtgaaggaggacaaggagagcaaccccgccaccatcaacgccgccaccgagctggacacccccaaggacctgcaggtgagcgagaccgccgagaccagcctgaccctgctgtggaagacccccctggccaagttcgacagatacagactgaactacagcctgcccaccggccagtgggtgggcgtgcagctgcccagaaacaccaccagctacgtgctgagaggcctggagcccggccaggagtacaacgtgctgctgaccgccgagaagggcagacacaagagcaagcccgccagagtgaaggccagcaccgagcaggcccccgagctggagaacctgaccgtgaccgaggtgggctgggacggcctgagactgaactggaccgccgccgaccaggcctacgagcacttcatcatccaggtgcaggaggccaacaaggtggaggccgccagaaacctgaccgtgcccggcagcctgagagccgtggacatccccggcctgaaggccgccaccccctacaccgtgagcatctacggcgtgatccagggctacagaacccccgtgctgagcgccgaggccagcaccggcgagacccccaacctgggcgaggtggtggtggccgaggtgggctgggacgccctgaagctgaactggaccgcccccgagggcgcctacgagtacttcttcatccaggtgcaggaggccgacaccgtggaggccgcccagaacctgaccgtgcccggcggcctgagaagcaccgacctgcccggcctgaaggccgccacccactacaccatcaccatcagaggcgtgacccaggacttcagcaccacccccctgagcgtggaggtgctgaccgaggaggtgcccgacatgggcaacctgaccgtgaccgaggtgagctgggacgccctgagactgaactggaccacccccgacggcacctacgaccagttcaccatccaggtgcaggaggccgaccaggtggaggaggcccacaacctgaccgtgcccggcagcctgagaagcatggagatccccggcctgagagccggcaccccctacaccgtgaccctgcacggcgaggtgagaggccacagcaccagacccctggccgtggaggtggtgaccgaggacctgccccagctgggcgacctggccgtgagcgaggtgggctgggacggcctgagactgaactggaccgccgccgacaacgcctacgagcacttcgtgatccaggtgcaggaggtgaacaaggtggaggccgcccagaacctgaccctgcccggcagcctgagagccgtggacatccccggcctggaggccgccaccccctacagagtgagcatctacggcgtgatcagaggctacagaacccccgtgctgagcgccgaggccagcaccgccaaggagcccgagatcggcaacctgaacgtgagcgacatcacccccgagagcttcaacctgagctggatggccaccgacggcatcttcgagaccttcaccatcgagatcatcgacagcaacagactgctggagaccgtggagtacaacatcagcggcgccgagagaaccgcccacatcagcggcctgccccccagcaccgacttcatcgtgtacctgagcggcctggcccccagcatcagaaccaagaccatcagcgccaccgccaccaccgaggccctgcccctgctggagaacctgaccatcagcgacatcaacccctacggcttcaccgtgagctggatggccagcgagaacgccttcgacagcttcctggtgaccgtggtggacagcggcaagctgctggacccccaggagttcaccctgagcggcacccagagaaagctggagctgagaggcctgatcaccggcatcggctacgaggtgatggtgagcggcttcacccagggccaccagaccaagcccctgagagccgagatcgtgaccgaggccgagcccgaggtggacaacctgctggtgagcgacgccacccccgacggcttcagactgagctggaccgccgacgagggcgtgttcgacaacttcgtgctgaagatcagagacaccaagaagcagagcgagcccctggagatcaccctgctggcccccgagagaaccagagacatcaccggcctgagagaggccaccgagtacgagatcgagctgtacggcatcagcaagggcagaagaagccagaccgtgagcgccatcgccaccaccgccatgggcagccccaaggaggtgatcttcagcgacatcaccgagaacagcgccaccgtgagctggagagcccccaccgcccaggtggagagcttcagaatcacctacgtgcccatcaccggcggcacccccagcatggtgaccgtggacggcaccaagacccagaccagactggtgaagctgatccccggcgtggagtacctggtgagcatcatcgccatgaagggcttcgaggagagcgagcccgtgagcggcagcttcaccaccgccctggacggccccagcggcctggtgaccgccaacatcaccgacagcgaggccctggccagatggcagcccgccatcgccaccgtggacagctacgtgatcagctacaccggcgagaaggtgcccgagatcaccagaaccgtgagcggcaacaccgtggagtacgccctgaccgacctggagcccgccaccgagtacaccctgagaatcttcgccgagaagggcccccagaagagcagcaccatcaccgccaagttcaccaccgacctggacagccccagagacctgaccgccaccgaggtgcagagcgagaccgccctgctgacctggagaccccccagagccagcgtgaccggctacctgctggtgtacgagagcgtggacggcaccgtgaaggaggtgatcgtgggccccgacaccaccagctacagcctggccgacctgagccccagcacccactacaccgccaagatccaggccctgaacggccccctgagaagcaacatgatccagaccatcttcaccaccatcggcctgctgtaccccttccccaaggactgcagccaggccatgctgaacggcgacaccaccagcggcctgtacaccatctacctgaacggcgacaaggccgaggccctggaggtgttctgcgacatgaccagcgacggcggcggctggatcgtgttcctgagaagaaagaacggcagagagaacttctaccagaactggaaggcctacgccgccggcttcggcgacagaagagaggagttctggctgggcctggacaacctgaacaagatcaccgcccagggccagtacgagctgagagtggacctgagagaccacggcgagaccgccttcgccgtgtacgacaagttcagcgtgggcgacgccaagaccagatacaagctgaaggtggagggctacagcggcaccgccggcgacagcatggcctaccacaacggcagaagcttcagcaccttcgacaaggacaccgacagcgccatcaccaactgcgccctgagctacaagggcgccttctggtacagaaactgccacagagtgaacctgatgggcagatacggcgacaacaaccacagccagggcgtgaactggttccactggaagggccacgagcacagcatccagttcgccgagatgaagctgagacccagcaacttcagaaacctggagggcagaagaaagagagcctag

SEQ ID NO: 102116 - DNA, 3240 bp, Artificial Sequence
  Description of Artificial Sequence: Synthetic coding sequence
atgggcgccatgacccagctgctggccggcgtgttcctggccttcctggccctggccaccgagggcggcgtgctgaagaaggtgatcagacacaagagacagagcggcgtgaacgccaccctgcccgaggagaaccagcccgtggtgttcaaccacgtgtacaacatcaagctgcccgtgggcagccagtgcagcgtggacctggagagcgccagcggcgagaaggacctggccccccccagcgagcccagcgagagcttccaggagcacaccgtggacggcgagaaccagatcgtgttcacccacagaatcaacatccccagaagagcctgcggctgcgccgccgcccccgacgtgaaggagctgctgagcagactggaggagctggagaacctggtgagcagcctgagagagcagtgcaccgccggcgccggctgctgcctgcagcccgccaccggcagactggacaccagacccttctgcagcggcagaggcaacttcagcaccgagggctgcggctgcgtgtgcgagcccggctggaagggccccaactgcagcgagcccgagtgccccggcaactgccacctgagaggcagatgcatcgacggccagtgcatctgcgacgacggcttcaccggcgaggactgcagccagctggcctgccccagcgactgcaacgaccagggcaagtgcgtgaacggcgtgtgcatctgcttcgagggctacgccggcgccgactgcagcagagagatctgccccgtgccctgcagcgaggagcacggcacctgcgtggacggcctgtgcgtgtgccacgacggcttcgccggcgacgactgcaacaagcccctgtgcctgaacaactgctacaacagaggcagatgcgtggagaacgagtgcgtgtgcgacgagggcttcaccggcgaggactgcagcgagctgatctgccccaacgactgcttcgacagaggcagatgcatcaacggcacctgctactgcgaggagggcttcaccggcgaggactgcggcaagcccacctgcccccacgcctgccacacccagggcagatgcgaggagggccagtgcgtgtgcgacgagggcttcgccggcgtggactgcagcgagaagagatgccccgccgactgccacaacagaggcagatgcgtggacggcagatgcgagtgcgacgacggcttcaccggcgccgactgcggcgagctgaagtgccccaacggctgcagcggccacggcagatgcgtgaacggccagtgcgtgtgcgacgagggctacaccggcgaggactgcagccagctgagatgccccaacgactgccacagcagaggcagatgcgtggagggcaagtgcgtgtgcgagcagggcttcaagggctacgactgcagcgacatgagctgccccaacgactgccaccagcacggcagatgcgtgaacggcatgtgcgtgtgcgacgacggctacaccggcgaggactgcagagacagacagtgccccagagactgcagcaacagaggcctgtgcgtggacggccagtgcgtgtgcgaggacggcttcaccggccccgactgcgccgagctgagctgccccaacgactgccacggccagggcagatgcgtgaacggccagtgcgtgtgccacgagggcttcatgggcaaggactgcaaggagcagagatgccccagcgactgccacggccagggcagatgcgtggacggccagtgcatctgccacgagggcttcaccggcctggactgcggccagcacagctgccccagcgactgcaacaacctgggccagtgcgtgagcggcagatgcatctgcaacgagggctacagcggcgaggactgcagcgaggtgagcccccccaaggacctggtggtgaccgaggtgaccgaggagaccgtgaacctggcctgggacaacgagatgagagtgaccgagtacctggtggtgtacacccccacccacgagggcggcctggagatgcagttcagagtgcccggcgaccagaccagcaccatcatccaggagctggagcccggcgtggagtacttcatcagagtgttcgccatcctggagaacaagaagagcatccccgtgagcgccagagtggccacctacctgcccgcccccgagggcctgaagttcaagagcatcaaggagaccagcgtggaggtggagtgggaccccctggacatcgccttcgagacctgggagatcatcttcagaaacatgaacaaggaggacgagggcgagatcaccaagagcctgagaagacccgagaccagctacagacagaccggcctggcccccggccaggagtacgagatcagcctgcacatcgtgaagaacaacaccagaggccccggcctgaagagagtgaccaccaccagactggacgcccccagccagatcgaggtgaaggacgtgaccgacaccaccgccctgatcacctggttcaagcccctggccgagatcgacggcatcgagctgacctacggcatcaaggacgtgcccggcgacagaaccaccatcgacctgaccgaggacgagaaccagtacagcatcggcaacctgaagcccgacaccgagtacgaggtgagcctgatcagcagaagaggcgacatgagcagcaaccccgccaaggagaccttcaccaccggcctggacgcccccagaaacctgagaagagtgagccagaccgacaacagcatcaccctggagtggagaaacggcaaggccgccatcgacagctacagaatcaagtacgcccccatcagcggcggcgaccacgccgaggtggacgtgcccaagagccagcaggccaccaccaagaccatcaccgccaagttcaccaccgacctggacagccccagagacctgaccgccaccgaggtgcagagcgagaccgccctgctgacctggagaccccccagagccagcgtgaccggctacctgctggtgtacgagagcgtggacggcaccgtgaaggaggtgatcgtgggccccgacaccaccagctacagcctggccgacctgagcccccccagcctgttcctgcacttcatccagcagaagcccgagaagcagtactgcttccacttcaaggacatgatcaacatcatcaacatcatcatgatgatgatgatgatgaagaccaaggacttcagcagagacctgagcttccagaacatcagcggccagtacctgatcgtgttcttcttctag

SEQ ID NO: 102117 - DNA, 279 bp, Artificial Sequence
  Description of Artificial Sequence: Synthetic coding sequence
atgggcgccatgacccagctgctggccggcgtgttcctggccttcctggccctggccaccgagggcggcgtgctgaagaaggtgatcagacacaagagacagagcggcgtgaacgccaccctgcccgaggagaaccagcccgtggtgttcaaccacgtgtacaacatcaagctgcccgtgggcagccagtgcagcgtggacctggagagcgccagcggcgagaaggacctggccccccccagcgagcccagcgagagcttccaggagcacaccgtgtag

SEQ ID NO: 102118 - DNA, 5241 bp, Artificial Sequence
  Description of Artificial Sequence: Synthetic coding sequence
atgggcgccatgacccagctgctggccggcgtgttcctggccttcctggccctggccaccgagggcggcgtgctgaagaaggtgatcagacacaagagacagagcggcgtgaacgccaccctgcccgaggagaaccagcccgtggtgttcaaccacgtgtacaacatcaagctgcccgtgggcagccagtgcagcgtggacctggagagcgccagcggcgagaaggacctggccccccccagcgagcccagcgagagcttccaggagcacaccgtggacggcgagaaccagatcgtgttcacccacagaatcaacatccccagaagagcctgcggctgcgccgccgcccccgacgtgaaggagctgctgagcagactggaggagctggagaacctggtgagcagcctgagagagcagtgcaccgccggcgccggctgctgcctgcagcccgccaccggcagactggacaccagacccttctgcagcggcagaggcaacttcagcaccgagggctgcggctgcgtgtgcgagcccggctggaagggccccaactgcagcgagcccgagtgccccggcaactgccacctgagaggcagatgcatcgacggccagtgcatctgcgacgacggcttcaccggcgaggactgcagccagctggcctgccccagcgactgcaacgaccagggcaagtgcgtgaacggcgtgtgcatctgcttcgagggctacgccggcgccgactgcagcagagagatctgccccgtgccctgcagcgaggagcacggcacctgcgtggacggcctgtgcgtgtgccacgacggcttcgccggcgacgactgcaacaagcccctgtgcctgaacaactgctacaacagaggcagatgcgtggagaacgagtgcgtgtgcgacgagggcttcaccggcgaggactgcagcgagctgatctgccccaacgactgcttcgacagaggcagatgcatcaacggcacctgctactgcgaggagggcttcaccggcgaggactgcggcaagcccacctgcccccacgcctgccacacccagggcagatgcgaggagggccagtgcgtgtgcgacgagggcttcgccggcgtggactgcagcgagaagagatgccccgccgactgccacaacagaggcagatgcgtggacggcagatgcgagtgcgacgacggcttcaccggcgccgactgcggcgagctgaagtgccccaacggctgcagcggccacggcagatgcgtgaacggccagtgcgtgtgcgacgagggctacaccggcgaggactgcagccagctgagatgccccaacgactgccacagcagaggcagatgcgtggagggcaagtgcgtgtgcgagcagggcttcaagggctacgactgcagcgacatgagctgccccaacgactgccaccagcacggcagatgcgtgaacggcatgtgcgtgtgcgacgacggctacaccggcgaggactgcagagacagacagtgccccagagactgcagcaacagaggcctgtgcgtggacggccagtgcgtgtgcgaggacggcttcaccggccccgactgcgccgagctgagctgccccaacgactgccacggccagggcagatgcgtgaacggccagtgcgtgtgccacgagggcttcatgggcaaggactgcaaggagcagagatgccccagcgactgccacggccagggcagatgcgtggacggccagtgcatctgccacgagggcttcaccggcctggactgcggccagcacagctgccccagcgactgcaacaacctgggccagtgcgtgagcggcagatgcatctgcaacgagggctacagcggcgaggactgcagcgaggtgagcccccccaaggacctggtggtgaccgaggtgaccgaggagaccgtgaacctggcctgggacaacgagatgagagtgaccgagtacctggtggtgtacacccccacccacgagggcggcctggagatgcagttcagagtgcccggcgaccagaccagcaccatcatccaggagctggagcccggcgtggagtacttcatcagagtgttcgccatcctggagaacaagaagagcatccccgtgagcgccagagtggccacctacctgcccgcccccgagggcctgaagttcaagagcatcaaggagaccagcgtggaggtggagtgggaccccctggacatcgccttcgagacctgggagatcatcttcagaaacatgaacaaggaggacgagggcgagatcaccaagagcctgagaagacccgagaccagctacagacagaccggcctggcccccggccaggagtacgagatcagcctgcacatcgtgaagaacaacaccagaggccccggcctgaagagagtgaccaccaccagactggacgcccccagccagatcgaggtgaaggacgtgaccgacaccaccgccctgatcacctggttcaagcccctggccgagatcgacggcatcgagctgacctacggcatcaaggacgtgcccggcgacagaaccaccatcgacctgaccgaggacgagaaccagtacagcatcggcaacctgaagcccgacaccgagtacgaggtgagcctgatcagcagaagaggcgacatgagcagcaaccccgccaaggagaccttcaccaccggcctggacgcccccagaaacctgagaagagtgagccagaccgacaacagcatcaccctggagtggagaaacggcaaggccgccatcgacagctacagaatcaagtacgcccccatcagcggcggcgaccacgccgaggtggacgtgcccaagagccagcaggccaccaccaagaccaccctgaccggcctgagacccggcaccgagtacggcatcggcgtgagcgccgtgaaggaggacaaggagagcaaccccgccaccatcaacgccgccaccgagctggacacccccaaggacctgcaggtgagcgagaccgccgagaccagcctgaccctgctgtggaagacccccctggccaagttcgacagatacagactgaactacagcctgcccaccggccagtgggtgggcgtgcagctgcccagaaacaccaccagctacgtgctgagaggcctggagcccggccaggagtacaacgtgctgctgaccgccgagaagggcagacacaagagcaagcccgccagagtgaaggccagcaccgccaaggagcccgagatcggcaacctgaacgtgagcgacatcacccccgagagcttcaacctgagctggatggccaccgacggcatcttcgagaccttcaccatcgagatcatcgacagcaacagactgctggagaccgtggagtacaacatcagcggcgccgagagaaccgcccacatcagcggcctgccccccagcaccgacttcatcgtgtacctgagcggcctggcccccagcatcagaaccaagaccatcagcgccaccgccaccaccgaggccgagcccgaggtggacaacctgctggtgagcgacgccacccccgacggcttcagactgagctggaccgccgacgagggcgtgttcgacaacttcgtgctgaagatcagagacaccaagaagcagagcgagcccctggagatcaccctgctggcccccgagagaaccagagacatcaccggcctgagagaggccaccgagtacgagatcgagctgtacggcatcagcaagggcagaagaagccagaccgtgagcgccatcgccaccaccgccatgggcagccccaaggaggtgatcttcagcgacatcaccgagaacagcgccaccgtgagctggagagcccccaccgcccaggtggagagcttcagaatcacctacgtgcccatcaccggcggcacccccagcatggtgaccgtggacggcaccaagacccagaccagactggtgaagctgatccccggcgtggagtacctggtgagcatcatcgccatgaagggcttcgaggagagcgagcccgtgagcggcagcttcaccaccgccctggacggccccagcggcctggtgaccgccaacatcaccgacagcgaggccctggccagatggcagcccgccatcgccaccgtggacagctacgtgatcagctacaccggcgagaaggtgcccgagatcaccagaaccgtgagcggcaacaccgtggagtacgccctgaccgacctggagcccgccaccgagtacaccctgagaatcttcgccgagaagggcccccagaagagcagcaccatcaccgccaagttcaccaccgacctggacagccccagagacctgaccgccaccgaggtgcagagcgagaccgccctgctgacctggagaccccccagagccagcgtgaccggctacctgctggtgtacgagagcgtggacggcaccgtgaaggaggtgatcgtgggccccgacaccaccagctacagcctggccgacctgagccccagcacccactacaccgccaagatccaggccctgaacggccccctgagaagcaacatgatccagaccatcttcaccaccatcggcctgctgtaccccttccccaaggactgcagccaggccatgctgaacggcgacaccaccagcggcctgtacaccatctacctgaacggcgacaaggccgaggccctggaggtgttctgcgacatgaccagcgacggcggcggctggatcgtgttcctgagaagaaagaacggcagagagaacttctaccagaactggaaggcctacgccgccggcttcggcgacagaagagaggagttctggctgggcctggacaacctgaacaagatcaccgcccagggccagtacgagctgagagtggacctgagagaccacggcgagaccgccttcgccgtgtacgacaagttcagcgtgggcgacgccaagaccagatacaagctgaaggtggagggctacagcggcaccgccggcgacagcatggcctaccacaacggcagaagcttcagcaccttcgacaaggacaccgacagcgccatcaccaactgcgccctgagctacaagggcgccttctggtacagaaactgccacagagtgaacctgatgggcagatacggcgacaacaaccacagccagggcgtgaactggttccactggaagggccacgagcacagcatccagttcgccgagatgaagctgagacccagcaacttcagaaacctggagggcagaagaaagagagcctag

SEQ ID NO: 102119 - DNA, 5517 bp, Artificial Sequence
  Description of Artificial Sequence: Synthetic coding sequence
atgggcgccatgacccagctgctggccggcgtgttcctggccttcctggccctggccaccgagggcggcgtgctgaagaaggtgatcagacacaagagacagagcggcgtgaacgccaccctgcccgaggagaaccagcccgtggtgttcaaccacgtgtacaacatcaagctgcccgtgggcagccagtgcagcgtggacctggagagcgccagcggcgagaaggacctggccccccccagcgagcccagcgagagcttccaggagcacaccgtggacggcgagaaccagatcgtgttcacccacagaatcaacatccccagaagagcctgcggctgcgccgccgcccccgacgtgaaggagctgctgagcagactggaggagctggagaacctggtgagcagcctgagagagcagtgcaccgccggcgccggctgctgcctgcagcccgccaccggcagactggacaccagacccttctgcagcggcagaggcaacttcagcaccgagggctgcggctgcgtgtgcgagcccggctggaagggccccaactgcagcgagcccgagtgccccggcaactgccacctgagaggcagatgcatcgacggccagtgcatctgcgacgacggcttcaccggcgaggactgcagccagctggcctgccccagcgactgcaacgaccagggcaagtgcgtgaacggcgtgtgcatctgcttcgagggctacgccggcgccgactgcagcagagagatctgccccgtgccctgcagcgaggagcacggcacctgcgtggacggcctgtgcgtgtgccacgacggcttcgccggcgacgactgcaacaagcccctgtgcctgaacaactgctacaacagaggcagatgcgtggagaacgagtgcgtgtgcgacgagggcttcaccggcgaggactgcagcgagctgatctgccccaacgactgcttcgacagaggcagatgcatcaacggcacctgctactgcgaggagggcttcaccggcgaggactgcggcaagcccacctgcccccacgcctgccacacccagggcagatgcgaggagggccagtgcgtgtgcgacgagggcttcgccggcgtggactgcagcgagaagagatgccccgccgactgccacaacagaggcagatgcgtggacggcagatgcgagtgcgacgacggcttcaccggcgccgactgcggcgagctgaagtgccccaacggctgcagcggccacggcagatgcgtgaacggccagtgcgtgtgcgacgagggctacaccggcgaggactgcagccagctgagatgccccaacgactgccacagcagaggcagatgcgtggagggcaagtgcgtgtgcgagcagggcttcaagggctacgactgcagcgacatgagctgccccaacgactgccaccagcacggcagatgcgtgaacggcatgtgcgtgtgcgacgacggctacaccggcgaggactgcagagacagacagtgccccagagactgcagcaacagaggcctgtgcgtggacggccagtgcgtgtgcgaggacggcttcaccggccccgactgcgccgagctgagctgccccaacgactgccacggccagggcagatgcgtgaacggccagtgcgtgtgccacgagggcttcatgggcaaggactgcaaggagcagagatgccccagcgactgccacggccagggcagatgcgtggacggccagtgcatctgccacgagggcttcaccggcctggactgcggccagcacagctgccccagcgactgcaacaacctgggccagtgcgtgagcggcagatgcatctgcaacgagggctacagcggcgaggactgcagcgaggtgagcccccccaaggacctggtggtgaccgaggtgaccgaggagaccgtgaacctggcctgggacaacgagatgagagtgaccgagtacctggtggtgtacacccccacccacgagggcggcctggagatgcagttcagagtgcccggcgaccagaccagcaccatcatccaggagctggagcccggcgtggagtacttcatcagagtgttcgccatcctggagaacaagaagagcatccccgtgagcgccagagtggccacctacctgcccgcccccgagggcctgaagttcaagagcatcaaggagaccagcgtggaggtggagtgggaccccctggacatcgccttcgagacctgggagatcatcttcagaaacatgaacaaggaggacgagggcgagatcaccaagagcctgagaagacccgagaccagctacagacagaccggcctggcccccggccaggagtacgagatcagcctgcacatcgtgaagaacaacaccagaggccccggcctgaagagagtgaccaccaccagactggacgcccccagccagatcgaggtgaaggacgtgaccgacaccaccgccctgatcacctggttcaagcccctggccgagatcgacggcatcgagctgacctacggcatcaaggacgtgcccggcgacagaaccaccatcgacctgaccgaggacgagaaccagtacagcatcggcaacctgaagcccgacaccgagtacgaggtgagcctgatcagcagaagaggcgacatgagcagcaaccccgccaaggagaccttcaccaccggcctggacgcccccagaaacctgagaagagtgagccagaccgacaacagcatcaccctggagtggagaaacggcaaggccgccatcgacagctacagaatcaagtacgcccccatcagcggcggcgaccacgccgaggtggacgtgcccaagagccagcaggccaccaccaagaccaccctgaccggcctgagacccggcaccgagtacggcatcggcgtgagcgccgtgaaggaggacaaggagagcaaccccgccaccatcaacgccgccaccgagctggacacccccaaggacctgcaggtgagcgagaccgccgagaccagcctgaccctgctgtggaagacccccctggccaagttcgacagatacagactgaactacagcctgcccaccggccagtgggtgggcgtgcagctgcccagaaacaccaccagctacgtgctgagaggcctggagcccggccaggagtacaacgtgctgctgaccgccgagaagggcagacacaagagcaagcccgccagagtgaaggccagcaccgccaaggagcccgagatcggcaacctgaacgtgagcgacatcacccccgagagcttcaacctgagctggatggccaccgacggcatcttcgagaccttcaccatcgagatcatcgacagcaacagactgctggagaccgtggagtacaacatcagcggcgccgagagaaccgcccacatcagcggcctgccccccagcaccgacttcatcgtgtacctgagcggcctggcccccagcatcagaaccaagaccatcagcgccaccgccaccaccgagcccaagccccagctgggcaccctgatcttcagcaacatcacccccaagagcttcaacatgagctggaccacccaggccggcctgttcgccaagatcgtgatcaacgtgagcgacgcccacagcctgcacgagagccagcagttcaccgtgagcggcgacgccaagcaggcccacatcaccggcctggtggagaacaccggctacgacgtgagcgtggccggcaccaccctggccggcgaccccaccagacccctgaccgccttcgtgatcaccgaggccgagcccgaggtggacaacctgctggtgagcgacgccacccccgacggcttcagactgagctggaccgccgacgagggcgtgttcgacaacttcgtgctgaagatcagagacaccaagaagcagagcgagcccctggagatcaccctgctggcccccgagagaaccagagacatcaccggcctgagagaggccaccgagtacgagatcgagctgtacggcatcagcaagggcagaagaagccagaccgtgagcgccatcgccaccaccgccatgggcagccccaaggaggtgatcttcagcgacatcaccgagaacagcgccaccgtgagctggagagcccccaccgcccaggtggagagcttcagaatcacctacgtgcccatcaccggcggcacccccagcatggtgaccgtggacggcaccaagacccagaccagactggtgaagctgatccccggcgtggagtacctggtgagcatcatcgccatgaagggcttcgaggagagcgagcccgtgagcggcagcttcaccaccgccctggacggccccagcggcctggtgaccgccaacatcaccgacagcgaggccctggccagatggcagcccgccatcgccaccgtggacagctacgtgatcagctacaccggcgagaaggtgcccgagatcaccagaaccgtgagcggcaacaccgtggagtacgccctgaccgacctggagcccgccaccgagtacaccctgagaatcttcgccgagaagggcccccagaagagcagcaccatcaccgccaagttcaccaccgacctggacagccccagagacctgaccgccaccgaggtgcagagcgagaccgccctgctgacctggagaccccccagagccagcgtgaccggctacctgctggtgtacgagagcgtggacggcaccgtgaaggaggtgatcgtgggccccgacaccaccagctacagcctggccgacctgagccccagcacccactacaccgccaagatccaggccctgaacggccccctgagaagcaacatgatccagaccatcttcaccaccatcggcctgctgtaccccttccccaaggactgcagccaggccatgctgaacggcgacaccaccagcggcctgtacaccatctacctgaacggcgacaaggccgaggccctggaggtgttctgcgacatgaccagcgacggcggcggctggatcgtgttcctgagaagaaagaacggcagagagaacttctaccagaactggaaggcctacgccgccggcttcggcgacagaagagaggagttctggctgggcctggacaacctgaacaagatcaccgcccagggccagtacgagctgagagtggacctgagagaccacggcgagaccgccttcgccgtgtacgacaagttcagcgtgggcgacgccaagaccagatacaagctgaaggtggagggctacagcggcaccgccggcgacagcatggcctaccacaacggcagaagcttcagcaccttcgacaaggacaccgacagcgccatcaccaactgcgccctgagctacaagggcgccttctggtacagaaactgccacagagtgaacctgatgggcagatacggcgacaacaaccacagccagggcgtgaactggttccactggaagggccacgagcacagcatccagttcgccgagatgaagctgagacccagcaacttcagaaacctggagggcagaagaaagagagcctag

SEQ ID NO: 102120 - DNA, 4077 bp, Artificial Sequence
  Description of Artificial Sequence: Synthetic coding sequence
atgggcgccgacggcgagaccgtggtgctgaagaacatgctgatcggcatcaacctgatcctgctgggcagcatgatcaagcccagcgagtgccagctggaggtgaccaccgagagagtgcagagacagagcgtggaggaggagggcggcatcgccaactacaacaccagcagcaaggagcagcccgtggtgttcaaccacgtgtacaacatcaacgtgcccctggacaacctgtgcagcagcggcctggaggccagcgccgagcaggaggtgagcgccgaggacgagaccctggccgagtacatgggccagaccagcgaccacgagagccaggtgaccttcacccacagaatcaacttccccaagaaggcctgcccctgcgccagcagcgcccaggtgctgcaggagctgctgagcagaatcgagatgctggagagagaggtgagcgtgctgagagaccagtgcaacgccaactgctgccaggagagcgccgccaccggccagctggactacatcccccactgcagcggccacggcaacttcagcttcgagagctgcggctgcatctgcaacgagggctggttcggcaagaactgcagcgagccctactgccccctgggctgcagcagcagaggcgtgtgcgtggacggccagtgcatctgcgacagcgagtacagcggcgacgactgcagcgagctgagatgccccaccgactgcagcagcagaggcctgtgcgtggacggcgagtgcgtgtgcgaggagccctacaccggcgaggactgcagagagctgagatgccccggcgactgcagcggcaagggcagatgcgccaacggcacctgcctgtgcgaggagggctacgtgggcgaggactgcggccagagacagtgcctgaacgcctgcagcggcagaggccagtgcgaggagggcctgtgcgtgtgcgaggagggctaccagggccccgactgcagcgccgtggccccccccgaggacctgagagtggccggcatcagcgacagaagcatcgagctggagtgggacggccccatggccgtgaccgagtacgtgatcagctaccagcccaccgccctgggcggcctgcagctgcagcagagagtgcccggcgactggagcggcgtgaccatcaccgagctggagcccggcctgacctacaacatcagcgtgtacgccgtgatcagcaacatcctgagcctgcccatcaccgccaaggtggccacccacctgagcaccccccagggcctgcagttcaagaccatcaccgagaccaccgtggaggtgcagtgggagcccttcagcttcagcttcgacggctgggagatcagcttcatccccaagaacaacgagggcggcgtgatcgcccaggtgcccagcgacgtgaccagcttcaaccagaccggcctgaagcccggcgaggagtacatcgtgaacgtggtggccctgaaggagcaggccagaagcccccccaccagcgccagcgtgagcaccgtgatcgacggccccacccagatcctggtgagagacgtgagcgacaccgtggccttcgtggagtggatcccccccagagccaaggtggacttcatcctgctgaagtacggcctggtgggcggcgagggcggcagaaccaccttcagactgcagccccccctgagccagtacagcgtgcaggccctgagacccggcagcagatacgaggtgagcgtgagcgccgtgagaggcaccaacgagagcgacagcgccaccacccagttcaccaccgagatcgacgcccccaagaacctgagagtgggcagcagaaccgccaccagcctggacctggagtgggacaacagcgaggccgaggtgcaggagtacaaggtggtgtacagcaccctggccggcgagcagtaccacgaggtgctggtgcccagaggcatcggccccaccaccagagccaccctgaccgacctggtgcccggcaccgagtacggcgtgggcatcagcgccgtgatgaacagccagcagagcgtgcccgccaccatgaacgccagaaccgagctggacagccccagagacctgatggtgaccgccagcagcgagaccagcatcagcctgatctggaccaaggccagcggccccatcgaccactacagaatcaccttcacccccagcagcggcatcgccagcgaggtgaccgtgcccaaggacagaaccagctacaccctgaccgacctggagcccggcgccgagtacatcatcagcgtgaccgccgagagaggcagacagcagagcctggagagcaccgtggacgccttcaccggcttcagacccatcagccacctgcacttcagccacgtgaccagcagcagcgtgaacatcacctggagcgaccccagcccccccgccgacagactgatcctgaactacagccccagagacgaggaggaggagatgatggaggtgagcctggacgccaccaagagacacgccgtgctgatgggcctgcagcccgccaccgagtacatcgtgaacctggtggccgtgcacggcaccgtgaccagcgagcccatcgtgggcagcatcaccaccggcatcgacccccccaaggacatcaccatcagcaacgtgaccaaggacagcgtgatggtgagctggagcccccccgtggccagcttcgactactacagagtgagctacagacccacccaggtgggcagactggacagcagcgtggtgcccaacaccgtgaccgagttcaccatcaccagactgaaccccgccaccgagtacgagatcagcctgaacagcgtgagaggcagagaggagagcgagagaatctgcaccctggtgcacaccgccatggacaaccccgtggacctgatcgccaccaacatcacccccaccgaggccctgctgcagtggaaggcccccgtgggcgaggtggagaactacgtgatcgtgctgacccacttcgccgtggccggcgagaccatcctggtggacggcgtgagcgaggagttcagactggtggacctgctgcccagcacccactacaccgccaccatgtacgccaccaacggccccctgaccagcggcaccatcagcaccaacttcagcaccctgctggacccccccgccaacctgaccgccagcgaggtgaccagacagagcgccctgatcagctggcagccccccagagccgagatcgagaactacgtgctgacctacaagagcaccgacggcagcagaaaggagctgatcgtggacgccgaggacacctggatcagactggagggcctgctggagaacaccgactacaccgtgctgctgcaggccgcccaggacaccacctggagcagcatcaccagcaccgccttcaccaccggcggcagagtgttcccccacccccaggactgcgcccagcacctgatgaacggcgacaccctgagcggcgtgtaccccatcttcctgaacggcgagctgagccagaagctgcaggtgtactgcgacatgaccaccgacggcggcggctggatcgtgttccagagaagacagaacggccagaccgacttcttcagaaagtgggccgactacagagtgggcttcggcaacgtggaggacgagttctggctgggcctggacaacatccacagaatcaccagccagggcagatacgagctgagagtggacatgagagacggccaggaggccgccttcgccagctacgacagattcagcgtggaggacagcagaaacctgtacaagctgagaatcggcagctacaacggcaccgccggcgacagcctgagctaccaccagggcagacccttcagcaccgaggacagagacaacgacgtggccgtgaccaactgcgccatgagctacaagggcgcctggtggtacaagaactgccacagaaccaacctgaacggcaagtacggcgagagcagacacagccagggcatcaactggtaccactggaagggccacgagttcagcatccccttcgtggagatgaagatgagaccctacaaccacagactgatggccggcagaaagagacagagcctgcagttctag

SEQ ID NO: 102121 - DNA, 3807 bp, Artificial Sequence
  Description of Artificial Sequence: Synthetic coding sequence
atgggcgccgacggcgagaccgtggtgctgaagaacatgctgatcggcatcaacctgatcctgctgggcagcatgatcaagcccagcgagtgccagctggaggtgaccaccgagagagtgcagagacagagcgtggaggaggagggcggcatcgccaactacaacaccagcagcaaggagcagcccgtggtgttcaaccacgtgtacaacatcaacgtgcccctggacaacctgtgcagcagcggcctggaggccagcgccgagcaggaggtgagcgccgaggacgagaccctggccgagtacatgggccagaccagcgaccacgagagccaggtgaccttcacccacagaatcaacttccccaagaaggcctgcccctgcgccagcagcgcccaggtgctgcaggagctgctgagcagaatcgagatgctggagagagaggtgagcgtgctgagagaccagtgcaacgccaactgctgccaggagagcgccgccaccggccagctggactacatcccccactgcagcggccacggcaacttcagcttcgagagctgcggctgcatctgcaacgagggctggttcggcaagaactgcagcgagccctactgccccctgggctgcagcagcagaggcgtgtgcgtggacggccagtgcatctgcgacagcgagtacagcggcgacgactgcagcgagctgagatgccccaccgactgcagcagcagaggcctgtgcgtggacggcgagtgcgtgtgcgaggagccctacaccggcgaggactgcagagagctgagatgccccggcgactgcagcggcaagggcagatgcgccaacggcacctgcctgtgcgaggagggctacgtgggcgaggactgcggccagagacagtgcctgaacgcctgcagcggcagaggccagtgcgaggagggcctgtgcgtgtgcgaggagggctaccagggccccgactgcagcgccgtggccccccccgaggacctgagagtggccggcatcagcgacagaagcatcgagctggagtgggacggccccatggccgtgaccgagtacgtgatcagctaccagcccaccgccctgggcggcctgcagctgcagcagagagtgcccggcgactggagcggcgtgaccatcaccgagctggagcccggcctgacctacaacatcagcgtgtacgccgtgatcagcaacatcctgagcctgcccatcaccgccaaggtggccacccacctgagcaccccccagggcctgcagttcaagaccatcaccgagaccaccgtggaggtgcagtgggagcccttcagcttcagcttcgacggctgggagatcagcttcatccccaagaacaacgagggcggcgtgatcgcccaggtgcccagcgacgtgaccagcttcaaccagaccggcctgaagcccggcgaggagtacatcgtgaacgtggtggccctgaaggagcaggccagaagcccccccaccagcgccagcgtgagcaccgtgatcgacggccccacccagatcctggtgagagacgtgagcgacaccgtggccttcgtggagtggatcccccccagagccaaggtggacttcatcctgctgaagtacggcctggtgggcggcgagggcggcagaaccaccttcagactgcagccccccctgagccagtacagcgtgcaggccctgagacccggcagcagatacgaggtgagcgtgagcgccgtgagaggcaccaacgagagcgacagcgccaccacccagttcaccaccgagatcgacgcccccaagaacctgagagtgggcagcagaaccgccaccagcctggacctggagtgggacaacagcgaggccgaggtgcaggagtacaaggtggtgtacagcaccctggccggcgagcagtaccacgaggtgctggtgcccagaggcatcggccccaccaccagagccaccctgaccgacctggtgcccggcaccgagtacggcgtgggcatcagcgccgtgatgaacagccagcagagcgtgcccgccaccatgaacgccagaaccgagctggacagccccagagacctgatggtgaccgccagcagcgagaccagcatcagcctgatctggaccaaggccagcggccccatcgaccactacagaatcaccttcacccccagcagcggcatcgccagcgaggtgaccgtgcccaaggacagaaccagctacaccctgaccgacctggagcccggcgccgagtacatcatcagcgtgaccgccgagagaggcagacagcagagcctggagagcaccgtggacgccttcaccggcatcgacccccccaaggacatcaccatcagcaacgtgaccaaggacagcgtgatggtgagctggagcccccccgtggccagcttcgactactacagagtgagctacagacccacccaggtgggcagactggacagcagcgtggtgcccaacaccgtgaccgagttcaccatcaccagactgaaccccgccaccgagtacgagatcagcctgaacagcgtgagaggcagagaggagagcgagagaatctgcaccctggtgcacaccgccatggacaaccccgtggacctgatcgccaccaacatcacccccaccgaggccctgctgcagtggaaggcccccgtgggcgaggtggagaactacgtgatcgtgctgacccacttcgccgtggccggcgagaccatcctggtggacggcgtgagcgaggagttcagactggtggacctgctgcccagcacccactacaccgccaccatgtacgccaccaacggccccctgaccagcggcaccatcagcaccaacttcagcaccctgctggacccccccgccaacctgaccgccagcgaggtgaccagacagagcgccctgatcagctggcagccccccagagccgagatcgagaactacgtgctgacctacaagagcaccgacggcagcagaaaggagctgatcgtggacgccgaggacacctggatcagactggagggcctgctggagaacaccgactacaccgtgctgctgcaggccgcccaggacaccacctggagcagcatcaccagcaccgccttcaccaccggcggcagagtgttcccccacccccaggactgcgcccagcacctgatgaacggcgacaccctgagcggcgtgtaccccatcttcctgaacggcgagctgagccagaagctgcaggtgtactgcgacatgaccaccgacggcggcggctggatcgtgttccagagaagacagaacggccagaccgacttcttcagaaagtgggccgactacagagtgggcttcggcaacgtggaggacgagttctggctgggcctggacaacatccacagaatcaccagccagggcagatacgagctgagagtggacatgagagacggccaggaggccgccttcgccagctacgacagattcagcgtggaggacagcagaaacctgtacaagctgagaatcggcagctacaacggcaccgccggcgacagcctgagctaccaccagggcagacccttcagcaccgaggacagagacaacgacgtggccgtgaccaactgcgccatgagctacaagggcgcctggtggtacaagaactgccacagaaccaacctgaacggcaagtacggcgagagcagacacagccagggcatcaactggtaccactggaagggccacgagttcagcatccccttcgtggagatgaagatgagaccctacaaccacagactgatggccggcagaaagagacagagcctgcagttctag

SEQ ID NO: 102122 - DNA, 4077 bp, Artificial Sequence; identical to SEQ ID NO: 102120
  Description of Artificial Sequence: Synthetic coding sequence

SEQ ID NO: 102123 - DNA, 534 bp, Artificial Sequence
  Description of Artificial Sequence: Synthetic coding sequence
tgaatcaacttccccaagaaggcctgcccctgcgccagcagcgcccaggtgctgcaggagctgctgagcagaatcgagatgctggagagagaggtgagcgtgctgagagaccagtgcaacgccaactgctgccaggagagcgccgccaccgtggccccccccgaggacctgagagtggccggcatcagcgacagaagcatcgagctggagtgggacggccccatggccgtgaccgagtacgtgatcagctaccagcccaccgccctgggcggcctgcagctgcagcagagagtgcccggcgactggagcggcgtgaccatcaccgagctggagcccggcctgacctacaacatcagcgtgtacgccgtgatcagcaacatcctgagcctgcccatcaccgccaaggtggccacccacctgagcaccccccagggcctgcagttcaagaccatcaccgagaccaccgtggaggtgcagtgggagcccttcagcttcagcttcgacggctgggagatcagcttcatccccaagtag

SEQ ID NO: 102124 - DNA, 12669 bp, Artificial Sequence
  Description of Artificial Sequence: Synthetic coding sequence
atgatgcccgcccagtacgccctgaccagcagcctggtgctgctggtgctgctgagcaccgccagagccggccccttcagcagcagaagcaacgtgaccctgcccgcccccagaccccccccccagcccggcggccacaccgtgggcgccggcgtgggcagccccagcagccagctgtacgagcacaccgtggagggcggcgagaagcaggtggtgttcacccacagaatcaacctgccccccagcaccggctgcggctgcccccccggcaccgagccccccgtgctggccagcgaggtgcaggccctgagagtgagactggagatcctggaggagctggtgaagggcctgaaggagcagtgcaccggcggctgctgccccgccagcgcccaggccggcaccggccagaccgacgtgagaaccctgtgcagcctgcacggcgtgttcgacctgagcagatgcacctgcagctgcgagcccggctggggcggccccacctgcagcgaccccaccgacgccgagatcccccccagcagcccccccagcgccagcggcagctgccccgacgactgcaacgaccagggcagatgcgtgagaggcagatgcgtgtgcttccccggctacaccggccccagctgcggctggcccagctgccccggcgactgccagggcagaggcagatgcgtgcagggcgtgtgcgtgtgcagagccggcttcagcggccccgactgcagccagagaagctgccccagaggctgcagccagagaggcagatgcgagggcggcagatgcgtgtgcgaccccggctacaccggcgacgactgcggcatgagaagctgccccagaggctgcagccagagaggcagatgcgagaacggcagatgcgtgtgcaaccccggctacgccggcgaggactgcggcgtgagaagctgccccagaggctgcagccagagaggcagatgcaaggacggcagatgcgtgtgcgaccccggctacaccggcgaggactgcggcaccagaagctgcccctgggactgcggcgagggcggcagatgcgtggacggcagatgcgtgtgctggcccggctacaccggcgaggactgcagcaccagaacctgccccagagactgcagaggcagaggcagatgcgaggacggcgagtgcatctgcgacaccggctacagcggcgacgactgcggcgtgagaagctgccccggcgactgcaaccagagaggcagatgcgaggacggcagatgcgtgtgctggcccggctacaccggcaccgactgcggcagcagagcctgccccagagactgcagaggcagaggcagatgcgagaacggcgtgtgcgtgtgcaacgccggctacagcggcgaggactgcggcgtgagaagctgccccggcgactgcagaggcagaggcagatgcgagagcggcagatgcatgtgctggcccggctacaccggcagagactgcggcaccagagcctgccccggcgactgcagaggcagaggcagatgcgtggacggcagatgcgtgtgcaaccccggcttcaccggcgaggactgcggcagcagaagatgccccggcgactgcagaggccacggcctgtgcgaggacggcgtgtgcgtgtgcgacgccggctacagcggcgaggactgcagcaccagaagctgccccggcggctgcagaggcagaggccagtgcctggacggcagatgcgtgtgcgaggacggctacagcggcgaggactgcggcgtgagacagtgccccaacgactgcagccagcacggcgtgtgccaggacggcgtgtgcatctgctgggagggctacgtgagcgaggactgcagcatcagaacctgccccagcaactgccacggcagaggcagatgcgaggagggcagatgcctgtgcgaccccggctacaccggccccacctgcgccaccagaatgtgccccgccgactgcagaggcagaggcagatgcgtgcagggcgtgtgcctgtgccacgtgggctacggcggcgaggactgcggccaggaggagccccccgccagcgcctgccccggcggctgcggccccagagagctgtgcagagccggccagtgcgtgtgcgtggagggcttcagaggccccgactgcgccatccagacctgccccggcgactgcagaggcagaggcgagtgccacgacggcagctgcgtgtgcaaggacggctacgccggcgaggactgcggcgaggaggtgcccaccatcgagggcatgagaatgcacctgctggaggagaccaccgtgagaaccgagtggacccccgcccccggccccgtggacgcctacgagatccagttcatccccaccaccgagggcgccagcccccccttcaccgccagagtgcccagcagcgccagcgcctacgaccagagaggcctggcccccggccaggagtaccaggtgaccgtgagagccctgagaggcaccagctggggcctgcccgccagcaagaccatcaccaccatgatcgacggcccccaggacctgagagtggtggccgtgacccccaccaccctggagctgggctggctgagaccccaggccgaggtggacagattcgtggtgagctacgtgagcgccggcaaccagagagtgagactggaggtgccccccgaggccgacggcaccctgctgaccgacctgatgcccggcgtggagtacgtggtgaccgtgaccgccgagagaggcagagccgtgagctaccccgccagcgtgagagccaacaccggcagcagccccctgggcctgctgggcaccaccgacgagcccccccccagcggccccagcaccacccagggcgcccaggcccccctgctgcagcagagaccccaggagctgggcgagctgagagtgctgggcagagacgagaccggcagactgagagtggtgtggaccgcccagcccgacaccttcgcctacttccagctgagaatgagagtgcccgagggccccggcgcccacgaggaggtgctgcccggcgacgtgagacaggccctggtgcccccccccccccccggcaccccctacgagctgagcctgcacggcgtgccccccggcggcaagcccagcgaccccatcatctaccagggcatcatggacaaggacgaggagaagcccggcaagagcagcggcccccccagactgggcgagctgaccgtgaccgacagaaccagcgacagcctgctgctgagatggaccgtgcccgagggcgagttcgacagcttcgtgatccagtacaaggacagagacggccagccccaggtggtgcccgtggagggcccccagagaagcgccgtgatcaccagcctggaccccggcagaaagtacaagttcgtgctgtacggcttcgtgggcaagaagagacacggccccctggtggccgaggccaagatcctgccccagagcgaccccagccccggcacccccccccacctgggcaacctgtgggtgaccgaccccacccccgacagcctgcacctgagctggaccgtgcccgagggccagttcgacaccttcatggtgcagtacagagacagagacggcagaccccaggtggtgcccgtggagggccccgagagaagcttcgtggtgagcagcctggaccccgaccacaagtacagattcaccctgttcggcatcgccaacaagaagagatacggccccctgaccgccgacggcaccaccgcccccgagagaaaggaggagccccccagacccgagttcctggagcagcccctgctgggcgagctgaccgtgaccggcgtgacccccgacagcctgagactgagctggaccgtggcccagggccccttcgacagcttcatggtgcagtacaaggacgcccagggccagccccaggccgtgcccgtggccggcgacgagaacgaggtgaccgtgcccggcctggaccccgacagaaagtacaagatgaacctgtacggcctgagaggcagacagagagtgggccccgagagcgtggtggccaagaccgccccccaggaggacgtggacgagacccccagccccaccgagctgggcaccgaggcccccgagagccccgaggagcccctgctgggcgagctgaccgtgaccggcagcagccccgacagcctgagcctgttctggaccgtgccccagggcagcttcgacagcttcaccgtgcagtacaaggacagagacggcagacccagagccgtgagagtgggcggcaaggagagcgaggtgaccgtgggcggcctggagcccggccacaagtacaagatgcacctgtacggcctgcacgagggccagagagtgggccccgtgagcgccgtgggcgtgaccgccccccagcaggaggagaccccccccgccaccgagagccccctggagcccagactgggcgagctgaccgtgaccgacgtgacccccaacagcgtgggcctgagctggaccgtgcccgagggccagttcgacagcttcatcgtgcagtacaaggacaaggacggccagccccaggtggtgcccgtggccgccgaccagagagaggtgaccgtgtacaacctggagcccgagagaaagtacaagatgaacatgtacggcctgcacgacggccagagaatgggccccctgagcgtggtgatcgtgaccgcccccctgccccccgcccccgccaccgaggccagcaagccccccctggagcccagactgggcgagctgaccgtgaccgacatcacccccgacagcgtgggcctgagctggaccgtgcccgagggcgagttcgacagcttcgtggtgcagtacaaggacagagacggccagccccaggtggtgcccgtggccgccgaccagagagaggtgaccatccccgacctggagcccagcagaaagtacaagttcctgctgttcggcatccaggacggcaagagaagaagccccgtgagcgtggaggccaagaccgtggccagaggcgacgccagccccggcgccccccccagactgggcgagctgtgggtgaccgaccccacccccgacagcctgagactgagctggaccgtgcccgagggccagttcgacagcttcgtggtgcagttcaaggacaaggacggcccccaggtggtgcccgtggagggccacgagagaagcgtgaccgtgacccccctggacgccggcagaaagtacagattcctgctgtacggcctgctgggcaagaagagacacggccccctgaccgccgacggcaccaccgaggccagaagcgccatggacgacaccggcaccaagagaccccccaagcccagactgggcgaggagctgcaggtgaccaccgtgacccagaacagcgtgggcctgagctggaccgtgcccgagggccagttcgacagcttcgtggtgcagtacaaggacagagacggccagccccaggtggtgcccgtggagggcagcctgagagaggtgagcgtgcccggcctggaccccgcccacagatacaagctgctgctgtacggcctgcaccacggcaagagagtgggccccatcagcgccgtggccatcaccgccggcagagaggagaccgagaccgagaccaccgcccccaccccccccgcccccgagccccacctgggcgagctgaccgtggaggaggccaccagccacaccctgcacctgagctggatggtgaccgagggcgagttcgacagcttcgagatccagtacaccgacagagacggccagctgcagatggtgagaatcggcggcgacagaaacgacatcaccctgagcggcctggagagcgaccacagatacctggtgaccctgtacggcttcagcgacggcaagcacgtgggccccgtgcacgtggaggccctgaccgtgcccgaggaggagaagcccagcgagccccccaccgccacccccgagccccccatcaagcccagactgggcgagctgaccgtgaccgacgccacccccgacagcctgagcctgagctggaccgtgcccgagggccagttcgaccacttcctggtgcagtacagaaacggcgacggccagcccaaggccgtgagagtgcccggccacgaggagggcgtgaccatcagcggcctggagcccgaccacaagtacaagatgaacctgtacggcttccacggcggccagagaatgggccccgtgagcgtggtgggcgtgaccgccgccgaggaggagacccccagccccaccgagcccagcatggaggcccccgagcccgccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcgccgtgggcgtgaccgcccccgaggaggagagccccgacgcccccctggccaagctgagactgggccagatgaccgtgagagacatcaccagcgacagcctgagcctgagctggaccgtgcccgagggccagttcgaccacttcctggtgcagttcaagaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccgtgggcctgaccgcccccggcaaggacgaggagatggcccccgccagcaccgagccccccacccccgagccccccatcaagcccagactggaggagctgaccgtgaccgacgccacccccgacagcctgagcctgagctggaccgtgcccgagggccagttcgaccacttcctggtgcagtacaagaacggcgacggccagcccaaggccaccagagtgcccggccacgaggacagagtgaccatcagcggcctggagcccgacaacaagtacaagatgaacctgtacggcttccacggcggccagagagtgggccccgtgagcgccatcggcgtgaccgccgccgaggaggagacccccagccccaccgagcccagcatggaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcaccgtgggcgtgaccgccccccaggaggacgtggacgagacccccagccccaccgagcccggcaccgaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggccgtgagagtgggcggccaggagagcaaggtgaccgtgagaggcctggagcccggcagaaagtacaagatgcacctgtacggcctgcacgagggcagaagactgggccccgtgagcgccgtgggcgtgaccgaggacgaggccgagaccacccaggccgtgcccaccatgacccccgagccccccatcaagcccagactgggcgagctgaccatgaccgacgccacccccgacagcctgagcctgagctggaccgtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccagccccaccgagctgagcaccgaggcccccgagccccccgaggagcccctgctgggcgagctgaccgtgaccggcagcagccccgacagcctgagcctgagctggaccatcccccagggccacttcgacagcttcaccgtgcagtacaaggacagagacggcagaccccaggtgatgagagtgagaggcgaggagagcgaggtgaccgtgggcggcctggagcccggcagaaagtacaagatgcacctgtacggcctgcacgagggcagaagagtgggccccgtgagcaccgtgggcgtgaccgtgcccaccaccacccccgagccccccaacaagcccagactgggcgagctgaccgtgaccgacgccacccccgacagcctgagcctgagctggatggtgcccgagggccagttcgaccacttcctggtgcagtacagaaacggcgacggccagcccaaggtggtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccgcccccaccgagcccagcaccgaggcccccgagccccccgaggagcccctgctgggcgagctgaccgtgaccggcagcagccccgacagcctgagcctgagctggaccatcccccagggcagattcgacagcttcaccgtgcagtacaaggacagagacggcagaccccaggtggtgagagtgagaggcgaggagagcgaggtgaccgtgggcggcctggagcccggctgcaagtacaagatgcacctgtacggcctgcacgagggccagagagtgggccccgtgagcgccgtgggcgtgaccgtgcccaccatgacccccgagccccccatcaagcccagactgggcgagctgaccgtgaccgacgccacccccgacagcctgagcctgagctggatggtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccatcggcgtgaccgaggaggagacccccagccccaccgagcccagcaccgaggcccccgaggcccccgaggagcccctgctgggcgagctgaccgtgaccggcagcagccccgacagcctgagcctgagctggaccgtgccccagggcagattcgacagcttcaccgtgcagtacaaggacagagacggccagccccaggtggtgagagtgagaggcgaggagagcgaggtgaccgtgggcggcctggagcccggcagaaagtacaagatgcacctgtacggcctgcacgagggccagagagtgggccccgtgagcaccgtgggcatcaccgcccccctgcccacccccctgcccgtggagcccagactgggcgagctggccgtggccgccgtgaccagcgacagcgtgggcctgagctggaccgtggcccagggccccttcgacagcttcctggtgcagtacagagacgcccagggccagccccaggccgtgcccgtgagcggcgacctgagagccgtggccgtgagcggcctggaccccgccagaaagtacaagttcctgctgttcggcctgcagaacggcaagagacacggccccgtgcccgtggaggccagaaccgcccccgacaccaagcccagccccagactgggcgagctgaccgtgaccgacgccacccccgacagcgtgggcctgagctggaccgtgcccgagggcgagttcgacagcttcgtggtgcagtacaaggacaaggacggcagactgcaggtggtgcccgtggccgccaaccagagagaggtgaccgtgcagggcctggagcccagcagaaagtacagattcctgctgtacggcctgagcggcagaaagagactgggccccatcagcgccgacagcaccaccgcccccctggagaaggagctgcccccccacctgggcgagctgaccgtggccgaggagaccagcagcagcctgagactgagctggaccgtggcccagggccccttcgacagcttcgtggtgcagtacagagacaccgacggccagcccagagccgtgcccgtggccgccgaccagagaaccgtgaccgtggaggacctggagcccggcaagaagtacaagttcctgctgtacggcctgctgggcggcaagagactgggccccgtgagcgccctgggcatgaccgcccccgaggaggacacccccgcccccgagctggcccccgaggcccccgagccccccgaggagcccagactgggcgtgctgaccgtgaccgacaccacccccgacagcatgagactgagctggagcgtggcccagggccccttcgacagcttcgtggtgcagtacgaggacaccaacggccagccccaggccctgctggtggacggcgaccagagcaagatcctgatcagcggcctggagcccagcaccccctacagattcctgctgtacggcctgcacgagggcaagagactgggccccctgagcgccgagggcaccaccggcctggcccccgccggccagaccagcgaggagagcagacccagactgagccagctgagcgtgaccgacgtgaccaccagcagcctgagactgaactgggaggccccccccggcgccttcgacagcttcctgctgagattcggcgtgcccagccccagcaccctggagccccaccccagacccctgctgcagagagagctgatggtgcccggcaccagacacagcgccgtgctgagagacctgagaagcggcaccctgtacagcctgaccctgtacggcctgagaggcccccacaaggccgacagcatccagggcaccgccagaaccctgagccccgtgctggagagccccagagacctgcagttcagcgagatcagagagaccagcgccaaggtgaactggatgcccccccccagcagagccgacagcttcaaggtgagctaccagctggccgacggcggcgagccccagagcgtgcaggtggacggccaggccagaacccagaagctgcagggcctgatccccggcgccagatacgaggtgaccgtggtgagcgtgagaggcttcgaggagagcgagcccctgaccggcttcctgaccaccgtgcccgacggccccacccagctgagagccctgaacctgaccgagggcttcgccgtgctgcactggaagcccccccagaaccccgtggacacctacgacgtgcaggtgaccgcccccggcgccccccccctgcaggccgagacccccggcagcgccgtggactaccccctgcacgacctggtgctgcacaccaactacaccgccaccgtgagaggcctgagaggccccaacctgaccagccccgccagcatcaccttcaccaccggcctggaggcccccagagacctggaggccaaggaggtgacccccagaaccgccctgctgacctggaccgagccccccgtgagacccgccggctacctgctgagcttccacacccccggcggccagaaccaggagatcctgctgcccggcggcatcaccagccaccagctgctgggcctgttccccagcaccagctacaacgccagactgcaggccatgtggggccagagcctgctgccccccgtgagcaccagcttcaccaccggcggcctgagaatccccttccccagagactgcggcgaggagatgcagaacggcgccggcgccagcagaaccagcaccatcttcctgaacggcaacagagagagacccctgaacgtgttctgcgacatggagaccgacggcggcggctggctggtgttccagagaagaatggacggccagaccgacttctggagagactgggaggactacgcccacggcttcggcaacatcagcggcgagttctggctgggcaacgaggccctgcacagcctgacccaggccggcgactacagcatgagagtggacctgagagccggcgacgaggccgtgttcgcccagtacgacagcttccacgtggacagcgccgccgagtactacagactgcacctggagggctaccacggcaccgccggcgacagcatgagctaccacagcggcagcgtgttcagcgccagagacagagaccccaacagcctgctgatcagctgcgccgtgagctacagaggcgcctggtggtacagaaactgccactacgccaacctgaacggcctgtacggcagcaccgtggaccaccagggcgtgagctggtaccactggaagggcttcgagttcagcgtgcccttcaccgagatgaagctgagacccagaaacttcagaagccccgccggcggcggctag

SEQ ID NO: 102125 - DNA, 6450 bp, Artificial Sequence
  Description of Artificial Sequence: Synthetic coding sequence
tgagccgaggaggagacccccagccccaccgagcccagcatggaggcccccgagcccgccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcgccgtgggcgtgaccgcccccgaggaggagagccccgacgcccccctggccaagctgagactgggccagatgaccgtgagagacatcaccagcgacagcctgagcctgagctggaccgtgcccgagggccagttcgaccacttcctggtgcagttcaagaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccgtgggcctgaccgcccccggcaaggacgaggagatggcccccgccagcaccgagccccccacccccgagccccccatcaagcccagactggaggagctgaccgtgaccgacgccacccccgacagcctgagcctgagctggaccgtgcccgagggccagttcgaccacttcctggtgcagtacaagaacggcgacggccagcccaaggccaccagagtgcccggccacgaggacagagtgaccatcagcggcctggagcccgacaacaagtacaagatgaacctgtacggcttccacggcggccagagagtgggccccgtgagcgccatcggcgtgaccgccgccgaggaggagacccccagccccaccgagcccagcatggaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcaccgtgggcgtgaccgccccccaggaggacgtggacgagacccccagccccaccgagcccggcaccgaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggccgtgagagtgggcggccaggagagcaaggtgaccgtgagaggcctggagcccggcagaaagtacaagatgcacctgtacggcctgcacgagggcagaagactgggccccgtgagcgccgtgggcgtgaccgaggacgaggccgagaccacccaggccgtgcccaccatgacccccgagccccccatcaagcccagactgggcgagctgaccatgaccgacgccacccccgacagcctgagcctgagctggaccgtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccatcagcgtgaccggcgtgaccgccgccgaggaggagacccccagccccaccgagctgagcaccgaggcccccgagccccccgaggagcccctgctgggcgagctgaccgtgaccggcagcagccccgacagcctgagcctgagctggaccatcccccagggccacttcgacagcttcaccgtgcagtacaaggacagagacggcagaccccaggtgatgagagtgagaggcgaggagagcgaggtgaccgtgggcggcctggagcccggcagaaagtacaagatgcacctgtacggcctgcacgagggcagaagagtgggccccgtgagcaccgtgggcgtgaccgtgcccaccaccacccccgagccccccaacaagcccagactgggcgagctgaccgtgaccgacgccacccccgacagcctgagcctgagctggatggtgcccgagggccagttcgaccacttcctggtgcagtacagaaacggcgacggccagcccaaggtggtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccgcccccaccgagcccagcaccgaggcccccgagccccccgaggagcccctgctgggcgagctgaccgtgaccggcagcagccccgacagcctgagcctgagctggaccatcccccagggcagattcgacagcttcaccgtgcagtacaaggacagagacggcagaccccaggtggtgagagtgagaggcgaggagagcgaggtgaccgtgggcggcctggagcccggctgcaagtacaagatgcacctgtacggcctgcacgagggccagagagtgggccccgtgagcgccgtgggcgtgaccgtgcccaccatgacccccgagccccccatcaagcccagactgggcgagctgaccgtgaccgacgccacccccgacagcctgagcctgagctggatggtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccatcggcgtgaccgaggaggagacccccagccccaccgagcccagcaccgaggcccccgaggcccccgaggagcccctgctgggcgagctgaccgtgaccggcagcagccccgacagcctgagcctgagctggaccgtgccccagggcagattcgacagcttcaccgtgcagtacaaggacagagacggccagccccaggtggtgagagtgagaggcgaggagagcgaggtgaccgtgggcggcctggagcccggcagaaagtacaagatgcacctgtacggcctgcacgagggccagagagtgggccccgtgagcaccgtgggcatcaccgcccccctgcccacccccctgcccgtggagcccagactgggcgagctggccgtggccgccgtgaccagcgacagcgtgggcctgagctggaccgtggcccagggccccttcgacagcttcctggtgcagtacagagacgcccagggccagccccaggccgtgcccgtgagcggcgacctgagagccgtggccgtgagcggcctggaccccgccagaaagtacaagttcctgctgttcggcctgcagaacggcaagagacacggccccgtgcccgtggaggccagaaccgcccccgacaccaagcccagccccagactgggcgagctgaccgtgaccgacgccacccccgacagcgtgggcctgagctggaccgtgcccgagggcgagttcgacagcttcgtggtgcagtacaaggacaaggacggcagactgcaggtggtgcccgtggccgccaaccagagagaggtgaccgtgcagggcctggagcccagcagaaagtacagattcctgctgtacggcctgagcggcagaaagagactgggccccatcagcgccgacagcaccaccgcccccctggagaaggagctgcccccccacctgggcgagctgaccgtggccgaggagaccagcagcagcctgagactgagctggaccgtggcccagggccccttcgacagcttcgtggtgcagtacagagacaccgacggccagcccagagccgtgcccgtggccgccgaccagagaaccgtgaccgtggaggacctggagcccggcaagaagtacaagttcctgctgtacggcctgctgggcggcaagagactgggccccgtgagcgccctgggcatgaccgcccccgaggaggacacccccgcccccgagctggcccccgaggcccccgagccccccgaggagcccagactgggcgtgctgaccgtgaccgacaccacccccgacagcatgagactgagctggagcgtggcccagggccccttcgacagcttcgtggtgcagtacgaggacaccaacggccagccccaggccctgctggtggacggcgaccagagcaagatcctgatcagcggcctggagcccagcaccccctacagattcctgctgtacggcctgcacgagggcaagagactgggccccctgagcgccgagggcaccaccggcctggcccccgccggccagaccagcgaggagagcagacccagactgagccagctgagcgtgaccgacgtgaccaccagcagcctgagactgaactgggaggccccccccggcgccttcgacagcttcctgctgagattcggcgtgcccagccccagcaccctggagccccaccccagacccctgctgcagagagagctgatggtgcccggcaccagacacagcgccgtgctgagagacctgagaagcggcaccctgtacagcctgaccctgtacggcctgagaggcccccacaaggccgacagcatccagggcaccgccagaaccctgagccccgtgctggagagccccagagacctgcagttcagcgagatcagagagaccagcgccaaggtgaactggatgcccccccccagcagagccgacagcttcaaggtgagctaccagctggccgacggcggcgagccccagagcgtgcaggtggacggccaggccagaacccagaagctgcagggcctgatccccggcgccagatacgaggtgaccgtggtgagcgtgagaggcttcgaggagagcgagcccctgaccggcttcctgaccaccgtgcccgacggccccacccagctgagagccctgaacctgaccgagggcttcgccgtgctgcactggaagcccccccagaaccccgtggacacctacgacatccaggtgaccgcccccggcgccccccccctgcaggccgagacccccggcagcgccgtggactaccccctgcacgacctggtgctgcacaccaactacaccgccaccgtgagaggcctgagaggccccaacctgaccagccccgccagcatcaccttcaccaccggcctggaggcccccagagacctggaggccaaggaggtgacccccagaaccgccctgctgacctggaccgagccccccgtgagacccgccggctacctgctgagcttccacacccccggcggccagacccaggagatcctgctgcccggcggcatcaccagccaccagctgctgggcctgttccccagcaccagctacaacgccagactgcaggccatgtggggccagagcctgctgccccccgtgagcaccagcttcaccaccggcggcctgagaatccccttccccagagactgcggcgaggagatgcagaacggcgccggcgccagcagaaccagcaccatcttcctgaacggcaacagagagagacccctgatcgtgttctgcgacatggagaccgacggcggcggctggctggtgttccagagaagaatggacggccagaccgacttctggagagactgggaggactacgcccacggcttcggcaacatcagcggcgagttctggctgggcaacgaggccctgcacagcctgacccaggccggcgactacagcatgagagtggacctgagagccggcgacgaggccgtgttcgcccagtacgacagcttccacgtggacagcgccgccgagtactacagactgcacctggagggctaccacggcaccgccggcgacagcatgagctaccacagcggcagcgtgttcagcgccagagacagagaccccaacagcctgctgatcagctgcgccgtgagctacagaggcgcctggtggtacagaaactgccactacgccaacctgaacggcctgtacggcagcaccgtggaccaccagggcgtgagctggtaccactggaagggcttcgagttcagcgtgcccttcaccgagatgaagctgagacccagaaacttcagaagccccgccggcggcggctag

SEQ ID NO: 102126 - DNA, 27 bp, Artificial Sequence
  Description of Artificial Sequence: Synthetic coding sequence
atgatgcccgcccagtacgccctgtag

SEQ ID NO: 102127 - DNA, 27 bp, Artificial Sequence
  Description of Artificial Sequence: Synthetic coding sequence
atgatgcccgcccagtacgccctgtag

SEQ ID NO: 102128 - DNA, 9891 bp, Artificial Sequence
  Description of Artificial Sequence: Synthetic coding sequence
tgaagcagccccctgggcctgctgggcaccaccgacgagcccccccccagcggccccagcaccacccagggcgcccaggcccccctgctgcagcagagaccccaggagctgggcgagctgagagtgctgggcagagacgagaccggcagactgagagtggtgtggaccgcccagcccgacaccttcgcctacttccagctgagaatgagagtgcccgagggccccggcgcccacgaggaggtgctgcccggcgacgtgagacaggccctggtgcccccccccccccccggcaccccctacgagctgagcctgcacggcgtgccccccggcggcaagcccagcgaccccatcatctaccagggcatcatggacaaggacgaggagaagcccggcaagagcagcggcccccccagactgggcgagctgaccgtgaccgacagaaccagcgacagcctgctgctgagatggaccgtgcccgagggcgagttcgacagcttcgtgatccagtacaaggacagagacggccagccccaggtggtgcccgtggagggcccccagagaagcgccgtgatcaccagcctggaccccggcagaaagtacaagttcgtgctgtacggcttcgtgggcaagaagagacacggccccctggtggccgaggccaagatcctgccccagagcgaccccagccccggcacccccccccacctgggcaacctgtgggtgaccgaccccacccccgacagcctgcacctgagctggaccgtgcccgagggccagttcgacaccttcatggtgcagtacagagacagagacggcagaccccaggtggtgcccgtggagggccccgagagaagcttcgtggtgagcagcctggaccccgaccacaagtacagattcaccctgttcggcatcgccaacaagaagagatacggccccctgaccgccgacggcaccaccgcccccgagagaaaggaggagccccccagacccgagttcctggagcagcccctgctgggcgagctgaccgtgaccggcgtgacccccgacagcctgagactgagctggaccgtggcccagggccccttcgacagcttcatggtgcagtacaaggacgcccagggccagccccaggccgtgcccgtggccggcgacgagaacgaggtgaccgtgcccggcctggaccccgacagaaagtacaagatgaacctgtacggcctgagaggcagacagagagtgggccccgagagcgtggtggccaagaccgccccccaggaggacgtggacgagacccccagccccaccgagctgggcaccgaggcccccgagagccccgaggagcccctgctgggcgagctgaccgtgaccggcagcagccccgacagcctgagcctgttctggaccgtgccccagggcagcttcgacagcttcaccgtgcagtacaaggacagagacggcagaccccaggccgtgagagtgggcggcaaggagagcgaggtgaccgtgggcggcctggagcccggccacaagtacaagatgcacctgtacggcctgcacgagggccagagagtgggccccgtgagcgccgtgggcgtgaccgccccccagcaggaggagaccccccccgccaccgagagccccctggagcccagactgggcgagctgaccgtgaccgacgtgacccccaacagcgtgggcctgagctggaccgtgcccgagggccagttcgacagcttcatcgtgcagtacaaggacaaggacggccagccccaggtggtgcccgtggccgccgaccagagagaggtgaccgtgtacaacctggagcccgagagaaagtacaagatgaacatgtacggcctgcacgacggccagagaatgggccccctgagcgtggtgatcgtgaccgcccccctgccccccgcccccgccaccgaggccagcaagccccccctggagcccagactgggcgagctgaccgtgaccgacatcacccccgacagcgtgggcctgagctggaccgtgcccgagggcgagttcgacagcttcgtggtgcagtacaaggacagagacggccagccccaggtggtgcccgtggccgccgaccagagagaggtgaccatccccgacctggagcccagcagaaagtacaagttcctgctgttcggcatccaggacggcaagagaagaagccccgtgagcgtggaggccaagaccgtggccagaggcgacgccagccccggcgccccccccagactgggcgagctgtgggtgaccgaccccacccccgacagcctgagactgagctggaccgtgcccgagggccagttcgacagcttcgtggtgcagttcaaggacaaggacggcccccaggtggtgcccgtggagggccacgagagaagcgtgaccgtgacccccctggacgccggcagaaagtacagattcctgctgtacggcctgctgggcaagaagagacacggccccctgaccgccgacggcaccaccgaggccagaagcgccatggacgacaccggcaccaagagaccccccaagcccagactgggcgaggagctgcaggtgaccaccgtgacccagaacagcgtgggcctgagctggaccgtgcccgagggccagttcgacagcttcgtggtgcagtacaaggacagagacggccagccccaggtggtgcccgtggagggcagcctgagagaggtgagcgtgcccggcctggaccccgcccacagatacaagctgctgctgtacggcctgcaccacggcaagagagtgggccccatcagcgccgtggccatcaccgccggcagagaggagaccgagaccgagaccaccgcccccaccccccccgcccccgagccccacctgggcgagctgaccgtggaggaggccaccagccacaccctgcacctgagctggatggtgaccgagggcgagttcgacagcttcgagatccagtacaccgacagagacggccagctgcagatggtgagaatcggcggcgacagaaacgacatcaccctgagcggcctggagagcgaccacagatacctggtgaccctgtacggcttcagcgacggcaagcacgtgggccccgtgcacgtggaggccctgaccgtgcccgaggaggagaagcccagcgagccccccaccgccacccccgagccccccatcaagcccagactgggcgagctgaccgtgaccgacgccacccccgacagcctgagcctgagctggaccgtgcccgagggccagttcgaccacttcctggtgcagtacagaaacggcgacggccagcccaaggccgtgagagtgcccggccacgaggagggcgtgaccatcagcggcctggagcccgaccacaagtacaagatgaacctgtacggcttccacggcggccagagaatgggccccgtgagcgtggtgggcgtgaccgccgccgaggaggagacccccagccccaccgagcccagcatggaggcccccgagcccgccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcgccgtgggcgtgaccgcccccgaggaggagagccccgacgcccccctggccaagctgagactgggccagatgaccgtgagagacatcaccagcgacagcctgagcctgagctggaccgtgcccgagggccagttcgaccacttcctggtgcagttcaagaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccgtgggcctgaccgcccccggcaaggacgaggagatggcccccgccagcaccgagccccccacccccgagccccccatcaagcccagactggaggagctgaccgtgaccgacgccacccccgacagcctgagcctgagctggaccgtgcccgagggccagttcgaccacttcctggtgcagtacaagaacggcgacggccagcccaaggccaccagagtgcccggccacgaggacagagtgaccatcagcggcctggagcccgacaacaagtacaagatgaacctgtacggcttccacggcggccagagagtgggccccgtgagcgccatcggcgtgaccgccgccgaggaggagacccccagccccaccgagcccagcatggaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcaccgtgggcgtgaccgccccccaggaggacgtggacgagacccccagccccaccgagcccggcaccgaggcccccggcccccccgaggagcccctgctgggcgagctgaccgtgaccggcagcagccccgacagcctgagcctgagctggaccgtgccccagggcagattcgacagcttcaccgtgcagtacaaggacagagacggcagaccccaggccgtgagagtgggcggccaggagagcaaggtgaccgtgagaggcctggagcccggcagaaagtacaagatgcacctgtacggcctgcacgagggcagaagactgggccccgtgagcgccgtgggcgtgaccgaggacgaggccgagaccacccaggccgtgcccaccatgacccccgagccccccatcaagcccagactgggcgagctgaccatgaccgacgccacccccgacagcctgagcctgagctggaccgtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccagccccaccgagctgagcaccgaggcccccgagccccccgaggagcccctgctgggcgagctgaccgtgaccggcagcagccccgacagcctgagcctgagctggaccatcccccagggccacttcgacagcttcaccgtgcagtacaaggacagagacggcagaccccaggtgatgagagtgagaggcgaggagagcgaggtgaccgtgggcggcctggagcccggcagaaagtacaagatgcacctgtacggcctgcacgagggcagaagagtgggccccgtgagcaccgtgggcgtgaccgtgcccaccaccacccccgagccccccaacaagcccagactgggcgagctgaccgtgaccgacgccacccccgacagcctgagcctgagctggatggtgcccgagggccagttcgaccacttcctggtgcagtacagaaacggcgacggccagcccaaggtggtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccgcccccaccgagcccagcaccgaggcccccgagccccccgaggagcccctgctgggcgagctgaccgtgaccggcagcagccccgacagcctgagcctgagctggaccatcccccagggcagattcgacagcttcaccgtgcagtacaaggacagagacggcagaccccaggtggtgagagtgagaggcgaggagagcgaggtgaccgtgggcggcctggagcccggctgcaagtacaagatgcacctgtacggcctgcacgagggccagagagtgggccccgtgagcgccgtgggcgtgaccgtgcccaccatgacccccgagccccccatcaagcccagactgggcgagctgaccgtgaccgacgccacccccgacagcctgagcctgagctggatggtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccatcggcgtgaccgaggaggagacccccagccccaccgagcccagcaccgaggcccccgaggcccccgaggagcccctgctgggcgagctgaccgtgaccggcagcagccccgacagcctgagcctgagctggaccgtgccccagggcagattcgacagcttcaccgtgcagtacaaggacagagacggccagccccaggtggtgagagtgagagtggaggagagcgaggtgaccgtgggcggcctggagcccggcagaaagtacaagatgcacctgtacggcctgcacgagggccagagagtgggccccgtgagcaccgtgggcatcaccgcccccctgcccacccccctgcccgtggagcccagactgggcgagctggccgtggccgccgtgaccagcgacagcgtgggcctgagctggaccgtggcccagggccccttcgacagcttcctggtgcagtacagagacgcccagggccagccccaggccgtgcccgtgagcggcgacctgagagccgtggccgtgagcggcctggaccccgccagaaagtacaagttcctgctgttcggcctgcagaacggcaagagacacggccccgtgcccgtggaggccagaaccgcccccgacaccaagcccagccccagactgggcgagctgaccgtgaccgacgccacccccgacagcgtgggcctgagctggaccgtgcccgagggcgagttcgacagcttcgtggtgcagtacaaggacaaggacggcagactgcaggtggtgcccgtggccgccaaccagagagaggtgaccgtgcagggcctggagcccagcagaaagtacagattcctgctgtacggcctgagcggcagaaagagactgggccccatcagcgccgacagcaccaccgcccccctggagaaggagctgcccccccacctgggcgagctgaccgtggccgaggagaccagcagcagcctgagactgagctggaccgtggcccagggccccttcgacagcttcgtggtgcagtacagagacaccgacggccagcccagagccgtgcccgtggccgccgaccagagaaccgtgaccgtggaggacctggagcccggcaagaagtacaagttcctgctgtacggcctgctgggcggcaagagactgggccccgtgagcgccctgggcatgaccgcccccgaggaggacacccccgcccccgagctggcccccgaggcccccgagccccccgaggagcccagactgggcgtgctgaccgtgaccgacaccacccccgacagcatgagactgagctggagcgtggcccagggccccttcgacagcttcgtggtgcagtacgaggacaccaacggccagccccaggccctgctggtggacggcgaccagagcaagatcctgatcagcggcctggagcccagcaccccctacagattcctgctgtacggcctgcacgagggcaagagactgggccccctgagcgccgagggcaccaccggcctggcccccgccggccagaccagcgaggagagcagacccagactgagccagctgagcgtgaccgacgtgaccaccagcagcctgagactgaactgggaggccccccccggcgccttcgacagcttcctgctgagattcggcgtgcccagccccagcaccctggagccccaccccagacccctgctgcagagagagctgatggtgcccggcaccagacacagcgccgtgctgagagacctgagaagcggcaccctgtacagcctgaccctgtacggcctgagaggcccccacaaggccgacagcatccagggcaccgccagaaccctgagccccgtgctggagagccccagagacctgcagttcagcgagatcagagagaccagcgccaaggtgaactggatgcccccccccagcagagccgacagcttcaaggtgagctaccagctggccgacggcggcgagccccagagcgtgcaggtggacggccaggccagaacccagaagctgcagggcctgatccccggcgccagatacgaggtgaccgtggtgagcgtgagaggcttcgaggagagcgagcccctgaccggcttcctgaccaccgtgcccgacggccccacccagctgagagccctgaacctgaccgagggcttcgccgtgctgcactggaagcccccccagaaccccgtggacacctacgacgtgcaggtgaccgcccccggcgccccccccctgcaggccgagacccccggcagcgccgtggactaccccctgcacgacctggtgctgcacaccaactacaccgccaccgtgagaggcctgagaggccccaacctgaccagccccgccagcatcaccttcaccaccggcctggaggcccccagagacctggaggccaaggaggtgacccccagaaccgccctgctgacctggaccgagccccccgtgagacccgccggctacctgctgagcttccacacccccggcggccagaaccaggagatcctgctgcccggcggcatcaccagccaccagctgctgggcctgttccccagcaccagctacaacgccagactgcaggccatgtggggccagagcctgctgccccccgtgagcaccagcttcaccaccggcggcctgagaatccccttccccagagactgcggcgaggagatgcagaacggcgccggcgccagcagaaccagcaccatcttcctgaacggcaacagagagagacccctgaacgtgttctgcgacatggagaccgacggcggcggctggctggtgttccagagaagaatggacggccagaccgacttctggagagactgggaggactacgcccacggcttcggcaacatcagcggcgagttctggctgggcaacgaggccctgcacagcctgacccaggccggcgactacagcatgagagtggacctgagagccggcgacgaggccgtgttcgcccagtacgacagcttccacgtggacagcgccgccgagtactacagactgcacctggagggctaccacggcaccgccggcgacagcatgagctaccacagcggcagcgtgttcagcgccagagacagagaccccaacagcctgctgatcagctgcgccgtgagctacagaggcgcctggtggtacagaaactgccactacgccaacctgaacggcctgtacggcagcaccgtggaccaccagggcgtgagctggtaccactggaagggcttcgagttcagcgtgcccttcaccgagatgaagctgagacccagaaacttcagaagccccgccggcggcggctag

SEQ ID NO: 102129 - DNA, 12669 bp, Artificial Sequence
  Description of Artificial Sequence: Synthetic coding sequence
atgatgcccgcccagtacgccctgaccagcagcctggtgctgctggtgctgctgagcaccgccagagccggccccttcagcagcagaagcaacgtgaccctgcccgcccccagaccccccccccagcccggcggccacaccgtgggcgccggcgtgggcagccccagcagccagctgtacgagcacaccgtggagggcggcgagaagcaggtggtgttcacccacagaatcaacctgccccccagcaccggctgcggctgcccccccggcaccgagccccccgtgctggccagcgaggtgcaggccctgagagtgagactggagatcctggaggagctggtgaagggcctgaaggagcagtgcaccggcggctgctgccccgccagcgcccaggccggcaccggccagaccgacgtgagaaccctgtgcagcctgcacggcgtgttcgacctgagcagatgcacctgcagctgcgagcccggctggggcggccccacctgcagcgaccccaccgacgccgagatcccccccagcagcccccccagcgccagcggcagctgccccgacgactgcaacgaccagggcagatgcgtgagaggcagatgcgtgtgcttccccggctacaccggccccagctgcggctggcccagctgccccggcgactgccagggcagaggcagatgcgtgcagggcgtgtgcgtgtgcagagccggcttcagcggccccgactgcagccagagaagctgccccagaggctgcagccagagaggcagatgcgagggcggcagatgcgtgtgcgaccccggctacaccggcgacgactgcggcatgagaagctgccccagaggctgcagccagagaggcagatgcgagaacggcagatgcgtgtgcaaccccggctacaccggcgaggactgcggcgtgagaagctgccccagaggctgcagccagagaggcagatgcaaggacggcagatgcgtgtgcgaccccggctacaccggcgaggactgcggcaccagaagctgcccctgggactgcggcgagggcggcagatgcgtggacggcagatgcgtgtgctggcccggctacaccggcgaggactgcagcaccagaacctgccccagagactgcagaggcagaggcagatgcgaggacggcgagtgcatctgcgacaccggctacagcggcgacgactgcggcgtgagaagctgccccggcgactgcaaccagagaggcagatgcgaggacggcagatgcgtgtgctggcccggctacaccggcaccgactgcggcagcagagcctgccccagagactgcagaggcagaggcagatgcgagaacggcgtgtgcgtgtgcaacgccggctacagcggcgaggactgcggcgtgagaagctgccccggcgactgcagaggcagaggcagatgcgagagcggcagatgcatgtgctggcccggctacaccggcagagactgcggcaccagagcctgccccggcgactgcagaggcagaggcagatgcgtggacggcagatgcgtgtgcaaccccggcttcaccggcgaggactgcggcagcagaagatgccccggcgactgcagaggccacggcctgtgcgaggacggcgtgtgcgtgtgcgacgccggctacagcggcgaggactgcagcaccagaagctgccccggcggctgcagaggcagaggccagtgcctggacggcagatgcgtgtgcgaggacggctacagcggcgaggactgcggcgtgagacagtgccccaacgactgcagccagcacggcgtgtgccaggacggcgtgtgcatctgctgggagggctacgtgagcgaggactgcagcatcagaacctgccccagcaactgccacggcagaggcagatgcgaggagggcagatgcctgtgcgaccccggctacaccggccccacctgcgccaccagaatgtgccccgccgactgcagaggcagaggcagatgcgtgcagggcgtgtgcctgtgccacgtgggctacggcggcgaggactgcggccaggaggagccccccgccagcgcctgccccggcggctgcggccccagagagctgtgcagagccggccagtgcgtgtgcgtggagggcttcagaggccccgactgcgccatccagacctgccccggcgactgcagaggcagaggcgagtgccacgacggcagctgcgtgtgcaaggacggctacgccggcgaggactgcggcgaggaggtgcccaccatcgagggcatgagaatgcacctgctggaggagaccaccgtgagaaccgagtggacccccgcccccggccccgtggacgcctacgagatccagttcatccccaccaccgagggcgccagcccccccttcaccgccagagtgcccagcagcgccagcgcctacgaccagagaggcctggcccccggccaggagtaccaggtgaccgtgagagccctgagaggcaccagctggggcctgcccgccagcaagaccatcaccaccatgatcgacggcccccaggacctgagagtggtggccgtgacccccaccaccctggagctgggctggctgagaccccaggccgaggtggacagattcgtggtgagctacgtgagcgccggcaaccagagagtgagactggaggtgccccccgaggccgacggcaccctgctgaccgacctgatgcccggcgtggagtacgtggtgaccgtgaccgccgagagaggcagagccgtgagctaccccgccagcgtgagagccaacaccggcagcagccccctgggcctgctgggcaccaccgacgagcccccccccagcggccccagcaccacccagggcgcccaggcccccctgctgcagcagagaccccaggagctgggcgagctgagagtgctgggcagagacgagaccggcagactgagagtggtgtggaccgcccagcccgacaccttcgcctacttccagctgagaatgagagtgcccgagggccccggcgcccacgaggaggtgctgcccggcgacgtgagacaggccctggtgcccccccccccccccggcaccccctacgagctgagcctgcacggcgtgccccccggcggcaagcccagcgaccccatcatctaccagggcatcatggacaaggacgaggagaagcccggcaagagcagcggcccccccagactgggcgagctgaccgtgaccgacagaaccagcgacagcctgctgctgagatggaccgtgcccgagggcgagttcgacagcttcgtgatccagtacaaggacagagacggccagccccaggtggtgcccgtggagggcccccagagaagcgccgtgatcaccagcctggaccccggcagaaagtacaagttcgtgctgtacggcttcgtgggcaagaagagacacggccccctggtggccgaggccaagatcctgccccagagcgaccccagccccggcaccccccccagactgggcaacctgtgggtgaccgaccccacccccgacagcctgcacctgagctggaccgtgcccgagggccagttcgacaccttcatggtgcagtacagagacagagacggcagaccccaggtggtgcccgtggagggccccgagagaagcttcgtggtgagcagcctggaccccgaccacaagtacagattcaccctgttcggcatcgccaacaagaagagatacggccccctgaccgccgacggcaccaccgcccccgagagaaaggaggagccccccagacccgagttcctggagcagcccctgctgggcgagctgaccgtgaccggcgtgacccccgacagcctgagactgagctggaccgtggcccagggccccttcgacagcttcatggtgcagtacaaggacgcccagggccagccccaggccgtgcccgtggccggcgacgagaacgaggtgaccgtgcccggcctggaccccgacagaaagtacaagatgaacctgtacggcctgagaggcagacagagagtgggccccgagagcgtggtggccaagaccgccccccaggaggacgtggacgagacccccagccccaccgagctgggcaccgaggcccccgagagccccgaggagcccctgctgggcgagctgaccgtgaccggcagcagccccgacagcctgagcctgttctggaccgtgccccagggcagcttcgacagcttcaccgtgcagtacaaggacagagacggcagacccagagccgtgagagtgggcggcaaggagagcgaggtgaccgtgggcggcctggagcccggccacaagtacaagatgcacctgtacggcctgcacgagggccagagagtgggccccgtgagcgccgtgggcgtgaccgccccccagcaggaggagaccccccccgccaccgagagccccctggagcccagactgggcgagctgaccgtgaccgacgtgacccccaacagcgtgggcctgagctggaccgtgcccgagggccagttcgacagcttcatcgtgcagtacaaggacaaggacggccagccccaggtggtgcccgtggccgccgaccagagagaggtgaccgtgtacaacctggagcccgagagaaagtacaagatgaacatgtacggcctgcacgacggccagagaatgggccccctgagcgtggtgatcgtgaccgcccccctgccccccgcccccgccaccgaggccagcaagccccccctggagcccagactgggcgagctgaccgtgaccgacatcacccccgacagcgtgggcctgagctggaccgtgcccgagggcgagttcgacagcttcgtggtgcagtacaaggacagagacggccagccccaggtggtgcccgtggccgccgaccagagagaggtgaccatccccgacctggagcccagcagaaagtacaagttcctgctgttcggcatccaggacggcaagagaagaagccccgtgagcgtggaggccaagaccgtggccagaggcgacgccagccccggcgccccccccagactgggcgagctgtgggtgaccgaccccacccccgacagcctgagactgagctggaccgtgcccgagggccagttcgacagcttcgtggtgcagttcaaggacaaggacggcccccaggtggtgcccgtggagggccacgagagaagcgtgaccgtgacccccctggacgccggcagaaagtacagattcctgctgtacggcctgctgggcaagaagagacacggccccctgaccgccgacggcaccaccgaggccagaagcgccatggacgacaccggcaccaagagaccccccaagcccagactgggcgaggagctgcaggtgaccaccgtgacccagaacagcgtgggcctgagctggaccgtgcccgagggccagttcgacagcttcgtggtgcagtacaaggacagagacggccagccccaggtggtgcccgtggagggcagcctgagagaggtgagcgtgcccggcctggaccccgcccacagatacaagctgctgctgtacggcctgcaccacggcaagagagtgggccccatcagcgccgtggccatcaccgccggcagagaggagaccgagaccgagaccaccgcccccaccccccccgcccccgagccccacctgggcgagctgaccgtggaggaggccaccagccacaccctgcacctgagctggatggtgaccgagggcgagttcgacagcttcgagatccagtacaccgacagagacggccagctgcagatggtgagaatcggcggcgacagaaacgacatcaccctgagcggcctggagagcgaccacagatacctggtgaccctgtacggcttcagcgacggcaagcacgtgggccccgtgcacgtggaggccctgaccgtgcccgaggaggagaagcccagcgagccccccaccgccacccccgagccccccatcaagcccagactgggcgagctgaccgtgaccgacgccacccccgacagcctgagcctgagctggaccgtgcccgagggccagttcgaccacttcctggtgcagtacagaaacggcgacggccagcccaaggccgtgagagtgcccggccacgaggagggcgtgaccatcagcggcctggagcccgaccacaagtacaagatgaacctgtacggcttccacggcggccagagaatgggccccgtgagcgtggtgggcgtgaccgccgccgaggaggagacccccagccccaccgagcccagcatggaggcccccgagcccgccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcgccgtgggcgtgaccgcccccgaggaggagagccccgacgcccccctggccaagctgagactgggccagatgaccgtgagagacatcaccagcgacagcctgagcctgagctggaccgtgcccgagggccagttcgaccacttcctggtgcagttcaagaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccgtgggcctgaccgcccccggcaaggacgaggagatggcccccgccagcaccgagccccccacccccgagccccccatcaagcccagactggaggagctgaccgtgaccgacgccacccccgacagcctgagcctgagctggaccgtgcccgagggccagttcgaccacttcctggtgcagtacaagaacggcgacggccagcccaaggccaccagagtgcccggccacgaggacagagtgaccatcagcggcctggagcccgacaacaagtacaagatgaacctgtacggcttccacggcggccagagagtgggccccgtgagcgccatcggcgtgaccgccgccgaggaggagacccccagccccaccgagcccagcatggaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcaccgtgggcgtgaccgccccccaggaggacgtggacgagacccccagccccaccgagcccggcaccgaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggccgtgagagtgggcggccaggagagcaaggtgaccgtgagaggcctggagcccggcagaaagtacaagatgcacctgtacggcctgcacgagggcagaagactgggccccgtgagcgccgtgggcgtgaccgaggacgaggccgagaccacccaggccgtgcccaccatgacccccgagccccccatcaagcccagactgggcgagctgaccatgaccgacgccacccccgacagcctgagcctgagctggaccgtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccagccccaccgagctgagcaccgaggcccccgagccccccgaggagcccctgctgggcgagctgaccgtgaccggcagcagccccgacagcctgagcctgagctggaccatcccccagggccacttcgacagcttcaccgtgcagtacaaggacagagacggcagaccccaggtgatgagagtgagaggcgaggagagcgaggtgaccgtgggcggcctggagcccggcagaaagtacaagatgcacctgtacggcctgcacgagggcagaagagtgggccccgtgagcaccgtgggcgtgaccgtgcccaccaccacccccgagccccccaacaagcccagactgggcgagctgaccgtgaccgacgccacccccgacagcctgagcctgagctggatggtgcccgagggccagttcgaccacttcctggtgcagtacagaaacggcgacggccagcccaaggtggtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccgcccccaccgagcccagcaccgaggcccccgagccccccgaggagcccctgctgggcgagctgaccgtgaccggcagcagccccgacagcctgagcctgagctggaccatcccccagggcagattcgacagcttcaccgtgcagtacaaggacagagacggcagaccccaggtggtgagagtgagaggcgaggagagcgaggtgaccgtgggcggcctggagcccggctgcaagtacaagatgcacctgtacggcctgcacgagggccagagagtgggccccgtgagcgccgtgggcgtgaccgtgcccaccatgacccccgagccccccatcaagcccagactgggcgagctgaccgtgaccgacgccacccccgacagcctgagcctgagctggatggtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccatcggcgtgaccgaggaggagacccccagccccaccgagcccagcaccgaggcccccgaggcccccgaggagcccctgctgggcgagctgaccgtgaccggcagcagccccgacagcctgagcctgagctggaccgtgccccagggcagattcgacagcttcaccgtgcagtacaaggacagagacggccagccccaggtggtgagagtgagaggcgaggagagcgaggtgaccgtgggcggcctggagcccggcagaaagtacaagatgcacctgtacggcctgcacgagggccagagagtgggccccgtgagcaccgtgggcatcaccgcccccctgcccacccccctgcccgtggagcccagactgggcgagctggccgtggccgccgtgaccagcgacagcgtgggcctgagctggaccgtggcccagggccccttcgacagcttcctggtgcagtacagagacgcccagggccagccccaggccgtgcccgtgagcggcgacctgagagccgtggccgtgagcggcctggaccccgccagaaagtacaagttcctgctgttcggcctgcagaacggcaagagacacggccccgtgcccgtggaggccagaaccgcccccgacaccaagcccagccccagactgggcgagctgaccgtgaccgacgccacccccgacagcgtgggcctgagctggaccgtgcccgagggcgagttcgacagcttcgtggtgcagtacaaggacaaggacggcagactgcaggtggtgcccgtggccgccaaccagagagaggtgaccgtgcagggcctggagcccagcagaaagtacagattcctgctgtacggcctgagcggcagaaagagactgggccccatcagcgccgacagcaccaccgcccccctggagaaggagctgcccccccacctgggcgagctgaccgtggccgaggagaccagcagcagcctgagactgagctggaccgtggcccagggccccttcgacagcttcgtggtgcagtacagagacaccgacggccagcccagagccgtgcccgtggccgccgaccagagaaccgtgaccgtggaggacctggagcccggcaagaagtacaagttcctgctgtacggcctgctgggcggcaagagactgggccccgtgagcgccctgggcatgaccgcccccgaggaggacacccccgcccccgagctggcccccgaggcccccgagccccccgaggagcccagactgggcgtgctgaccgtgaccgacaccacccccgacagcatgagactgagctggagcgtggcccagggccccttcgacagcttcgtggtgcagtacgaggacaccaacggccagccccaggccctgctggtggacggcgaccagagcaagatcctgatcagcggcctggagcccagcaccccctacagattcctgctgtacggcctgcacgagggcaagagactgggccccctgagcgccgagggcaccaccggcctggcccccgccggccagaccagcgaggagagcagacccagactgagccagctgagcgtgaccgacgtgaccaccagcagcctgagactgaactgggaggccccccccggcgccttcgacagcttcctgctgagattcggcgtgcccagccccagcaccctggagccccaccccagacccctgctgcagagagagctgatggtgcccggcaccagacacagcgccgtgctgagagacctgagaagcggcaccctgtacagcctgaccctgtacggcctgagaggcccccacaaggccgacagcatccagggcaccgccagaaccctgagccccgtgctggagagccccagagacctgcagttcagcgagatcagagagaccagcgccaaggtgaactggatgcccccccccagcagagccgacagcttcaaggtgagctaccagctggccgacggcggcgagccccagagcgtgcaggtggacggccaggccagaacccagaagctgcagggcctgatccccggcgccagatacgaggtgaccgtggtgagcgtgagaggcttcgaggagagcgagcccctgaccggcttcctgaccaccgtgcccgacggccccacccagctgagagccctgaacctgaccgagggcttcgccgtgctgcactggaagcccccccagaaccccgtggacacctacgacatccaggtgaccgcccccggcgccccccccctgcaggccgagacccccggcagcgccgtggactaccccctgcacgacctggtgctgcacaccaactacaccgccaccgtgagaggcctgagaggccccaacctgaccagccccgccagcatcaccttcaccaccggcctggaggcccccagagacctggaggccaaggaggtgacccccagaaccgccctgctgacctggaccgagccccccgtgagacccgccggctacctgctgagcttccacacccccggcggccagacccaggagatcctgctgcccggcggcatcaccagccaccagctgctgggcctgttccccagcaccagctacaacgccagactgcaggccatgtggggccagagcctgctgccccccgtgagcaccagcttcaccaccggcggcctgagaatccccttccccagagactgcggcgaggagatgcagaacggcgccggcgccagcagaaccagcaccatcttcctgaacggcaacagagagagacccctgatcgtgttctgcgacatggagaccgacggcggcggctggctggtgttccagagaagaatggacggccagaccgacttctggagagactgggaggactacgcccacggcttcggcaacatcagcggcgagttctggctgggcaacgaggccctgcacagcctgacccaggccggcgactacagcatgagagtggacctgagagccggcgacgaggccgtgttcgcccagtacgacagcttccacgtggacagcgccgccgagtactacagactgcacctggagggctaccacggcaccgccggcgacagcatgagctaccacagcggcagcgtgttcagcgccagagacagagaccccaacagcctgctgatcagctgcgccgtgagctacagaggcgcctggtggtacagaaactgccactacgccaacctgaacggcctgtacggcagcaccgtggaccaccagggcgtgagctggtaccactggaagggcttcgagttcagcgtgcccttcaccgagatgaagctgagacccagaaacttcagaagccccgccggcggcggctag

SEQ ID NO: 102130 - DNA, 27 bp, Artificial Sequence
  Description of Artificial Sequence: Synthetic coding sequence
atgatgcccgcccagtacgccctgtag

SEQ ID NO: 102131 - DNA, 1905 bp, Artificial Sequence
  Description of Artificial Sequence: Synthetic coding sequence
tgaagcagccccctgggcctgctgggcaccaccgacgagcccccccccagcggccccagcaccacccagggcgcccaggcccccctgctgcagcagagaccccaggagctgggcgagctgagagtgctgggcagagacgagaccggcagactgagagtggtgtggaccgcccagcccgacaccttcgcctacttccagctgagaatgagagtgcccgagggccccggcgcccacgaggaggtgctgcccggcgacgtgagacaggccctggtgcccccccccccccccggcaccccctacgagctgagcctgcacggcgtgccccccggcggcaagcccagcgaccccatcatctaccagggcatcatggacaaggacgaggagaagcccggcaagagcagcggcccccccagactgggcgagctgaccgtgaccgacagaaccagcgacagcctgctgctgagatggaccgtgcccgagggcgagttcgacagcttcgtgatccagtacaaggacagagacggccagccccaggtggtgcccgtggagggcccccagagaagcgccgtgatcaccagcctggaccccggcagaaagtacaagttcgtgctgtacggcttcgtgggcaagaagagacacggccccctggtggccgaggccaagatcctgccccagagcgaccccagccccggcaccccccccagactgggcaacctgtgggtgaccgaccccacccccgacagcctgcacctgagctggaccgtgcccgagggccagttcgacaccttcatggtgcagtacagagacagagacggcagaccccaggtggtgcccgtggagggccccgagagaagcttcgtggtgagcagcctggaccccgaccacaagtacagattcaccctgttcggcatcgccaacaagaagagatacggccccctgaccgccgacggcaccaccgcccccgagagaaaggaggagccccccagacccgagttcctggagcagcccctgctgggcgagctgaccgtgaccggcgtgacccccgacagcctgagactgagctggaccgtggcccagggccccttcgacagcttcatggtgcagtacaaggacgcccagggccagccccaggccgtgcccgtggccggcgacgagaacgaggtgaccgtgcccggcctggaccccgacagaaagtacaagatgaacctgtacggcctgagaggcagacagagagtgggccccgagagcgtggtggccaagaccgccccccaggaggacgtggacgagacccccagccccaccgagctgggcaccgaggcccccgagagccccgaggagcccctgctgggcgagctgaccgtgaccggcagcagccccgacagcctgagcctgttctggaccgtgccccagggcagcttcgacagcttcaccgtgcagtacaaggacagagacggcagacccagagccgtgagagtgggcggcaaggagagcgaggtgaccgtgggcggcctggagcccggccacaagtacaagatgcacctgtacggcctgcacgagggccagagagtgggccccgtgagcgccgtgggcgtgaccgccccccagcaggaggagaccccccccgccaccgagagccccctggagcccagactgggcgagctgaccgtgaccgacgtgacccccaacagcgtgggcctgagctggaccgtgcccgagggccagttcgacagcttcatcgtgcagtacaaggacaaggacggccagccccaggtggtgcccgtggccgccgaccagagagaggtgaccgtgtacaacctggagcccgagagaaagtacaagatgaacatgtacggcctgcacgacggccagagaatgggccccctgagcgtggtgatcgtgacctag

SEQ ID NO: 102132 - DNA, 27 bp, Artificial Sequence
  Description of Artificial Sequence: Synthetic coding sequence
atgatgcccgcccagtacgccctgtag

SEQ ID NO: 102133 - DNA, 12669 bp, Artificial Sequence
  Description of Artificial Sequence: Synthetic coding sequence
atgatgcccgcccagtacgccctgaccagcagcctggtgctgctggtgctgctgagcaccgccagagccggccccttcagcagcagaagcaacgtgaccctgcccgcccccagaccccccccccagcccggcggccacaccgtgggcgccggcgtgggcagccccagcagccagctgtacgagcacaccgtggagggcggcgagaagcaggtggtgttcacccacagaatcaacctgccccccagcaccggctgcggctgcccccccggcaccgagccccccgtgctggccagcgaggtgcaggccctgagagtgagactggagatcctggaggagctggtgaagggcctgaaggagcagtgcaccggcggctgctgccccgccagcgcccaggccggcaccggccagaccgacgtgagaaccctgtgcagcctgcacggcgtgttcgacctgagcagatgcacctgcagctgcgagcccggctggggcggccccacctgcagcgaccccaccgacgccgagatcccccccagcagcccccccagcgccagcggcagctgccccgacgactgcaacgaccagggcagatgcgtgagaggcagatgcgtgtgcttccccggctacaccggccccagctgcggctggcccagctgccccggcgactgccagggcagaggcagatgcgtgcagggcgtgtgcgtgtgcagagccggcttcagcggccccgactgcagccagagaagctgccccagaggctgcagccagagaggcagatgcgagggcggcagatgcgtgtgcgaccccggctacaccggcgacgactgcggcatgagaagctgccccagaggctgcagccagagaggcagatgcgagaacggcagatgcgtgtgcaaccccggctacaccggcgaggactgcggcgtgagaagctgccccagaggctgcagccagagaggcagatgcaaggacggcagatgcgtgtgcgaccccggctacaccggcgaggactgcggcaccagaagctgcccctgggactgcggcgagggcggcagatgcgtggacggcagatgcgtgtgctggcccggctacaccggcgaggactgcagcaccagaacctgccccagagactgcagaggcagaggcagatgcgaggacggcgagtgcatctgcgacaccggctacagcggcgacgactgcggcgtgagaagctgccccggcgactgcaaccagagaggcagatgcgaggacggcagatgcgtgtgctggcccggctacaccggcaccgactgcggcagcagagcctgccccagagactgcagaggcagaggcagatgcgagaacggcgtgtgcgtgtgcaacgccggctacagcggcgaggactgcggcgtgagaagctgccccggcgactgcagaggcagaggcagatgcgagagcggcagatgcatgtgctggcccggctacaccggcagagactgcggcaccagagcctgccccggcgactgcagaggcagaggcagatgcgtggacggcagatgcgtgtgcaaccccggcttcaccggcgaggactgcggcagcagaagatgccccggcgactgcagaggccacggcctgtgcgaggacggcgtgtgcgtgtgcgacgccggctacagcggcgaggactgcagcaccagaagctgccccggcggctgcagaggcagaggccagtgcctggacggcagatgcgtgtgcgaggacggctacagcggcgaggactgcggcgtgagacagtgccccaacgactgcagccagcacggcgtgtgccaggacggcgtgtgcatctgctgggagggctacgtgagcgaggactgcagcatcagaacctgccccagcaactgccacggcagaggcagatgcgaggagggcagatgcctgtgcgaccccggctacaccggccccacctgcgccaccagaatgtgccccgccgactgcagaggcagaggcagatgcgtgcagggcgtgtgcctgtgccacgtgggctacggcggcgaggactgcggccaggaggagccccccgccagcgcctgccccggcggctgcggccccagagagctgtgcagagccggccagtgcgtgtgcgtggagggcttcagaggccccgactgcgccatccagacctgccccggcgactgcagaggcagaggcgagtgccacgacggcagctgcgtgtgcaaggacggctacgccggcgaggactgcggcgaggaggtgcccaccatcgagggcatgagaatgcacctgctggaggagaccaccgtgagaaccgagtggacccccgcccccggccccgtggacgcctacgagatccagttcatccccaccaccgagggcgccagcccccccttcaccgccagagtgcccagcagcgccagcgcctacgaccagagaggcctggcccccggccaggagtaccaggtgaccgtgagagccctgagaggcaccagctggggcctgcccgccagcaagaccatcaccaccatgatcgacggcccccaggacctgagagtggtggccgtgacccccaccaccctggagctgggctggctgagaccccaggccgaggtggacagattcgtggtgagctacgtgagcgccggcaaccagagagtgagactggaggtgccccccgaggccgacggcaccctgctgaccgacctgatgcccggcgtggagtacgtggtgaccgtgaccgccgagagaggcagagccgtgagctaccccgccagcgtgagagccaacaccggcagcagccccctgggcctgctgggcaccaccgacgagcccccccccagcggccccagcaccacccagggcgcccaggcccccctgctgcagcagagaccccaggagctgggcgagctgagagtgctgggcagagacgagaccggcagactgagagtggtgtggaccgcccagcccgacaccttcgcctacttccagctgagaatgagagtgcccgagggccccggcgcccacgaggaggtgctgcccggcgacgtgagacaggccctggtgcccccccccccccccggcaccccctacgagctgagcctgcacggcgtgccccccggcggcaagcccagcgaccccatcatctaccagggcatcatggacaaggacgaggagaagcccggcaagagcagcggcccccccagactgggcgagctgaccgtgaccgacagaaccagcgacagcctgctgctgagatggaccgtgcccgagggcgagttcgacagcttcgtgatccagtacaaggacagagacggccagccccaggtggtgcccgtggagggcccccagagaagcgccgtgatcaccagcctggaccccggcagaaagtacaagttcgtgctgtacggcttcgtgggcaagaagagacacggccccctggtggccgaggccaagatcctgccccagagcgaccccagccccggcaccccccccagactgggcaacctgtgggtgaccgaccccacccccgacagcctgcacctgagctggaccgtgcccgagggccagttcgacaccttcatggtgcagtacagagacagagacggcagaccccaggtggtgcccgtggagggccccgagagaagcttcgtggtgagcagcctggaccccgaccacaagtacagattcaccctgttcggcatcgccaacaagaagagatacggccccctgaccgccgacggcaccaccgcccccgagagaaaggaggagcccccccaccccgagttcctggagcagcccctgctgggcgagctgaccgtgaccggcgtgacccccgacagcctgagactgagctggaccgtggcccagggccccttcgacagcttcatggtgcagtacaaggacgcccagggccagccccaggccgtgcccgtggccggcgacgagaacgaggtgaccgtgcccggcctggaccccgacagaaagtacaagatgaacctgtacggcctgagaggcagacagagagtgggccccgagagcgtggtggccaagaccgccccccaggaggacgtggacgagacccccagccccaccgagctgggcaccgaggcccccgagagccccgaggagcccctgctgggcgagctgaccgtgaccggcagcagccccgacagcctgagcctgttctggaccgtgccccagggcagcttcgacagcttcaccgtgcagtacaaggacagagacggcagacccagagccgtgagagtgggcggcaaggagagcgaggtgaccgtgggcggcctggagcccggccacaagtacaagatgcacctgtacggcctgcacgagggccagagagtgggccccgtgagcgccgtgggcgtgaccgccccccagcaggaggagaccccccccgccaccgagagccccctggagcccagactgggcgagctgaccgtgaccgacgtgacccccaacagcgtgggcctgagctggaccgtgcccgagggccagttcgacagcttcatcgtgcagtacaaggacaaggacggccagccccaggtggtgcccgtggccgccgaccagagagaggtgaccgtgtacaacctggagcccgagagaaagtacaagatgaacatgtacggcctgcacgacggccagagaatgggccccctgagcgtggtgatcgtgaccgcccccctgccccccgcccccgccaccgaggccagcaagccccccctggagcccagactgggcgagctgaccgtgaccgacatcacccccgacagcgtgggcctgagctggaccgtgcccgagggcgagttcgacagcttcgtggtgcagtacaaggacagagacggccagccccaggtggtgcccgtggccgccgaccagagagaggtgaccatccccgacctggagcccagcagaaagtacaagttcctgctgttcggcatccaggacggcaagagaagaagccccgtgagcgtggaggccaagaccgtggccagaggcgacgccagccccggcgccccccccagactgggcgagctgtgggtgaccgaccccacccccgacagcctgagactgagctggaccgtgcccgagggccagttcgacagcttcgtggtgcagttcaaggacaaggacggcccccaggtggtgcccgtggagggccacgagagaagcgtgaccgtgacccccctggacgccggcagaaagtacagattcctgctgtacggcctgctgggcaagaagagacacggccccctgaccgccgacggcaccaccgaggccagaagcgccatggacgacaccggcaccaagagaccccccaagcccagactgggcgaggagctgcaggtgaccaccgtgacccagaacagcgtgggcctgagctggaccgtgcccgagggccagttcgacagcttcgtggtgcagtacaaggacagagacggccagccccaggtggtgcccgtggagggcagcctgagagaggtgagcgtgcccggcctggaccccgcccacagatacaagctgctgctgtacggcctgcaccacggcaagagagtgggccccatcagcgccgtggccatcaccgccggcagagaggagaccgagaccgagaccaccgcccccaccccccccgcccccgagccccacctgggcgagctgaccgtggaggaggccaccagccacaccctgcacctgagctggatggtgaccgagggcgagttcgacagcttcgagatccagtacaccgacagagacggccagctgcagatggtgagaatcggcggcgacagaaacgacatcaccctgagcggcctggagagcgaccacagatacctggtgaccctgtacggcttcagcgacggcaagcacgtgggccccgtgcacgtggaggccctgaccgtgcccgaggaggagaagcccagcgagccccccaccgccacccccgagccccccatcaagcccagactgggcgagctgaccgtgaccgacgccacccccgacagcctgagcctgagctggaccgtgcccgagggccagttcgaccacttcctggtgcagtacagaaacggcgacggccagcccaaggccgtgagagtgcccggccacgaggagggcgtgaccatcagcggcctggagcccgaccacaagtacaagatgaacctgtacggcttccacggcggccagagaatgggccccgtgagcgtggtgggcgtgaccgccgccgaggaggagacccccagccccaccgagcccagcatggaggcccccgagcccgccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcgccgtgggcgtgaccgcccccgaggaggagagccccgacgcccccctggccaagctgagactgggccagatgaccgtgagagacatcaccagcgacagcctgagcctgagctggaccgtgcccgagggccagttcgaccacttcctggtgcagttcaagaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccgtgggcctgaccgcccccggcaaggacgaggagatggcccccgccagcaccgagccccccacccccgagccccccatcaagcccagactggaggagctgaccgtgaccgacgccacccccgacagcctgagcctgagctggaccgtgcccgagggccagttcgaccacttcctggtgcagtacaagaacggcgacggccagcccaaggccaccagagtgcccggccacgaggacagagtgaccatcagcggcctggagcccgacaacaagtacaagatgaacctgtacggcttccacggcggccagagagtgggccccgtgagcgccatcggcgtgaccgccgccgaggaggagacccccagccccaccgagcccagcatggaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcaccgtgggcgtgaccgccccccaggaggacgtggacgagacccccagccccaccgagcccggcaccgaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggccgtgagagtgggcggccaggagagcaaggtgaccgtgagaggcctggagcccggcagaaagtacaagatgcacctgtacggcctgcacgagggcagaagactgggccccgtgagcgccgtgggcgtgaccgaggacgaggccgagaccacccaggccgtgcccaccatgacccccgagccccccatcaagcccagactgggcgagctgaccatgaccgacgccacccccgacagcctgagcctgagctggaccgtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccagccccaccgagctgagcaccgaggcccccgagccccccgaggagcccctgctgggcgagctgaccgtgaccggcagcagccccgacagcctgagcctgagctggaccatcccccagggccacttcgacagcttcaccgtgcagtacaaggacagagacggcagaccccaggtgatgagagtgagaggcgaggagagcgaggtgaccgtgggcggcctggagcccggcagaaagtacaagatgcacctgtacggcctgcacgagggcagaagagtgggccccgtgagcaccgtgggcgtgaccgtgcccaccaccacccccgagccccccaacaagcccagactgggcgagctgaccgtgaccgacgccacccccgacagcctgagcctgagctggatggtgcccgagggccagttcgaccacttcctggtgcagtacagaaacggcgacggccagcccaaggtggtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccgcccccaccgagcccagcaccgaggcccccgagccccccgaggagcccctgctgggcgagctgaccgtgaccggcagcagccccgacagcctgagcctgagctggaccatcccccagggcagattcgacagcttcaccgtgcagtacaaggacagagacggcagaccccaggtggtgagagtgagaggcgaggagagcgaggtgaccgtgggcggcctggagcccggctgcaagtacaagatgcacctgtacggcctgcacgagggccagagagtgggccccgtgagcgccgtgggcgtgaccgtgcccaccatgacccccgagccccccatcaagcccagactgggcgagctgaccgtgaccgacgccacccccgacagcctgagcctgagctggatggtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccatcggcgtgaccgaggaggagacccccagccccaccgagcccagcaccgaggcccccgaggcccccgaggagcccctgctgggcgagctgaccgtgaccggcagcagccccgacagcctgagcctgagctggaccatcccccagggcagattcgacagcttcaccgtgcagtacaaggacagagacggccagccccaggtggtgagagtgagaggcgaggagagcgaggtgaccgtgggcggcctggagcccggcagaaagtacaagatgcacctgtacggcctgcacgagggccagagagtgggccccgtgagcaccgtgggcatcaccgcccccctgcccacccccctgcccgtggagcccagactgggcgagctggccgtggccgccgtgaccagcgacagcgtgggcctgagctggaccgtggcccagggccccttcgacagcttcctggtgcagtacagagacgcccagggccagccccaggccgtgcccgtgagcggcgacctgagagccgtggccgtgagcggcctggaccccgccagaaagtacaagttcctgctgttcggcctgcagaacggcaagagacacggccccgtgcccgtggaggccagaaccgcccccgacaccaagcccagccccagactgggcgagctgaccgtgaccgacgccacccccgacagcgtgggcctgagctggaccgtgcccgagggcgagttcgacagcttcgtggtgcagtacaaggacaaggacggcagactgcaggtggtgcccgtggccgccaaccagagagaggtgaccgtgcagggcctggagcccagcagaaagtacagattcctgctgtacggcctgagcggcagaaagagactgggccccatcagcgccgacagcaccaccgcccccctggagaaggagctgcccccccacctgggcgagctgaccgtggccgaggagaccagcagcagcctgagactgagctggaccgtggcccagggccccttcgacagcttcgtggtgcagtacagagacaccgacggccagcccagagccgtgcccgtggccgccgaccagagaaccgtgaccgtggaggacctggagcccggcaagaagtacaagttcctgctgtacggcctgctgggcggcaagagactgggccccgtgagcgccctgggcatgaccgcccccgaggaggacacccccgcccccgagctggcccccgaggcccccgagccccccgaggagcccagactgggcgtgctgaccgtgaccgacaccacccccgacagcatgagactgagctggagcgtggcccagggccccttcgacagcttcgtggtgcagtacgaggacaccaacggccagccccaggccctgctggtggacggcgaccagagcaagatcctgatcagcggcctggagcccagcaccccctacagattcctgctgtacggcctgcacgagggcaagagactgggccccctgagcgccgagggcaccaccggcctggcccccgccggccagaccagcgaggagagcagacccagactgagccagctgagcgtgaccgacgtgaccaccagcagcctgagactgaactgggaggccccccccggcgccttcgacagcttcctgctgagattcggcgtgcccagccccagcaccctggagccccaccccagacccctgctgcagagagagctgatggtgcccggcaccagacacagcgccgtgctgagagacctgagaagcggcaccctgtacagcctgaccctgtacggcctgagaggcccccacaaggccgacagcatccagggcaccgccagaaccctgagccccgtgctggagagccccagagacctgcagttcagcgagatcagagagaccagcgccaaggtgaactggatgcccccccccagcagagccgacagcttcaaggtgagctaccagctggccgacggcggcgagccccagagcgtgcaggtggacggccaggccagaacccagaagctgcagggcctgatccccggcgccagatacgaggtgaccgtggtgagcgtgagaggcttcgaggagagcgagcccctgaccggcttcctgaccaccgtgcccgacggccccacccagctgagagccctgaacctgaccgagggcttcgccgtgctgcactggaagcccccccagaaccccgtggacacctacgacatccaggtgaccgcccccggcgccccccccctgcaggccgagacccccggcagcgccgtggactaccccctgcacgacctggtgctgcacaccaactacaccgccaccgtgagaggcctgagaggccccaacctgaccagccccgccagcatcaccttcaccaccggcctggaggcccccagagacctggaggccaaggaggtgacccccagaaccgccctgctgacctggaccgagccccccgtgagacccgccggctacctgctgagcttccacacccccggcggccagacccaggagatcctgctgcccggcggcatcaccagccaccagctgctgggcctgttccccagcaccagctacaacgccagactgcaggccacctggggccagagcctgctgccccccgtgagcaccagcttcaccaccggcggcctgagaatccccttccccagagactgcggcgaggagatgcagaacggcgccggcgccagcagaaccagcaccatcttcctgaacggcaacagagagagacccctgaacgtgttctgcgacatggagaccgacggcggcggctggctggtgttccagagaagaatggacggccagaccgacttctggagagactgggaggactacgcccacggcttcggcaacatcagcggcgagttctggctgggcaacgaggccctgcacagcctgacccaggccggcgactacagcatgagagtggacctgagagccggcgacgaggccgtgttcgcccagtacgacagcttccacgtggacagcgccgccgagtactacagactgcacctggagggctaccacggcaccgccggcgacagcatgagctaccacagcggcagcgtgttcagcgccagagacagagaccccaacagcctgctgatcagctgcgccgtgagctacagaggcgcctggtggtacagaaactgccactacgccaacctgaacggcctgtacggcagcaccgtggaccaccagggcgtgagctggtaccactggaagggcttcgagttcagcgtgcccttcaccgagatgaagctgagacccagaaacttcagaagccccgccggcggcggctag

SEQ ID NO: 102134 - DNA, 27 bp, Artificial Sequence
  Description of Artificial Sequence: Synthetic coding sequence
atgatgcccgcccagtacgccctgtag

SEQ ID NO: 102135 - DNA, 6843 bp, Artificial Sequence
  Description of Artificial Sequence: Synthetic coding sequence
atgatgcccgcccagtacgccctgaccagcagcctggtgctgctggtgctgctgagcaccgccagagccggccccttcagcagcagaagcaacgtgaccctgcccgcccccagaccccccccccagcccggcggccacaccgtgggcgccggcgtgggcagccccagcagccagctgtacgagcacaccgtggagggcggcgagaagcaggtggtgttcacccacagaatcaacctgccccccagcaccggctgcggctgcccccccggcaccgagccccccgtgctggccagcgaggtgcaggccctgagagtgagactggagatcctggaggagctggtgaagggcctgaaggagcagtgcaccggcggctgctgccccgccagcgcccaggccggcaccggccagaccgacgtgagaaccctgtgcagcctgcacggcgtgttcgacctgagcagatgcacctgcagctgcgagcccggctggggcggccccacctgcagcgaccccaccgacgccgagatcccccccagcagcccccccagcgccagcggcagctgccccgacgactgcaacgaccagggcagatgcgtgagaggcagatgcgtgtgcttccccggctacaccggccccagctgcggctggcccagctgccccggcgactgccagggcagaggcagatgcgtgcagggcgtgtgcgtgtgcagagccggcttcagcggccccgactgcagccagagaagctgccccagaggctgcagccagagaggcagatgcgagggcggcagatgcgtgtgcgaccccggctacaccggcgacgactgcggcatgagaagctgccccagaggctgcagccagagaggcagatgcgagaacggcagatgcgtgtgcaaccccggctacaccggcgaggactgcggcgtgagaagctgccccagaggctgcagccagagaggcagatgcaaggacggcagatgcgtgtgcgaccccggctacaccggcgaggactgcggcaccagaagctgcccctgggactgcggcgagggcggcagatgcgtggacggcagatgcgtgtgctggcccggctacaccggcgaggactgcagcaccagaacctgccccagagactgcagaggcagaggcagatgcgaggacggcgagtgcatctgcgacaccggctacagcggcgacgactgcggcgtgagaagctgccccggcgactgcaaccagagaggcagatgcgaggacggcagatgcgtgtgctggcccggctacaccggcaccgactgcggcagcagagcctgccccagagactgcagaggcagaggcagatgcgagaacggcgtgtgcgtgtgcaacgccggctacagcggcgaggactgcggcgtgagaagctgccccggcgactgcagaggcagaggcagatgcgagagcggcagatgcatgtgctggcccggctacaccggcagagactgcggcaccagagcctgccccggcgactgcagaggcagaggcagatgcgtggacggcagatgcgtgtgcaaccccggcttcaccggcgaggactgcggcagcagaagatgccccggcgactgcagaggccacggcctgtgcgaggacggcgtgtgcgtgtgcgacgccggctacagcggcgaggactgcagcaccagaagctgccccggcggctgcagaggcagaggccagtgcctggacggcagatgcgtgtgcgaggacggctacagcggcgaggactgcggcgtgagacagtgccccaacgactgcagccagcacggcgtgtgccaggacggcgtgtgcatctgctgggagggctacgtgagcgaggactgcagcatcagaacctgccccagcaactgccacggcagaggcagatgcgaggagggcagatgcctgtgcgaccccggctacaccggccccacctgcgccaccagaatgtgccccgccgactgcagaggcagaggcagatgcgtgcagggcgtgtgcctgtgccacgtgggctacggcggcgaggactgcggccaggaggagccccccgccagcgcctgccccggcggctgcggccccagagagctgtgcagagccggccagtgcgtgtgcgtggagggcttcagaggccccgactgcgccatccagacctgccccggcgactgcagaggcagaggcgagtgccacgacggcagctgcgtgtgcaaggacggctacgccggcgaggactgcggcgaggaggtgcccaccatcgagggcatgagaatgcacctgctggaggagaccaccgtgagaaccgagtggacccccgcccccggccccgtggacgcctacgagatccagttcatccccaccaccgagggcgccagcccccccttcaccgccagagtgcccagcagcgccagcgcctacgaccagagaggcctggcccccggccaggagtaccaggtgaccgtgagagccctgagaggcaccagctggggcctgcccgccagcaagaccatcaccaccatgatcgacggcccccaggacctgagagtggtggccgtgacccccaccaccctggagctgggctggctgagaccccaggccgaggtggacagattcgtggtgagctacgtgagcgccggcaaccagagagtgagactggaggtgccccccgaggccgacggcaccctgctgaccgacctgatgcccggcgtggagtacgtggtgaccgtgaccgccgagagaggcagagccgtgagctaccccgccagcgtgagagccaacaccggcagcagccccctgggcctgctgggcaccaccgacgagcccccccccagcggccccagcaccacccagggcgcccaggcccccctgctgcagcagagaccccaggagctgggcgagctgagagtgctgggcagagacgagaccggcagactgagagtggtgtggaccgcccagcccgacaccttcgcctacttccagctgagaatgagagtgcccgagggccccggcgcccacgaggaggtgctgcccggcgacgtgagacaggccctggtgcccccccccccccccggcaccccctacgagctgagcctgcacggcgtgccccccggcggcaagcccagcgaccccatcatctaccagggcatcatggacaaggacgaggagaagcccggcaagagcagcggcccccccagactgggcgagctgaccgtgaccgacagaaccagcgacagcctgctgctgagatggaccgtgcccgagggcgagttcgacagcttcgtgatccagtacaaggacagagacggccagccccaggtggtgcccgtggagggcccccagagaagcgccgtgatcaccagcctggaccccggcagaaagtacaagttcgtgctgtacggcttcgtgggcaagaagagacacggccccctggtggccgaggccaagatcctgccccagagcgaccccagccccggcacccccccccacctgggcaacctgtgggtgaccgaccccacccccgacagcctgcacctgagctggaccgtgcccgagggccagttcgacaccttcatggtgcagtacagagacagagacggcagaccccaggtggtgcccgtggagggccccgagagaagcttcgtggtgagcagcctggaccccgaccacaagtacagattcaccctgttcggcatcgccaacaagaagagatacggccccctgaccgccgacggcaccaccgcccccgagagaaaggaggagccccccagacccgagttcctggagcagcccctgctgggcgagctgaccgtgaccggcgtgacccccgacagcctgagactgagctggaccgtggcccagggccccttcgacagcttcatggtgcagtacaaggacgcccagggccagccccaggccgtgcccgtggccggcgacgagaacgaggtgaccgtgcccggcctggaccccgacagaaagtacaagatgaacctgtacggcctgagaggcagacagagagtgggccccgagagcgtggtggccaagaccgccccccaggaggacgtggacgagacccccagccccaccgagctgggcaccgaggcccccgagagccccgaggagcccctgctgggcgagctgaccgtgaccggcagcagccccgacagcctgagcctgttctggaccgtgccccagggcagcttcgacagcttcaccgtgcagtacaaggacagagacggcagacccagagccgtgagagtgggcggcaaggagagcgaggtgaccgtgggcggcctggagcccggccacaagtacaagatgcacctgtacggcctgcacgagggccagagagtgggccccgtgagcgccgtgggcgtgaccgccccccagcaggaggagaccccccccgccaccgagagccccctggagcccagactgggcgagctgaccgtgaccgacgtgacccccaacagcgtgggcctgagctggaccgtgcccgagggccagttcgacagcttcatcgtgcagtacaaggacaaggacggccagccccaggtggtgcccgtggccgccgaccagagagaggtgaccgtgtacaacctggagcccgagagaaagtacaagatgaacatgtacggcctgcacgacggccagagaatgggccccctgagcgtggtgatcgtgaccgcccccctgccccccgcccccgccaccgaggccagcaagccccccctggagcccagactgggcgagctgaccgtgaccgacatcacccccgacagcgtgggcctgagctggaccgtgcccgagggcgagttcgacagcttcgtggtgcagtacaaggacagagacggccagccccaggtggtgcccgtggccgccgaccagagagaggtgaccatccccgacctggagcccagcagaaagtacaagttcctgctgttcggcatccaggacggcaagagaagaagccccgtgagcgtggaggccaagaccgtggccagaggcgacgccagccccggcgccccccccagactgggcgagctgtgggtgaccgaccccacccccgacagcctgagactgagctggaccgtgcccgagggccagttcgacagcttcgtggtgcagttcaaggacaaggacggcccccaggtggtgcccgtggagggccacgagagaagcgtgaccgtgacccccctggacgccggcagaaagtacagattcctgctgtacggcctgctgggcaagaagagacacggccccctgaccgccgacggcaccaccgaggccagaagcgccatggacgacaccggcaccaagagaccccccaagcccagactgggcgaggagctgcaggtgaccaccgtgacccagaacagcgtgggcctgagctggaccgtgcccgagggccagttcgacagcttcgtggtgcagtacaaggacagagacggccagccccaggtggtgcccgtggagggcagcctgagagaggtgagcgtgcccggcctggaccccgcccacagatacaagctgctgctgtacggcctgcaccacggcaagagagtgggccccatcagcgccgtggccatcaccgccggcagagaggagaccgagaccgagaccaccgcccccaccccccccgcccccgagccccacctgggcgagctgaccgtggaggaggccaccagccacaccctgcacctgagctggatggtgaccgagggcgagttcgacagcttcgagatccagtacaccgacagagacggccagctgcagatggtgagaatcggcggcgacagaaacgacatcaccctgagcggcctggagagcgaccacagatacctggtgaccctgtacggcttcagcgacggcaagcacgtgggccccgtgcacgtggaggccctgaccgtgcccgaggaggagaagcccagcgagccccccaccgccacccccgagccccccatcaagcccagactgggcgagctgaccgtgaccgacgccacccccgacagcctgagcctgagctggaccgtgcccgagggccagttcgaccacttcctggtgcagtacagaaacggcgacggccagcccaaggccgtgagagtgcccggccacgaggagggcgtgaccatcagcggcctggagcccgaccacaagtacaagatgaacctgtacggcttccacggcggccagagaatgggccccgtgagcgtggtgggcgtgaccgccgccgaggaggagacccccagccccaccgagcccagcatggaggcccccgagcccgccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcgccgtgggcgtgaccgcccccgaggaggagagccccgacgcccccctggccaagctgagactgggccagatgaccgtgagagacatcaccagcgacagcctgagcctgagctggaccgtgcccgagggccagttcgaccacttcctggtgcagttcaagaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccgtgggcctgacctag

SEQ ID NO: 102136 - DNA, 2022 bp, Artificial Sequence
  Description of Artificial Sequence: Synthetic coding sequence
atgagactgagctggagcgtggcccagggccccttcgacagcttcgtggtgcagtacgaggacaccaacggccagccccaggccctgctggtggacggcgaccagagcaagatcctgatcagcggcctggagcccagcaccccctacagattcctgctgtacggcctgcacgagggcaagagactgggccccctgagcgccgagggcaccaccggcctggcccccgccggccagaccagcgaggagagcagacccagactgagccagctgagcgtgaccgacgtgaccaccagcagcctgagactgaactgggaggccccccccggcgccttcgacagcttcctgctgagattcggcgtgcccagccccagcaccctggagccccaccccagacccctgctgcagagagagctgatggtgcccggcaccagacacagcgccgtgctgagagacctgagaagcggcaccctgtacagcctgaccctgtacggcctgagaggcccccacaaggccgacagcatccagggcaccgccagaaccctgagccccgtgctggagagccccagagacctgcagttcagcgagatcagagagaccagcgccaaggtgaactggatgcccccccccagcagagccgacagcttcaaggtgagctaccagctggccgacggcggcgagccccagagcgtgcaggtggacggccaggccagaacccagaagctgcagggcctgatccccggcgccagatacgaggtgaccgtggtgagcgtgagaggcttcgaggagagcgagcccctgaccggcttcctgaccaccgtgcccgacggccccacccagctgagagccctgaacctgaccgagggcttcgccgtgctgcactggaagcccccccagaaccccgtggacacctacgacatccaggtgaccgcccccggcgccccccccctgcaggccgagacccccggcagcgccgtggactaccccctgcacgacctggtgctgcacaccaactacaccgccaccgtgagaggcctgagaggccccaacctgaccagccccgccagcatcaccttcaccaccggcctggaggcccccagagacctggaggccaaggaggtgacccccagaaccgccctgctgacctggaccgagccccccgtgagacccgccggctacctgctgagcttccacacccccggcggccagacccaggagatcctgctgcccggcggcatcaccagccaccagctgctgggcctgttccccagcaccagctacaacgccagactgcaggccatgtggggccagagcctgctgccccccgtgagcaccagcttcaccaccggcggcctgagaatccccttccccagagactgcggcgaggagatgcagaacggcgccggcgccagcagaaccagcaccatcttcctgaacggcaacagagagagacccctgatcgtgttctgcgacatggagaccgacggcggcggctggctggtgttccagagaagaatggacggccagaccgacttctggagagactgggaggactacgcccacggcttcggcaacatcagcggcgagttctggctgggcaacgaggccctgcacagcctgacccaggccggcgactacagcatgagagtggacctgagagccggcgacgaggccgtgttcgcccagtacgacagcttccacgtggacagcgccgccgagtactacagactgcacctggagggctaccacggcaccgccggcgacagcatgagctaccacagcggcagcgtgttcagcgccagagacagagaccccaacagcctgctgatcagctgcgccgtgagctacagaggcgcctggtggtacagaaactgccactacgccaacctgaacggcctgtacggcagcaccgtggaccaccagggcgtgagctggtaccactggaagggcttcgagttcagcgtgcccttcaccgagatgaagctgagacccagaaacttcagaagccccgccggcggcggctag

SEQ ID NO: 102137 - DNA, 654 bp, Artificial Sequence
  Description of Artificial Sequence: Synthetic coding sequence
gcccccggcaaggacgaggagatggcccccgccagcaccgagccccccacccccgagccccccatcaagcccagactggaggagctgaccgtgaccgacgccacccccgacagcctgagcctgagctggaccgtgcccgagggccagttcgaccacttcctggtgcagtacaagaacggcgacggccagcccaaggccaccagagtgcccggccacgaggacagagtgaccatcagcggcctggagcccgacaacaagtacaagatgaacctgtacggcttccacggcggccagagagtgggccccgtgagcgccatcggcgtgaccgccgccgaggaggagacccccagccccaccgagcccagcatggaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcaccgtgggcgtgacctag

SEQ ID NO: 102138 - DNA, 12729 bp, Artificial Sequence
  Description of Artificial Sequence: Synthetic coding sequence
atgatgcccgcccagtacgccctgaccagcagcctggtgctgctggtgctgctgagcaccgccagagccggccccttcagcagcagaagcaacgtgaccctgcccgcccccagaccccccccccagcccggcggccacaccgtgggcgccggcgtgggcagccccagcagccagctgtacgagcacaccgtggagggcggcgagaagcaggtggtgttcacccacagaatcaacctgccccccagcaccggctgcggctgcccccccggcaccgagccccccgtgctggccagcgaggtgcaggccctgagagtgagactggagatcctggaggagctggtgaagggcctgaaggagcagtgcaccggcggctgctgccccgccagcgcccaggccggcaccggccagaccgacgtgagaaccctgtgcagcctgcacggcgtgttcgacctgagcagatgcacctgcagctgcgagcccggctggggcggccccacctgcagcgaccccaccgacgccgagatcccccccagcagcccccccagcgccagcggcagctgccccgacgactgcaacgaccagggcagatgcgtgagaggcagatgcgtgtgcttccccggctacaccggccccagctgcggctggcccagctgccccggcgactgccagggcagaggcagatgcgtgcagggcgtgtgcgtgtgcagagccggcttcagcggccccgactgcagccagagaagctgccccagaggctgcagccagagaggcagatgcgagggcggcagatgcgtgtgcgaccccggctacaccggcgacgactgcggcatgagaagctgccccagaggctgcagccagagaggcagatgcgagaacggcagatgcgtgtgcaaccccggctacaccggcgaggactgcggcgtgagaagctgccccagaggctgcagccagagaggcagatgcaaggacggcagatgcgtgtgcgaccccggctacaccggcgaggactgcggcaccagaagctgcccctgggactgcggcgagggcggcagatgcgtggacggcagatgcgtgtgctggcccggctacaccggcgaggactgcagcaccagaacctgccccagagactgcagaggcagaggcagatgcgaggacggcgagtgcatctgcgacaccggctacagcggcgacgactgcggcgtgagaagctgccccggcgactgcaaccagagaggcagatgcgaggacggcagatgcgtgtgctggcccggctacaccggcaccgactgcggcagcagagcctgccccagagactgcagaggcagaggcagatgcgagaacggcgtgtgcgtgtgcaacgccggctacagcggcgaggactgcggcgtgagaagctgccccggcgactgcagaggcagaggcagatgcgagagcggcagatgcatgtgctggcccggctacaccggcagagactgcggcaccagagcctgccccggcgactgcagaggcagaggcagatgcgtggacggcagatgcgtgtgcaaccccggcttcaccggcgaggactgcggcagcagaagatgccccggcgactgcagaggccacggcctgtgcgaggacggcgtgtgcgtgtgcgacgccggctacagcggcgaggactgcagcaccagaagctgccccggcggctgcagaggcagaggccagtgcctggacggcagatgcgtgtgcgaggacggctacagcggcgaggactgcggcgtgagacagtgccccaacgactgcagccagcacggcgtgtgccaggacggcgtgtgcatctgctgggagggctacgtgagcgaggactgcagcatcagaacctgccccagcaactgccacggcagaggcagatgcgaggagggcagatgcctgtgcgaccccggctacaccggccccacctgcgccaccagaatgtgccccgccgactgcagaggcagaggcagatgcgtgcagggcgtgtgcctgtgccacgtgggctacggcggcgaggactgcggccaggaggagccccccgccagcgcctgccccggcggctgcggccccagagagctgtgcagagccggccagtgcgtgtgcgtggagggcttcagaggccccgactgcgccatccagacctgccccggcgactgcagaggcagaggcgagtgccacgacggcagctgcgtgtgcaaggacggctacgccggcgaggactgcggcgaggaggtgcccaccatcgagggcatgagaatgcacctgctggaggagaccaccgtgagaaccgagtggacccccgcccccggccccgtggacgcctacgagatccagttcatccccaccaccgagggcgccagcccccccttcaccgccagagtgcccagcagcgccagcgcctacgaccagagaggcctggcccccggccaggagtaccaggtgaccgtgagagccctgagaggcaccagctggggcctgcccgccagcaagaccatcaccaccatgatcgacggcccccaggacctgagagtggtggccgtgacccccaccaccctggagctgggctggctgagaccccaggccgaggtggacagattcgtggtgagctacgtgagcgccggcaaccagagagtgagactggaggtgccccccgaggccgacggcaccctgctgaccgacctgatgcccggcgtggagtacgtggtgaccgtgaccgccgagagaggcagagccgtgagctaccccgccagcgtgagagccaacaccggcagcagccccctgggcctgctgggcaccaccgacgagcccccccccagcggccccagcaccacccagggcgcccaggcccccctgctgcagcagagaccccaggagctgggcgagctgagagtgctgggcagagacgagaccggcagactgagagtggtgtggaccgcccagcccgacaccttcgcctacttccagctgagaatgagagtgcccgagggccccggcgcccacgaggaggtgctgcccggcgacgtgagacaggccctggtgcccccccccccccccggcaccccctacgagctgagcctgcacggcgtgccccccggcggcaagcccagcgaccccatcatctaccagggcatcatggacaaggacgaggagaagcccggcaagagcagcggcccccccagactgggcgagctgaccgtgaccgacagaaccagcgacagcctgctgctgagatggaccgtgcccgagggcgagttcgacagcttcgtgatccagtacaaggacagagacggccagccccaggtggtgcccgtggagggcccccagagaagcgccgtgatcaccagcctggaccccggcagaaagtacaagttcgtgctgtacggcttcgtgggcaagaagagacacggccccctggtggccgaggccaagatcctgccccagagcgaccccagccccggcaccccccccagactgggcaacctgtgggtgaccgaccccacccccgacagcctgcacctgagctggaccgtgcccgagggccagttcgacaccttcatggtgcagtacagagacagagacggcagaccccaggtggtgcccgtggagggccccgagagaagcttcgtggtgagcagcctggaccccgaccacaagtacagattcaccctgttcggcatcgccaacaagaagagatacggccccctgaccgccgacggcaccaccgcccccgagagaaaggaggagccccccagacccgagttcctggagcagcccctgctgggcgagctgaccgtgaccggcgtgacccccgacagcctgagactgagctggaccgtggcccagggccccttcgacagcttcatggtgcagtacaaggacgcccagggccagccccaggccgtgcccgtggccggcgacgagaacgaggtgaccgtgcccggcctggaccccgacagaaagtacaagatgaacctgtacggcctgagaggcagacagagagtgggccccgagagcgtggtggccaagaccgccccccaggaggacgtggacgagacccccagccccaccgagctgggcaccgaggcccccgagagccccgaggagcccctgctgggcgagctgaccgtgaccggcagcagccccgacagcctgagcctgttctggaccgtgccccagggcagcttcgacagcttcaccgtgcagtacaaggacagagacggcagacccagagccgtgagagtgggcggcaaggagagcgaggtgaccgtgggcggcctggagcccggccacaagtacaagatgcacctgtacggcctgcacgagggccagagagtgggccccgtgagcgccgtgggcgtgaccgccccccagcaggaggagaccccccccgccaccgagagccccctggagcccagactgggcgagctgaccgtgaccgacgtgacccccaacagcgtgggcctgagctggaccgtgcccgagggccagttcgacagcttcatcgtgcagtacaaggacaaggacggccagccccaggtggtgcccgtggccgccgaccagagagaggtgaccgtgtacaacctggagcccgagagaaagtacaagatgaacatgtacggcctgcacgacggccagagaatgggccccctgagcgtggtgatcgtgaccgcccccctgccccccgcccccgccaccgaggccagcaagccccccctggagcccagactgggcgagctgaccgtgaccgacatcacccccgacagcgtgggcctgagctggaccgtgcccgagggcgagttcgacagcttcgtggtgcagtacaaggacagagacggccagccccaggtggtgcccgtggccgccgaccagagagaggtgaccatccccgacctggagcccagcagaaagtacaagttcctgctgttcggcatccaggacggcaagagaagaagccccgtgagcgtggaggccaagaccgtggccagaggcgacgccagccccggcgccccccccagactgggcgagctgtgggtgaccgaccccacccccgacagcctgagactgagctggaccgtgcccgagggccagttcgacagcttcgtggtgcagttcaaggacaaggacggcccccaggtggtgcccgtggagggccacgagagaagcgtgaccgtgacccccctggacgccggcagaaagtacagattcctgctgtacggcctgctgggcaagaagagacacggccccctgaccgccgacggcaccaccgaggccagaagcgccatggacgacaccggcaccaagagaccccccaagcccagactgggcgaggagctgcaggtgaccaccgtgacccagaacagcgtgggcctgagctggaccgtgcccgagggccagttcgacagcttcgtggtgcagtacaaggacagagacggccagccccaggtggtgcccgtggagggcagcctgagagaggtgagcgtgcccggcctggaccccgcccacagatacaagctgctgctgtacggcctgcaccacggcaagagagtgggccccatcagcgccgtggccatcaccgccggcagagaggagaccgagaccgagaccaccgcccccaccccccccgcccccgagccccacctgggcgagctgaccgtggaggaggccaccagccacaccctgcacctgagctggatggtgaccgagggcgagttcgacagcttcgagatccagtacaccgacagagacggccagctgcagatggtgagaatcggcggcgacagaaacgacatcaccctgagcggcctggagagcgaccacagatacctggtgaccctgtacggcttcagcgacggcaagcacgtgggccccgtgcacgtggaggccctgaccgtgcccgaggaggagaagcccagcgagccccccaccgccacccccgagccccccatcaagcccagactgggcgagctgaccgtgaccgacgccacccccgacagcctgagcctgagctggaccgtgcccgagggccagttcgaccacttcctggtgcagtacagaaacggcgacggccagcccaaggccgtgagagtgcccggccacgaggagggcgtgaccatcagcggcctggagcccgaccacaagtacaagatgaacctgtacggcttccacggcggccagagaatgggccccgtgagcgtggtgggcgtgaccgccgccgaggaggagacccccagccccaccgagcccagcatggaggcccccgagcccgccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcgccgtgggcgtgaccgcccccgaggaggagagccccgacgcccccctggccaagctgagactgggccagatgaccgtgagagacatcaccagcgacagcctgagcctgagctggaccgtgcccgagggccagttcgaccacttcctggtgcagttcaagaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccgtgggcctgaccgcccccggcaaggacgaggagatggcccccgccagcaccgagccccccacccccgagccccccatcaagcccagactggaggagctgaccgtgaccgacgccacccccgacagcctgagcctgagctggaccgtgcccgagggccagttcgaccacttcctggtgcagtacaagaacggcgacggccagcccaaggccaccagagtgcccggccacgaggacagagtgaccatcagcggcctggagcccgacaacaagtacaagatgaacctgtacggcttccacggcggccagagagtgggccccgtgagcgccatcggcgtgaccgccgccgaggaggagacccccagccccaccgagcccagcatggaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcaccgtgggcgtgaccgccccccaggaggacgtggacgagacccccagccccaccgagcccggcaccgaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggccgtgagagtgggcggccaggagagcaaggtgaccgtgagaggcctggagcccggcagaaagtacaagatgcacctgtacggcctgcacgagggcagaagactgggccccgtgagcgccgtgggcgtgaccgaggacgaggccgagaccacccaggccgtgcccaccatgacccccgagccccccatcaagcccagactgggcgagctgaccatgaccgacgccacccccgacagcctgagcctgagctggaccgtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccagccccaccgagctgagcaccgaggcccccgagccccccgaggagcccctgctgggcgagctgaccgtgaccggcagcagccccgacagcctgagcctgagctggaccatcccccagggccacttcgacagcttcaccgtgcagtacaaggacagagacggcagaccccaggtgatgagagtgagaggcgaggagagcgaggtgaccgtgggcggcctggagcccggcagaaagtacaagatgcacctgtacggcctgcacgagggcagaagagtgggccccgtgagcaccgtgggcgtgaccgaggacgaggccgagaccacccaggccgtgcccaccaccacccccgagccccccaacaagcccagactgggcgagctgaccgtgaccgacgccacccccgacagcctgagcctgagctggatggtgcccgagggccagttcgaccacttcctggtgcagtacagaaacggcgacggccagcccaaggtggtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccgcccccaccgagcccagcaccgaggcccccgagccccccgaggagcccctgctgggcgagctgaccgtgaccggcagcagccccgacagcctgagcctgagctggaccatcccccagggcagattcgacagcttcaccgtgcagtacaaggacagagacggcagaccccaggtggtgagagtgagaggcgaggagagcgaggtgaccgtgggcggcctggagcccggctgcaagtacaagatgcacctgtacggcctgcacgagggccagagagtgggccccgtgagcgccgtgggcgtgaccgcccccaaggacgaggccgagaccacccaggccgtgcccaccatgacccccgagccccccatcaagcccagactgggcgagctgaccgtgaccgacgccacccccgacagcctgagcctgagctggatggtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccatcggcgtgaccgaggaggagacccccagccccaccgagcccagcaccgaggcccccgaggcccccgaggagcccctgctgggcgagctgaccgtgaccggcagcagccccgacagcctgagcctgagctggaccgtgccccagggcagattcgacagcttcaccgtgcagtacaaggacagagacggccagccccaggtggtgagagtgagaggcgaggagagcgaggtgaccgtgggcggcctggagcccggcagaaagtacaagatgcacctgtacggcctgcacgagggccagagagtgggccccgtgagcaccgtgggcatcaccgcccccctgcccacccccctgcccgtggagcccagactgggcgagctggccgtggccgccgtgaccagcgacagcgtgggcctgagctggaccgtggcccagggccccttcgacagcttcctggtgcagtacagagacgcccagggccagccccaggccgtgcccgtgagcggcgacctgagagccgtggccgtgagcggcctggaccccgccagaaagtacaagttcctgctgttcggcctgcagaacggcaagagacacggccccgtgcccgtggaggccagaaccgcccccgacaccaagcccagccccagactgggcgagctgaccgtgaccgacgccacccccgacagcgtgggcctgagctggaccgtgcccgagggcgagttcgacagcttcgtggtgcagtacaaggacaaggacggcagactgcaggtggtgcccgtggccgccaaccagagagaggtgaccgtgcagggcctggagcccagcagaaagtacagattcctgctgtacggcctgagcggcagaaagagactgggccccatcagcgccgacagcaccaccgcccccctggagaaggagctgcccccccacctgggcgagctgaccgtggccgaggagaccagcagcagcctgagactgagctggaccgtggcccagggccccttcgacagcttcgtggtgcagtacagagacaccgacggccagcccagagccgtgcccgtggccgccgaccagagaaccgtgaccgtggaggacctggagcccggcaagaagtacaagttcctgctgtacggcctgctgggcggcaagagactgggccccgtgagcgccctgggcatgaccgcccccgaggaggacacccccgcccccgagctggcccccgaggcccccgagccccccgaggagcccagactgggcgtgctgaccgtgaccgacaccacccccgacagcatgagactgagctggagcgtggcccagggccccttcgacagcttcgtggtgcagtacgaggacaccaacggccagccccaggccctgctggtggacggcgaccagagcaagatcctgatcagcggcctggagcccagcaccccctacagattcctgctgtacggcctgcacgagggcaagagactgggccccctgagcgccgagggcaccaccggcctggcccccgccggccagaccagcgaggagagcagacccagactgagccagctgagcgtgaccgacgtgaccaccagcagcctgagactgaactgggaggccccccccggcgccttcgacagcttcctgctgagattcggcgtgcccagccccagcaccctggagccccaccccagacccctgctgcagagagagctgatggtgcccggcaccagacacagcgccgtgctgagagacctgagaagcggcaccctgtacagcctgaccctgtacggcctgagaggcccccacaaggccgacagcatccagggcaccgccagaaccctgagccccgtgctggagagccccagagacctgcagttcagcgagatcagagagaccagcgccaaggtgaactggatgcccccccccagcagagccgacagcttcaaggtgagctaccagctggccgacggcggcgagccccagagcgtgcaggtggacggccaggccagaacccagaagctgcagggcctgatccccggcgccagatacgaggtgaccgtggtgagcgtgagaggcttcgaggagagcgagcccctgaccggcttcctgaccaccgtgcccgacggccccacccagctgagagccctgaacctgaccgagggcttcgccgtgctgcactggaagcccccccagaaccccgtggacacctacgacatccaggtgaccgcccccggcgccccccccctgcaggccgagacccccggcagcgccgtggactaccccctgcacgacctggtgctgcacaccaactacaccgccaccgtgagaggcctgagaggccccaacctgaccagccccgccagcatcaccttcaccaccggcctggaggcccccagagacctggaggccaaggaggtgacccccagaaccgccctgctgacctggaccgagccccccgtgagacccgccggctacctgctgagcttccacacccccggcggccagacccaggagatcctgctgcccggcggcatcaccagccaccagctgctgggcctgttccccagcaccagctacaacgccagactgcaggccatgtggggccagagcctgctgccccccgtgagcaccagcttcaccaccggcggcctgagaatccccttccccagagactgcggcgaggagatgcagaacggcgccggcgccagcagaaccagcaccatcttcctgaacggcaacagagagagacccctgatcgtgttctgcgacatggagaccgacggcggcggctggctggtgttccagagaagaatggacggccagaccgacttctggagagactgggaggactacgcccacggcttcggcaacatcagcggcgagttctggctgggcaacgaggccctgcacagcctgacccaggccggcgactacagcatgagagtggacctgagagccggcgacgaggccgtgttcgcccagtacgacagcttccacgtggacagcgccgccgagtactacagactgcacctggagggctaccacggcaccgccggcgacagcatgagctaccacagcggcagcgtgttcagcgccagagacagagaccccaacagcctgctgatcagctgcgccgtgagctacagaggcgcctggtggtacagaaactgccactacgccaacctgaacggcctgtacggcagcaccgtggaccaccagggcgtgagctggtaccactggaagggcttcgagttcagcgtgcccttcaccgagatgaagctgagacccagaaacttcagaagccccgccggcggcggctag

SEQ ID NO: 102139 - DNA, 12729 bp, Artificial Sequence
  Description of Artificial Sequence: Synthetic coding sequence
atgatgcccgcccagtacgccctgaccagcagcctggtgctgctggtgctgctgagcaccgccagagccggccccttcagcagcagaagcaacgtgaccctgcccgcccccagaccccccccccagcccggcggccacaccgtgggcgccggcgtgggcagccccagcagccagctgtacgagcacaccgtggagggcggcgagaagcaggtggtgttcacccacagaatcaacctgccccccagcaccggctgcggctgcccccccggcaccgagccccccgtgctggccagcgaggtgcaggccctgagagtgagactggagatcctggaggagctggtgaagggcctgaaggagcagtgcaccggcggctgctgccccgccagcgcccaggccggcaccggccagaccgacgtgagaaccctgtgcagcctgcacggcgtgttcgacctgagcagatgcacctgcagctgcgagcccggctggggcggccccacctgcagcgaccccaccgacgccgagatcccccccagcagcccccccagcgccagcggcagctgccccgacgactgcaacgaccagggcagatgcgtgagaggcagatgcgtgtgcttccccggctacaccggccccagctgcggctggcccagctgccccggcgactgccagggcagaggcagatgcgtgcagggcgtgtgcgtgtgcagagccggcttcagcggccccgactgcagccagagaagctgccccagaggctgcagccagagaggcagatgcgagggcggcagatgcgtgtgcgaccccggctacaccggcgacgactgcggcatgagaagctgccccagaggctgcagccagagaggcagatgcgagaacggcagatgcgtgtgcaaccccggctacgccggcgaggactgcggcgtgagaagctgccccagaggctgcagccagagaggcagatgcaaggacggcagatgcgtgtgcgaccccggctacaccggcgaggactgcggcaccagaagctgcccctgggactgcggcgagggcggcagatgcgtggacggcagatgcgtgtgctggcccggctacaccggcgaggactgcagcaccagaacctgccccagagactgcagaggcagaggcagatgcgaggacggcgagtgcatctgcgacaccggctacagcggcgacgactgcggcgtgagaagctgccccggcgactgcaaccagagaggcagatgcgaggacggcagatgcgtgtgctggcccggctacaccggcaccgactgcggcagcagagcctgccccagagactgcagaggcagaggcagatgcgagaacggcgtgtgcgtgtgcaacgccggctacagcggcgaggactgcggcgtgagaagctgccccggcgactgcagaggcagaggcagatgcgagagcggcagatgcatgtgctggcccggctacaccggcagagactgcggcaccagagcctgccccggcgactgcagaggcagaggcagatgcgtggacggcagatgcgtgtgcaaccccggcttcaccggcgaggactgcggcagcagaagatgccccggcgactgcagaggccacggcctgtgcgaggacggcgtgtgcgtgtgcgacgccggctacagcggcgaggactgcagcaccagaagctgccccggcggctgcagaggcagaggccagtgcctggacggcagatgcgtgtgcgaggacggctacagcggcgaggactgcggcgtgagacagtgccccaacgactgcagccagcacggcgtgtgccaggacggcgtgtgcatctgctgggagggctacgtgagcgaggactgcagcatcagaacctgccccagcaactgccacggcagaggcagatgcgaggagggcagatgcctgtgcgaccccggctacaccggccccacctgcgccaccagaatgtgccccgccgactgcagaggcagaggcagatgcgtgcagggcgtgtgcctgtgccacgtgggctacggcggcgaggactgcggccaggaggagccccccgccagcgcctgccccggcggctgcggccccagagagctgtgcagagccggccagtgcgtgtgcgtggagggcttcagaggccccgactgcgccatccagacctgccccggcgactgcagaggcagaggcgagtgccacgacggcagctgcgtgtgcaaggacggctacgccggcgaggactgcggcgaggaggtgcccaccatcgagggcatgagaatgcacctgctggaggagaccaccgtgagaaccgagtggacccccgcccccggccccgtggacgcctacgagatccagttcatccccaccaccgagggcgccagcccccccttcaccgccagagtgcccagcagcgccagcgcctacgaccagagaggcctggcccccggccaggagtaccaggtgaccgtgagagccctgagaggcaccagctggggcctgcccgccagcaagaccatcaccaccatgatcgacggcccccaggacctgagagtggtggccgtgacccccaccaccctggagctgggctggctgagaccccaggccgaggtggacagattcgtggtgagctacgtgagcgccggcaaccagagagtgagactggaggtgccccccgaggccgacggcaccctgctgaccgacctgatgcccggcgtggagtacgtggtgaccgtgaccgccgagagaggcagagccgtgagctaccccgccagcgtgagagccaacaccggcagcagccccctgggcctgctgggcaccaccgacgagcccccccccagcggccccagcaccacccagggcgcccaggcccccctgctgcagcagagaccccaggagctgggcgagctgagagtgctgggcagagacgagaccggcagactgagagtggtgtggaccgcccagcccgacaccttcgcctacttccagctgagaatgagagtgcccgagggccccggcgcccacgaggaggtgctgcccggcgacgtgagacaggccctggtgcccccccccccccccggcaccccctacgagctgagcctgcacggcgtgccccccggcggcaagcccagcgaccccatcatctaccagggcatcatggacaaggacgaggagaagcccggcaagagcagcggcccccccagactgggcgagctgaccgtgaccgacagaaccagcgacagcctgctgctgagatggaccgtgcccgagggcgagttcgacagcttcgtgatccagtacaaggacagagacggccagccccaggtggtgcccgtggagggcccccagagaagcgccgtgatcaccagcctggaccccggcagaaagtacaagttcgtgctgtacggcttcgtgggcaagaagagacacggccccctggtggccgaggccaagatcctgccccagagcgaccccagccccggcacccccccccacctgggcaacctgtgggtgaccgaccccacccccgacagcctgcacctgagctggaccgtgcccgagggccagttcgacaccttcatggtgcagtacagagacagagacggcagaccccaggtggtgcccgtggagggccccgagagaagcttcgtggtgagcagcctggaccccgaccacaagtacagattcaccctgttcggcatcgccaacaagaagagatacggccccctgaccgccgacggcaccaccgcccccgagagaaaggaggagccccccagacccgagttcctggagcagcccctgctgggcgagctgaccgtgaccggcgtgacccccgacagcctgagactgagctggaccgtggcccagggccccttcgacagcttcatggtgcagtacaaggacgcccagggccagccccaggccgtgcccgtggccggcgacgagaacgaggtgaccgtgcccggcctggaccccgacagaaagtacaagatgaacctgtacggcctgagaggcagacagagagtgggccccgagagcgtggtggccaagaccgccccccaggaggacgtggacgagacccccagccccaccgagctgggcaccgaggcccccgagagccccgaggagcccctgctgggcgagctgaccgtgaccggcagcagccccgacagcctgagcctgttctggaccgtgccccagggcagcttcgacagcttcaccgtgcagtacaaggacagagacggcagacccagagccgtgagagtgggcggcaaggagagcgaggtgaccgtgggcggcctggagcccggccacaagtacaagatgcacctgtacggcctgcacgagggccagagagtgggccccgtgagcgccgtgggcgtgaccgccccccagcaggaggagaccccccccgccaccgagagccccctggagcccagactgggcgagctgaccgtgaccgacgtgacccccaacagcgtgggcctgagctggaccgtgcccgagggccagttcgacagcttcatcgtgcagtacaaggacaaggacggccagccccaggtggtgcccgtggccgccgaccagagagaggtgaccgtgtacaacctggagcccgagagaaagtacaagatgaacatgtacggcctgcacgacggccagagaatgggccccctgagcgtggtgatcgtgaccgcccccctgccccccgcccccgccaccgaggccagcaagccccccctggagcccagactgggcgagctgaccgtgaccgacatcacccccgacagcgtgggcctgagctggaccgtgcccgagggcgagttcgacagcttcgtggtgcagtacaaggacagagacggccagccccaggtggtgcccgtggccgccgaccagagagaggtgaccatccccgacctggagcccagcagaaagtacaagttcctgctgttcggcatccaggacggcaagagaagaagccccgtgagcgtggaggccaagaccgtggccagaggcgacgccagccccggcgccccccccagactgggcgagctgtgggtgaccgaccccacccccgacagcctgagactgagctggaccgtgcccgagggccagttcgacagcttcgtggtgcagttcaaggacaaggacggcccccaggtggtgcccgtggagggccacgagagaagcgtgaccgtgacccccctggacgccggcagaaagtacagattcctgctgtacggcctgctgggcaagaagagacacggccccctgaccgccgacggcaccaccgaggccagaagcgccatggacgacaccggcaccaagagaccccccaagcccagactgggcgaggagctgcaggtgaccaccgtgacccagaacagcgtgggcctgagctggaccgtgcccgagggccagttcgacagcttcgtggtgcagtacaaggacagagacggccagccccaggtggtgcccgtggagggcagcctgagagaggtgagcgtgcccggcctggaccccgcccacagatacaagctgctgctgtacggcctgcaccacggcaagagagtgggccccatcagcgccgtggccatcaccgccggcagagaggagaccgagaccgagaccaccgcccccaccccccccgcccccgagccccacctgggcgagctgaccgtggaggaggccaccagccacaccctgcacctgagctggatggtgaccgagggcgagttcgacagcttcgagatccagtacaccgacagagacggccagctgcagatggtgagaatcggcggcgacagaaacgacatcaccctgagcggcctggagagcgaccacagatacctggtgaccctgtacggcttcagcgacggcaagcacgtgggccccgtgcacgtggaggccctgaccgtgcccgaggaggagaagcccagcgagccccccaccgccacccccgagccccccatcaagcccagactgggcgagctgaccgtgaccgacgccacccccgacagcctgagcctgagctggaccgtgcccgagggccagttcgaccacttcctggtgcagtacagaaacggcgacggccagcccaaggccgtgagagtgcccggccacgaggagggcgtgaccatcagcggcctggagcccgaccacaagtacaagatgaacctgtacggcttccacggcggccagagaatgggccccgtgagcgtggtgggcgtgaccgccgccgaggaggagacccccagccccaccgagcccagcatggaggcccccgagcccgccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcgccgtgggcgtgaccgcccccgaggaggagagccccgacgcccccctggccaagctgagactgggccagatgaccgtgagagacatcaccagcgacagcctgagcctgagctggaccgtgcccgagggccagttcgaccacttcctggtgcagttcaagaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccgtgggcctgaccgcccccggcaaggacgaggagatggcccccgccagcaccgagccccccacccccgagccccccatcaagcccagactggaggagctgaccgtgaccgacgccacccccgacagcctgagcctgagctggaccgtgcccgagggccagttcgaccacttcctggtgcagtacaagaacggcgacggccagcccaaggccaccagagtgcccggccacgaggacagagtgaccatcagcggcctggagcccgacaacaagtacaagatgaacctgtacggcttccacggcggccagagagtgggccccgtgagcgccatcggcgtgaccgccgccgaggaggagacccccagccccaccgagcccagcatggaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcaccgtgggcgtgaccgccccccaggaggacgtggacgagacccccagccccaccgagcccggcaccgaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggccgtgagagtgggcggccaggagagcaaggtgaccgtgagaggcctggagcccggcagaaagtacaagatgcacctgtacggcctgcacgagggcagaagactgggccccgtgagcgccgtgggcgtgaccgaggacgaggccgagaccacccaggccgtgcccaccatgacccccgagccccccatcaagcccagactgggcgagctgaccatgaccgacgccacccccgacagcctgagcctgagctggaccgtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccagccccaccgagctgagcaccgaggcccccgagccccccgaggagcccctgctgggcgagctgaccgtgaccggcagcagccccgacagcctgagcctgagctggaccatcccccagggccacttcgacagcttcaccgtgcagtacaaggacagagacggcagaccccaggtgatgagagtgagaggcgaggagagcgaggtgaccgtgggcggcctggagcccggcagaaagtacaagatgcacctgtacggcctgcacgagggcagaagagtgggccccgtgagcaccgtgggcgtgaccgaggacgaggccgagaccacccaggccgtgcccaccaccacccccgagccccccaacaagcccagactgggcgagctgaccgtgaccgacgccacccccgacagcctgagcctgagctggatggtgcccgagggccagttcgaccacttcctggtgcagtacagaaacggcgacggccagcccaaggtggtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccgcccccaccgagcccagcaccgaggcccccgagccccccgaggagcccctgctgggcgagctgaccgtgaccggcagcagccccgacagcctgagcctgagctggaccatcccccagggcagattcgacagcttcaccgtgcagtacaaggacagagacggcagaccccaggtggtgagagtgagaggcgaggagagcgaggtgaccgtgggcggcctggagcccggctgcaagtacaagatgcacctgtacggcctgcacgagggccagagagtgggccccgtgagcgccgtgggcgtgaccgcccccaaggacgaggccgagaccacccaggccgtgcccaccatgacccccgagccccccatcaagcccagactgggcgagctgaccgtgaccgacgccacccccgacagcctgagcctgagctggatggtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccatcggcgtgaccgaggaggagacccccagccccaccgagcccagcaccgaggcccccgaggcccccgaggagcccctgctgggcgagctgaccgtgaccggcagcagccccgacagcctgagcctgagctggaccgtgccccagggcagattcgacagcttcaccgtgcagtacaaggacagagacggccagccccaggtggtgagagtgagaggcgaggagagcgaggtgaccgtgggcggcctggagcccggcagaaagtacaagatgcacctgtacggcctgcacgagggccagagagtgggccccgtgagcaccgtgggcatcaccgcccccctgcccacccccctgcccgtggagcccagactgggcgagctggccgtggccgccgtgaccagcgacagcgtgggcctgagctggaccgtggcccagggccccttcgacagcttcctggtgcagtacagagacgcccagggccagccccaggccgtgcccgtgagcggcgacctgagagccgtggccgtgagcggcctggaccccgccagaaagtacaagttcctgctgttcggcctgcagaacggcaagagacacggccccgtgcccgtggaggccagaaccgcccccgacaccaagcccagccccagactgggcgagctgaccgtgaccgacgccacccccgacagcgtgggcctgagctggaccgtgcccgagggcgagttcgacagcttcgtggtgcagtacaaggacaaggacggcagactgcaggtggtgcccgtggccgccaaccagagagaggtgaccgtgcagggcctggagcccagcagaaagtacagattcctgctgtacggcctgagcggcagaaagagactgggccccatcagcgccgacagcaccaccgcccccctggagaaggagctgcccccccacctgggcgagctgaccgtggccgaggagaccagcagcagcctgagactgagctggaccgtggcccagggccccttcgacagcttcgtggtgcagtacagagacaccgacggccagcccagagccgtgcccgtggccgccgaccagagaaccgtgaccgtggaggacctggagcccggcaagaagtacaagttcctgctgtacggcctgctgggcggcaagagactgggccccgtgagcgccctgggcatgaccgcccccgaggaggacacccccgcccccgagctggcccccgaggcccccgagccccccgaggagcccagactgggcgtgctgaccgtgaccgacaccacccccgacagcatgagactgagctggagcgtggcccagggccccttcgacagcttcgtggtgcagtacgaggacaccaacggccagccccaggccctgctggtggacggcgaccagagcaagatcctgatcagcggcctggagcccagcaccccctacagattcctgctgtacggcctgcacgagggcaagagactgggccccctgagcgccgagggcaccaccggcctggcccccgccggccagaccagcgaggagagcagacccagactgagccagctgagcgtgaccgacgtgaccaccagcagcctgagactgaactgggaggccccccccggcgccttcgacagcttcctgctgagattcggcgtgcccagccccagcaccctggagccccaccccagacccctgctgcagagagagctgatggtgcccggcaccagacacagcgccgtgctgagagacctgagaagcggcaccctgtacagcctgaccctgtacggcctgagaggcccccacaaggccgacagcatccagggcaccgccagaaccctgagccccgtgctggagagccccagagacctgcagttcagcgagatcagagagaccagcgccaaggtgaactggatgcccccccccagcagagccgacagcttcaaggtgagctaccagctggccgacggcggcgagccccagagcgtgcaggtggacggccaggccagaacccagaagctgcagggcctgatccccggcgccagatacgaggtgaccgtggtgagcgtgagaggcttcgaggagagcgagcccctgaccggcttcctgaccaccgtgcccgacggccccacccagctgagagccctgaacctgaccgagggcttcgccgtgctgcactggaagcccccccagaaccccgtggacacctacgacgtgcaggtgaccgcccccggcgccccccccctgcaggccgagacccccggcagcgccgtggactaccccctgcacgacctggtgctgcacaccaactacaccgccaccgtgagaggcctgagaggccccaacctgaccagccccgccagcatcaccttcaccaccggcctggaggcccccagagacctggaggccaaggaggtgacccccagaaccgccctgctgacctggaccgagccccccgtgagacccgccggctacctgctgagcttccacacccccggcggccagaaccaggagatcctgctgcccggcggcatcaccagccaccagctgctgggcctgttccccagcaccagctacaacgccagactgcaggccatgtggggccagagcctgctgccccccgtgagcaccagcttcaccaccggcggcctgagaatccccttccccagagactgcggcgaggagatgcagaacggcgccggcgccagcagaaccagcaccatcttcctgaacggcaacagagagagacccctgaacgtgttctgcgacatggagaccgacggcggcggctggctggtgttccagagaagaatggacggccagaccgacttctggagagactgggaggactacgcccacggcttcggcaacatcagcggcgagttctggctgggcaacgaggccctgcacagcctgacccaggccggcgactacagcatgagagtggacctgagagccggcgacgaggccgtgttcgcccagtacgacagcttccacgtggacagcgccgccgagtactacagactgcacctggagggctaccacggcaccgccggcgacagcatgagctaccacagcggcagcgtgttcagcgccagagacagagaccccaacagcctgctgatcagctgcgccgtgagctacagaggcgcctggtggtacagaaactgccactacgccaacctgaacggcctgtacggcagcaccgtggaccaccagggcgtgagctggtaccactggaagggcttcgagttcagcgtgcccttcaccgagatgaagctgagacccagaaacttcagaagccccgccggcggcggctag

SEQ ID NO: 102140 - DNA, 843 bp, Artificial Sequence
  Description of Artificial Sequence: Synthetic coding sequence
atggtgaccgagggcgagttcgacagcttcgagatccagtacaccgacagagacggccagctgcagatggtgagaatcggcggcgacagaaacgacatcaccctgagcggcctggagagcgaccacagatacctggtgaccctgtacggcttcagcgacggcaagcacgtgggccccgtgcacgtggaggccctgaccgtgcccgaggaggagaagcccagcgagccccccaccgccacccccgagccccccatcaagcccagactgggcgagctgaccgtgaccgacgccacccccgacagcctgagcctgagctggaccgtgcccgagggccagttcgaccacttcctggtgcagtacagaaacggcgacggccagcccaaggccgtgagagtgcccggccacgaggagggcgtgaccatcagcggcctggagcccgaccacaagtacaagatgaacctgtacggcttccacggcggccagagaatgggccccgtgagcgtggtgggcgtgaccgccgccgaggaggagacccccagccccaccgagcccagcatggaggcccccgagcccgccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcgccgtgggcgtgacctag

SEQ ID NO: 102141 - DNA, 12729 bp, Artificial Sequence
  Description of Artificial Sequence: Synthetic coding sequence
atgatgcccgcccagtacgccctgaccagcagcctggtgctgctggtgctgctgagcaccgccagagccggccccttcagcagcagaagcaacgtgaccctgcccgcccccagaccccccccccagcccggcggccacaccgtgggcgccggcgtgggcagccccagcagccagctgtacgagcacaccgtggagggcggcgagaagcaggtggtgttcacccacagaatcaacctgccccccagcaccggctgcggctgcccccccggcaccgagccccccgtgctggccagcgaggtgcaggccctgagagtgagactggagatcctggaggagctggtgaagggcctgaaggagcagtgcaccggcggctgctgccccgccagcgcccaggccggcaccggccagaccgacgtgagaaccctgtgcagcctgcacggcgtgttcgacctgagcagatgcacctgcagctgcgagcccggctggggcggccccacctgcagcgaccccaccgacgccgagatcccccccagcagcccccccagcgccagcggcagctgccccgacgactgcaacgaccagggcagatgcgtgagaggcagatgcgtgtgcttccccggctacaccggccccagctgcggctggcccagctgccccggcgactgccagggcagaggcagatgcgtgcagggcgtgtgcgtgtgcagagccggcttcagcggccccgactgcagccagagaagctgccccagaggctgcagccagagaggcagatgcgagggcggcagatgcgtgtgcgaccccggctacaccggcgacgactgcggcatgagaagctgccccagaggctgcagccagagaggcagatgcgagaacggcagatgcgtgtgcaaccccggctacaccggcgaggactgcggcgtgagaagctgccccagaggctgcagccagagaggcagatgcaaggacggcagatgcgtgtgcgaccccggctacaccggcgaggactgcggcaccagaagctgcccctgggactgcggcgagggcggcagatgcgtggacggcagatgcgtgtgctggcccggctacaccggcgaggactgcagcaccagaacctgccccagagactgcagaggcagaggcagatgcgaggacggcgagtgcatctgcgacaccggctacagcggcgacgactgcggcgtgagaagctgccccggcgactgcaaccagagaggcagatgcgaggacggcagatgcgtgtgctggcccggctacaccggcaccgactgcggcagcagagcctgccccagagactgcagaggcagaggcagatgcgagaacggcgtgtgcgtgtgcaacgccggctacagcggcgaggactgcggcgtgagaagctgccccggcgactgcagaggcagaggcagatgcgagagcggcagatgcatgtgctggcccggctacaccggcagagactgcggcaccagagcctgccccggcgactgcagaggcagaggcagatgcgtggacggcagatgcgtgtgcaaccccggcttcaccggcgaggactgcggcagcagaagatgccccggcgactgcagaggccacggcctgtgcgaggacggcgtgtgcgtgtgcgacgccggctacagcggcgaggactgcagcaccagaagctgccccggcggctgcagaggcagaggccagtgcctggacggcagatgcgtgtgcgaggacggctacagcggcgaggactgcggcgtgagacagtgccccaacgactgcagccagcacggcgtgtgccaggacggcgtgtgcatctgctgggagggctacgtgagcgaggactgcagcatcagaacctgccccagcaactgccacggcagaggcagatgcgaggagggcagatgcctgtgcgaccccggctacaccggccccacctgcgccaccagaatgtgccccgccgactgcagaggcagaggcagatgcgtgcagggcgtgtgcctgtgccacgtgggctacggcggcgaggactgcggccaggaggagccccccgccagcgcctgccccggcggctgcggccccagagagctgtgcagagccggccagtgcgtgtgcgtggagggcttcagaggccccgactgcgccatccagacctgccccggcgactgcagaggcagaggcgagtgccacgacggcagctgcgtgtgcaaggacggctacgccggcgaggactgcggcgaggaggtgcccaccatcgagggcatgagaatgcacctgctggaggagaccaccgtgagaaccgagtggacccccgcccccggccccgtggacgcctacgagatccagttcatccccaccaccgagggcgccagcccccccttcaccgccagagtgcccagcagcgccagcgcctacgaccagagaggcctggcccccggccaggagtaccaggtgaccgtgagagccctgagaggcaccagctggggcctgcccgccagcaagaccatcaccaccatgatcgacggcccccaggacctgagagtggtggccgtgacccccaccaccctggagctgggctggctgagaccccaggccgaggtggacagattcgtggtgagctacgtgagcgccggcaaccagagagtgagactggaggtgccccccgaggccgacggcaccctgctgaccgacctgatgcccggcgtggagtacgtggtgaccgtgaccgccgagagaggcagagccgtgagctaccccgccagcgtgagagccaacaccggcagcagccccctgggcctgctgggcaccaccgacgagcccccccccagcggccccagcaccacccagggcgcccaggcccccctgctgcagcagagaccccaggagctgggcgagctgagagtgctgggcagagacgagaccggcagactgagagtggtgtggaccgcccagcccgacaccttcgcctacttccagctgagaatgagagtgcccgagggccccggcgcccacgaggaggtgctgcccggcgacgtgagacaggccctggtgcccccccccccccccggcaccccctacgagctgagcctgcacggcgtgccccccggcggcaagcccagcgaccccatcatctaccagggcatcatggacaaggacgaggagaagcccggcaagagcagcggcccccccagactgggcgagctgaccgtgaccgacagaaccagcgacagcctgctgctgagatggaccgtgcccgagggcgagttcgacagcttcgtgatccagtacaaggacagagacggccagccccaggtggtgcccgtggagggcccccagagaagcgccgtgatcaccagcctggaccccggcagaaagtacaagttcgtgctgtacggcttcgtgggcaagaagagacacggccccctggtggccgaggccaagatcctgccccagagcgaccccagccccggcaccccccccagactgggcaacctgtgggtgaccgaccccacccccgacagcctgcacctgagctggaccgtgcccgagggccagttcgacaccttcatggtgcagtacagagacagagacggcagaccccaggtggtgcccgtggagggccccgagagaagcttcgtggtgagcagcctggaccccgaccacaagtacagattcaccctgttcggcatcgccaacaagaagagatacggccccctgaccgccgacggcaccaccgcccccgagagaaaggaggagcccccccaccccgagttcctggagcagcccctgctgggcgagctgaccgtgaccggcgtgacccccgacagcctgagactgagctggaccgtggcccagggccccttcgacagcttcatggtgcagtacaaggacgcccagggccagccccaggccgtgcccgtggccggcgacgagaacgaggtgaccgtgcccggcctggaccccgacagaaagtacaagatgaacctgtacggcctgagaggcagacagagagtgggccccgagagcgtggtggccaagaccgccccccaggaggacgtggacgagacccccagccccaccgagctgggcaccgaggcccccgagagccccgaggagcccctgctgggcgagctgaccgtgaccggcagcagccccgacagcctgagcctgttctggaccgtgccccagggcagcttcgacagcttcaccgtgcagtacaaggacagagacggcagacccagagccgtgagagtgggcggcaaggagagcgaggtgaccgtgggcggcctggagcccggccacaagtacaagatgcacctgtacggcctgcacgagggccagagagtgggccccgtgagcgccgtgggcgtgaccgccccccagcaggaggagaccccccccgccaccgagagccccctggagcccagactgggcgagctgaccgtgaccgacgtgacccccaacagcgtgggcctgagctggaccgtgcccgagggccagttcgacagcttcatcgtgcagtacaaggacaaggacggccagccccaggtggtgcccgtggccgccgaccagagagaggtgaccgtgtacaacctggagcccgagagaaagtacaagatgaacatgtacggcctgcacgacggccagagaatgggccccctgagcgtggtgatcgtgaccgcccccctgccccccgcccccgccaccgaggccagcaagccccccctggagcccagactgggcgagctgaccgtgaccgacatcacccccgacagcgtgggcctgagctggaccgtgcccgagggcgagttcgacagcttcgtggtgcagtacaaggacagagacggccagccccaggtggtgcccgtggccgccgaccagagagaggtgaccatccccgacctggagcccagcagaaagtacaagttcctgctgttcggcatccaggacggcaagagaagaagccccgtgagcgtggaggccaagaccgtggccagaggcgacgccagccccggcgccccccccagactgggcgagctgtgggtgaccgaccccacccccgacagcctgagactgagctggaccgtgcccgagggccagttcgacagcttcgtggtgcagttcaaggacaaggacggcccccaggtggtgcccgtggagggccacgagagaagcgtgaccgtgacccccctggacgccggcagaaagtacagattcctgctgtacggcctgctgggcaagaagagacacggccccctgaccgccgacggcaccaccgaggccagaagcgccatggacgacaccggcaccaagagaccccccaagcccagactgggcgaggagctgcaggtgaccaccgtgacccagaacagcgtgggcctgagctggaccgtgcccgagggccagttcgacagcttcgtggtgcagtacaaggacagagacggccagccccaggtggtgcccgtggagggcagcctgagagaggtgagcgtgcccggcctggaccccgcccacagatacaagctgctgctgtacggcctgcaccacggcaagagagtgggccccatcagcgccgtggccatcaccgccggcagagaggagaccgagaccgagaccaccgcccccaccccccccgcccccgagccccacctgggcgagctgaccgtggaggaggccaccagccacaccctgcacctgagctggatggtgaccgagggcgagttcgacagcttcgagatccagtacaccgacagagacggccagctgcagatggtgagaatcggcggcgacagaaacgacatcaccctgagcggcctggagagcgaccacagatacctggtgaccctgtacggcttcagcgacggcaagcacgtgggccccgtgcacgtggaggccctgaccgtgcccgaggaggagaagcccagcgagccccccaccgccacccccgagccccccatcaagcccagactgggcgagctgaccgtgaccgacgccacccccgacagcctgagcctgagctggaccgtgcccgagggccagttcgaccacttcctggtgcagtacagaaacggcgacggccagcccaaggccgtgagagtgcccggccacgaggagggcgtgaccatcagcggcctggagcccgaccacaagtacaagatgaacctgtacggcttccacggcggccagagaatgggccccgtgagcgtggtgggcgtgaccgccgccgaggaggagacccccagccccaccgagcccagcatggaggcccccgagcccgccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcgccgtgggcgtgaccgcccccgaggaggagagccccgacgcccccctggccaagctgagactgggccagatgaccgtgagagacatcaccagcgacagcctgagcctgagctggaccgtgcccgagggccagttcgaccacttcctggtgcagttcaagaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccgtgggcctgaccgcccccggcaaggacgaggagatggcccccgccagcaccgagccccccacccccgagccccccatcaagcccagactggaggagctgaccgtgaccgacgccacccccgacagcctgagcctgagctggaccgtgcccgagggccagttcgaccacttcctggtgcagtacaagaacggcgacggccagcccaaggccaccagagtgcccggccacgaggacagagtgaccatcagcggcctggagcccgacaacaagtacaagatgaacctgtacggcttccacggcggccagagagtgggccccgtgagcgccatcggcgtgaccgccgccgaggaggagacccccagccccaccgagcccagcatggaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcaccgtgggcgtgaccgccccccaggaggacgtggacgagacccccagccccaccgagcccggcaccgaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggccgtgagagtgggcggccaggagagcaaggtgaccgtgagaggcctggagcccggcagaaagtacaagatgcacctgtacggcctgcacgagggcagaagactgggccccgtgagcgccgtgggcgtgaccgaggacgaggccgagaccacccaggccgtgcccaccatgacccccgagccccccatcaagcccagactgggcgagctgaccatgaccgacgccacccccgacagcctgagcctgagctggaccgtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccagccccaccgagctgagcaccgaggcccccgagccccccgaggagcccctgctgggcgagctgaccgtgaccggcagcagccccgacagcctgagcctgagctggaccatcccccagggccacttcgacagcttcaccgtgcagtacaaggacagagacggcagaccccaggtgatgagagtgagaggcgaggagagcgaggtgaccgtgggcggcctggagcccggcagaaagtacaagatgcacctgtacggcctgcacgagggcagaagagtgggccccgtgagcaccgtgggcgtgaccgaggacgaggccgagaccacccaggccgtgcccaccaccacccccgagccccccaacaagcccagactgggcgagctgaccgtgaccgacgccacccccgacagcctgagcctgagctggatggtgcccgagggccagttcgaccacttcctggtgcagtacagaaacggcgacggccagcccaaggtggtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccgcccccaccgagcccagcaccgaggcccccgagccccccgaggagcccctgctgggcgagctgaccgtgaccggcagcagccccgacagcctgagcctgagctggaccatcccccagggcagattcgacagcttcaccgtgcagtacaaggacagagacggcagaccccaggtggtgagagtgagaggcgaggagagcgaggtgaccgtgggcggcctggagcccggctgcaagtacaagatgcacctgtacggcctgcacgagggccagagagtgggccccgtgagcgccgtgggcgtgaccgcccccaaggacgaggccgagaccacccaggccgtgcccaccatgacccccgagccccccatcaagcccagactgggcgagctgaccgtgaccgacgccacccccgacagcctgagcctgagctggatggtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccatcggcgtgaccgaggaggagacccccagccccaccgagcccagcaccgaggcccccgaggcccccgaggagcccctgctgggcgagctgaccgtgaccggcagcagccccgacagcctgagcctgagctggaccatcccccagggcagattcgacagcttcaccgtgcagtacaaggacagagacggccagccccaggtggtgagagtgagaggcgaggagagcgaggtgaccgtgggcggcctggagcccggcagaaagtacaagatgcacctgtacggcctgcacgagggccagagagtgggccccgtgagcaccgtgggcatcaccgcccccctgcccacccccctgcccgtggagcccagactgggcgagctggccgtggccgccgtgaccagcgacagcgtgggcctgagctggaccgtggcccagggccccttcgacagcttcctggtgcagtacagagacgcccagggccagccccaggccgtgcccgtgagcggcgacctgagagccgtggccgtgagcggcctggaccccgccagaaagtacaagttcctgctgttcggcctgcagaacggcaagagacacggccccgtgcccgtggaggccagaaccgcccccgacaccaagcccagccccagactgggcgagctgaccgtgaccgacgccacccccgacagcgtgggcctgagctggaccgtgcccgagggcgagttcgacagcttcgtggtgcagtacaaggacaaggacggcagactgcaggtggtgcccgtggccgccaaccagagagaggtgaccgtgcagggcctggagcccagcagaaagtacagattcctgctgtacggcctgagcggcagaaagagactgggccccatcagcgccgacagcaccaccgcccccctggagaaggagctgcccccccacctgggcgagctgaccgtggccgaggagaccagcagcagcctgagactgagctggaccgtggcccagggccccttcgacagcttcgtggtgcagtacagagacaccgacggccagcccagagccgtgcccgtggccgccgaccagagaaccgtgaccgtggaggacctggagcccggcaagaagtacaagttcctgctgtacggcctgctgggcggcaagagactgggccccgtgagcgccctgggcatgaccgcccccgaggaggacacccccgcccccgagctggcccccgaggcccccgagccccccgaggagcccagactgggcgtgctgaccgtgaccgacaccacccccgacagcatgagactgagctggagcgtggcccagggccccttcgacagcttcgtggtgcagtacgaggacaccaacggccagccccaggccctgctggtggacggcgaccagagcaagatcctgatcagcggcctggagcccagcaccccctacagattcctgctgtacggcctgcacgagggcaagagactgggccccctgagcgccgagggcaccaccggcctggcccccgccggccagaccagcgaggagagcagacccagactgagccagctgagcgtgaccgacgtgaccaccagcagcctgagactgaactgggaggccccccccggcgccttcgacagcttcctgctgagattcggcgtgcccagccccagcaccctggagccccaccccagacccctgctgcagagagagctgatggtgcccggcaccagacacagcgccgtgctgagagacctgagaagcggcaccctgtacagcctgaccctgtacggcctgagaggcccccacaaggccgacagcatccagggcaccgccagaaccctgagccccgtgctggagagccccagagacctgcagttcagcgagatcagagagaccagcgccaaggtgaactggatgcccccccccagcagagccgacagcttcaaggtgagctaccagctggccgacggcggcgagccccagagcgtgcaggtggacggccaggccagaacccagaagctgcagggcctgatccccggcgccagatacgaggtgaccgtggtgagcgtgagaggcttcgaggagagcgagcccctgaccggcttcctgaccaccgtgcccgacggccccacccagctgagagccctgaacctgaccgagggcttcgccgtgctgcactggaagcccccccagaaccccgtggacacctacgacatccaggtgaccgcccccggcgccccccccctgcaggccgagacccccggcagcgccgtggactaccccctgcacgacctggtgctgcacaccaactacaccgccaccgtgagaggcctgagaggccccaacctgaccagccccgccagcatcaccttcaccaccggcctggaggcccccagagacctggaggccaaggaggtgacccccagaaccgccctgctgacctggaccgagccccccgtgagacccgccggctacctgctgagcttccacacccccggcggccagacccaggagatcctgctgcccggcggcatcaccagccaccagctgctgggcctgttccccagcaccagctacaacgccagactgcaggccacctggggccagagcctgctgccccccgtgagcaccagcttcaccaccggcggcctgagaatccccttccccagagactgcggcgaggagatgcagaacggcgccggcgccagcagaaccagcaccatcttcctgaacggcaacagagagagacccctgaacgtgttctgcgacatggagaccgacggcggcggctggctggtgttccagagaagaatggacggccagaccgacttctggagagactgggaggactacgcccacggcttcggcaacatcagcggcgagttctggctgggcaacgaggccctgcacagcctgacccaggccggcgactacagcatgagagtggacctgagagccggcgacgaggccgtgttcgcccagtacgacagcttccacgtggacagcgccgccgagtactacagactgcacctggagggctaccacggcaccgccggcgacagcatgagctaccacagcggcagcgtgttcagcgccagagacagagaccccaacagcctgctgatcagctgcgccgtgagctacagaggcgcctggtggtacagaaactgccactacgccaacctgaacggcctgtacggcagcaccgtggaccaccagggcgtgagctggtaccactggaagggcttcgagttcagcgtgcccttcaccgagatgaagctgagacccagaaacttcagaagccccgccggcggcggctag

SEQ ID NO: 102142 - DNA, 2022 bp, Artificial Sequence
  Description of Artificial Sequence: Synthetic coding sequence
atgagactgagctggagcgtggcccagggccccttcgacagcttcgtggtgcagtacgaggacaccaacggccagccccaggccctgctggtggacggcgaccagagcaagatcctgatcagcggcctggagcccagcaccccctacagattcctgctgtacggcctgcacgagggcaagagactgggccccctgagcgccgagggcaccaccggcctggcccccgccggccagaccagcgaggagagcagacccagactgagccagctgagcgtgaccgacgtgaccaccagcagcctgagactgaactgggaggccccccccggcgccttcgacagcttcctgctgagattcggcgtgcccagccccagcaccctggagccccaccccagacccctgctgcagagagagctgatggtgcccggcaccagacacagcgccgtgctgagagacctgagaagcggcaccctgtacagcctgaccctgtacggcctgagaggcccccacaaggccgacagcatccagggcaccgccagaaccctgagccccgtgctggagagccccagagacctgcagttcagcgagatcagagagaccagcgccaaggtgaactggatgcccccccccagcagagccgacagcttcaaggtgagctaccagctggccgacggcggcgagccccagagcgtgcaggtggacggccaggccagaacccagaagctgcagggcctgatccccggcgccagatacgaggtgaccgtggtgagcgtgagaggcttcgaggagagcgagcccctgaccggcttcctgaccaccgtgcccgacggccccacccagctgagagccctgaacctgaccgagggcttcgccgtgctgcactggaagcccccccagaaccccgtggacacctacgacgtgcaggtgaccgcccccggcgccccccccctgcaggccgagacccccggcagcgccgtggactaccccctgcacgacctggtgctgcacaccaactacaccgccaccgtgagaggcctgagaggccccaacctgaccagccccgccagcatcaccttcaccaccggcctggaggcccccagagacctggaggccaaggaggtgacccccagaaccgccctgctgacctggaccgagccccccgtgagacccgccggctacctgctgagcttccacacccccggcggccagaaccaggagatcctgctgcccggcggcatcaccagccaccagctgctgggcctgttccccagcaccagctacaacgccagactgcaggccatgtggggccagagcctgctgccccccgtgagcaccagcttcaccaccggcggcctgagaatccccttccccagagactgcggcgaggagatgcagaacggcgccggcgccagcagaaccagcaccatcttcctgaacggcaacagagagagacccctgaacgtgttctgcgacatggagaccgacggcggcggctggctggtgttccagagaagaatggacggccagaccgacttctggagagactgggaggactacgcccacggcttcggcaacatcagcggcgagttctggctgggcaacgaggccctgcacagcctgacccaggccggcgactacagcatgagagtggacctgagagccggcgacgaggccgtgttcgcccagtacgacagcttccacgtggacagcgccgccgagtactacagactgcacctggagggctaccacggcaccgccggcgacagcatgagctaccacagcggcagcgtgttcagcgccagagacagagaccccaacagcctgctgatcagctgcgccgtgagctacagaggcgcctggtggtacagaaactgccactacgccaacctgaacggcctgtacggcagcaccgtggaccaccagggcgtgagctggtaccactggaagggcttcgagttcagcgtgcccttcaccgagatgaagctgagacccagaaacttcagaagccccgccggcggcggctag

SEQ ID NO: 102143 - DNA, 654 bp, Artificial Sequence; identical to SEQ ID NO: 102137
  Description of Artificial Sequence: Synthetic coding sequence

SEQ ID NO: 102144 - DNA, 942 bp, Artificial Sequence
  Description of Artificial Sequence: Synthetic coding sequence
accgagcccggcaccgaggcccccggcccccccgaggagcccctgctgggcgagctgaccgtgaccggcagcagccccgacagcctgagcctgagctggaccgtgccccagggcagattcgacagcttcaccgtgcagtacaaggacagagacggcagaccccaggccgtgagagtgggcggccaggagagcaaggtgaccgtgagaggcctggagcccggcagaaagtacaagatgcacctgtacggcctgcacgagggcagaagactgggccccgtgagcgccgtgggcgtgaccgaggacgaggccgagaccacccaggccgtgcccaccatgacccccgagccccccatcaagcccagactgggcgagctgaccatgaccgacgccacccccgacagcctgagcctgagctggaccgtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccagccccaccgagctgagcaccgaggcccccgagccccccgaggagcccctgctgggcgagctgaccgtgaccggcagcagccccgacagcctgagcctgagctggaccatcccccagggccacttcgacagcttcaccgtgcagtacaaggacagagacggcagaccccaggtgatgagagtgagaggcgaggagagcgaggtgaccgtgggcggcctggagcccggcagaaagtacaagatgcacctgtacggcctgcacgagggcagaagagtgggccccgtgagcaccgtgggcgtgacctag

SEQ ID NO: 102145 - DNA, 942 bp, Artificial Sequence
  Description of Artificial Sequence: Synthetic coding sequence
atgacccccgagccccccatcaagcccagactgggcgagctgaccatgaccgacgccacccccgacagcctgagcctgagctggaccgtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccatcagcgtgaccggcgtgaccgccgccgaggaggagacccccagccccaccgagctgagcaccgaggcccccgagccccccgaggagcccctgctgggcgagctgaccgtgaccggcagcagccccgacagcctgagcctgagctggaccatcccccagggccacttcgacagcttcaccgtgcagtacaaggacagagacggcagaccccaggtgatgagagtgagaggcgaggagagcgaggtgaccgtgggcggcctggagcccggcagaaagtacaagatgcacctgtacggcctgcacgagggcagaagagtgggccccgtgagcaccgtgggcgtgaccgcccccgaggacgaggaggaggagacccccgcccccaccgagcccagcaccgaggcccccgagccccccgaggagcccctgctgggcgagctgaccgtgaccggcagcagccccgacagcctgagcctgagctggaccatcccccagggcagattcgacagcttcaccgtgcagtacaaggacagagacggcagaccccaggtggtgagagtgagaggcgaggagagcgaggtgaccgtgggcggcctggagcccggctgcaagtacaagatgcacctgtacggcctgcacgagggccagagagtgggccccgtgagcgccgtgggcgtgacctag

SEQ ID NO: 102146 - DNA, 1281 bp, Artificial Sequence
  Description of Artificial Sequence: Synthetic coding sequence
gccggcgaggactgcggcgaggaggtgcccaccatcgagggcatgagaatgcacctgctggaggagaccaccgtgagaaccgagtggacccccgcccccggccccgtggacgcctacgagatccagttcatccccaccaccgagggcgccagcccccccttcaccgccagagtgcccagcagcgccagcgcctacgaccagagaggcctggcccccggccaggagtaccaggtgaccgtgagagccctgagaggcaccagctggggcctgcccgccagcaagaccatcaccaccatgatcgacggcccccaggacctgagagtggtggccgtgacccccaccaccctggagctgggctggctgagaccccaggccgaggtggacagattcgtggtgagctacgtgagcgccggcaaccagagagtgagactggaggtgccccccgaggccgacggcaccctgctgaccgacctgatgcccggcgtggagtacgtggtgaccgtgaccgccgagagaggcagagccgtgagctaccccgccagcgtgagagccaacaccggcagcagccccctgggcctgctgggcaccaccgacgagcccccccccagcggccccagcaccacccagggcgcccaggcccccctgctgcagcagagaccccaggagctgggcgagctgagagtgctgggcagagacgagaccggcagactgagagtggtgtggaccgcccagcccgacaccttcgcctacttccagctgagaatgagagtgcccgagggccccggcgcccacgaggaggtgctgcccggcgacgtgagacaggccctggtgcccccccccccccccggcaccccctacgagctgagcctgcacggcgtgccccccggcggcaagcccagcgaccccatcatctaccagggcatcatggacaaggacgaggagaagcccggcaagagcagcggcccccccagactgggcgagctgaccgtgaccgacagaaccagcgacagcctgctgctgagatggaccgtgcccgagggcgagttcgacagcttcgtgatccagtacaaggacagagacggccagccccaggtggtgcccgtggagggcccccagagaagcgccgtgatcaccagcctggaccccggcagaaagtacaagttcgtgctgtacggcttcgtgggcaagaagagacacggccccctggtggccgaggccaagatcctgccccagagcgaccccagccccggcacccccccccacctgggcaacctgtggtag

SEQ ID NO: 102147 - DNA, 2598 bp, Artificial Sequence
  Description of Artificial Sequence: Synthetic coding sequence
ctgtacggcctgagaggcagacagagagtgggccccgagagcgtggtggccaagaccgccccccaggaggacgtggacgagacccccagccccaccgagctgggcaccgaggcccccgagagccccgaggagcccctgctgggcgagctgaccgtgaccggcagcagccccgacagcctgagcctgttctggaccgtgccccagggcagcttcgacagcttcaccgtgcagtacaaggacagagacggcagacccagagccgtgagagtgggcggcaaggagagcgaggtgaccgtgggcggcctggagcccggccacaagtacaagatgcacctgtacggcctgcacgagggccagagagtgggccccgtgagcgccgtgggcgtgaccgccccccagcaggaggagaccccccccgccaccgagagccccctggagcccagactgggcgagctgaccgtgaccgacgtgacccccaacagcgtgggcctgagctggaccgtgcccgagggccagttcgacagcttcatcgtgcagtacaaggacaaggacggccagccccaggtggtgcccgtggccgccgaccagagagaggtgaccgtgtacaacctggagcccgagagaaagtacaagatgaacatgtacggcctgcacgacggccagagaatgggccccctgagcgtggtgatcgtgaccgcccccctgccccccgcccccgccaccgaggccagcaagccccccctggagcccagactgggcgagctgaccgtgaccgacatcacccccgacagcgtgggcctgagctggaccgtgcccgagggcgagttcgacagcttcgtggtgcagtacaaggacagagacggccagccccaggtggtgcccgtggccgccgaccagagagaggtgaccatccccgacctggagcccagcagaaagtacaagttcctgctgttcggcatccaggacggcaagagaagaagccccgtgagcgtggaggccaagaccgtggccagaggcgacgccagccccggcgccccccccagactgggcgagctgtgggtgaccgaccccacccccgacagcctgagactgagctggaccgtgcccgagggccagttcgacagcttcgtggtgcagttcaaggacaaggacggcccccaggtggtgcccgtggagggccacgagagaagcgtgaccgtgacccccctggacgccggcagaaagtacagattcctgctgtacggcctgctgggcaagaagagacacggccccctgaccgccgacggcaccaccgaggccagaagcgccatggacgacaccggcaccaagagaccccccaagcccagactgggcgaggagctgcaggtgaccaccgtgacccagaacagcgtgggcctgagctggaccgtgcccgagggccagttcgacagcttcgtggtgcagtacaaggacagagacggccagccccaggtggtgcccgtggagggcagcctgagagaggtgagcgtgcccggcctggaccccgcccacagatacaagctgctgctgtacggcctgcaccacggcaagagagtgggccccatcagcgccgtggccatcaccgccggcagagaggagaccgagaccgagaccaccgcccccaccccccccgcccccgagccccacctgggcgagctgaccgtggaggaggccaccagccacaccctgcacctgagctggatggtgaccgagggcgagttcgacagcttcgagatccagtacaccgacagagacggccagctgcagatggtgagaatcggcggcgacagaaacgacatcaccctgagcggcctggagagcgaccacagatacctggtgaccctgtacggcttcagcgacggcaagcacgtgggccccgtgcacgtggaggccctgaccgtgcccgaggaggagaagcccagcgagccccccaccgccacccccgagccccccatcaagcccagactgggcgagctgaccgtgaccgacgccacccccgacagcctgagcctgagctggaccgtgcccgagggccagttcgaccacttcctggtgcagtacagaaacggcgacggccagcccaaggccgtgagagtgcccggccacgaggagggcgtgaccatcagcggcctggagcccgaccacaagtacaagatgaacctgtacggcttccacggcggccagagaatgggccccgtgagcgtggtgggcgtgaccgccgccgaggaggagacccccagccccaccgagcccagcatggaggcccccgagcccgccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcgccgtgggcgtgaccgcccccgaggaggagagccccgacgcccccctggcctag

SEQ ID NO: 102148 - DNA, 5208 bp, Artificial Sequence
  Description of Artificial Sequence: Synthetic coding sequence
atgagcgtgagcagaaccatggaggacagctgcgagctggacctggtgtacgtgaccgagagaatcatcgccgtgagcttccccagcaccgccaacgaggagaacttcagaagcaacctgagagaggtggcccagatgctgaagagcaagcacggcggcaactacctgctgttcaacctgagcgagagaagacccgacatcaccaagctgcacgccaaggtgctggagttcggctggcccgacctgcacacccccgccctggagaagatctgcagcatctgcaaggccatggacacctggctgaacgccgacccccacaacgtggtggtgctgcacaacaagggcaacagaggcagaatcggcgtggtgatcgccgcctacatgcactacagcaacatcagcgccagcgccgaccaggccctggacagattcgccatgaagagattctacgaggacaagatcgtgcccatcggccagcccagccagagaagatacgtgcactacttcagcggcctgctgagcggcagcatcaagatgaacaacaagcccctgttcctgcaccacgtgatcatgcacggcatccccaacttcgagagcaagggcggctgcagacccttcctgagaatctaccaggccatgcagcccgtgtacaccagcggcatctacaacatccccggcgacagccagaccagcgtgtgcatcaccatcgagcccggcctgctgctgaagggcgacatcctgctgaagtgctaccacaagaagttcagaagccccgccagagacgtgatcttcagagtgcagttccacacctgcgccatccacgacctgggcgtggtgttcggcaaggaggacctggacgacgccttcaaggacgacagattccccgagtacggcaaggtggagttcgtgttcagctacggccccgagaagatccagggcatggagcacctggagaacggccccagcgtgagcgtggactacaacaccagcgaccccctgatcagatgggacagctacgacaacttcagcggccacagagacgacggcatggaggaggtggtgggccacacccagggccccctggacggcagcctgtacgccaaggtgaagaagaaggacagcctgcacggcagcaccggcgccgtgaacgccaccagacccaccctgagcgccacccccaaccacgtggagcacaccctgagcgtgagcagcgacagcggcaacagcaccgccagcaccaagaccgacaagaccgacgagcccgtgcccggcgccagcagcgccaccgccgccctgagcccccaggagaagagagagctggacagactgctgagcggcttcggcctggagagagagaagcagggcgccatgtaccacacccagcacctgagaagcagacccgccggcggcagcgccgtgcccagcagcggcagacacgtggtgcccgcccaggtgcacgtgaacggcggcgccctggccagcgagagagagaccgacatcctggacgacgagctgcccaaccaggacggccacagcgccggcagcatgggcaccctgagcagcctggacggcgtgaccaacaccagcgagggcggctaccccgaggccctgagccccctgaccaacggcctggacaagagctaccccatggagcccatggtgaacggcggcggctacccctacgagagcgccagcagagccggccccgcccacgccggccacaccgcccccatgagacccagctacagcgcccaggagggcctggccggctaccagagagagggcccccaccccgcctggccccagcccgtgaccaccagccactacgcccacgaccccagcggcatgttcagaagccagagcttcagcgaggccgagccccagctgccccccgcccccgtgagaggcggcagcagcagagaggccgtgcagagaggcctgaacagctggcagcagcagcagcagcagcagcagcagcccagacccccccccagacagcaggagagagcccacctggagagcctggtggccagcagacccagcccccagcccctggccgagacccccatccccagcctgcccgagttccccagagccgccagccagcaggagatcgagcagagcatcgagaccctgaacatgctgatgctggacctggagcccgccagcgccgccgcccccctgcacaagagccagagcgtgcccggcgcctggcccggcgccagccccctgagcagccagcccctgagcggcagcagcagacagagccaccccctgacccagagcagaagcggctacatccccagcggccacagcctgggcacccccgagcccgcccccagagccagcctggagagcgtgccccccggcagaagctacagcccctacgactaccagccctgcctggccggccccaaccaggacttccacagcaagagccccgccagcagcagcctgcccgccttcctgcccaccacccacagcccccccggcccccagcagccccccgccagcctgcccggcctgaccgcccagcccctgctgagccccaaggaggccaccagcgaccccagcagaacccccgaggaggagcccctgaacctggagggcctggtggcccacagagtggccggcgtgcaggccagagagaagcagcccgccgagccccccgcccccctgagaagaagagccgccagcgacggccagtacgagaaccagagccccgaggccaccagccccagaagccccggcgtgagaagccccgtgcagtgcgtgagccccgagctggccctgaccatcgccctgaaccccggcggcagacccaaggagccccacctgcacagctacaaggaggccttcgaggagatggagggcaccagccccagcagccccccccccagcggcgtgagaagcccccccggcctggccaagacccccctgagcgccctgggcctgaagccccacaaccccgccgacatcctgctgcaccccaccggcgtgaccagaagaagaatccagcccgaggaggacgagggcaaggtggtggtgagactgagcgaggagcccagaagctacgtggagagcgtggccagaaccgccgtggccggccccagagcccaggacagcgagcccaagagcttcagcgcccccgccacccaggcctacggccacgagatccccctgagaaacggcaccctgggcggcagcttcgtgagccccagccccctgagcaccagcagccccatcctgagcgccgacagcaccagcgtgggcagcttccccagcggcgagagcagcgaccagggccccagaacccccacccagcccctgctggagagcggcttcagaagcggcagcctgggccagcccagccccagcgcccagagaaactaccagagcagcagccccctgcccaccgtgggcagcagctacagcagccccgactacagcctgcagcacttcagcagcagccccgagagccaggccagagcccagttcagcgtggccggcgtgcacaccgtgcccggcagcccccaggccagacacagaaccgtgggcaccaacaccccccccagccccggcttcggctggagagccatcaaccccagcatggccgcccccagcagccccagcctgagccaccaccagatgatgggcccccccggcaccggcttccacggcagcaccgtgagcagcccccagagcagcgccgccaccacccccggcagccccagcctgtgcagacaccccgccggcgtgtaccaggtgagcggcctgcacaacaaggtggccaccacccccggcagccccagcctgggcagacaccccggcgcccaccagggcaacctggccagcggcctgcacagcaacgccatcgccagccccggcagccccagcctgggcagacacctgggcggcagcggcagcgtggtgcccggcagcccctgcctggacagacacgtggcctacggcggctacagcacccccgaggacagaagacccaccctgagcagacagagcagcgccagcggctaccaggcccccagcacccccagcttccccgtgagccccgcctactaccccggcctgagcagccccgccaccagccccagccccgacagcgccgccttcagacagggcagccccacccccgccctgcccgagaagagaagaatgagcgtgggcgacagagccggcagcctgcccaactacgccaccatcaacggcaaggtgagcagccccgtggccagcggcatgagcagccccagcggcggcagcaccgtgagcttcagccacaccctgcccgacttcagcaagtacagcatgcccgacaacagccccgagaccagagccaaggtgaagttcgtgcaggacaccagcaagtactggtacaagcccgagatcagcagagagcaggccatcgccctgctgaaggaccaggagcccggcgccttcatcatcagagacagccacagcttcagaggcgcctacggcctggccatgaaggtgagcagccccccccccaccatcatgcagcagaacaagaagggcgacatgacccacgagctggtgagacacttcctgatcgagaccggccccagaggcgtgaagctgaagggctgccccaacgagcccaacttcggcagcctgagcgccctggtgtaccagcacagcatcatccccctggccctgccctgcaagctggtgatccccaacagagaccccaccgacgagagcaaggacagcagcggccccgccaacagcaccgccgacctgctgaagcagggcgccgcctgcaacgtgctgttcgtgaacagcgtggacatggagagcctgaccggcccccaggccatcagcaaggccaccagcgagaccctggccgccgaccccacccccgccgccaccatcgtgcacttcaaggtgagcgcccagggcatcaccctgaccgacaaccagagaaagctgttcttcagaagacactaccccctgaacaccgtgaccttctgcgacctggacccccaggagagaaagtggatgaagaccgagggcggcgcccccgccaagctgttcggcttcgtggccagaaagcagggcagcaccaccgacaacgcctgccacctgttcgccgagctggaccccaaccagcccgccagcgccatcgtgaacttcgtgagcaaggtgatgctgaacgccggccagaagagatag

SEQ ID NO: 102149 - DNA, 1251 bp, Artificial Sequence
  Description of Artificial Sequence: Synthetic coding sequence
atggtgcccttccagcagagaaaggactgcgtgctggagggcagcaccagagtgacccccagcgtgcagccccacctgcagcccatcagaaacatgagcgtgagcagaaccatggaggacagctgcgagctggacctggtgtacgtgaccgagagaatcatcgccgtgagcttccccagcaccgccaacgaggagaacttcagaagcaacctgagagaggtggcccagatgctgaagagcaagcacggcggcaactacctgctgttcaacctgagcgagagaagacccgacatcaccaagctgcacgccaaggtgctggagttcggctggcccgacctgcacacccccgccctggagaagatctgcagcatctgcaaggccatggacacctggctgaacgccgacccccacaacgtggtggtgctgcacaacaagggcaacagaggcagaatcggcgtggtgatcgccgcctacatgcactacagcaacatcagcgccagcgccgaccaggccctggacagattcgccatgaagagattctacgaggacaagatcgtgcccatcggccagcccagccagagaagatacgtgcactacttcagcggcctgctgagcggcagcatcaagatgaacaacaagcccctgttcctgcaccacgtgatcatgcacggcatccccaacttcgagagcaagggcggctgcagacccttcctgagaatctaccaggccatgcagcccgtgtacaccagcggcatctacaacatccccggcgacagccagaccagcgtgtgcatcaccatcgagcccggcctgctgctgaagggcgacatcctgctgaagtgctaccacaagaagttcagaagccccgccagagacgtgatcttcagagtgcagttccacacctgcgccatccacgacctgggcgtggtgttcggcaaggaggacctggacgacgccttcaaggacgacagattccccgagtacggcaaggtggagttcgtgttcagctacggccccgagaagatccagggcatggagcacctggagaacggccccagcgtgagcgtggactacaacaccagcgaccccctgatcagatgggacagctacgacaacttcagcggccacagagacgacggcatggaggacggcaacaagcagaacaccaacagccagagcatcggcagcatcagcggcggcctggaggaccagtacacctggcccgacacccactggcccagccagagctag

SEQ ID NO: 102150 - DNA, 312 bp, Artificial Sequence
  Description of Artificial Sequence: Synthetic coding sequence
atgagcgtgagcagaaccatggaggacagctgcgagctggacctggtgtacgtgaccgagagaatcatcgccgtgagcttccccagcaccgccaacgaggagaacttcagaagcaacctgagagaggtggcccagatgctgaagagcaagcacggcggcaactacctgctgttcaacctgagcgagagaagacccgacatcaccaagctgcacgccaaggtgctggagttcggctggcccgacctgcacacccccgccctggagaagatctgcagcatctgcaaggccatggacacctggctgaacgcctag

SEQ ID NO: 102151 - DNA, 5145 bp, Artificial Sequence
  Description of Artificial Sequence: Synthetic coding sequence
atgagcgtgagcagaaccatggaggacagctgcgagctggacctggtgtacgtgaccgagagaatcatcgccgtgagcttccccagcaccgccaacgaggagaacttcagaagcaacctgagagaggtggcccagatgctgaagagcaagcacggcggcaactacctgctgttcaacctgagcgagagaagacccgacatcaccaagctgcacgccaaggtgctggagttcggctggcccgacctgcacacccccgccctggagaagatctgcagcatctgcaaggccatggacacctggctgaacgccgacccccacaacgtggtggtgctgcacaacaagggcaacagaggcagaatcggcgtggtgatcgccgcctacatgcactacagcaacatcagcgccagcgccgaccaggccctggacagattcgccatgaagagattctacgaggacaagatcgtgcccatcggccagcccagccagagaagatacgtgcactacttcagcggcctgctgagcggcagcatcaagatgaacaacaagcccctgttcctgcaccacgtgatcatgcacggcatccccaacttcgagagcaagggcggctgcagacccttcctgagaatctaccaggccatgcagcccgtgtacaccagcggcatctacaacatccccggcgacagccagaccagcgtgtgcatcaccatcgagcccggcctgctgctgaagggcgacatcctgctgaagtgctaccacaagaagttcagaagccccgccagagacgtgatcttcagagtgcagttccacacctgcgccatccacgacctgggcgtggtgttcggcaaggaggacctggacgacgccttcaaggacgacagattccccgagtacggcaaggtggagttcgtgttcagctacggccccgagaagatccagggcatggagcacctggagaacggccccagcgtgagcgtggactacaacaccagcgaccccctgatcagatgggacagctacgacaacttcagcggccacagagacgacggcatggaggaggtggtgggccacacccagggccccctggacggcagcctgtacgccaaggtgaagaagaaggacagcctgcacggcagcaccggcgccgtgaacgccaccagacccaccctgagcgccacccccaaccacgtggagcacaccctgagcgtgagcagcgacagcggcaacagcaccgccagcaccaagaccgacaagaccgacgagcccgtgcccggcgccagcagcgccaccgccgccctgagcccccaggagaagagagagctggacagactgctgagcggcttcggcctggagagagagaagcagggcgccatgtaccacacccagcacctgagaagcagacccgccggcggcagcgccgtgcccagcagcggcagacacgtggtgcccgcccaggtgcacgtgaacggcggcgccctggccagcgagagagagaccgacatcctggacgacgagctgcccaaccaggacggccacagcgccggcagcatgggcaccctgagcagcctggacggcgtgaccaacaccagcgagggcggctaccccgaggccctgagccccctgaccaacggcctggacaagagctaccccatggagcccatggtgaacggcggcggctacccctacgagagcgccagcagagccggccccgcccacgccggccacaccgcccccatgagacccagctacagcgcccaggagggcctggccggctaccagagagagggcccccaccccgcctggccccagcccgtgaccaccagccactacgcccacgaccccagcggcatgttcagaagccagagcttcagcgaggccgagccccagctgccccccgcccccgtgagaggcggcagcagcagagaggccgtgcagagaggcctgaacagctggcagcagcagcagcagcagcagcagcagcccagacccccccccagacagcaggagagagcccacctggagagcctggtggccagcagacccagcccccagcccctggccgagacccccatccccagcctgcccgagttccccagagccgccagccagcaggagatcgagcagagcatcgagaccctgaacatgctgatgctggacctggagcccgccagcgccgccgcccccctgcacaagagccagagcgtgcccggcgcctggcccggcgccagccccctgagcagccagcccctgagcggcagcagcagacagagccaccccctgacccagagcagaagcggctacatccccagcggccacagcctgggcacccccgagcccgcccccagagccagcctggagagcgtgccccccggcagaagctacagcccctacgactaccagccctgcctggccggccccaaccaggacttccacagcaagagccccgccagcagcagcctgcccgccttcctgcccaccacccacagcccccccggcccccagcagccccccgccagcctgcccggcctgaccgcccagcccctgctgagccccaaggaggccaccagcgaccccagcagaacccccgaggaggagcccctgaacctggagggcctggtggcccacagagtggccggcgtgcaggccagagagaagcagcccgccgagccccccgcccccctgagaagaagagccgccagcgacggccagtacgagaaccagagccccgaggccaccagccccagaagccccggcgtgagaagccccgtgcagtgcgtgagccccgagctggccctgaccatcgccctgaaccccggcggcagacccaaggagccccacctgcacagctacaaggaggccttcgaggagatggagggcaccagccccagcagccccccccccagcggcgtgagaagcccccccggcctggccaagacccccctgagcgccctgggcctgaagccccacaaccccgccgacatcctgctgcaccccaccggcgagcccagaagctacgtggagagcgtggccagaaccgccgtggccggccccagagcccaggacagcgagcccaagagcttcagcgcccccgccacccaggcctacggccacgagatccccctgagaaacggcaccctgggcggcagcttcgtgagccccagccccctgagcaccagcagccccatcctgagcgccgacagcaccagcgtgggcagcttccccagcggcgagagcagcgaccagggccccagaacccccacccagcccctgctggagagcggcttcagaagcggcagcctgggccagcccagccccagcgcccagagaaactaccagagcagcagccccctgcccaccgtgggcagcagctacagcagccccgactacagcctgcagcacttcagcagcagccccgagagccaggccagagcccagttcagcgtggccggcgtgcacaccgtgcccggcagcccccaggccagacacagaaccgtgggcaccaacaccccccccagccccggcttcggctggagagccatcaaccccagcatggccgcccccagcagccccagcctgagccaccaccagatgatgggcccccccggcaccggcttccacggcagcaccgtgagcagcccccagagcagcgccgccaccacccccggcagccccagcctgtgcagacaccccgccggcgtgtaccaggtgagcggcctgcacaacaaggtggccaccacccccggcagccccagcctgggcagacaccccggcgcccaccagggcaacctggccagcggcctgcacagcaacgccatcgccagccccggcagccccagcctgggcagacacctgggcggcagcggcagcgtggtgcccggcagcccctgcctggacagacacgtggcctacggcggctacagcacccccgaggacagaagacccaccctgagcagacagagcagcgccagcggctaccaggcccccagcacccccagcttccccgtgagccccgcctactaccccggcctgagcagccccgccaccagccccagccccgacagcgccgccttcagacagggcagccccacccccgccctgcccgagaagagaagaatgagcgtgggcgacagagccggcagcctgcccaactacgccaccatcaacggcaaggtgagcagccccgtggccagcggcatgagcagccccagcggcggcagcaccgtgagcttcagccacaccctgcccgacttcagcaagtacagcatgcccgacaacagccccgagaccagagccaaggtgaagttcgtgcaggacaccagcaagtactggtacaagcccgagatcagcagagagcaggccatcgccctgctgaaggaccaggagcccggcgccttcatcatcagagacagccacagcttcagaggcgcctacggcctggccatgaaggtgagcagccccccccccaccatcatgcagcagaacaagaagggcgacatgacccacgagctggtgagacacttcctgatcgagaccggccccagaggcgtgaagctgaagggctgccccaacgagcccaacttcggcagcctgagcgccctggtgtaccagcacagcatcatccccctggccctgccctgcaagctggtgatccccaacagagaccccaccgacgagagcaaggacagcagcggccccgccaacagcaccgccgacctgctgaagcagggcgccgcctgcaacgtgctgttcgtgaacagcgtggacatggagagcctgaccggcccccaggccatcagcaaggccaccagcgagaccctggccgccgaccccacccccgccgccaccatcgtgcacttcaaggtgagcgcccagggcatcaccctgaccgacaaccagagaaagctgttcttcagaagacactaccccctgaacaccgtgaccttctgcgacctggacccccaggagagaaagtggatgaagaccgagggcggcgcccccgccaagctgttcggcttcgtggccagaaagcagggcagcaccaccgacaacgcctgccacctgttcgccgagctggaccccaaccagcccgccagcgccatcgtgaacttcgtgagcaaggtgatgctgaacgccggccagaagagatag

SEQ ID NO: 102152 - DNA, 186 bp, Artificial Sequence
  Description of Artificial Sequence: Synthetic coding sequence
atgagcgtgagcagaaccatggaggacagctgcgagctggacctggtgtacgtgaccgagagaatcatcgccgtgagcttccccagcaccgccaacgaggagaacttcagaagcaacctgagagaggtggcccagatgctgaagagcaagcacggcggcaactacctgctgttcaacctgagctag

SEQ ID NO: 102153 - DNA, 75 bp, Artificial Sequence
  Description of Artificial Sequence: Synthetic coding sequence
atgagcgtgagcagaaccatggaggacagctgcgagctggacctggtgtacgtgaccgagagaatcatcgcctag

SEQ ID NO: 102154 - DNA, 4338 bp, Artificial Sequence
  Description of Artificial Sequence: Synthetic coding sequence
atggaggagggccacggcctggacctgacctacatcaccgagagaatcatcgccgtgagcttccccgccggctgcagcgaggagagctacctgcacaacctgcaggaggtgaccagaatgctgaagagcaagcacggcgacaactacctggtgctgaacctgagcgagaagagatacgacctgaccaagctgaaccccaagatcatggacgtgggctggcccgagctgcacgccccccccctggacaagatgtgcaccatctgcaaggcccaggagagctggctgaacagcaacctgcagcacgtggtggtgatccactgcagaggcggcaagggcagaatcggcgtggtgatcagcagctacatgcacttcaccaacgtgagcgccagcgccgaccaggccctggacagattcgccatgaagaagttctacgacgacaaggtgagcgccctgatgcagcccagccagaagagatacgtgcagttcctgagcggcctgctgagcggcagcgtgaagatgaacgccagccccctgttcctgcacttcgtgatcctgcacggcacccccaacttcgacaccggcggcgtgtgcagacccttcctgaagctgtaccaggccatgcagcccgtgtacaccagcggcatctacaacgtgggccccgagaaccccagcagaatctgcatcgtgatcgagcccgcccagctgctgaagggcgacgtgatggtgaagtgctaccacaagaagtacagaagcgccaccagagacgtgatcttcagactgcagttccacaccggcgccgtgcagggctacggcctggtgttcggcaaggaggacctggacaacgccagcaaggacgacagattccccgactacggcaaggtggagctggtgttcagcgccacccccgagaagatccagggcagcgagcacctgtacaacgaccacggcgtgatcgtggactacaacaccaccgaccccctgatcagatgggacagctacgagaacctgagcgccgacggcgaggtgctgcacacccagggccccgtggacggcagcctgtacgccaaggtgagaaagaagagcagcagcgaccccggcatccccggcggcccccaggccatccccgccaccaacagccccgaccacagcgaccacaccctgagcgtgagcagcgacagcggccacagcaccgccagcgccagaaccgacaagaccgaggagagactggcccccggcaccagaagaggcctgagcgcccaggagaaggccgagctggaccagctgctgagcggcttcggcctggaggaccccggcagcagcctgaaggagatgaccgacgccagaagcaagtacagcggcaccagacacgtggtgcccgcccaggtgcacgtgaacggcgacgccgccctgaaggacagagagaccgacatcctggacgacgagatgccccaccacgacctgcacagcgtggacagcctgggcaccctgagcagcagcgagggcccccagagcgcccacctgggccccttcacctgccacaagagcagccagaacagcctgctgagcgacggcttcggcagcaacgtgggcgaggacccccagggcaccctggtgcccgacctgggcctgggcatggacggcccctacgagagagagagaaccttcggcagcagagagcccaagcagccccagcccctgctgagaaagcccagcgtgagcgcccagatgcaggcctacggccagagcagctacagcacccagacctgggtgagacagcagcagatggtggtggcccaccagtacagcttcgcccccgacggcgaggccagactggtgagcagatgccccgccgacaaccccggcctggtgcaggcccagcccagagtgcccctgacccccaccagaggcaccagcagcagagtggccgtgcagagaggcgtgggcagcggcccccacccccccgacacccagcagcccagccccagcaaggccttcaagcccagattccccggcgaccaggtggtgaacggcgccggccccgagctgagcaccggccccagccccggcagccccaccctggacatcgaccagagcatcgagcagctgaacagactgatcctggagctggaccccaccttcgagcccatccccacccacatgaacgccctgggcagccaggccaacggcagcgtgagccccgacagcgtgggcggcggcctgagagccagcagcagactgcccgacaccggcgagggccccagcagagccaccggcagacagggcagcagcgccgagcagcccctgggcggcagactgagaaagctgagcctgggccagtacgacaacgacgccggcggccagctgcccttcagcaagtgcgcctggggcaaggccggcgtggactacgcccccaacctgccccccttccccagccccgccgacgtgaaggagaccatgacccccggctacccccaggacctggacatcatcgacggcagaatcctgagcagcaaggagagcatgtgcagcacccccgccttccccgtgagccccgagaccccctacgtgaagaccgccctgagacacccccccttcagcccccccgagccccccctgagcagccccgccagccagcacaagggcggcagagagcccagaagctgccccgagaccctgacccacgccgtgggcatgagcgagagccccatcggccccaagagcaccatgctgagagccgacgccagcagcacccccagcttccagcaggccttcgccagcagctgcaccatcagcagcaacggccccggccagagaagagagagcagcagcagcgccgagagacagtgggtggagagcagccccaagcccatggtgagcctgctgggcagcggcagacccaccggcagccccctgagcgccgagttcagcggcaccagaaaggacagccccgtgctgagctgcttcccccccagcgagctgcaggcccccttccacagccacgagctgagcctggccgagccccccgacagcctggccccccccagcagccaggccttcctgggcttcggcaccgcccccgtgggcagcggcctgccccccgaggaggacctgggcgccctgctggccaacagccacggcgccagccccacccccagcatccccctgaccgccaccggcgccgccgacaacggcttcctgagccacaacttcctgaccgtggcccccggccacagcagccaccacagccccggcctgcagggccagggcgtgaccctgcccggccagccccccctgcccgagaagaagagagccagcgagggcgacagaagcctgggcagcgtgagccccagcagcagcggcttcagcagcccccacagcggcagcaccatcagcatccccttccccaacgtgctgcccgacttcagcaaggccagcgaggccgccagccccctgcccgacagccccggcgacaagctggtgatcgtgaagttcgtgcaggacaccagcaagttctggtacaaggccgacatcagcagagagcaggccatcgccatgctgaaggacaaggagcccggcagcttcatcgtgagagacagccacagcttcagaggcgcctacggcctggccatgaaggtggccacccccccccccagcgtgctgcagctgaacaagaaggccggcgacctggccaacgagctggtgagacacttcctgatcgagtgcacccccaagggcgtgagactgaagggctgcagcaacgagccctacttcggcagcctgaccgccctggtgtgccagcacagcatcacccccctggccctgccctgcaagctgctgatccccgagagagaccccctggaggagatcgccgagagcagcccccagaccgccgccaacagcgccgccgagctgctgaagcagggcgccgcctgcaacgtgtggtacctgaacagcgtggagatggagagcctgaccggccaccaggccatccagaaggccctgagcatcaccctggtgcaggagcccccccccgtgagcaccgtggtgcacttcaaggtgagcgcccagggcatcaccctgaccgacaaccagagaaagctgttcttcagaagacactaccccgtgaacagcgtgatcttctgcgccctggacccccaggacagaaagtggatcaaggacggccccagcagcaaggtgttcggcttcgtggccagaaagcagggcagcgccaccgacaacgtgtgccacctgttcgccgagcacgaccccgagcagcccgccagcgccatcgtgaacttcgtgagcaaggtgatgatcggcagccccaagaaggtgtag

SEQ ID NO: 102155 - DNA, 3618 bp, Artificial Sequence
  Description of Artificial Sequence: Synthetic coding sequence
atggaggagggccacggcctggacctgacctacatcaccgagagaatcatcgccgtgagcttccccgccggctgcagcgaggagagctacctgcacaacctgcaggaggtgaccagaatgctgaagagcaagcacggcgacaactacctggtgctgaacctgagcgagaagagatacgacctgaccaagctgaaccccaagatcatggacgtgggctggcccgagctgcacgccccccccctggacaagatgtgcaccatctgcaaggcccaggagagctggctgaacagcaacctgcagcacgtggtggtgatccactgcagaggcggcaagggcagaatcggcgtggtgatcagcagctacatgcacttcaccaacgtgagcgccagcgccgaccaggccctggacagattcgccatgaagaagttctacgacgacaaggtgagcgccctgatgcagcccagccagaagagatacgtgcagttcctgagcggcctgctgagcggcagcgtgaagatgaacgccagccccctgttcctgcacttcgtgatcctgcacggcacccccaacttcgacaccggcggcgtgtgcagacccttcctgaagctgtaccaggccatgcagcccgtgtacaccagcggcatctacaacgtgggccccgagaaccccagcagaatctgcatcgtgatcgagcccgcccagctgctgaagggcgacgtgatgatgccccaccacgacctgcacagcgtggacagcctgggcaccctgagcagcagcgagggcccccagagcgcccacctgggccccttcacctgccacaagagcagccagaacagcctgctgagcgacggcttcggcagcaacgtgggcgaggacccccagggcaccctggtgcccgacctgggcctgggcatggacggcccctacgagagagagagaaccttcggcagcagagagcccaagcagccccagcccctgctgagaaagcccagcgtgagcgcccagatgcaggcctacggccagagcagctacagcacccagacctgggtgagacagcagcagatggtggtggcccaccagtacagcttcgcccccgacggcgaggccagactggtgagcagatgccccgccgacaaccccggcctggtgcaggcccagcccagagtgcccctgacccccaccagaggcaccagcagcagagtggccgtgcagagaggcgtgggcagcggcccccacccccccgacacccagcagcccagccccagcaaggccttcaagcccagattccccggcgaccaggtggtgaacggcgccggccccgagctgagcaccggccccagccccggcagccccaccctggacatcgaccagagcatcgagcagctgaacagactgatcctggagctggaccccaccttcgagcccatccccacccacatgaacgccctgggcagccaggccaacggcagcgtgagccccgacagcgtgggcggcggcctgagagccagcagcagactgcccgacaccggcgagggccccagcagagccaccggcagacagggcagcagcgccgagcagcccctgggcggcagactgagaaagctgagcctgggccagtacgacaacgacgccggcggccagctgcccttcagcaagtgcgcctggggcaaggccggcgtggactacgcccccaacctgccccccttccccagccccgccgacgtgaaggagaccatgacccccggctacccccaggacctggacatcatcgacggcagaatcctgagcagcaaggagagcatgtgcagcacccccgccttccccgtgagccccgagaccccctacgtgaagaccgccctgagacacccccccttcagcccccccgagccccccctgagcagccccgccagccagcacaagggcggcagagagcccagaagctgccccgagaccctgacccacgccgtgggcatgagcgagagccccatcggccccaagagcaccatgctgagagccgacgccagcagcacccccagcttccagcaggccttcgccagcagctgcaccatcagcagcaacggccccggccagagaagagagagcagcagcagcgccgagagacagtgggtggagagcagccccaagcccatggtgagcctgctgggcagcggcagacccaccggcagccccctgagcgccgagttcagcggcaccagaaaggacagccccgtgctgagctgcttcccccccagcgagctgcaggcccccttccacagccacgagctgagcctggccgagccccccgacagcctggccccccccagcagccaggccttcctgggcttcggcaccgcccccgtgggcagcggcctgccccccgaggaggacctgggcgccctgctggccaacagccacggcgccagccccacccccagcatccccctgaccgccaccggcgccgccgacaacggcttcctgagccacaacttcctgaccgtggcccccggccacagcagccaccacagccccggcctgcagggccagggcgtgaccctgcccggccagccccccctgcccgagaagaagagagccagcgagggcgacagaagcctgggcagcgtgagccccagcagcagcggcttcagcagcccccacagcggcagcaccatcagcatccccttccccaacgtgctgcccgacttcagcaaggccagcgaggccgccagccccctgcccgacagccccggcgacaagctggtgatcgtgaagttcgtgcaggacaccagcaagttctggtacaaggccgacatcagcagagagcaggccatcgccatgctgaaggacaaggagcccggcagcttcatcgtgagagacagccacagcttcagaggcgcctacggcctggccatgaaggtggccacccccccccccagcgtgctgcagctgaacaagaaggccggcgacctggccaacgagctggtgagacacttcctgatcgagtgcacccccaagggcgtgagactgaagggctgcagcaacgagccctacttcggcagcctgaccgccctggtgtgccagcacagcatcacccccctggccctgccctgcaagctgctgatccccgagagagaccccctggaggagatcgccgagagcagcccccagaccgccgccaacagcgccgccgagctgctgaagcagggcgccgcctgcaacgtgtggtacctgaacagcgtggagatggagagcctgaccggccaccaggccatccagaaggccctgagcatcaccctggtgcaggagcccccccccgtgagcaccgtggtgcacttcaaggtgagcgcccagggcatcaccctgaccgacaaccagagaaagctgttcttcagaagacactaccccgtgaacagcgtgatcttctgcgccctggacccccaggacagaaagtggatcaaggacggccccagcagcaaggtgttcggcttcgtggccagaaagcagggcagcgccaccgacaacgtgtgccacctgttcgccgagcacgaccccgagcagcccgccagcgccatcgtgaacttcgtgagcaaggtgatgatcggcagccccaagaaggtgtag

SEQ ID NO: 102156 - DNA, 4338 bp, Artificial Sequence; identical to SEQ ID NO: 102154
  Description of Artificial Sequence: Synthetic coding sequence

SEQ ID NO: 102157 - DNA, 327 bp, Artificial Sequence
  Description of Artificial Sequence: Synthetic coding sequence
atggaggagggccacggcctggacctgacctacatcaccgagagaatcatcgccgtgagcttccccgccggctgcagcgaggagagctacctgcacaacctgcaggaggtgaccagaatgctgaagagcaagcacggcgacaactacctggtgctgaacctgagcgagaagagatacgacctgaccaagctgaaccccaagatcatggacgtgggctggcccgagctgcacgccccccccctggacaagatgtgcaccatctgcaaggcccaggagagctggctgaacagcaacctgcagcacgtggtggtgatccactgcagatag

SEQ ID NO: 102158 - DNA, 417 bp, Artificial Sequence
  Description of Artificial Sequence: Synthetic coding sequence
atggaggagggccacggcctggacctgacctacatcaccgagagaatcatcgccgtgagcttccccgccggctgcagcgaggagagctacctgcacaacctgcaggaggtgaccagaatgctgaagagcaagcacggcgacaactacctggtgctgaacctgagcgagaagagatacgacctgaccaagctgaaccccaagatcatggacgtgggctggcccgagctgcacgccccccccctggacaagatgtgcaccatctgcaaggcccaggagagctggctgaacagcaacctgcagcacgtggtggtgatccactgcagaggcggcaagggcagaatcggcgtggtgatcagcagctacatgcacttcaccaacgtgagcgccagcgccgaccaggccctggacagattctag

SEQ ID NO: 102159 - DNA, 753 bp, Artificial Sequence
  Description of Artificial Sequence: Synthetic coding sequence
atggaggagggccacggcctggacctgacctacatcaccgagagaatcatcgccgtgagcttccccgccggctgcagcgaggagagctacctgcacaacctgcaggaggtgaccagaatgctgaagagcaagcacggcgacaactacctggtgctgaacctgagcgagaagagatacgacctgaccaagctgaaccccaagatcatggacgtgggctggcccgagctgcacgccccccccctggacaagatgtgcaccatctgcaaggcccaggagagctggctgaacagcaacctgcagcacgtggtggtgatccactgcagaggcggcaagggcagaatcggcgtggtgatcagcagctacatgcacttcaccaacgtgagcgccagcgccgaccaggccctggacagattcgccatgaagaagttctacgacgacaaggtgagcgccctgatgcagcccagccagaagagatacgtgcagttcctgagcggcctgctgagcggcagcgtgaagatgaacgccagccccctgttcctgcacttcgtgatcctgcacggcacccccaacttcgacaccggcggcgtgtgcagacccttcctgaagctgtaccaggccatgcagcccgtgtacaccagcggcatctacaacgtgggccccgagaaccccagcagaatctgcatcgtgatcgagcccgcccagctgctgaagggcgacgtgatggtgatgaactacaacatcgccaacatctag

SEQ ID NO: 102160 - DNA, 753 bp, Artificial Sequence; identical to SEQ ID NO: 102159
  Description of Artificial Sequence: Synthetic coding sequence

SEQ ID NO: 102161 - DNA, 3816 bp, Artificial Sequence
  Description of Artificial Sequence: Synthetic coding sequence
agccaggccctgaacgagagaatgaactggctgtgcagaaaccaggaccccaacccccccccccagcccgaggagctgaccagcagcctgcacgccttcaagaacaaggccttcaagaagagcaaggtgtgcggcgtgtgcaagcagatcatcgacggccagggcatcagctgcagagcctgcaagtacagctgccacaagaagtgcgaggccaaggtggtgatcccctgcggcgtgcaggtgagactggagcaggcccccggcagcagcaccctgagcagcagcctgtgcagagacaagcccctgagacccgtgatcctgagccccaccatggaggagggccacggcctggacctgacctacatcaccgagagaatcatcgccgtgagcttccccgccggctgcagcgaggagagctacctgcacaacctgcaggaggtgaccagaatgctgaagagcaagcacggcgacaactacctggtgctgaacctgagcgagaagagatacgacctgaccaagctgaaccccaagatcatggacgtgggctggcccgagctgcacgccccccccctggacaagatgtgcaccatctgcaaggcccaggagagctggctgaacagcaacctgcagcacgtggtggtgatccactgcagaggcggcaagggcagaatcggcgtggtgatcagcagctacatgcacttcaccaacgtgagcgccagcgccgaccaggccctggacagattcgccatgaagaagttctacgacgacaaggtgagcgccctgatgcagcccagccagaagagatacgtgcagttcctgagcggcctgctgagcggcagcgtgaagatgaacgccagccccctgttcctgcacttcgtgatcctgcacggcacccccaacttcgacaccggcggcgtgtgcagacccttcctgaagctgtaccaggccatgcagcccgtgtacaccagcggcatctacaacgtgggccccgagaaccccagcagaatctgcatcgtgatcgagcccgcccagctgctgaagggcgacgtgatggtgaagtgctaccacaagaagtacagaagcgccaccagagacgtgatcttcagactgcagttccacaccggcgccgtgcagggctacggcctggtgttcggcaaggaggacctggacaacgccagcaaggacgacagattccccgactacggcaaggtggagctggtgttcagcgccacccccgagaagatccagggcagcgagcacctgtacaacgaccacggcgtgatcgtggactacaacaccaccgaccccctgatcagatgggacagctacgagaacctgagcgccgacggcgaggtgctgcacacccagggccccgtggacggcagcctgtacgccaaggtgagaaagaagagcagcagcgaccccggcatccccggcggcccccaggccatccccgccaccaacagccccgaccacagcgaccacaccctgagcgtgagcagcgacagcggccacagcaccgccagcgccagaaccgacaagaccgaggagagactggcccccggcaccagaagaggcctgagcgcccaggagaaggccgagctggaccagctgctgagcggcttcggcctggaggaccccggcagcagcctgaaggagatgaccgacgccagaagcaagtacagcggcaccagacacgtggtgcccgcccaggtgcacgtgaacggcgacgccgccctgaaggacagagagaccgacatcctggacgacgagatgccccaccacgacctgcacagcgtggacagcctgggcaccctgagcagcagcgagggcccccagagcgcccacctgggccccttcacctgccacaagagcagccagaacagcctgctgagcgacggcttcggcagcaacgtgggcgaggacccccagggcaccctggtgcccgacctgggcctgggcatggacggcccctacgagagagagagaaccttcggcagcagagagcccaagcagccccagcccctgctgagaaagcccagcgtgagcgcccagatgcaggcctacggccagagcagctacagcacccagacctgggtgagacagcagcagatggtggtggcccaccagtacagcttcgcccccgacggcgaggccagactggtgagcagatgccccgccgacaaccccggcctggtgcaggcccagcccagagtgcccctgacccccaccagaggcaccagcagcagagtggccgtgcagagaggcgtgggcagcggcccccacccccccgacacccagcagcccagccccagcaaggccttcaagcccagattccccggcgaccaggtggtgaacggcgccggccccgagctgagcaccggccccagccccggcagccccaccctggacatcgaccagagcatcgagcagctgaacagactgatcctggagctggaccccaccttcgagcccatccccacccacatgaacgccctgggcagccaggccaacggcagcgtgagccccgacagcgtgggcggcggcctgagagccagcagcagactgcccgacaccggcgagggccccagcagagccaccggcagacagggcagcagcgccgagcagcccctgggcggcagactgagaaagctgagcctgggccagtacgacaacgacgccggcggccagctgcccttcagcaagtgcgcctggggcaaggccggcgtggactacgcccccaacctgccccccttccccagccccgccgacgtgaaggagaccatgacccccggctacccccaggacctggacatcatcgacggcagaatcctgagcagcaaggagagcatgtgcagcacccccgccttccccgtgagccccgagaccccctacgtgaagaccgccctgagacacccccccttcagcccccccgagccccccctgagcagccccgccagccagcacaagggcggcagagagcccagaagctgccccgagaccctgacccacgccgtgggcatgagcgagagccccatcggccccaagagcaccatgctgagagccgacgccagcagcacccccagcttccagcaggccttcgccagcagctgcaccatcagcagcaacggccccggccagagaagagagagcagcagcagcgccgagagacagtgggtggagagcagccccaagcccatggtgagcctgctgggcagcggcagacccaccggcagccccctgagcgccgagttcagcggcaccagaaaggacagccccgtgctgagctgcttcccccccagcgagctgcaggcccccttccacagccacgagctgagcctggccgagccccccgacagcctggccccccccagcagccaggccttcctgggcttcggcaccgcccccgtgggcagcggcctgccccccgaggaggacctgggcgccctgctggccaacagccacggcgccagccccacccccagcatccccctgaccgccaccggcgccgccgacaacggcttcctgagccacaacttcctgaccgtggcccccggccacagcagccaccacagccccggcctgcagggccagggcgtgaccctgcccggccagccccccctgcccgagaagaagagagccagcgagggcgacagaagcctgggcagcgtgagccccagcagcagcggcttcagcagcccccacagcggcagcaccatcagcatccccttccccaacgtgctgcccgacttcagcaaggccagcgaggcccccaccttctaccagaccagcaagcccgacatccccggcccctag

SEQ ID NO: 102162 - DNA, 2760 bp, Artificial Sequence
  Description of Artificial Sequence: Synthetic coding sequence
atggacggcccctacgagagagagagaaccttcggcagcagagagcccaagcagccccagcccctgctgagaaagcccagcgtgagcgcccagatgcaggcctacggccagagcagctacagcacccagacctgggtgagacagcagcagatggtggtggcccaccagtacagcttcgcccccgacggcgaggccagactggtgagcagatgccccgccgacaaccccggcctggtgcaggcccagcccagagtgcccctgacccccaccagaggcaccagcagcagagtggccgtgcagagaggcgtgggcagcggcccccacccccccgacacccagcagcccagccccagcaaggccttcaagcccagattccccggcgaccaggtggtgaacggcgccggccccgagctgagcaccggccccagccccggcagccccaccctggacatcgaccagagcatcgagcagctgaacagactgatcctggagctggaccccaccttcgagcccatccccacccacatgaacgccctgggcagccaggccaacggcagcgtgagccccgacagcgtgggcggcggcctgagagccagcagcagactgcccgacaccggcgagggccccagcagagccaccggcagacagggcagcagcgccgagcagcccctgggcggcagactgagaaagctgagcctgggccagtacgacaacgacgccggcggccagctgcccttcagcaagtgcgcctggggcaaggccggcgtggactacgcccccaacctgccccccttccccagccccgccgacgtgaaggagaccatgacccccggctacccccaggacctggacatcatcgacggcagaatcctgagcagcaaggagagcatgtgcagcacccccgccttccccgtgagccccgagaccccctacgtgaagaccgccctgagacacccccccttcagcccccccgagccccccctgagcagccccgccagccagcacaagggcggcagagagcccagaagctgccccgagaccctgacccacgccgtgggcatgagcgagagccccatcggccccaagagcaccatgctgagagccgacgccagcagcacccccagcttccagcaggccttcgccagcagctgcaccatcagcagcaacggccccggccagagaagagagagcagcagcagcgccgagagacagtgggtggagagcagccccaagcccatggtgagcctgctgggcagcggcagacccaccggcagccccctgagcgccgagttcagcggcaccagaaaggacagccccgtgctgagctgcttcccccccagcgagctgcaggcccccttccacagccacgagctgagcctggccgagccccccgacagcctggccccccccagcagccaggccttcctgggcttcggcaccgcccccgtgggcagcggcctgccccccgaggaggacctgggcgccctgctggccaacagccacggcgccagccccacccccagcatccccctgaccgccaccggcgccgccgacaacggcttcctgagccacaacttcctgaccgtggcccccggccacagcagccaccacagccccggcctgcagggccagggcgtgaccctgcccggccagccccccctgcccgagaagaagagagccagcgagggcgacagaagcctgggcagcgtgagccccagcagcagcggcttcagcagcccccacagcggcagcaccatcagcatccccttccccaacgtgctgcccgacttcagcaaggccagcgaggccgccagccccctgcccgacagccccggcgacaagctggtgatcgtgaagttcgtgcaggacaccagcaagttctggtacaaggccgacatcagcagagagcaggccatcgccatgctgaaggacaaggagcccggcagcttcatcgtgagagacagccacagcttcagaggcgcctacggcctggccatgaaggtggccacccccccccccagcgtgctgcagctgaacaagaaggccggcgacctggccaacgagctggtgagacacttcctgatcgagtgcacccccaagggcgtgagactgaagggctgcagcaacgagccctacttcggcagcctgaccgccctggtgtgccagcacagcatcacccccctggccctgccctgcaagctgctgatccccgagagagaccccctggaggagatcgccgagagcagcccccagaccgccgccaacagcgccgccgagctgctgaagcagggcgccgcctgcaacgtgtggtacctgaacagcgtggagatggagagcctgaccggccaccaggccatccagaaggccctgagcatcaccctggtgcaggagcccccccccgtgagcaccgtggtgcacttcaaggtgagcgcccagggcatcaccctgaccgacaaccagagaaagctgttcttcagaagacactaccccgtgaacagcgtgatcttctgcgccctggacccccaggacagaaagtggatcaaggacggccccagcagcaaggtgttcggcttcgtggccagaaagcagggcagcgccaccgacaacgtgtgccacctgttcgccgagcacgaccccgagcagcccgccagagagagccagagacacagaggcgccagagacggcccccacgaggccatgcccagaagacacagcggcagccccgccaacgtgctgttcgagctgatcggccaggtgtag

SEQ ID NO: 102163 - DNA, 2148 bp, Artificial Sequence
  Description of Artificial Sequence: Synthetic coding sequence
atgagccaggtgatgagcagccccctgctggccggcggccacgccgtgagcctggccccctgcgacgagcccagaagaaccctgcaccccgcccccagccccagcctgcccccccagtgcagctactacaccaccgagggctggggcgcccaggccctgatggcccccgtgccctgcatgggcccccccggcagactgcagcaggccccccaggtggaggccaaggccacctgcttcctgcccagccccggcgagaaggccctgggcacccccgaggacctggacagctacatcgacttcagcctggagagcctgaaccagatgatcctggagctggaccccaccttccagctgctgccccccggcaccggcggcagccaggccgagctggcccagagcaccatgagcatgagaaagaaggaggagagcgaggccctggacatcaagtacatcgaggtgaccagcgccagaagcagatgccacgacggcccccagcactgcagcagccccagcgtgaccccccccttcggcagcctgagaagcggcggcctgctgctgagcagagacgtgcccagagagaccagaagcagcagcgagagcctgatcttcagcggcaaccagggcagaggccaccagagacccctgccccccagcgagggcctgagccccagaccccccaacagccccagcatcagcatcccctgcatgggcagcaaggccagcagcccccacggcctgggcagccccctggtggccagccccagactggagaagagactgggcggcctggccccccagagaggcagcagaatcagcgtgctgagcgccagccccgtgagcgacgtgagctacatgttcggcagcagccagagcctgctgcacagcagcaacagcagccaccagagcagcagcagaagcctggagagccccgccaacagcagcagcagcctgcacagcctgggcagcgtgagcctgtgcaccagacccagcgacttccaggcccccagaaaccccaccctgaccatgggccagcccagaaccccccacagcccccccctggccaaggagcacgccagcagctgcccccccagcatcaccaacagcatggtggacatccccatcgtgctgatcaacggctgccccgagcccggcagcagccccccccagagaacccccggccaccagaacagcgtgcagcccggcgccgccagccccagcaacccctgccccgccaccagaagcaacagccagaccctgagcgacgcccccttcaccacctgccccgagggccccgccagagacatgcagcccaccatgaagttcgtgatggacaccagcaagtactggttcaagcccaacatcaccagagagcaggccatcgagctgctgagaaaggaggagcccggcgccttcgtgatcagagacagcagcagctacagaggcagcttcggcctggccctgaaggtgcaggaggtgcccgccagcgcccagagcagacccggcgaggacagcaacgacctgatcagacacttcctgatcgagagcagcgccaagggcgtgcacctgaagggcgccgacgaggagccctacttcggcagcctgagcgccttcgtgtgccagcacagcatcatggccctggccctgccctgcaagctgaccatcccccagagagagctgggcggcgccgacggcgccagcgacagcaccgacagccccgccagctgccagaagaagagcgccggctgccacaccctgtacctgagcagcgtgagcgtggagaccctgaccggcgccctggccgtgcagaaggccatcagcaccaccttcgagagagacatcctgcccacccccaccgtggtgcacttcaaggtgaccgagcagggcatcaccctgaccgacgtgcagagaaaggtgttcttcagaagacactaccccctgaccaccctgagattctgcggcatggaccccgagcagagaaagtggcagaagtactgcaagcccagctggatcttcggcttcgtggccaagagccagaccgagccccaggagaacgtgtgccacctgttcgccgagtacgacatggtgcagcccgccagccaggtgatcggcctggtgaccgccctgctgcaggacgccgagagaatgtag

SEQ ID NO: 102164 - DNA, 2148 bp, Artificial Sequence; identical to SEQ ID NO: 102163
  Description of Artificial Sequence: Synthetic coding sequence

SEQ ID NO: 102165 - DNA, 387 bp, Artificial Sequence
  Description of Artificial Sequence: Synthetic coding sequence
atgagacccgtgcccgtgagaggcgtgcacagcctgcaccccagacccttcggcggccccgtgagcctgccctggctgagaaccggcagatgcagatggggcctgggcctgtacagacagcccagcctgctgcccgaggagatctgcggcgtgttcttcagaagacactaccccctgaccaccctgagattctgcggcatggaccccgagcagagaaagtggcagaagtactgcaagcccagctggatcttcggcttcgtggccaagagccagaccgagccccaggagaacgtgtgccacctgttcgccgagtacgacatggtgcagcccgccagccaggtgatcggcctggtgaccgccctgctgcaggacgccgagagaatgtag

SEQ ID NO: 102166 - DNA, 4230 bp, Artificial Sequence
  Description of Artificial Sequence: Synthetic coding sequence
atgaagagcagcggccccgtggagagactgctgagagccctgggcagaagagacagcagcagagccgccagcagacccagaaaggccgagccccacagcttcagagagaaggtgttcagaaagaagccccccgtgtgcgccgtgtgcaaggtgaccatcgacggcaccggcgtgagctgcagagtgtgcaaggtggccacccacagaaagtgcgaggccaaggtgaccagcgcctgccaggccctgccccccgtggagctgagaagaaacaccgcccccgtgagaagaatcgagcacctgggcagcaccaagagcctgaaccacagcaagcagagaagcaccctgcccagaagcttcagcctggaccccctgatggagagaagatgggacctggacctgacctacgtgaccgagagaatcctggccgccgccttccccgccagacccgacgagcagagacacagaggccacctgagagagctggcccacgtgctgcagagcaagcacagagacaagtacctgctgttcaacctgagcgagaagagacacgacctgaccagactgaaccccaaggtgcaggacttcggctggcccgagctgcacgccccccccctggacaagctgtgcagcatctgcaaggccatggagacctggctgagcgccgacccccagcacgtggtggtgctgtactgcaagggcaacaagggcaagctgggcgtgatcgtgagcgcctacatgcactacagcaagatcagcgccggcgccgaccaggccctggccaccctgaccatgagaaagttctgcgaggacaaggtggccaccgagctgcagcccagccagagaagatacatcagctacttcagcggcctgctgagcggcagcatcagaatgaacagcagccccctgttcctgcactacgtgctgatccccatgctgcccgccttcgagcccggcaccggcttccagcccttcctgaagatctaccagagcatgcagctggtgtacaccagcggcgtgtaccacatcgccggccccggcccccagcagctgtgcatcagcctggagcccgccctgctgctgaagggcgacgtgatggtgacctgctaccacaagggcggcagaggcaccgacagaaccctggtgttcagagtgcagttccacacctgcaccatccacggcccccagctgaccttccccaaggaccagctggacgaggcctggaccgacgagagattccccttccaggccagcgtggagttcgtgttcagcagcagccccgagaagatcaagggcagcacccccagaaacgaccccagcgtgagcgtggactacaacaccaccgagcccgccgtgagatgggacagctacgagaacttcaaccagcaccacgaggacagcgtggacggcagcctgacccacaccagaggccccctggacggcagcccctacgcccaggtgcagagaccccccagacagaccccccccgcccccagccccgagcccccccccccccccatgctgagcgtgagcagcgacagcggccacagcagcaccctgaccaccgagcccgccgccgagagccccggcagacccccccccaccgccgccgagagacaggagctggacagactgctgggcggctgcggcgtggccagcggcggcagaggcgccggcagagagaccgccatcctggacgacgaggagcagcccaccgtgggcggcggcccccacctgggcgtgtaccccggccacagacccggcctgagcagacactgcagctgcagacagggctacagagagccctgcggcgtgcccaacggcggctactacagacccgagggcaccctggagagaagaagactggcctacggcggctacgagggcagcccccagggctacgccgaggccagcatggagaagagaagactgtgcagaagcctgagcgagggcctgtacccctacccccccgagatgggcaagcccgccaccggcgacttcggctacagagcccccggctacagagaggtggtgatcctggaggaccccggcctgcccgccctgtacccctgccccgcctgcgaggagaagctggccctgcccaccgccgccctgtacggcctgagactggagagagaggccggcgagggctgggccagcgaggccggcaagcccctgctgcaccccgtgagacccggccaccccctgcccctgctgctgcccgcctgcggccaccaccacgcccccatgcccgactacagctgcctgaagccccccaaggccggcgaggagggccacgagggctgcagctacaccatgtgccccgagggcagatacggccaccccggctaccccgccctggtgacctacagctacggcggcgccgtgcccagctactgccccgcctacggcagagtgccccacagctgcggcagccccggcgagggcagaggctaccccagccccggcgcccacagccccagagccggcagcatcagccccggcagccccccctacccccagagcagaaagctgagctacgagatccccaccgaggagggcggcgacagataccccctgcccggccacctggccagcgccggccccctggccagcgccgagagcctggagcccgtgagctggagagagggccccagcggccacagcaccctgcccagaagccccagagacgccccctgcagcgccagcagcgagctgagcggccccagcacccccctgcacaccagcagccccgtgcagggcaaggagagcaccagaagacaggacaccagaagccccaccagcgcccccacccagagactgagccccggcgaggccctgccccccgtgagccaggccggcaccggcaaggcccccgagctgcccagcggcagcggccccgagcccctggcccccagccccgtgagccccaccttcccccccagcagccccagcgactggccccaggagagaagccccggcggccacagcgacggcgccagccccagaagccccgtgcccaccaccctgcccggcctgagacacgccccctggcagggccccagaggcccccccgacagccccgacggcagccccctgacccccgtgcccagccagatgccctggctggtggccagccccgagcccccccagagcagccccacccccgccttccccctggccgccagctacgacaccaacggcctgagccagccccccctgcccgagaagagacacctgcccggccccggccagcagcccggcccctggggccccgagcaggccagcagccccgccagaggcatcagccaccacgtgaccttcgcccccctgctgagcgacaacgtgccccagacccccgagccccccacccaggagagccagagcaacgtgaagttcgtgcaggacaccagcaagttctggtacaagccccacctgagcagagaccaggccatcgccctgctgaaggacaaggaccccggcgccttcctgatcagagacagccacagcttccagggcgcctacggcctggccctgaaggtggccacccccccccccagcgcccagccctggaagggcgaccccgtggagcagctggtgagacacttcctgatcgagaccggccccaagggcgtgaagatcaagggctgccccagcgagccctacttcggcagcctgagcgccctggtgagccagcacagcatcagccccatcagcctgccctgctgcctgagaatccccagcaaggaccccctggaggagacccccgaggcccccgtgcccaccaacatgagcaccgccgccgacctgctgagacagggcgccgcctgcagcgtgctgtacctgaccagcgtggagaccgagagcctgaccggcccccaggccgtggccagagccagcagcgccgccctgagctgcagccccagacccacccccgccgtggtgcacttcaaggtgagcgcccagggcatcaccctgaccgacaaccagagaaagctgttcttcagaagacactaccccgtgaacagcatcaccttcagcagcaccgacccccaggacagaagatggaccaaccccgacggcaccaccagcaagatcttcggcttcgtggccaagaagcccggcagcccctgggagaacgtgtgccacctgttcgccgagctggaccccgaccagcccgccggcgccatcgtgaccttcatcaccaaggtgctgctgggccagagaaagtag

SEQ ID NO: 102167 - DNA, 4260 bp, Artificial Sequence
  Description of Artificial Sequence: Synthetic coding sequence
atggacggcggcggcgtgtgcgtgggcagaggcgacctgctgagcagcccccaggccctgggccagctgctgagaaaggagagcagacccagaagagccatgaagcccagaaaggccgagccccacagcttcagagagaaggtgttcagaaagaagccccccgtgtgcgccgtgtgcaaggtgaccatcgacggcaccggcgtgagctgcagagtgtgcaaggtggccacccacagaaagtgcgaggccaaggtgaccagcgcctgccaggccctgccccccgtggagctgagaagaaacaccgcccccgtgagaagaatcgagcacctgggcagcaccaagagcctgaaccacagcaagcagagaagcaccctgcccagaagcttcagcctggaccccctgatggagagaagatgggacctggacctgacctacgtgaccgagagaatcctggccgccgccttccccgccagacccgacgagcagagacacagaggccacctgagagagctggcccacgtgctgcagagcaagcacagagacaagtacctgctgttcaacctgagcgagaagagacacgacctgaccagactgaaccccaaggtgcaggacttcggctggcccgagctgcacgccccccccctggacaagctgtgcagcatctgcaaggccatggagacctggctgagcgccgacccccagcacgtggtggtgctgtactgcaagggcaacaagggcaagctgggcgtgatcgtgagcgcctacatgcactacagcaagatcagcgccggcgccgaccaggccctggccaccctgaccatgagaaagttctgcgaggacaaggtggccaccgagctgcagcccagccagagaagatacatcagctacttcagcggcctgctgagcggcagcatcagaatgaacagcagccccctgttcctgcactacgtgctgatccccatgctgcccgccttcgagcccggcaccggcttccagcccttcctgaagatctaccagagcatgcagctggtgtacaccagcggcgtgtaccacatcgccggccccggcccccagcagctgtgcatcagcctggagcccgccctgctgctgaagggcgacgtgatggtgacctgctaccacaagggcggcagaggcaccgacagaaccctggtgttcagagtgcagttccacacctgcaccatccacggcccccagctgaccttccccaaggaccagctggacgaggcctggaccgacgagagattccccttccaggccagcgtggagttcgtgttcagcagcagccccgagaagatcaagggcagcacccccagaaacgaccccagcgtgagcgtggactacaacaccaccgagcccgccgtgagatgggacagctacgagaacttcaaccagcaccacgaggacagcgtggacggcagcctgacccacaccagaggccccctggacggcagcccctacgcccaggtgcagagaccccccagacagaccccccccgcccccagccccgagcccccccccccccccatgctgagcgtgagcagcgacagcggccacagcagcaccctgaccaccgagcccgccgccgagagccccggcagacccccccccaccgccgccgagagacaggagctggacagactgctgggcggctgcggcgtggccagcggcggcagaggcgccggcagagagaccgccatcctggacgacgaggagcagcccaccgtgggcggcggcccccacctgggcgtgtaccccggccacagacccggcctgagcagacactgcagctgcagacagggctacagagagccctgcggcgtgcccaacggcggctactacagacccgagggcaccctggagagaagaagactggcctacggcggctacgagggcagcccccagggctacgccgaggccagcatggagaagagaagactgtgcagaagcctgagcgagggcctgtacccctacccccccgagatgggcaagcccgccaccggcgacttcggctacagagcccccggctacagagaggtggtgatcctggaggaccccggcctgcccgccctgtacccctgccccgcctgcgaggagaagctggccctgcccaccgccgccctgtacggcctgagactggagagagaggccggcgagggctgggccagcgaggccggcaagcccctgctgcaccccgtgagacccggccaccccctgcccctgctgctgcccgcctgcggccaccaccacgcccccatgcccgactacagctgcctgaagccccccaaggccggcgaggagggccacgagggctgcagctacaccatgtgccccgagggcagatacggccaccccggctaccccgccctggtgacctacagctacggcggcgccgtgcccagctactgccccgcctacggcagagtgccccacagctgcggcagccccggcgagggcagaggctaccccagccccggcgcccacagccccagagccggcagcatcagccccggcagccccccctacccccagagcagaaagctgagctacgagatccccaccgaggagggcggcgacagataccccctgcccggccacctggccagcgccggccccctggccagcgccgagagcctggagcccgtgagctggagagagggccccagcggccacagcaccctgcccagaagccccagagacgccccctgcagcgccagcagcgagctgagcggccccagcacccccctgcacaccagcagccccgtgcagggcaaggagagcaccagaagacaggacaccagaagccccaccagcgcccccacccagagactgagccccggcgaggccctgccccccgtgagccaggccggcaccggcaaggcccccgagctgcccagcggcagcggccccgagcccctggcccccagccccgtgagccccaccttcccccccagcagccccagcgactggccccaggagagaagccccggcggccacagcgacggcgccagccccagaagccccgtgcccaccaccctgcccggcctgagacacgccccctggcagggccccagaggcccccccgacagccccgacggcagccccctgacccccgtgcccagccagatgccctggctggtggccagccccgagcccccccagagcagccccacccccgccttccccctggccgccagctacgacaccaacggcctgagccagccccccctgcccgagaagagacacctgcccggccccggccagcagcccggcccctggggccccgagcaggccagcagccccgccagaggcatcagccaccacgtgaccttcgcccccctgctgagcgacaacgtgccccagacccccgagccccccacccaggagagccagagcaacgtgaagttcgtgcaggacaccagcaagttctggtacaagccccacctgagcagagaccaggccatcgccctgctgaaggacaaggaccccggcgccttcctgatcagagacagccacagcttccagggcgcctacggcctggccctgaaggtggccacccccccccccagcgcccagccctggaagggcgaccccgtggagcagctggtgagacacttcctgatcgagaccggccccaagggcgtgaagatcaagggctgccccagcgagccctacttcggcagcctgagcgccctggtgagccagcacagcatcagccccatcagcctgccctgctgcctgagaatccccagcaaggaccccctggaggagacccccgaggcccccgtgcccaccaacatgagcaccgccgccgacctgctgagacagggcgccgcctgcagcgtgctgtacctgaccagcgtggagaccgagagcctgaccggcccccaggccgtggccagagccagcagcgccgccctgagctgcagccccagacccacccccgccgtggtgcacttcaaggtgagcgcccagggcatcaccctgaccgacaaccagagaaagctgttcttcagaagacactaccccgtgaacagcatcaccttcagcagcaccgacccccaggacagaagatggaccaaccccgacggcaccaccagcaagatcttcggcttcgtggccaagaagcccggcagcccctgggagaacgtgtgccacctgttcgccgagctggaccccgaccagcccgccggcgccatcgtgaccttcatcaccaaggtgctgctgggccagagaaagtag

SEQ ID NO: 102168 - DNA, 3858 bp, Artificial Sequence
  Description of Artificial Sequence: Synthetic coding sequence
atggagagaagatgggacctggacctgacctacgtgaccgagagaatcctggccgccgccttccccgccagacccgacgagcagagacacagaggccacctgagagagctggcccacgtgctgcagagcaagcacagagacaagtacctgctgttcaacctgagcgagaagagacacgacctgaccagactgaaccccaaggtgcaggacttcggctggcccgagctgcacgccccccccctggacaagctgtgcagcatctgcaaggccatggagacctggctgagcgccgacccccagcacgtggtggtgctgtactgcaagggcaacaagggcaagctgggcgtgatcgtgagcgcctacatgcactacagcaagatcagcgccggcgccgaccaggccctggccaccctgaccatgagaaagttctgcgaggacaaggtggccaccgagctgcagcccagccagagaagatacatcagctacttcagcggcctgctgagcggcagcatcagaatgaacagcagccccctgttcctgcactacgtgctgatccccatgctgcccgccttcgagcccggcaccggcttccagcccttcctgaagatctaccagagcatgcagctggtgtacaccagcggcgtgtaccacatcgccggccccggcccccagcagctgtgcatcagcctggagcccgccctgctgctgaagggcgacgtgatggtgacctgctaccacaagggcggcagaggcaccgacagaaccctggtgttcagagtgcagttccacacctgcaccatccacggcccccagctgaccttccccaaggaccagctggacgaggcctggaccgacgagagattccccttccaggccagcgtggagttcgtgttcagcagcagccccgagaagatcaagggcagcacccccagaaacgaccccagcgtgagcgtggactacaacaccaccgagcccgccgtgagatgggacagctacgagaacttcaaccagcaccacgaggacagcgtggacggcagcctgacccacaccagaggccccctggacggcagcccctacgcccaggtgcagagaccccccagacagaccccccccgcccccagccccgagcccccccccccccccatgctgagcgtgagcagcgacagcggccacagcagcaccctgaccaccgagcccgccgccgagagccccggcagacccccccccaccgccgccgagagacaggagctggacagactgctgggcggctgcggcgtggccagcggcggcagaggcgccggcagagagaccgccatcctggacgacgaggagcagcccaccgtgggcggcggcccccacctgggcgtgtaccccggccacagacccggcctgagcagacactgcagctgcagacagggctacagagagccctgcggcgtgcccaacggcggctactacagacccgagggcaccctggagagaagaagactggcctacggcggctacgagggcagcccccagggctacgccgaggccagcatggagaagagaagactgtgcagaagcctgagcgagggcctgtacccctacccccccgagatgggcaagcccgccaccggcgacttcggctacagagcccccggctacagagaggtggtgatcctggaggaccccggcctgcccgccctgtacccctgccccgcctgcgaggagaagctggccctgcccaccgccgccctgtacggcctgagactggagagagaggccggcgagggctgggccagcgaggccggcaagcccctgctgcaccccgtgagacccggccaccccctgcccctgctgctgcccgcctgcggccaccaccacgcccccatgcccgactacagctgcctgaagccccccaaggccggcgaggagggccacgagggctgcagctacaccatgtgccccgagggcagatacggccaccccggctaccccgccctggtgacctacagctacggcggcgccgtgcccagctactgccccgcctacggcagagtgccccacagctgcggcagccccggcgagggcagaggctaccccagccccggcgcccacagccccagagccggcagcatcagccccggcagccccccctacccccagagcagaaagctgagctacgagatccccaccgaggagggcggcgacagataccccctgcccggccacctggccagcgccggccccctggccagcgccgagagcctggagcccgtgagctggagagagggccccagcggccacagcaccctgcccagaagccccagagacgccccctgcagcgccagcagcgagctgagcggccccagcacccccctgcacaccagcagccccgtgcagggcaaggagagcaccagaagacaggacaccagaagccccaccagcgcccccacccagagactgagccccggcgaggccctgccccccgtgagccaggccggcaccggcaaggcccccgagctgcccagcggcagcggccccgagcccctggcccccagccccgtgagccccaccttcccccccagcagccccagcgactggccccaggagagaagccccggcggccacagcgacggcgccagccccagaagccccgtgcccaccaccctgcccggcctgagacacgccccctggcagggccccagaggcccccccgacagccccgacggcagccccctgacccccgtgcccagccagatgccctggctggtggccagccccgagcccccccagagcagccccacccccgccttccccctggccgccagctacgacaccaacggcctgagccagccccccctgcccgagaagagacacctgcccggccccggccagcagcccggcccctggggccccgagcaggccagcagccccgccagaggcatcagccaccacgtgaccttcgcccccctgctgagcgacaacgtgccccagacccccgagccccccacccaggagagccagagcaacgtgaagttcgtgcaggacaccagcaagttctggtacaagccccacctgagcagagaccaggccatcgccctgctgaaggacaaggaccccggcgccttcctgatcagagacagccacagcttccagggcgcctacggcctggccctgaaggtggccacccccccccccagcgcccagccctggaagggcgaccccgtggagcagctggtgagacacttcctgatcgagaccggccccaagggcgtgaagatcaagggctgccccagcgagccctacttcggcagcctgagcgccctggtgagccagcacagcatcagccccatcagcctgccctgctgcctgagaatccccagcaaggaccccctggaggagacccccgaggcccccgtgcccaccaacatgagcaccgccgccgacctgctgagacagggcgccgcctgcagcgtgctgtacctgaccagcgtggagaccgagagcctgaccggcccccaggccgtggccagagccagcagcgccgccctgagctgcagccccagacccacccccgccgtggtgcacttcaaggtgagcgcccagggcatcaccctgaccgacaaccagagaaagctgttcttcagaagacactaccccgtgaacagcatcaccttcagcagcaccgacccccaggacagaagatggaccaaccccgacggcaccaccagcaagatcttcggcttcgtggccaagaagcccggcagcccctgggagaacgtgtgccacctgttcgccgagctggaccccgaccagcccgccggcgccatcgtgaccttcatcaccaaggtgctgctgggccagagaaagtag

SEQ ID NO: 102169 - DNA, 2346 bp, Artificial Sequence
  Description of Artificial Sequence: Synthetic coding sequence
atgaagagcagcggccccgtggagagactgctgagagccctgggcagaagagacagcagcagagccgccagcagacccagaaaggccgagccccacagcttcagagagaaggtgttcagaaagaagccccccgtgtgcgccgtgtgcaaggtgaccatcgacggcaccggcgtgagctgcagagtgtgcaaggtggccacccacagaaagtgcgaggccaaggtgaccagcgcctgccaggccctgccccccgtggagctgagaagaaacaccgcccccgtgagaagaatcgagcacctgggcagcaccaagagcctgaaccacagcaagcagagaagcaccctgcccagaagcttcagcctggaccccctgatggagagaagatgggacctggacctgacctacgtgaccgagagaatcctggccgccgccttccccgccagacccgacgagcagagacacagaggccacctgagagagctggcccacgtgctgcagagcaagcacagagacaagtacctgctgttcaacctgagcgagaagagacacgacctgaccagactgaaccccaaggtgcaggacttcggctggcccgagctgcacgccccccccctggacaagctgtgcagcatctgcaaggccatggagacctggctgagcgccgacccccagcacgtggtggtgctgtactgcaagggcaacaagggcaagctgggcgtgatcgtgagcgcctacatgcactacagcaagatcagcgccggcgccgaccaggccctggccaccctgaccatgagaaagttctgcgaggacaaggtggccaccgagctgcagcccagccagagaagatacatcagctacttcagcggcctgctgagcggcagcatcagaatgaacagcagccccctgttcctgcactacgtgctgatccccatgctgcccgccttcgagcccggcaccggcttccagcccttcctgaagatctaccagagcatgcagctggtgtacaccagcggcgtgtaccacatcgccggccccggcccccagcagctgtgcatcagcctggagcccgccctgctgctgaagggcgacgtgatggtgacctgctaccacaagggcggcagaggcaccgacagaaccctggtgttcagagtgcagttccacacctgcaccatccacggcccccagctgaccttccccaaggaccagctggacgaggcctggaccgacgagagattccccttccaggccagcgtggagttcgtgttcagcagcagccccgagaagatcaagggcagcacccccagaaacgaccccagcgtgagcgtggactacaacaccaccgagcccgccgtgagatgggacagctacgagaacttcaaccagcaccacgaggacagcgtggacggcagcctgacccacaccagaggccccctggacggcagcccctacgcccaggtgcagagaccccccagacagaccccccccgcccccagccccgagcccccccccccccccatgctgagcgtgagcagcgacagcggccacagcagcaccctgaccaccgagcccgccgccgagagccccggcagacccccccccaccgccgccgagagacaggagctggacagactgctgggcggctgcggcgtggccagcggcggcagaggcgccggcagagagaccgccatcctggacgacgaggagcagcccaccgtgggcggcggcccccacctgggcgtgtaccccggccacagacccggcctgagcagacactgcagctgcagacagggctacagagagccctgcggcgtgcccaacggcggctactacagacccgagggcaccctggagagaagaagactggcctacggcggctacgagggcagcccccagggctacgccgaggccagcatggagaagagaagactgtgcagaagcctgagcgagggcctgtacccctacccccccgagatgggcaagcccgccaccggcgacttcggctacagagccagcagcgccgccctgagctgcagccccagacccacccccgccgtggtgcacttcaaggtgagcgcccagggcatcaccctgaccgacaaccagagaaagctgttcttcagaagacactaccccgtgaacagcatcaccttcagcagcaccgacccccaggacagaagatggaccaaccccgacggcaccaccagcaagatcttcggcttcgtggccaagaagcccggcagcccctgggagaacgtgtgccacctgttcgccgagctggaccccgaccagcccgccggcgccatcgtgaccttcatcaccaaggtgctgctgggccagagaaagtag

SEQ ID NO: 102170 - DNA, 4200 bp, Artificial Sequence
  Description of Artificial Sequence: Synthetic coding sequence
atgaagagcagcggccccgtggagagactgctgagagccctgggcagaagagacagcagcagagccgccagcagacccagaaaggccgagccccacagcttcagagagaaggtgttcagaaagaagccccccgtgtgcgccgtgtgcaaggtgaccatcgacggcaccggcgtgagctgcagagtgtgcaaggtggccacccacagaaagtgcgaggccaaggtgaccagcgcctgccaggccctgccccccgtggagctgagaagaaacaccgcccccgtgagaagaatcgagcacctgggcagcaccaagagcctgaaccacagcaagcagagaagcaccctgcccagaagcttcagcctggaccccctgatggagagaagatgggacctggacctgacctacgtgaccgagagaatcctggccgccgccttccccgccagacccgacgagcagagacacagaggccacctgagagagctggcccacgtgctgcagagcaagcacagagacaagtacctgctgttcaacctgagcgagaagagacacgacctgaccagactgaaccccaaggtgcaggacttcggctggcccgagctgcacgccccccccctggacaagctgtgcagcatctgcaaggccatggagacctggctgagcgccgacccccagcacgtggtggtgctgtactgcaagggcaacaagggcaagctgggcgtgatcgtgagcgcctacatgcactacagcaagatcagcgccggcgccgaccaggccctggccaccctgaccatgagaaagttctgcgaggacaaggtggccaccgagctgcagcccagccagagaagatacatcagctacttcagcggcctgctgagcggcagcatcagaatgaacagcagccccctgttcctgcactacgtgctgatccccatgctgcccgccttcgagcccggcaccggcttccagcccttcctgaagatctaccagagcatgcagctggtgtacaccagcggcgtgtaccacatcgccggccccggcccccagcagctgtgcatcagcctggagcccgccctgctgctgaagggcgacgtgatggtgacctgctaccacaagggcggcagaggcaccgacagaaccctggtgttcagagtgcagttccacacctgcaccatccacggcccccagctgaccttccccaaggaccagctggacgaggcctggaccgacgagagattccccttccaggccagcgtggagttcgtgttcagcagcagccccgagaagatcaagggcagcacccccagaaacgaccccagcgtgagcgtggactacaacaccaccgagcccgccgtgagatgggacagctacgagaacttcaaccagcaccacgaggacagcgtggacggcagcctgacccacaccagaggccccctggacggcagcccctacgcccaggtgcagagaccccccagacagaccccccccgcccccagccccgagcccccccccccccccatgctgagcgtgagcagcgacagcggccacagcagcaccctgaccaccgagcccgccgccgagagccccggcagacccccccccaccgccgccgagagacaggagctggacagactgctgggcggctgcggcgtggccagcggcggcagaggcgccggcagagagaccgccatcctggacgacgaggagcagcccaccgtgggcggcggcccccacctgggcgtgtaccccggccacagacccggcctgagcagacactgcagctgcagacagggctacagagagccctgcggcgtgcccaacggcggctactacagacccgagggcaccctggagagaagaagactggcctacggcggctacgagggcagcccccagggctacgccgaggccagcatggagaagagaagactgtgcagaagcctgagcgagggcctgtacccctacccccccgagatgggcaagcccgccaccggcgacttcggctacagagcccccggctacagagaggtggtgatcctggaggaccccggcctgcccgccctgtacccctgccccgccagcctgtacggcctgagactggagagagaggccggcgagggctgggccagcgaggccggcaagcccctgctgcaccccgtgagacccggccaccccctgcccctgctgctgcccgcctgcggccaccaccacgcccccatgcccgactacagctgcctgaagccccccaaggccggcgaggagggccacgagggctgcagctacaccatgtgccccgagggcagatacggccaccccggctaccccgccctggtgacctacagctacggcggcgccgtgcccagctactgccccgcctacggcagagtgccccacagctgcggcagccccggcgagggcagaggctaccccagccccggcgcccacagccccagagccggcagcatcagccccggcagccccccctacccccagagcagaaagctgagctacgagatccccaccgaggagggcggcgacagataccccctgcccggccacctggccagcgccggccccctggccagcgccgagagcctggagcccgtgagctggagagagggccccagcggccacagcaccctgcccagaagccccagagacgccccctgcagcgccagcagcgagctgagcggccccagcacccccctgcacaccagcagccccgtgcagggcaaggagagcaccagaagacaggacaccagaagccccaccagcgcccccacccagagactgagccccggcgaggccctgccccccgtgagccaggccggcaccggcaaggcccccgagctgcccagcggcagcggccccgagcccctggcccccagccccgtgagccccaccttcccccccagcagccccagcgactggccccaggagagaagccccggcggccacagcgacggcgccagccccagaagccccgtgcccaccaccctgcccggcctgagacacgccccctggcagggccccagaggcccccccgacagccccgacggcagccccctgacccccgtgcccagccagatgccctggctggtggccagccccgagcccccccagagcagccccacccccgccttccccctggccgccagctacgacaccaacggcctgagccagccccccctgcccgagaagagacacctgcccggccccggccagcagcccggcccctggggccccgagcaggccagcagccccgccagaggcatcagccaccacgtgaccttcgcccccctgctgagcgacaacgtgccccagacccccgagccccccacccaggagagccagagcaacgtgaagttcgtgcaggacaccagcaagttctggtacaagccccacctgagcagagaccaggccatcgccctgctgaaggacaaggaccccggcgccttcctgatcagagacagccacagcttccagggcgcctacggcctggccctgaaggtggccacccccccccccagcgcccagccctggaagggcgaccccgtggagcagctggtgagacacttcctgatcgagaccggccccaagggcgtgaagatcaagggctgccccagcgagccctacttcggcagcctgagcgccctggtgagccagcacagcatcagccccatcagcctgccctgctgcctgagaatccccagcaaggaccccctggaggagacccccgaggcccccgtgcccaccaacatgagcaccgccgccgacctgctgagacagggcgccgcctgcagcgtgctgtacctgaccagcgtggagaccgagagcctgaccggcccccaggccgtggccagagccagcagcgccgccctgagctgcagccccagacccacccccgccgtggtgcacttcaaggtgagcgcccagggcatcaccctgaccgacaaccagagaaagctgttcttcagaagacactaccccgtgaacagcatcaccttcagcagcaccgacccccaggacagaagatggaccaaccccgacggcaccaccagcaagatcttcggcttcgtggccaagaagcccggcagcccctgggagaacgtgtgccacctgttcgccgagctggaccccgaccagcccgccggcgccatcgtgaccttcatcaccaaggtgctgctgggccagagaaagtag

SEQ ID NO: 102171 - DNA, 567 bp, Artificial Sequence
  Description of Artificial Sequence: Synthetic coding sequence
atggactgcagaaagatggccagattcagctacagcgtgatctggatcatggccatcagcaaggtgttcgagctgggcctggtggccggcctgggccaccaggagttcgccagacccagcagaggctacctggccttcagagacgacagcatctggccccaggaggagcccgccatcagacccagaagcagccagagagtgccccccatgggcatccagcacagcaaggagctgaacagaacctgctgcctgaacggcggcacctgcatgctgggcagcttctgcgcctgcccccccagcttctacggcagaaactgcgagcacgacgtgagaaaggagaactgcggcagcgtgccccacgacacctggctgcccaagaagtgcagcctgtgcaagtgctggcacggccagctgagatgcttcccccaggccttcctgcccggctgcgacggcctggtgatggacgagcacctggtggccagcagaacccccgagctgccccccagcgccagaaccaccaccttcatgctggtgggcatctgcctgagcatccagagctactactag

SEQ ID NO: 102172 - DNA, 519 bp, Artificial Sequence
  Description of Artificial Sequence: Synthetic coding sequence
atggccatcagcaaggtgttcgagctgggcctggtggccggcctgggccaccaggagttcgccagacccagcagaggctacctggccttcagagacgacagcatctggccccaggaggagcccgccatcagacccagaagcagccagagagtgccccccatgggcatccagcacagcaaggagctgaacagaacctgctgcctgaacggcggcacctgcatgctgggcagcttctgcgcctgcccccccagcttctacggcagaaactgcgagcacgacgtgagaaaggagaactgcggcagcgtgccccacgacacctggctgcccaagaagtgcagcctgtgcaagtgctggcacggccagctgagatgcttcccccaggccttcctgcccggctgcgacggcctggtgatggacgagcacctggtggccagcagaacccccgagctgccccccagcgccagaaccaccaccttcatgctggtgggcatctgcctgagcatccagagctactactag

SEQ ID NO: 102173 - DNA, 645 bp, Artificial Sequence
  Description of Artificial Sequence: Synthetic coding sequence
atgggcgccgcccacagcgccagcgaggaggtgagagagctggagggcaagaccggcttcagcagcgaccagatcgagcagctgcacagaagattcaagcagctgagcggcgaccagcccaccatcagaaaggagaacttcaacaacgtgcccgacctggagctgaaccccatcagaagcaagatcgtgagagccttcttcgacaacagaaacctgagaaagggccccagcggcctggccgacgagatcaacttcgaggacttcctgaccatcatgagctacttcagacccatcgacaccaccatggacgaggagcaggtggagctgagcagaaaggagaagctgagattcctgttccacatgtacgacagcgacagcgacggcagaatcaccctggaggagtacagaaacgtggtggaggagctgctgagcggcaacccccacatcgagaaggagagcgccagaagcatcgccgacggcgccatgatggaggccgccagcgtgtgcatgggccagatggagcccgaccaggtgtacgagggcatcaccttcgaggacttcctgaagatctggcagggcatcgacatcgagaccaagatgcacgtgagattcctgaacatggagaccatggccctgtgccactag

SEQ ID NO: 102174 - DNA, 804 bp, Artificial Sequence
  Description of Artificial Sequence: Synthetic coding sequence
atgagacccagaagcggccccaccagaaaccccagactgagagccttcgccggcgtgcccaccagaggcagaaccagaggccagagcagaagatgcgccgccgaggccagcgccggccccgagagagacgccagacccggcgcccccgccgccggcaccatgggcgccgcccacagcgccagcgaggaggtgagagagctggagggcaagaccggcttcagcagcgaccagatcgagcagctgcacagaagattcaagcagctgagcggcgaccagcccaccatcagaaaggagaacttcaacaacgtgcccgacctggagctgaaccccatcagaagcaagatcgtgagagccttcttcgacaacagaaacctgagaaagggccccagcggcctggccgacgagatcaacttcgaggacttcctgaccatcatgagctacttcagacccatcgacaccaccatggacgaggagcaggtggagctgagcagaaaggagaagctgagattcctgttccacatgtacgacagcgacagcgacggcagaatcaccctggaggagtacagaaacgtggtggaggagctgctgagcggcaacccccacatcgagaaggagagcgccagaagcatcgccgacggcgccatgatggaggccgccagcgtgtgcatgggccagatggagcccgaccaggtgtacgagggcatcaccttcgaggacttcctgaagatctggcagggcatcgacatcgagaccaagatgcacgtgagattcctgaacatggagaccatggccctgtgccactag

SEQ ID NO: 102175 - DNA, 564 bp, Artificial Sequence
  Description of Artificial Sequence: Synthetic coding sequence
atgggcgccgcccacagcgccagcgaggaggtgagagagctggagggcaagaccggcttcagcagcgaccagatcgagcagctgcacagaagattcaagcagctgagcggcgaccagcccaccatcagaaacctgagaaagggccccagcggcctggccgacgagatcaacttcgaggacttcctgaccatcatgagctacttcagacccatcgacaccaccatggacgaggagcaggtggagctgagcagaaaggagaagctgagattcctgttccacatgtacgacagcgacagcgacggcagaatcaccctggaggagtacagaaacgtggtggaggagctgctgagcggcaacccccacatcgagaaggagagcgccagaagcatcgccgacggcgccatgatggaggccgccagcgtgtgcatgggccagatggagcccgaccaggtgtacgagggcatcaccttcgaggacttcctgaagatctggcagggcatcgacatcgagaccaagatgcacgtgagattcctgaacatggagaccatggccctgtgccactag

SEQ ID NO: 102176 - DNA, 1266 bp, Artificial Sequence
  Description of Artificial Sequence: Synthetic coding sequence
ctgaacctggaggtgaagttcaagaagatgggcctgggccacgagcagggcttcggcgccccctgcctgaagtgcaaggagaagtgcgagggcttcgagctgcacttctggagaaagatctgcagaaactgcaagtgcggccaggaggagcacgacgtgctgctgagcaacgaggaggacagaaaggtgggcaagctgttcgaggacaccaagtacaccaccctgatcgccaagctgaagagcgacggcatccccatgtacaagagaaacgtgatgatcctgaccaaccccgtggccgccaagaagaacgtgagcatcaacaccgtgacctacgagtgggccccccccgtgcagaaccaggccctggccagacagtacatgcagatgctgcccaaggagaagcagcccgtggccggcagcgagggcgcccagtacagaaagaagcagctggccaagcagctgcccgcccacgaccaggaccccagcaagtgccacgagctgagccccagagaggtgaaggagatggagcagttcgtgaagaagtacaagagcgaggccctgggcgtgggcgacgtgaagctgccctgcgagatggacgcccagggccccaagcagatgaacatccccggcggcgacagaagcacccccgccgccgtgggcgccatggaggacaagagcgccgagcacaagagaacccagtacagctgctactgctgcaagctgagcatgaaggagggcgaccccgccatctacgccgagagagccggctacgacaagctgtggcaccccgcctgcttcgtgtgcagcacctgccacgagctgctggtggacatgatctacttctggaagaacgagaagctgtactgcggcagacactactgcgacagcgagaagcccagatgcgccggctgcgacgagctgatcttcagcaacgagtacacccaggccgagaaccagaactggcacctgaagcacttctgctgcttcgactgcgacagcatcctggccggcgagatctacgtgatggtgaacgacaagcccgtgtgcaagccctgctacgtgaagaaccacgccgtggtgtgccagggctgccacaacgccatcgaccccgaggtgcagagagtgacctacaacaacttcagctggcacgccagcaccgagtgcttcctgtgcagctgctgcagcaagtgcctgatcggccagaagttcatgcccgtggagggcatggtgttctgcagcgtggagtgcaagaagagaatgagctag

SEQ ID NO: 102177 - DNA, 1266 bp, Artificial Sequence
  Description of Artificial Sequence: Synthetic coding sequence
atggacctggagaacaaggtgaagaagatgggcctgggccacgagcagggcttcggcgccccctgcctgaagtgcaaggagaagtgcgagggcttcgagctgcacttctggagaaagatctgcagaaactgcaagtgcggccaggaggagcacgacgtgctgctgagcaacgaggaggacagaaaggtgggcaagctgttcgaggacaccaagtacaccaccctgatcgccaagctgaagagcgacggcatccccatgtacaagagaaacgtgatgatcctgaccaaccccgtggccgccaagaagaacgtgagcatcaacaccgtgacctacgagtgggccccccccgtgcagaaccaggccctggccagacagtacatgcagatgctgcccaaggagaagcagcccgtggccggcagcgagggcgcccagtacagaaagaagcagctggccaagcagctgcccgcccacgaccaggaccccagcaagtgccacgagctgagccccagagaggtgaaggagatggagcagttcgtgaagaagtacaagagcgaggccctgggcgtgggcgacgtgaagctgccctgcgagatggacgcccagggccccaagcagatgaacatccccggcggcgacagaagcacccccgccgccgtgggcgccatggaggacaagagcgccgagcacaagagaacccagtacagctgctactgctgcaagctgagcatgaaggagggcgaccccgccatctacgccgagagagccggctacgacaagctgtggcaccccgcctgcttcgtgtgcagcacctgccacgagctgctggtggacatgatctacttctggaagaacgagaagctgtactgcggcagacactactgcgacagcgagaagcccagatgcgccggctgcgacgagctgatcttcagcaacgagtacacccaggccgagaaccagaactggcacctgaagcacttctgctgcttcgactgcgacagcatcctggccggcgagatctacgtgatggtgaacgacaagcccgtgtgcaagccctgctacgtgaagaaccacgccgtggtgtgccagggctgccacaacgccatcgaccccgaggtgcagagagtgacctacaacaacttcagctggcacgccagcaccgagtgcttcctgtgcagctgctgcagcaagtgcctgatcggccagaagttcatgcccgtggagggcatggtgttctgcagcgtggagtgcaagaagagaatgagctag

SEQ ID NO: 102178 - DNA, 1239 bp, Artificial Sequence
  Description of Artificial Sequence: Synthetic coding sequence
atgggcctgggccacgagcagggcttcggcgccccctgcctgaagtgcaaggagaagtgcgagggcttcgagctgcacttctggagaaagatctgcagaaactgcaagtgcggccaggaggagcacgacgtgctgctgagcaacgaggaggacagaaaggtgggcaagctgttcgaggacaccaagtacaccaccctgatcgccaagctgaagagcgacggcatccccatgtacaagagaaacgtgatgatcctgaccaaccccgtggccgccaagaagaacgtgagcatcaacaccgtgacctacgagtgggccccccccgtgcagaaccaggccctggccagacagtacatgcagatgctgcccaaggagaagcagcccgtggccggcagcgagggcgcccagtacagaaagaagcagctggccaagcagctgcccgcccacgaccaggaccccagcaagtgccacgagctgagccccagagaggtgaaggagatggagcagttcgtgaagaagtacaagagcgaggccctgggcgtgggcgacgtgaagctgccctgcgagatggacgcccagggccccaagcagatgaacatccccggcggcgacagaagcacccccgccgccgtgggcgccatggaggacaagagcgccgagcacaagagaacccagtacagctgctactgctgcaagctgagcatgaaggagggcgaccccgccatctacgccgagagagccggctacgacaagctgtggcaccccgcctgcttcgtgtgcagcacctgccacgagctgctggtggacatgatctacttctggaagaacgagaagctgtactgcggcagacactactgcgacagcgagaagcccagatgcgccggctgcgacgagctgatcttcagcaacgagtacacccaggccgagaaccagaactggcacctgaagcacttctgctgcttcgactgcgacagcatcctggccggcgagatctacgtgatggtgaacgacaagcccgtgtgcaagccctgctacgtgaagaaccacgccgtggtgtgccagggctgccacaacgccatcgaccccgaggtgcagagagtgacctacaacaacttcagctggcacgccagcaccgagtgcttcctgtgcagctgctgcagcaagtgcctgatcggccagaagttcatgcccgtggagggcatggtgttctgcagcgtggagtgcaagaagagaatgagctag

SEQ ID NO: 102179 - DNA, 540 bp, Artificial Sequence
  Description of Artificial Sequence: Synthetic coding sequence
atgaaggagggcgaccccgccatctacgccgagagagccggctacgacaagctgtggcaccccgcctgcttcgtgtgcagcacctgccacgagctgctggtggacatgatctacttctggaagaacgagaagctgtactgcggcagacactactgcgacagcgagaagcccagatgcgccggctgcgacgagctgatcttcagcaacgagtacacccaggccgagaaccagaactggcacctgaagcacttctgctgcttcgactgcgacagcatcctggccggcgagatctacgtgatggtgaacgacaagcccgtgtgcaagccctgctacgtgaagaaccacgccgtggtgtgccagggctgccacaacgccatcgaccccgaggtgcagagagtgacctacaacaacttcagctggcacgccagcaccgagtgcttcctgtgcagctgctgcagcaagtgcctgatcggccagaagttcatgcccgtggagggcatggtgttctgcagcgtggagtgcaagaagagaatgagctag

SEQ ID NO: 102180 - DNA, 804 bp, Artificial Sequence
  Description of Artificial Sequence: Synthetic coding sequence
atgggcgccagacagatccagaccagcagcagccagaccagccccgaggaggccatgggcacccccagaatccagcacctgctgatcctgctggtgctgggcgccagcctgctgaccagcggcctggagctgtactgccagaagggcctgagcatgaccgtggaggccgaccccgccaacatgttcaactggaccaccgaggaggtggagacctgcgacaagggcgccctgtgccaggagaccatcctgatcatcaaggccggcaccgagaccgccatcctggccaccaagggctgcatccccgagggcgaggaggccatcaccatcgtgcagcacagcagcccccccggcctgatcgtgaccagctacagcaactactgcgaggacagcttctgcaacgacaaggacagcctgagccagttctgggagttcagcgagaccaccgccagcaccgtgagcaccaccctgcactgccccacctgcgtggccctgggcacctgcttcagcgcccccagcctgccctgccccaacggcaccaccagatgctaccagggcaagctggagatcaccggcggcggcatcgagagcagcgtggaggtgaagggctgcaccgccatgatcggctgcagactgatgagcggcatcctggccgtgggccccatgttcgtgagagaggcctgcccccaccagctgctgacccagcccagaaagaccgagaacggcgccacctgcctgcccatccccgtgtggggcctgcagctgctgctgcccctgctgctgcccagcttcatccacttcagctag

SEQ ID NO: 102181 - DNA, 789 bp, Artificial Sequence
  Description of Artificial Sequence: Synthetic coding sequence
atccagaccagcagcagccagaccagccccgaggaggccatgggcacccccagaatccagcacctgctgatcctgctggtgctgggcgccagcctgctgaccagcggcctggagctgtactgccagaagggcctgagcatgaccgtggaggccgaccccgccaacatgttcaactggaccaccgaggaggtggagacctgcgacaagggcgccctgtgccaggagaccatcctgatcatcaaggccggcaccgagaccgccatcctggccaccaagggctgcatccccgagggcgaggaggccatcaccatcgtgcagcacagcagcccccccggcctgatcgtgaccagctacagcaactactgcgaggacagcttctgcaacgacaaggacagcctgagccagttctgggagttcagcgagaccaccgccagcaccgtgagcaccaccctgcactgccccacctgcgtggccctgggcacctgcttcagcgcccccagcctgccctgccccaacggcaccaccagatgctaccagggcaagctggagatcaccggcggcggcatcgagagcagcgtggaggtgaagggctgcaccgccatgatcggctgcagactgatgagcggcatcctggccgtgggccccatgttcgtgagagaggcctgcccccaccagctgctgacccagcccagaaagaccgagaacggcgccacctgcctgcccatccccgtgtggggcctgcagctgctgctgcccctgctgctgcccagcttcatccacttcagctag

SEQ ID NO: 102182 - DNA, 750 bp, Artificial Sequence
  Description of Artificial Sequence: Synthetic coding sequence
atgggcacccccagaatccagcacctgctgatcctgctggtgctgggcgccagcctgctgaccagcggcctggagctgtactgccagaagggcctgagcatgaccgtggaggccgaccccgccaacatgttcaactggaccaccgaggaggtggagacctgcgacaagggcgccctgtgccaggagaccatcctgatcatcaaggccggcaccgagaccgccatcctggccaccaagggctgcatccccgagggcgaggaggccatcaccatcgtgcagcacagcagcccccccggcctgatcgtgaccagctacagcaactactgcgaggacagcttctgcaacgacaaggacagcctgagccagttctgggagttcagcgagaccaccgccagcaccgtgagcaccaccctgcactgccccacctgcgtggccctgggcacctgcttcagcgcccccagcctgccctgccccaacggcaccaccagatgctaccagggcaagctggagatcaccggcggcggcatcgagagcagcgtggaggtgaagggctgcaccgccatgatcggctgcagactgatgagcggcatcctggccgtgggccccatgttcgtgagagaggcctgcccccaccagctgctgacccagcccagaaagaccgagaacggcgccacctgcctgcccatccccgtgtggggcctgcagctgctgctgcccctgctgctgcccagcttcatccacttcagctag

SEQ ID NO: 102183 - DNA, 804 bp, Artificial Sequence; identical to SEQ ID NO: 102180
  Description of Artificial Sequence: Synthetic coding sequence

SEQ ID NO: 102184 - DNA, 2823 bp, Artificial Sequence
  Description of Artificial Sequence: Synthetic coding sequence
atgatcagcgcccactgcaacctgagactgctgtgcagcagcgacagcagcgccagcgccagccaggtggccggcaccaccgaggtggtggagaacctggtgaccaacgacaacagccccaacatccccgaggccatcgacagactgttcagcgacatcgccaacatcaacagagagagcatggccgagatcaccgacatccagatcgaggagatggccgtgaacctgtggaactgggccctgaccatcggcggcggctggctggtgaacgaggagcagaagatcagactgcactacgtggcctgcaagctgctgagcatgtgcgaggccagcttcgccagcgagcagagcatccagagactgatcatgatgaacatgagaatcggcaaggagtggctggacgccggcaacttcctgatcgccgacgagtgcttccaggccgccgtggccagcctggagcagctgtacgtgaagctgatccagagaagcagccccgaggccgacctgaccatggagaagatcaccgtggagagcgaccacttcagagtgctgagctaccaggccgagagcgccgtggcccagggcgacttccagagagccagcatgtgcgtgctgcagtgcaaggacatgctgatgagactgccccagatgaccagcagcctgcaccacctgtgctacaacttcggcgtggagacccagaagaacaacaagtacgaggagagcagcttctggctgagccagagctacgacatcggcaagatggacaagaagagcaccggccccgagatgctggccaaggtgctgagactgctggccaccaactacctggactgggacgacaccaagtactacgacaaggccctgaacgccgtgaacctggccaacaaggagcacctgagcagccccggcctgttcctgaagatgaagatcctgctgaagggcgagaccagcaacgaggagctgctggaggccgtgatggagatcctgcacctggacatgcccctggacttctgcctgaacatcgccaagctgctgatggaccacgagagagagagcgtgggcttccacttcctgaccatcatccacgagagattcaagagcagcgagaacatcggcaaggtgctgatcctgcacaccgacatgctgctgcagagaaaggaggagctgctggccaaggagaagatcgaggagatcttcctggcccaccagaccggcagacagctgaccgccgagagcatgaactggctgcacaacatcctgtggagacaggccgccagcagcttcgaggtgcagaactacaccgacgccctgcagtggtactactacagcctgagattctacagcaccgacgagatggacctggacttcaccaagctgcagagaaacatggcctgctgctacctgaacctgcagcagctggacaaggccaaggaggccgtggccgaggccgagagacacgaccccagaaacgtgttcacccagttctacatcttcaagatcgccgtgatcgagggcaacagcgagagagccctgcaggccatcatcaccctggagaacatcctgaccgacgaggagagcgaggacaacgacctggtggccgagagaggcagccccaccatgctgctgagcctggccgcccagttcgccctggagaacggccagcagatcgtggccgagaaggccctggagtacctggcccagcacagcgaggaccaggagcaggtgctgaccgccgtgaagtgcctgctgagattcctgctgcccaagatcgccgagatgcccgagagcgaggacaagaagaaggagatggacagactgctgacctgcctgaacagagccttcgtgaagctgagccagcccttcggcgaggaggccctgagcctggagagcagagccaacgaggcccagtggttcagaaagaccgcctggaacctggccgtgcagtgcgacaaggaccccgtgatgatgagagagttcttcatcctgagctacaagatgagccagttctgccccagcgaccaggtgatcctgatcgccagaaagacctgcctgctgatggccgtggccgtggacctggagcagggcagaaaggccagcaccgccttcgagcagaccatgttcctgagcagagccctggaggagatccagacctgcaacgacatccacaacttcctgaagcagaccggcaccttcagcaacgacagctgcgagaagctgctgctgctgtacgagttcgaggtgagagccaagctgaacgaccccctgctggagagcttcctggagagcgtgtgggagctgccccacctggagaccaagaccttcgagaccatcgccatcatcgccatggagaagcccgcccactaccccctgatcgccctgaaggccctgaagaaggccctgctgctgtacaagaaggaggagcccatcgacatcagccagtacagcaagtgcatgcacaacctggtgaacctgagcgtgcccgacggcgccagcaacgtggagctgtgccccctggaggaggtgtggggctacttcgaggacgccctgagccacatcagcagaaccaaggactaccccgagatggagatcctgtggctgatggtgaagagctggaacaccggcgtgctgatgttcagcagaagcaagtacgccagcgccgagaagtggtgcggcctggccctgagattcctgaaccacctgaccagcttcaaggagagctacgagacccagatgaacatgctgtacagccagctggtggaggccctgagcaacaacaagggccccgtgttccacgagcacggctactggagcaagagcgactag

SEQ ID NO: 102185 - DNA, 1848 bp, Artificial Sequence
  Description of Artificial Sequence: Synthetic coding sequence
atggagatcctgcacctggacatgcccctggacttctgcctgaacatcgccaagctgctgatggaccacgagagagagagcgtgggcttccacttcctgaccatcatccacgagagattcaagagcagcgagaacatcggcaaggtgctgatcctgcacaccgacatgctgctgcagagaaaggaggagctgctggccaaggagaagatcgaggagatcttcctggcccaccagaccggcagacagctgaccgccgagagcatgaactggctgcacaacatcctgtggagacaggccgccagcagcttcgaggtgcagaactacaccgacgccctgcagtggtactactacagcctgagattctacagcaccgacgagatggacctggacttcaccaagctgcagagaaacatggcctgctgctacctgaacctgcagcagctggacaaggccaaggaggccgtggccgaggccgagagacacgaccccagaaacgtgttcacccagttctacatcttcaagatcgccgtgatcgagggcaacagcgagagagccctgcaggccatcatcaccctggagaacatcctgaccgacgaggagagcgaggacaacgacctggtggccgagagaggcagccccaccatgctgctgagcctggccgcccagttcgccctggagaacggccagcagatcgtggccgagaaggccctggagtacctggcccagcacagcgaggaccaggagcaggtgctgaccgccgtgaagtgcctgctgagattcctgctgcccaagatcgccgagatgcccgagagcgaggacaagaagaaggagatggacagactgctgacctgcctgaacagagccttcgtgaagctgagccagcccttcggcgaggaggccctgagcctggagagcagagccaacgaggcccagtggttcagaaagaccgcctggaacctggccgtgcagtgcgacaaggaccccgtgatgatgagagagttcttcatcctgagctacaagatgagccagttctgccccagcgaccaggtgatcctgatcgccagaaagacctgcctgctgatggccgtggccgtggacctggagcagggcagaaaggccagcaccgccttcgagcagaccatgttcctgagcagagccctggaggagatccagacctgcaacgacatccacaacttcctgaagcagaccggcaccttcagcaacgacagctgcgagaagctgctgctgctgtacgagttcgaggtgagagccaagctgaacgaccccctgctggagagcttcctggagagcgtgtgggagctgccccacctggagaccaagaccttcgagaccatcgccatcatcgccatggagaagcccgcccactaccccctgatcgccctgaaggccctgaagaaggccctgctgctgtacaagaaggaggagcccatcgacatcagccagtacagcaagtgcatgcacaacctggtgaacctgagcgtgcccgacggcgccagcaacgtggagctgtgccccctggaggaggtgtggggctacttcgaggacgccctgagccacatcagcagaaccaaggactaccccgagatggagatcctgtggctgatggtgaagagctggaacaccggcgtgctgatgttcagcagaagcaagtacgccagcgccgagaagtggtgcggcctggccctgagattcctgaaccacctgaccagcttcaaggagagctacgagacccagatgaacatgctgtacagccagctggtggaggccctgagcaacaacaagggccccgtgttccacgagcacggctactggagcaagagcgactag

SEQ ID NO: 102186 - DNA, 2778 bp, Artificial Sequence
  Description of Artificial Sequence: Synthetic coding sequence
atggacaacgacgacttcttcagcatggacttcaaggaggtggtggagaacctggtgaccaacgacaacagccccaacatccccgaggccatcgacagactgttcagcgacatcgccaacatcaacagagagagcatggccgagatcaccgacatccagatcgaggagatggccgtgaacctgtggaactgggccctgaccatcggcggcggctggctggtgaacgaggagcagaagatcagactgcactacgtggcctgcaagctgctgagcatgtgcgaggccagcttcgccagcgagcagagcatccagagactgatcatgatgaacatgagaatcggcaaggagtggctggacgccggcaacttcctgatcgccgacgagtgcttccaggccgccgtggccagcctggagcagctgtacgtgaagctgatccagagaagcagccccgaggccgacctgaccatggagaagatcaccgtggagagcgaccacttcagagtgctgagctaccaggccgagagcgccgtggcccagggcgacttccagagagccagcatgtgcgtgctgcagtgcaaggacatgctgatgagactgccccagatgaccagcagcctgcaccacctgtgctacaacttcggcgtggagacccagaagaacaacaagtacgaggagagcagcttctggctgagccagagctacgacatcggcaagatggacaagaagagcaccggccccgagatgctggccaaggtgctgagactgctggccaccaactacctggactgggacgacaccaagtactacgacaaggccctgaacgccgtgaacctggccaacaaggagcacctgagcagccccggcctgttcctgaagatgaagatcctgctgaagggcgagaccagcaacgaggagctgctggaggccgtgatggagatcctgcacctggacatgcccctggacttctgcctgaacatcgccaagctgctgatggaccacgagagagagagcgtgggcttccacttcctgaccatcatccacgagagattcaagagcagcgagaacatcggcaaggtgctgatcctgcacaccgacatgctgctgcagagaaaggaggagctgctggccaaggagaagatcgaggagatcttcctggcccaccagaccggcagacagctgaccgccgagagcatgaactggctgcacaacatcctgtggagacaggccgccagcagcttcgaggtgcagaactacaccgacgccctgcagtggtactactacagcctgagattctacagcaccgacgagatggacctggacttcaccaagctgcagagaaacatggcctgctgctacctgaacctgcagcagctggacaaggccaaggaggccgtggccgaggccgagagacacgaccccagaaacgtgttcacccagttctacatcttcaagatcgccgtgatcgagggcaacagcgagagagccctgcaggccatcatcaccctggagaacatcctgaccgacgaggagagcgaggacaacgacctggtggccgagagaggcagccccaccatgctgctgagcctggccgcccagttcgccctggagaacggccagcagatcgtggccgagaaggccctggagtacctggcccagcacagcgaggaccaggagcaggtgctgaccgccgtgaagtgcctgctgagattcctgctgcccaagatcgccgagatgcccgagagcgaggacaagaagaaggagatggacagactgctgacctgcctgaacagagccttcgtgaagctgagccagcccttcggcgaggaggccctgagcctggagagcagagccaacgaggcccagtggttcagaaagaccgcctggaacctggccgtgcagtgcgacaaggaccccgtgatgatgagagagttcttcatcctgagctacaagatgagccagttctgccccagcgaccaggtgatcctgatcgccagaaagacctgcctgctgatggccgtggccgtggacctggagcagggcagaaaggccagcaccgccttcgagcagaccatgttcctgagcagagccctggaggagatccagacctgcaacgacatccacaacttcctgaagcagaccggcaccttcagcaacgacagctgcgagaagctgctgctgctgtacgagttcgaggtgagagccaagctgaacgaccccctgctggagagcttcctggagagcgtgtgggagctgccccacctggagaccaagaccttcgagaccatcgccatcatcgccatggagaagcccgcccactaccccctgatcgccctgaaggccctgaagaaggccctgctgctgtacaagaaggaggagcccatcgacatcagccagtacagcaagtgcatgcacaacctggtgaacctgagcgtgcccgacggcgccagcaacgtggagctgtgccccctggaggaggtgtggggctacttcgaggacgccctgagccacatcagcagaaccaaggactaccccgagatggagatcctgtggctgatggtgaagagctggaacaccggcgtgctgatgttcagcagaagcaagtacgccagcgccgagaagtggtgcggcctggccctgagattcctgaaccacctgaccagcttcaaggagagctacgagacccagatgaacatgctgtacagccagctggtggaggccctgagcaacaacaagggccccgtgttccacgagcacggctactggagcaagagcgactag

SEQ ID NO: 102187 - DNA, 2823 bp, Artificial Sequence; identical to SEQ ID NO: 102184
  Description of Artificial Sequence: Synthetic coding sequence

SEQ ID NO: 102188 - DNA, 372 bp, Artificial Sequence
  Description of Artificial Sequence: Synthetic coding sequence
atgatggccaaccacctggtgaagcccgacaacagaaactgcaagagacccagagagctggagagccccgtgcccgacagcccccagctgagcagcctgggcaagagcgacagcagcttcagcgagatcagcggcctgttctacaaggacgaggccctggagaaggacctgaacgacgtgagcaaggagatcaacctgatgctgagcacctacgccaagctgctgagcgagagagccgccgtggacgccagctacatcgacgagatcgacgagctgttcaaggaggccaacgccatcgagaacttcctgatccagaagagagagttcctgagacagagattcaccgtgatcgccaacaccctgcacagatag

SEQ ID NO: 102189 - DNA, 372 bp, Artificial Sequence; identical to SEQ ID NO: 102188
  Description of Artificial Sequence: Synthetic coding sequence

SEQ ID NO: 102190 - DNA, 1059 bp, Artificial Sequence
  Description of Artificial Sequence: Synthetic coding sequence
atggccctgagacccgaggaccccagcagcggcttcagacacagcaacgtggtggccttcatcaacgagaagatggccagacacaccaagggccccgagttctacctggagaacatcagcctgagctgggagaaggtggaggacaagctgagagccatcctggaggacagcgaggtgcccagcgaggtgaaggaggcctgcacctggggcagcctggccctgggcgtgagattcgcccacagacaggcccagctgcagagacacagagtgagatggctgcacggcttcgccaagctgcacaagagcgccgcccaggccctggccagcgacctgaagaagctgagagagcagcaggagaccgagagaaaggaggccgccagcagactgagaatggcccagaccagcctggtggaggtgcagaaggagagagacaaggagctggtgagcccccacgagtgggagcagggcgccggctggcccggcctggccaccgccggcggcgtgtgcaccgagggcgccgccgaggaggaggaggaggccgccgtggccgccgccggcgccgccggcggcaagggcgccgaggaggagcagagaggctgctggagactgtggctgcccctgtggagaccctggctgcccctgtggagactgggcctgcccccctggagacccagcagccccacctggagacccggcctgcccccctggagaccccagagaagctggagagagagcagctgcagcagcctggagatgctgatcagaaagagcacccccatcggcggcagaagaagagagatcagcggcagaagcaagcagccccacctgatcagcctggagcccagaacccccggccccgagccccaccagaacctgttcctgagcagcagcctgccccacacccacacccacacccaggccctgttcccccccagccagacctaccccctgtaccccctgcacaagcagcagagccagcaccagttcagactgagctgcctgcccaccggcagacccctgatcctggcctgcggcctgatgggcggccccaccgagtag

SEQ ID NO: 102191 - DNA, 1059 bp, Artificial Sequence; identical to SEQ ID NO: 102190
  Description of Artificial Sequence: Synthetic coding sequence

SEQ ID NO: 102192 - DNA, 1230 bp, Artificial Sequence
  Description of Artificial Sequence: Synthetic coding sequence
atggccctgagacccgaggaccccagcagcggcttcagacacagcaacgtggtggccttcatcaacgagaagatggccagacacaccaagggccccgagttctacctggagaacatcagcctgagctgggagaaggtggaggacaagctgagagccatcctggaggacagcgaggtgcccagcgaggtgaaggaggcctgcacctggggcagcctggccctgggcgtgagattcgcccacagacaggcccagctgcagagacacagagtgagatggctgcacggcttcgccaagctgcacaagagcgccgcccaggccctggccagcgacctgaagaagctgagagagcagcaggagaccgagagaaaggaggccgccagcagactgagaatggcccagaccagcctggtggaggtgcagaaggagagagacaaggagctggtgagcccccacgagtgggagcagggcgccggctggcccggcctggccaccgccggcggcgtgtgcaccgagggcgccgccgaggaggaggaggaggccgccgtggccgccgccggcgccgccggcggcaagggcgccgaggaggagcagagagacgtggaggtggtggccgcccccgtggaggccatggccccccccgtggaggccggcgccgcccccatggagacccagttcccccacgtggaggccagagccgccagcatggagaccaccgagaagctggagagaatcctgctgcagctgctgggcgacgccgaccaggagaagtacacctactggggccagaaggagggcgacctgagaagcgtggagaccgccaccagctacttcagcggcaccaccaacccctggagcagagccagcagcgagcccctgcccgtgcagctgcccgccagctacagctacagctacagcagccccttcagcagcttcagcgacatccccaccatcagccccccccaggccaccgtgaccgcccccgtgcccccccagctgcccagcgactgggaggccttcgacaccagcctgtggagcgacggcggcccccacagaatcgaccaccaggagcaccccagagacagaagatacagcgagccccaccagcagagaccccccgtgtacagaagacccggcgactgggactgcccctggtgcaacgccgtgaacttcagcagaagagacacctgcttcgactgcggcaagggcatctggctgcagaagccccactag

SEQ ID NO: 102193 - DNA, 939 bp, Artificial Sequence
  Description of Artificial Sequence: Synthetic coding sequence
atggccctgagacccgaggaccccagcagcggcttcagacacggcaacgtggtggccttcatcatcgagaagatggccagacacaccaagggccccgagttctacttcgagaacatcagcctgagctgggaggaggtggaggacaagctgagagccatcctggaggacagcgaggtgcccagcgaggtgaaggaggcctgcacctggggcagcctggccctgggcgtgagattcgcccacagacagggccagctgcagaacagaagagtgcagtggctgcagggcttcgccaagctgcacagaagcgccgccctggtgctggccagcaacctgaccgagctgaaggagcagcaggagatggagtgcaacgaggccaccttccagctgcagctgaccgagaccagcctggccgaggtgcagagagagagagacatgctgagatggaagctgttccacgccgagctggcccccccccagggccagggccaggccaccgtgttccccggcctggccaccgccggcggcgactggaccgagggcgccggcgagcaggagaaggaggccgtggccgccgccggcgccgccggcggcaagggcgaggagagatacgccgaggccggccccgcccccgccgaggtgctgcagggcctgggcggcggcttcagacagcccctgggcgccatcgtggccggcaagctgcacctgtgcggcgccgagggcgagagaagccaggtgagcaccaacagccacgtgtgcctgctgtgggcctgggtgcacagcctgaccggcgccagcagctgccccgccccctacctgatccacatcctgatccccatgcccttcgtgagactgctgagccacacccagtacacccccttcaccagcaagggccacagaaccggcagcaacagcgacgccttccagctgggcggcctgtag

SEQ ID NO: 102194 - DNA, 4494 bp, Artificial Sequence
  Description of Artificial Sequence: Synthetic coding sequence
atgagcagagccgtgagactgcccgtgccctgccccgtgcagctgggcaccctgagaaacgacagcctggaggcccagctgcacgagtacgtgaagcagggcaactacgtgaaggtgaagaagatcctgaagaagggcatctacgtggacgccgtgaacagcctgggccagaccgccctgttcgtggccgccctgctgggcctgagaaagttcgtggacgtgctggtggactacggcagcgaccccaaccacagatgcttcgacggcagcacccccgtgcacgccgccgccttcagcggcaaccagtggatcctgagcaagctgctggacgccggcggcgacctgagactgcacgacgagagaggccagaaccccaagacctgggccctgaccgccggcaaggagagaagcacccagatcgtggagttcatgcagagatgcgccagccacatgcaggccatcatccagggcttcagctacgacctgctgaagaagatcgacagcccccagagactggtgtacagccccagctggtgcggcggcctggtgcagggcaaccccaacggcagccccaacagactgctgaaggccggcgtgatcagcgcccagaacatctacagcttcggcttcggcaaggccatgccctggttccagttctacctgaccggcgccacccagatggcctacctgggcagcctgcccgtgatcggcgagaaggaggtgatccaggccgacgacgagcccaccttcagcttcttcagcggcccctacatggtgatgaccaacctggtgtggaacggcagcagagtgaccgtgaaggagctgaacctgcccacccacccccactgcagcagactgagactggccgacctgctgatcgccgagcaggagcacagcagcaagctgagacacccctacctgctgcagctgatggccgtgtgcctgagccaggacctggagaagaccagactggtgtacgagagaatcaccatcggcaccctgttcagcgtgctgcacgagagaagaagccagttccccgtgctgcacatggaggtgatcgtgcacctgctgctgcagatcagcgacgccctgagatacctgcacttccagggcttcatccacagaagcctgagcagctacgccgtgcacatcatcagccccggcgaggccagactgaccaacctggagtacatgctggagagcgaggacagaggcgtgcagagagacctgaccagagtgcccctgcccacccagctgtacaactgggccgcccccgaggtgatcctgcagaaggccgccaccgtgaagagcgacatctacagcttcagcatgatcatgcaggagatcctgaccgacgacatcccctggaagggcctggacggcagcgtggtgaagaaggccgtggtgagcggcaactacctggaggccgacgtgagactgcccaagccctactacgacatcgtgaagagcggcatccacgtgaagcagaaggacagaaccatgaacctgcaggacatcagatacatcctgaagaacgacctgaaggacttcaccggcgcccagagaacccagcccaccgagagccccagagtgcagagatacggcctgcaccccgacgtgaacgtgtacctgggcctgaccagcgagcaccccagagagacccccgacatggagatcatcgagctgaaggagatgggcagccagccccacagccccagagtgcacagcctgttcaccgagggcaccctggacccccaggcccccgacccctgcctgatggccagagagacccagaaccaggacgccccctgccccgcccccttcatggccgaggaggccagcagccccagcaccggccagcccagcctgtgcagcttcgagatcaacgagatctacagcggctgcctgatcctggaggacgacatcgaggagccccccggcgccgccagcagcctggaggccgacggccccaaccaggtggacgagctgaagagcatggaggaggagctggacaagatggagagagaggcctgctgcttcggcagcgaggacgagagcagcagcaaggccgagaccgagtacagcttcgacgactgggactggcagaacggcagcctgagcagcctgagcctgcccgagagcaccagagaggccaagagcaacctgaacaacatgagcaccaccgaggagtacctgatcagcaagtgcgtgctggacctgaagatcatgcagaccatcatgcacgagaacgacgacagactgagaaacatcgagcagatcctggacgaggtggagatgaagcagaaggagcaggaggagagaatgagcctgtgggccaccagcagagagttcaccaacgcctacaagctgcccctggccgtgggcccccccagcctgaactacatcccccccgtgctgcagctgagcggcggccagaagcccgacaccagcggcaactaccccaccctgcccagattccccagaatgctgcccaccctgtgcgaccccggcaagcagaacaccgacgagcagttccagtgcacccagggcgccaaggacagcctggagaccagcagaatccagaacaccagcagccagggcagacccagagagagcaccgcccaggccaaggccacccagttcaacagcgccctgttcaccctgagcagccacagacagggccccagcgccagccccagctgccactgggacagcaccagaatgagcgtggagcccgtgagcagcgagatctacaacgccgagagcagaaacaaggacgacggcaaggtgcacctgaagtggaagatggaggtgaaggagatggccaagaaggccgccaccggccagctgaccgtgcccccctggcacccccagagcagcctgaccctggagagcgaggccgagaacgagcccgacgccctgctgcagccccccatcagaagccccgagaacaccgactggcagagagtgatcgagtaccacagagagaacgacgagcccagaggcaacggcaagttcgacaagaccggcaacaacgactgcgacagcgaccagcacggcagacagcccagactgggcagcttcaccagcatcagacaccccagccccagacagaaggagcagcccgagcacagcgaggccttccaggccagcagcgacaccctggtggccgtggagaagagctacagccaccagagcatgcagagcacctgcagccccgagagcagcgaggacatcaccgacgagttcctgacccccgacggcgagtacttctacagcagcaccgcccaggagaacctggccctggagaccagcagccccatcgaggaggacttcgagggcatccagggcgccttcgcccagccccaggtgagcggcgaggagaagttccagatgagaaagatcctgggcaagaacgccgagatcctgcccagaagccagttccagcccgtgagaagcaccgaggacgagcaggaggagaccagcaaggagagccccaaggagctgaaggagaaggacatcagcctgaccgacatccaggacctgagcagcatcagctacgagcccgacagcagcttcaaggaggccagctgcaagacccccaagatcaaccacgcccccaccagcgtgagcacccccctgagccccggcagcgtgagcagcgccgccagccagtacaaggactgcctggagagcatcaccttccaggtgaagaccgagttcgccagctgctggaacagccaggagttcatccagaccctgagcgacgacttcatcagcgtgagagagagagccaagaagctggacagcctgctgaccagcagcgagaccccccccagcagactgaccggcctgaagagactgagcagcttcatcggcgccggcagccccagcctggtgaaggcctgcgacagcagccccccccacgccacccagagaagaagcctgcccaaggtggaggccttcagccagcaccacatcgacgagctgcccccccccagccaggagctgctggacgacatcgagctgctgaagcagcagcagggcagcagcaccgtgctgcacgagaacaccgccagcgacggcggcggcaccgccaacgaccagagacacctggaggagcaggagaccgacagcaagaaggaggacagcagcatgctgctgagcaaggagaccgaggacctgggcgaggacaccgagagagcccacagcaccctggacgaggacctggagagatggctgcagccccccgaggagagcgtggagctgcaggacctgcccaagggcagcgagagagagaccaacatcaaggaccagaaggtgggcgaggagaagagaaagagagaggacagcatcacccccgagagaagaaagagcgagggcgtgctgggcaccagcgaggaggacgagctgaagagctgcttctggaagagactgggctggagcgagagcagcagaatcatcgtgctggaccagagcgacctgagcgactag

SEQ ID NO: 102195 - DNA, 4356 bp, Artificial Sequence
  Description of Artificial Sequence: Synthetic coding sequence
atgagcagagccgtgagactgcccgtgccctgccccgtgcagctgggcaccctgagaaacgacagcctggaggcccagctgcacgagtacgtgaagcagggcaactacgtgaaggtgaagaagatcctgaagaagggcatctacgtggacgccgtgaacagcctgggccagaccgccctgttcgtggccgccctgctgggcctgagaaagttcgtggacgtgctggtggactacggcagcgaccccaaccacagatgcttcgacggcagcacccccgtgcacgccgccgccttcagcggcaaccagtggatcctgagcaagctgctggacgccggcggcgacctgagactgcacgacgagagaggccagaaccccaagacctgggccctgaccgccggcaaggagagaagcacccagatcgtggagttcatgcagagatgcgccagccacatgcaggccatcatccagggcttcagctacgacctgctgaagaagatcgacagcccccagagactggtgtacagccccagctggtgcggcggcctggtgcagggcaaccccaacggcagccccaacagactgctgaaggccggcgtgatcagcgcccagaacatctacagcttcggcttcggcaagttctacctgaccggcgccacccagatggcctacctgggcagcctgcccgtgatcggcgagaaggaggtgatccaggccgacgacgagcccaccttcagcttcttcagcggcccctacatggtgatgaccaacctggtgtggaacggcagcagagtgaccgtgaaggagctgaacctgcccacccacccccactgcagcagactgagactggccgacctgctgatcgccgagcaggagcacagcagcaagctgagacacccctacctgctgcagctgatggccgtgtgcctgagccaggacctggagaagaccagactggtgtacgagagaatcaccatcggcaccctgttcagcgtgctgcacgagagaagaagccagttccccgtgctgcacatggaggtgatcgtgcacctgctgctgcagatcagcgacgccctgagatacctgcacttccagggcttcatccacagaagcctgagcagctacgccgtgcacatcatcagccccggcgaggccagactgaccaacctggagtacatgctggagagcgaggacagaggcgtgcagagagacctgaccagagtgcccctgcccacccagctgtacaactgggccgcccccgaggtgatcctgcagaaggccgccaccgtgaagagcgacatctacagcttcagcatgatcatgcaggagatcctgaccgacgacatcccctggaagggcctggacggcagcgtggtgaagaaggccgtggtgagcggcaactacctggaggccgacgtgagactgcccaagccctactacgacatcgtgaagagcggcatccacgtgaagcagaaggacagaaccatgaacctgcaggacatcagatacatcctgaagaacgacctgaaggacttcaccggcgcccagagaacccagcccaccgagagccccagagtgcagagatacggcctgcaccccgacgtgaacgtgtacctgggcctgaccagcgagcaccccagagagacccccgacatggagatcatcgagctgaaggagatgggcagccagccccacagccccagagtgcacagcctgttcaccgagggcaccctggacccccaggcccccgacccctgcctgatggccagagagacccagaaccaggacgccccctgccccgcccccttcatggccgaggaggccagcagccccagcaccggccagcccagcctgtgcagcttcgagatcaacgagatctacagcggctgcctgatcctggaggacgacatcgaggagccccccggcgccgccagcagcctggaggccgacggccccaaccaggtggacgagctgaagagcatggaggaggagctggacaagatggagagagaggcctgctgcttcggcagcgaggacgagagcagcagcaaggccgagaccgagtacagcttcgacgactgggactggcagaacggcagcctgagcagcctgagcctgcccgagagcaccagagaggccaagagcaacctgaacaacatgagcaccaccgaggagtacctgatcagcaagtgcgtgctggacctgaagatcatgcagaccatcatgcacgagaacgacgacagactgagaaacatcgagcagatcctggacgaggtggagatgaagcagaaggagcaggaggagagaatgagcctgtgggccaccagcagagagttcaccaacgcctacaagctgcccctggccgtgggcccccccagcctgaactacatcccccccgtgctgcagctgagcggcggccagaagcccgacaccagcggcaactaccccaccctgcccagattccccagaatgctgcccaccctgtgcgaccccggcaagcagaacaccgacgagcagttccagtgcacccagggcgccaaggacagcctggagaccagcagaatccagaacaccagcagccagggcagacccagagagagcaccgcccaggccaaggccacccagttcaacagcgccctgttcaccctgagcagccacagacagggccccagcgccagccccagctgccactgggacagcaccagaatgagcgtggagcccgtgagcagcgagatctacaacgccgagagcagaaacaaggacgacggcaaggtgcacctgaagtggaagatggaggtgaaggagatggccaagaaggccgccaccggccagctgaccgtgcccccctggcacccccagagcagcctgaccctggagagcgaggccgagaacgagcccgacgccctgctgcagccccccatcagaagccccgagaacaccgactggcagagagtgatcgagtaccacagagagaacgacgagcccagaggcaacggcaagttcgacaagaccggcaacaacgactgcgacagcgaccagcacggcagacagcccagactgggcagcttcaccagcatcagacaccccagccccagacagaaggagcagcccgagcacagcgaggccttccaggccagcagcgacaccctggtggccgtggagaagagctacagcaccagcagccccatcgaggaggacttcgagggcatccagggcgccttcgcccagccccaggtgagcggcgaggagaagttccagatgagaaagatcctgggcaagaacgccgagatcctgcccagaagccagttccagcccgtgagaagcaccgaggacgagcaggaggagaccagcaaggagagccccaaggagctgaaggagaaggacatcagcctgaccgacatccaggacctgagcagcatcagctacgagcccgacagcagcttcaaggaggccagctgcaagacccccaagatcaaccacgcccccaccagcgtgagcacccccctgagccccggcagcgtgagcagcgccgccagccagtacaaggactgcctggagagcatcaccttccaggtgaagaccgagttcgccagctgctggaacagccaggagttcatccagaccctgagcgacgacttcatcagcgtgagagagagagccaagaagctggacagcctgctgaccagcagcgagaccccccccagcagactgaccggcctgaagagactgagcagcttcatcggcgccggcagccccagcctggtgaaggcctgcgacagcagccccccccacgccacccagagaagaagcctgcccaaggtggaggccttcagccagcaccacatcgacgagctgcccccccccagccaggagctgctggacgacatcgagctgctgaagcagcagcagggcagcagcaccgtgctgcacgagaacaccgccagcgacggcggcggcaccgccaacgaccagagacacctggaggagcaggagaccgacagcaagaaggaggacagcagcatgctgctgagcaaggagaccgaggacctgggcgaggacaccgagagagcccacagcaccctggacgaggacctggagagatggctgcagccccccgaggagagcgtggagctgcaggacctgcccaagggcagcgagagagagaccaacatcaaggaccagaaggtgggcgaggagaagagaaagagagaggacagcatcacccccgagagaagaaagagcgagggcgtgctgggcaccagcgaggaggacgagctgaagagctgcttctggaagagactgggctggagcgagagcagcagaatcatcgtgctggaccagagcgacctgagcgactag

SEQ ID NO: 102196 - DNA, 4476 bp, Artificial Sequence
  Description of Artificial Sequence: Synthetic coding sequence
atgagcagagccgtgagactgcccgtgccctgccccgtgcagctgggcaccctgagaaacgacagcctggaggcccagctgcacgagtacgtgaagcagggcaactacgtgaaggtgaagaagatcctgaagaagggcatctacgtggacgccgtgaacagcctgggccagaccgccctgttcgtggccgccctgctgggcctgagaaagttcgtggacgtgctggtggactacggcagcgaccccaaccacagatgcttcgacggcagcacccccgtgcacgccgccgccttcagcggcaaccagtggatcctgagcaagctgctggacgccggcggcgacctgagactgcacgacgagagaggccagaaccccaagacctgggccctgaccgccggcaaggagagaagcacccagatcgtggagttcatgcagagatgcgccagccacatgcaggccatcatccagggcttcagctacgacctgctgaagaagatcgacagcccccagagactggtgtacagccccagctggtgcggcggcctggtgcagggcaaccccaacggcagccccaacagactgctgaaggccggcgtgatcagcgcccagaacatctacagcttcggcttcggcaagttctacctgaccggcgccacccagatggcctacctgggcagcctgcccgtgatcggcgagaaggaggtgatccaggccgacgacgagcccaccttcagcttcttcagcggcccctacatggtgatgaccaacctggtgtggaacggcagcagagtgaccgtgaaggagctgaacctgcccacccacccccactgcagcagactgagactggccgacctgctgatcgccgagcaggagcacagcagcaagctgagacacccctacctgctgcagctgatggccgtgtgcctgagccaggacctggagaagaccagactggtgtacgagagaatcaccatcggcaccctgttcagcgtgctgcacgagagaagaagccagttccccgtgctgcacatggaggtgatcgtgcacctgctgctgcagatcagcgacgccctgagatacctgcacttccagggcttcatccacagaagcctgagcagctacgccgtgcacatcatcagccccggcgaggccagactgaccaacctggagtacatgctggagagcgaggacagaggcgtgcagagagacctgaccagagtgcccctgcccacccagctgtacaactgggccgcccccgaggtgatcctgcagaaggccgccaccgtgaagagcgacatctacagcttcagcatgatcatgcaggagatcctgaccgacgacatcccctggaagggcctggacggcagcgtggtgaagaaggccgtggtgagcggcaactacctggaggccgacgtgagactgcccaagccctactacgacatcgtgaagagcggcatccacgtgaagcagaaggacagaaccatgaacctgcaggacatcagatacatcctgaagaacgacctgaaggacttcaccggcgcccagagaacccagcccaccgagagccccagagtgcagagatacggcctgcaccccgacgtgaacgtgtacctgggcctgaccagcgagcaccccagagagacccccgacatggagatcatcgagctgaaggagatgggcagccagccccacagccccagagtgcacagcctgttcaccgagggcaccctggacccccaggcccccgacccctgcctgatggccagagagacccagaaccaggacgccccctgccccgcccccttcatggccgaggaggccagcagccccagcaccggccagcccagcctgtgcagcttcgagatcaacgagatctacagcggctgcctgatcctggaggacgacatcgaggagccccccggcgccgccagcagcctggaggccgacggccccaaccaggtggacgagctgaagagcatggaggaggagctggacaagatggagagagaggcctgctgcttcggcagcgaggacgagagcagcagcaaggccgagaccgagtacagcttcgacgactgggactggcagaacggcagcctgagcagcctgagcctgcccgagagcaccagagaggccaagagcaacctgaacaacatgagcaccaccgaggagtacctgatcagcaagtgcgtgctggacctgaagatcatgcagaccatcatgcacgagaacgacgacagactgagaaacatcgagcagatcctggacgaggtggagatgaagcagaaggagcaggaggagagaatgagcctgtgggccaccagcagagagttcaccaacgcctacaagctgcccctggccgtgggcccccccagcctgaactacatcccccccgtgctgcagctgagcggcggccagaagcccgacaccagcggcaactaccccaccctgcccagattccccagaatgctgcccaccctgtgcgaccccggcaagcagaacaccgacgagcagttccagtgcacccagggcgccaaggacagcctggagaccagcagaatccagaacaccagcagccagggcagacccagagagagcaccgcccaggccaaggccacccagttcaacagcgccctgttcaccctgagcagccacagacagggccccagcgccagccccagctgccactgggacagcaccagaatgagcgtggagcccgtgagcagcgagatctacaacgccgagagcagaaacaaggacgacggcaaggtgcacctgaagtggaagatggaggtgaaggagatggccaagaaggccgccaccggccagctgaccgtgcccccctggcacccccagagcagcctgaccctggagagcgaggccgagaacgagcccgacgccctgctgcagccccccatcagaagccccgagaacaccgactggcagagagtgatcgagtaccacagagagaacgacgagcccagaggcaacggcaagttcgacaagaccggcaacaacgactgcgacagcgaccagcacggcagacagcccagactgggcagcttcaccagcatcagacaccccagccccagacagaaggagcagcccgagcacagcgaggccttccaggccagcagcgacaccctggtggccgtggagaagagctacagccaccagagcatgcagagcacctgcagccccgagagcagcgaggacatcaccgacgagttcctgacccccgacggcgagtacttctacagcagcaccgcccaggagaacctggccctggagaccagcagccccatcgaggaggacttcgagggcatccagggcgccttcgcccagccccaggtgagcggcgaggagaagttccagatgagaaagatcctgggcaagaacgccgagatcctgcccagaagccagttccagcccgtgagaagcaccgaggacgagcaggaggagaccagcaaggagagccccaaggagctgaaggagaaggacatcagcctgaccgacatccaggacctgagcagcatcagctacgagcccgacagcagcttcaaggaggccagctgcaagacccccaagatcaaccacgcccccaccagcgtgagcacccccctgagccccggcagcgtgagcagcgccgccagccagtacaaggactgcctggagagcatcaccttccaggtgaagaccgagttcgccagctgctggaacagccaggagttcatccagaccctgagcgacgacttcatcagcgtgagagagagagccaagaagctggacagcctgctgaccagcagcgagaccccccccagcagactgaccggcctgaagagactgagcagcttcatcggcgccggcagccccagcctggtgaaggcctgcgacagcagccccccccacgccacccagagaagaagcctgcccaaggtggaggccttcagccagcaccacatcgacgagctgcccccccccagccaggagctgctggacgacatcgagctgctgaagcagcagcagggcagcagcaccgtgctgcacgagaacaccgccagcgacggcggcggcaccgccaacgaccagagacacctggaggagcaggagaccgacagcaagaaggaggacagcagcatgctgctgagcaaggagaccgaggacctgggcgaggacaccgagagagcccacagcaccctggacgaggacctggagagatggctgcagccccccgaggagagcgtggagctgcaggacctgcccaagggcagcgagagagagaccaacatcaaggaccagaaggtgggcgaggagaagagaaagagagaggacagcatcacccccgagagaagaaagagcgagggcgtgctgggcaccagcgaggaggacgagctgaagagctgcttctggaagagactgggctggagcgagagcagcagaatcatcgtgctggaccagagcgacctgagcgactag

SEQ ID NO: 102197 - DNA, 8370 bp, Artificial Sequence
  Description of Artificial Sequence: Synthetic coding sequence
atgcccagcgacgccaaggacagcgtgaacggcgacctgctgctgaactggaccagcctgaagaacatcctgagcggcctgaacgccagcttccccctgcacaacaacaccggcagcagcaccgtgaccaccagcaagagcatcaaggaccccagactgatgagaagagaggagagcatgggcgagcagagcagcaccgccggcctgaacgaggtgctgcagttcgagaagagcagcgacaacgtgaacagcgagatcaagagcacccccagcaacagcgccagcagcagcgaggtggtgcccggcgactgcgccgtgctgaccaacggcctggacaccccctgcttcaagaccagcgtgaacgacagccagagctgggcccacaacatgggcagcgaggactacgactgcatcccccccaacaaggtgaccatggccggccagtgcaaggaccagggcaacttcagcttccccatcagcgtgagcaacgtggtgagcgaggtggagaaccagaaccacagcgaggagaaggcccagagagcccagcaggagagcggcaacgcctacaccaaggagtacagcagccacatcttccaggacagccagagcagcgacctgaagaccatctaccagaccggctgccagaccagcaccgtgttccccctgaagaagaaggtgagcatcgacgagtacctgcagaacaccggcaagatgaagaacttcgccgacctggaggacagcagcaagcacgaggagaagcagaccagctggaaggagatcgacaacgacttcaccaacgagaccaagatcagccccatcgacaactacatcgtgctgcaccaggagtacaaggagagcgagagccacaacagcttcggcaagagctgcgacaagatcctgatcacccaggagctggagatcaccaagagcagcaccagcaccatcaaggacaaggacgagctggaccacctggccctggagtggcagatcacccccagcttcgagagcctgagccagaagcacccccagcacagcgtggagtacgagggcaacatccacaccagcctggccatcgcccagaagctgatggagctgaagctgggcaagatcaaccagaactacgccagcatcatcaccgaggccttccccaagcccaaggacatcccccaggccaaggagatgttcatcgacaccgtgatcagcagctacaacatcgagaccgcccacgacagcagcaactgcagcatcaccagagagcacatctgcgtgcacagaaagaacgagaacgagcccgtgagcctggagaacatccagagagactacaaggagaccgcctacgtggaggacagaggccaggaccacaacctgttctgcaacagccagctgagcaacgacatctggctgaacgtgaacttcaagaagcagaccgacagagagaaccagaacgaggccaaggagaacagcgccagctgcgtggagaacaacatcgagaacatctacggcgacaagaagcaggacagccacaccaacgagaacttcagcaacatcgacgagaaggaggacaagaactaccacaacatcgagatcctgagcagcgaggagttcagcaccaagttcaacctgatctgcagagaggacaacgccgtgagcgccgccaccgccctgctggagagcgaggaggacaccatcagcgccgtgaagcagaaggacaccgagaacaccggcagaagcgtggagcacctggccagcaccaccttccccaagaccgccagcagcagcgtgtgcgtggccagcaacgccgccatccagatcgccagcgccaccatgcccgccctgagcctgaacaacgacgaccaccagatctaccagttcaaggagacctgcagcagcgagagccccgacttcggcctgctggtgaagcacagagtgagcgactgcgagatcgacaccgacaagaacaagagccaggagagcttccaccagagcatcaacgagaacctggtgctgcagagcatcgagctggagagcgagatcgagatcgagctggaggactgcgacgacgccttcatcttccagcaggacacccacagccacgagaacatgctgtgcgaggagttcgtgaccagctacaaggccctgaagagcagaatcagctgggagggcctgctggccctggacaacggcgagatggaggtgctggagagcaccaccggcagagagaacagcgaccagcactacagcaaggagagcaactacttctacagcagcacccagaacaacgagaccgagctgaccagccccatcctgctgcccgacctgcagatcaagatcaccaacatcttcagacccggcttcagccccaccgccgacagcctggccctgaaggacagcttctgcacccacgtgaccgaggccaccaagcccgagatcaacaaggaggacggcgagatcctgggcttcgacatctacagccagcccttcggcgagaacgccgactacccctgcgaggacaaggtggacaacatcagacaggagagcggccccgtgagcaacagcgagatcagcctgagcttcgacctgagcagaaacaccgacgtgaaccacaccagcgagaaccagaacagcgagagcctgttcaccgagcccagcaacgtgaccaccatcgacgacggcagcagatgcttcttcaccaagagcaagaccgactacaacgacaccaagaacaagaaggaggtggagagcagaatcagcaagagaaagctgcacatcagcagcagagaccagaacatcccccacaaggacctgagaagacacaagatctacggcagaaagagaagactgaccagccaggacagcagcgagtgcttcagcagcctgagccagggcagaatcaagaccttcagccagagcgagaagcacatcaagagcgtgctgaacatcctgagcgacgaggccagcctgtgcaagagcaagtgcctgagcagaaagctggacaaggccgtggtgcacctgaagaaggcccacagaagagtgcacaccagcctgcagctgatcaccaaggtgggcgaggagagaaagggccccctgcccaagagctacgccatcatctgcaacaacttctgggagagctgcgacctgcagggctacagcagcgtgagccagagaaagtactacagcaccaagcacttcagcagcaagagaaagtacgacaagagaagaaagaagagagcccccaaggccgacatcagcaagagcctgacccacgtgagcaagcacaagagctacaagaccagcggcgagaagaagtgcctgagcagaaagagcatggccagcagcgtgagcaagagccaccccaccaccagccacatgggcgagttctgcaaccaggagcaccccgagagccagctgcccgtgagcagcaccagccagagcaccagccagagcgtgtactacaacagcagcgtgagcaaccccagcctgagcgaggagcaccagcccttcagcggcaagaccgcctacctgttcagccccgaccacagcgacgagaagctgatcgagaaggagaaccagatcgacaccgccttcctgagcagcaccagcaagtacgagaagctggagaagcacagcgccaaccacaacgtgaaggacgccaccaaggagaacagctgcgacgccaacgaggtgatcaacgagagcaacagcgtgagcctgagctgcatcaaggagaacatcaacagcagcaccggcaacgactgcgacgccacctgcatcggccacaccaaggccaagaccgacgtgctgatcagcgtgctggacagcaacgtgaagcacttcctgaacgacctgtaccagcagggcaacctgatcctgagcgactgcaagagaaacctggaggtgaagtggaccgaccccatcgagagacccaagcagaacatcatcaccggcaacttcctgatgggccccctgaacctgaccctgatcgccagcaagaagtacagcatcccccagctgagcgccgccgccgtgaccgacagcgagggcgagagcagcaagagctacctggacaagcagagaatcctgaccgtggacagcttcgccgccagcagcaccgtgccccactgcgagcagagctgcagagagaaggagctgctgaagaccgagcagtgcagcagcggcaactgcctgcacaccgacggcaacgagaccaacgtgaccgagaactacgagctggacgtggccagcggcaccgaggaggacaagagctacggcgagaacatcgtggagctgagcagcagcgacagcagcctgctgctgaaggacaacgtgaagggcagcagcagcgagacctgcatcgtgaagaaggacaccgaggacagaatcacctggaaggtgaagcaggccgagaaggccaaggacagcgtgtacaagagaagcatgaccgagggcagcaccgtgaacaccgagtacaagaaccagaagaaccagatcagcgaggagagctgcctgaacgagaagatcatcaccaccaacctgatcgacagccacctgagcaccaagaacaccaccaccgagagcgtgcccctgaagaacaccgtgagcaaccccctgaacaagagagagaagaagggcgagatcaaggtgagcaaggacagccagagcgacctgaccctgcacagcgagatcgcctacatcagcaagcccggcatcctgggcgtgaaccacacccccatcctgcccgcccacagcgagacctgcaaggtgcccaccctgctgaagaagcccgccagctacgtgagcgacttcaaggagaagcactgcagcgccaaccacaccgccctgatcgccaacctgagccagatcctgcagagagccgacgaggccagcagcctgcagatcctgcaggaggagaccaaggtgtgcctgaacatcctgcccctgttcgtggaggccttcgagagaaagcaggagtgcagcgtggagcagatcctgatcagcagagagctgctggtggaccagaacctgtggaacaactgcaagcacaccctgaagccctgcgccgtggacaccctggtggagctgcagatgatgatggagaccatccagttcatcgagaacaagaagagacacctggagggcgagcccaccctgagaagcctgctgtggtacgacgagaccctgtacgccgagctgctgggcaagcccagaggcttccagcagcagagcaacttctaccccggcttccagggcagactgaagtacaacgccttctgcgagctgcagacctaccacgaccagctggtggagctgctggaggagaccaagagagagaagaacagctactacgtgttcctgaagtacaagagacaggtgaacgagtgcgaggccatcatggagcactgcagcgactgcttcgacttcagcctgagcgtgcccttcacctgcggcgtgaacttcggcgacagcctggaggacctggagatcctgagaaagagcaccctgaagctgatcaacgtgtgcggcgacagccccaaggtgcacagctaccccggcaagcaggaccacctgtggatcatcatcgagatgatcagcagcaaggtgaacttcatcaagaacaacgaggccgtgagagtgaagatcagcctgtacggcctggagcacatcttcttcgacgccgccaagaacctggtgtggaaggagagaacccagagcttcagcaagaagtacagccagaagaaggacgaggagagactgctgagagtgaacaagtgcgccttcagcaagctgcagaagatctacgacaccctgagcaaggacctgaacaacgagcccatcagccccatcggcctggaggaggacaccatcatcgccagcagaaagagcgaccaccccatcaacgaggccaccatcagcatcgagaacagcaagttcaacagcaacctgctggcccaccccgacatctgctgcatcagcgagatcctggaccaggccgagttcgccgacctgaagaagctgcaggacctgaccctgagatgcaccgaccacctggagatcctgaagaagtacttccagatgctgcaggacaacaacatggacaacatcttcatcaccgaggagaacgtgctggacgtggtgatcaaccacagccacgaggccatcatcctgaagcccgaggccatcgagatgtacatcgagatcgtgatggtgagcgagaccatccacttcctgaagaacagcatcgccaagaagctggacaagcagagattcagaggcatgctgtggttcgacctgagcctgctgcccgagctggtgcagtgccaggagaagatggccagcttcagcttcctgaaggacaacagcaccgacgtgtgcctgtggaaggtgatcgagaccgccgtgagcgagctgaagaaggacctggacatcatctgcaagtacaacgaggccgtgaactgcagctacgccatccacctgctgagcagagagctgcaggagctgagcgagatcaagaagctgctgaagaagagcaagtacttcatcagcacctacatcgacttcgtgccctacatcgccagcatcaactacggcagcaccgtgaccgagctggagtacaactacaaccagttcagcaccctgctgaagaacgtgatgagcgcccccagaaaggacctgggcaagatggcccacatcagaaaggtgatgaagaccatcgagcacatgaagatgatctgcaccaagaacgccgagctgaccatcagcttcttcctgtgccagatgctgtacaacagaagaaagatcctgcagctgaagagaaaggagaagatgaacatccacatcgtgaagcccggcgagaacaacaacaagttcagcatcagcaccatgctgccccccgtgagcgagtgcatcaacaagaacatcagcaacagcagcaagaagagacccagcaccgtggacaagtgcgaggacagccaggagcagcagcaggacaccaccgtgagcagctgcaagaagctgaaggtggacatgaaggacgtgaccaagatcaacagagagaaggccaccttcaagcaccccagaaccaccggcagccaccccaagagcgagaacaagatcgtgcccagcagctgcgacagcctgaagagaaaccacctgacccccaagaaggtggagatgcagagaagcctgcccggcagcctgctgcccctggagaaccccaaggacacctgcgccagcaagagcgagagcaagatcgacctgaccgtgagcagcgaccacttcagcggccagcaggagaacctgaacagcatgaagaagagaaacgtgaacttcagcgccgccgagaccaagagcgacaagaaggactgcgccgccttcgccatctgcgaccagaagagcgtgcacggcaccttcagccccgaccacggcaccctgctgcagaagttcctgaagaacagccccgaccccacccagaagagctgcctgagcgacatcaaccccgagaccgacgtgagcctggtgcccgacgccagcgtgctgagcaagcccatcttctgcttcgtgaaggacgtgcaccccgacctggagatgaacgacaccgtgttcgagctgcaggacaacgacatcgtgaacagcagcatcaagaacagcagctgcatgaccagccccgagcccatctgcatccagaacaagatccccaccctgcagatcaacaagctgcagcccaccgagaccgagagcgaggacaagtacatgaaggacaccctgaaccccaacaccgtgcacaccttcggcgccagcggccacatcaccctgaacgtgaaccagggcgccgagtacagcctgagcgagcagcagaacgacaagaacagcaaggtgctgatgcagaacgccgccacctactggaacgagctgccccagagcgcctgcaaccccacctacaacagcagcgagcacctgttcggcaccagctacccctacagcgcctggtgcgtgtaccagtacagcaacagcaacggcaacgccatcacccagacctaccagggcatcaccagctacgaggtgcagcccagccccagcggcctgctgaccaccgtggccagcaccgcccagggcacccacagcaacctgctgtacagccagtacttcacctacttcgccggcgagccccaggccaacggcttcgtgcccgtgaacggctacttccagagccagatccccgccagcaacttcagacagcccatcttcagccagtacgccagccaccagcccctgccccaggccacctacccctacctgcccaacagattcgtgccccccgaggtgccctgggtgtacgccccctggcaccaggagagcttccaccccggccactag

SEQ ID NO: 102198 - DNA, 1233 bp, Artificial Sequence
  Description of Artificial Sequence: Synthetic coding sequence
atggtgctgaaggccgagcacaccagaagccccagcgccaccctgcccagcaacgtgcccagctgcagaagcctgagcagcagcgaggacggccccagcggccccagcagcctggccgacggcggcctggcccacaacctgcaggacagcgtgagacacagaatcctgtacctgagcgagcagctgagagtggagaaggccagcagagacggcaacaccgtgagctacctgaagctggtgagcaaggccgacagacaccaggtgccccacatccagcaggccttcgagaaggtgaaccagagagccagcgccaccatcgcccagatcgagcacagactgcaccagtgccaccagcagctgcaggagctggaggagggctgcagacccgagggcctgctgctgatggccgagagcgaccccgccaactgcgagccccccagcgagaaggccctgctgagcgagccccccgagcccggcggcgaggacggccccgtgaacctgccccacgccagcagacccttcatcctggagagcagattccagagcctgcagcagggcacctgcctggagaccgaggacgtggcccagcagcagaacctgctgctgcagaaggtgaaggccgagctggaggaggccaagagattccacatcagcctgcaggagagctaccacagcctgaaggagagaagcctgaccgacctgcagctgctgctggagagcctgcaggaggagaagtgcagacaggccctgatggaggagcaggtgaacggcagactgcagggccagctgaacgagatctacaacctgaagcacaacctggcctgcagcgaggagagaatggcctacctgagctacgagagagccaaggagatctgggagatcaccgagaccttcaagagcagaatcagcaagctggagatgctgcagcaggtgacccagctggaggccgccgagcacctgcagagcagacccccccagatgctgttcaagttcctgagccccagactgagcctggccaccgtgctgctggtgttcgtgagcaccctgtgcgcctgccccagcagcctgatcagcagcagactgtgcacctgcaccatgctgatgctgatcggcctgggcgtgctggcctggcagagatggagagccatccccgccaccgactggcaggagtgggtgcccagcagatgcagactgtacagcaaggacagcggcccccccgccgacggcccctag

SEQ ID NO: 102199 - DNA, 1233 bp, Artificial Sequence; identical to SEQ ID NO: 102198
  Description of Artificial Sequence: Synthetic coding sequence

SEQ ID NO: 102200 - DNA, 945 bp, Artificial Sequence
  Description of Artificial Sequence: Synthetic coding sequence
atgagacccgagggcagcctgacctacagagtgcccgagagactgagacagggcttctgcggcgtgggcagagccgcccaggccctggtgtgcgccagcgccaaggagggcaccgccttcagaatggaggccgtgcaggagggcgccgccggcgtggagagcgagcaggccgccctgggcgaggaggccgtgctgctgctggacgacatcatggccgaggtggaggtggtggccgaggtggaggtggtggccgaggaggagggcctggtggagagaagagaggaggcccagagagcccagcaggccgtgcccggccccggccccatgacccccgagagcgcccccgaggagctgctggccgtgcaggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtgggcgaggagaagcaccccgtgcacctgtgcaagatcatgctgttcttcagaagcaacccctacttccagaacaaggtgatcaccaaggagtacctggtgaacatcaccgagtacagagccagccacagcacccccatcgagtggtaccccgactacgaggtggaggcctacagaagaagacaccacaacagcagcctgaacttcttcaactggttcagcgaccacaacttcgccggcagcaacaagatcgccgagatcctgtgcaaggacctgtggagaaaccccctgcagtactacaagagaatgaagccccccgaggagggcaccgagaccagcggcgacagccagctgctgagctag

SEQ ID NO: 102201 - DNA, 927 bp, Artificial Sequence
  Description of Artificial Sequence: Synthetic coding sequence
atgagacccgagggcagcctgacctacagagtgcccgagagactgagacagggcttctgcggcgtgggcagagccgcccaggccctggtgtgcgccagcgccaaggagggcaccgccttcagaatggaggccgtgcaggagggcgccgccggcgtggagagcgagcaggccgccctgggcgaggaggccgtgctgctgctggacgacatcatggccgaggtggaggtggtggccgaggaggagggcctggtggagagaagagaggaggcccagagagcccagcaggccgtgcccggccccggccccatgacccccgagagcgcccccgaggagctgctggccgtgcaggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtgggcgaggagaagcaccccgtgcacctgtgcaagatcatgctgttcttcagaagcaacccctacttccagaacaaggtgatcaccaaggagtacctggtgaacatcaccgagtacagagccagccacagcacccccatcgagtggtaccccgactacgaggtggaggcctacagaagaagacaccacaacagcagcctgaacttcttcaactggttcagcgaccacaacttcgccggcagcaacaagatcgccgagatcctgtgcaaggacctgtggagaaaccccctgcagtactacaagagaatgaagccccccgaggagggcaccgagaccagcggcgacagccagctgctgagctag

SEQ ID NO: 102202 - DNA, 2097 bp, Artificial Sequence
  Description of Artificial Sequence: Synthetic coding sequence
atgatgagaagcagaagcaagagccccagaagacccagccccaccgccagaggcgccaactgcgacgtggagctgctgaagaccaccaccagagacagagaggagctgaagtgcatgctggagaagtacgagagacacctggccgagatccagggcaacgtgaaggtgctgaagagcgagagagacaagatcttcctgctgtacgagcaggcccaggaggagatcaccagactgagaagagagatgatgaagagctgcaagagccccaagagcaccaccgcccacgccatcctgagaagagtggagaccgagagagacgtggccttcaccgacctgagaagaatgaccaccgagagagacagcctgagagagagactgaagatcgcccaggagaccgccttcaacgagaaggcccacctggagcagagaatcgaggagctggagtgcaccgtgcacaacctggacgacgagagaatggagcagatgagcaacatgaccctgatgaaggagaccatcagcaccgtggagaaggagatgaagagcctggccagaaaggccatggacaccgagagcgagctgggcagacagaaggccgagaacaacagcctgagactgctgtacgagaacaccgagaaggacctgagcgacacccagagacacctggccaagaagaagtacgagctgcagctgacccaggagaagatcatgtgcctggacgagaagatcgacaacttcaccagacagaacatcgcccagagagaggagatcagcatcctgggcggcaccctgaacgacctggccaaggagaaggagtgcctgcaggcctgcctggacaagaagagcgagaacatcgccagcctgggcgagagcctggccatgaaggagaagaccatcagcggcatgaagaacatcatcgccgagatggagcaggccagcagacagtgcaccgaggccctgatcgtgtgcgagcaggacgtgagcagaatgagaagacagctggacgagaccaacgacgagctggcccagatcgccagagagagagacatcctggcccacgacaacgacaacctgcaggagcagttcgccaaggccaagcaggagaaccaggccctgagcaagaagctgaacgacacccacaacgagctgaacgacatcaagcagaaggtgcaggacaccaacctggaggtgaacaagctgaagaacatcctgaagagcgaggagagcgagaacagacagatgatggagcagctgagaaaggccaacgaggacgccgagaactgggagaacaaggccagacagagcgaggccgacaacaacaccctgaagctggagctgatcaccgccgaggccgagggcaacagactgaaggagaaggtggacagcctgaacagagaggtggagcagcacctgaacgccgagagaagctacaagagccagatcagcaccctgcacaagagcgtggtgaagatggaggaggagctgcagaaggtgcagttcgagaaggtgagcgccctggccgacctgagcagcaccagagagctgtgcatcaagctggacagcagcaaggagctgctgaacagacagctggtggccaaggaccaggagatcgagatgagagagaacgagctggacagcgcccacagcgagatcgagctgctgagaagccagatggccaacgagagaatcagcatgcagaacctggaggccctgctggtggccaacagagacaaggagtaccagagccagatcgccctgcaggagaaggagagcgagatccagctgctgaaggagcacctgtgcctggccgagaacaagatggccatccagagcagagacgtggcccagttcagaaacgtggtgacccagctggaggccgacctggacatcaccaagagacagctgggcaccgagagattcgagagagagagagccgtgcaggagctgagaagacagaactacagcagcaacgcctaccacatgagcagcaccatgaagcccaacaccaagtgccacagccccgagagagcccaccacagaagccccgacagaggcctggacagaagcctggaggagaacctgtgctacagagacttctag

SEQ ID NO: 102203 - DNA, 2073 bp, Artificial Sequence
  Description of Artificial Sequence: Synthetic coding sequence
atgatgagaagcagaagcaagagccccagaagacccagccccaccgccagaggcgccaactgcgacgtggagctgctgaagaccaccaccagagacagagaggagctgaagtgcatgctggagaagtacgagagacacctggccgagatccagggcaacgtgaaggtgctgaagagcgagagagacaagatcttcctgctgtacgagcaggcccaggaggagatcaccagactgagaagagagatgatgaagagctgcaagagccccaagagcaccaccgcccacgccatcctgagaagagtggagaccgagagagacgtggccttcaccgacctgagaagaatgaccaccgagagagacagcctgagagagagactgaagatcgcccaggagaccgccttcaacgagaaggcccacctggagcagagaatcgaggagctggagtgcaccgtgcacaacctggacgacgagagaatggagcagatgagcaacatgaccctgatgaaggagaccatcagcaccgtggagaaggagatgaagagcctggccagaaaggccatggacaccgagagcgagctgggcagacagaaggccgagaacaacagcctgagactgctgtacgagaacaccgagaaggacctgagcgacacccagagacacctggccaagaagaagtacgagctgcagctgacccaggagaagatcatgtgcctggacgagaagatcgacaacttcaccagacagaacatcgcccagagagaggagatcagcatcctgggcggcaccctgaacgacctggccaaggagaaggagtgcctgcaggcctgcctggacaagaagagcgagaacatcgccagcctgggcgagagcctggccatgaaggagaagaccatcagcggcatgaagaacatcatcgccgagatggagcaggccagcagacagtgcaccgaggccctgatcgtgtgcgagcaggacgtgagcagaatgagaagacagctggacgagaccaacgacgagctggcccagatcgccagagagagagacatcctggcccacgacaacgacaacctgcaggagcagttcgccaaggccaagcaggagaaccaggccctgagcaagaagctgaacgacacccacaacgagctgaacgacatcaagcagaaggtgcaggacaccaacctggaggtgaacaagctgaagaacatcctgaagagcgaggagagcgagaacagacagatgatggagcagctgagaaaggccaacgaggacgccgagaactgggagaacaaggccagacagagcgaggccgacaacaacaccctgaagctggagctgatcaccgccgaggccgagggcaacagactgaaggagaaggtggacagcctgaacagagaggtggagcagcacctgaacgccgagagaagctacaagagccagatcagcaccctgcacaagagcgtggtgaagatggaggaggagctgcagaaggtgcagttcgagaaggtgagcgccctggccgacctgagcagcaccagagagctgtgcatcaagctggacagcagcaaggagctgctgaacagacagctggtggccaaggaccaggagatcgagatgagagagaacgagctggacagcgcccacagcgagatcgagctgctgagaagccagatggccaacgagagaatcagcatgcagaacctggaggccctgctggtggccaacagagacaaggagtaccagagccagatcgccctgcaggagaaggagagcgagatccagctgctgaaggagcacctgtgcctggccgagaacaagatggccatccagagcagagacgtggcccagttcagaaacgtggtgacccagctggaggccgacctggacatcaccaagagacagctgggcaccgagagattcgagagagagagagccgtgcaggagctgagaagacagaactacagcagcaacgcctaccacatgagcagcaccatgaagcccaacaccaagtgccacagccccgagagagcccaccacagaagccccgacagaggcctggacagaagcctggagtag

SEQ ID NO: 102204 - DNA, 2097 bp, Artificial Sequence; identical to SEQ ID NO: 102202
  Description of Artificial Sequence: Synthetic coding sequence

SEQ ID NO: 102205 - DNA, 2097 bp, Artificial Sequence; identical to SEQ ID NO: 102202
  Description of Artificial Sequence: Synthetic coding sequence

SEQ ID NO: 102206 - DNA, 2097 bp, Artificial Sequence; identical to SEQ ID NO: 102202
  Description of Artificial Sequence: Synthetic coding sequence

SEQ ID NO: 102207 - DNA, 894 bp, Artificial Sequence
  Description of Artificial Sequence: Synthetic coding sequence
atgatgagaagcagaagcaagagccccagaagacccagccccaccgccagaggcgccaactgcgacgtggagctgctgaagaccaccaccagagacagagaggagctgaagtgcatgctggagaagtacgagagacacctggccgagatccagggcaacgtgaaggtgctgaagagcgagagagacaagatcttcctgctgtacgagcaggcccaggaggagatcaccagactgagaagagagatgatgaagagctgcaagagccccaagagcaccaccgcccacgccatcctgagaagagtggagaccgagagagacgtggccttcaccgacctgagaagaatgaccaccgagagagacagcctgagagagagactgaagatcgcccaggagaccgccttcaacgagaaggcccacctggagcagagaatcgaggagctggagtgcaccgtgcacaacctggacgacgagagaatggagcagatgagcaacatgaccctgatgaaggagaccatcagcaccgtggagaaggagatgaagagcctggccagaaaggccatggacaccgagagcgagctgggcagacagaaggccgagaacaacagcctgagactgctgtacgagaacaccgagaaggacctgagcgacacccagagacacctggccaagaagaagtacgagctgcagctgacccaggagaagatcatgtgcctggacgagaagatcgacaacttcaccagacagaacatcgcccagagagaggagatcagcatcctgggcggcaccctgaacgacctggccaaggagaaggagtgcctgcaggcctgcctggacaagaagagcgagaacatcgccagcctgggcgagagcctggccatgaagaccgtgtactag

SEQ ID NO: 102208 - DNA, 1881 bp, Artificial Sequence
  Description of Artificial Sequence: Synthetic coding sequence
atggccggcgagagaccccccctgagaggccccggccccggccccggcgaggtgcccggcgagggcccccccggccccggcggcaccggcggcggccccggcagaggcagacccagcagctacagagccctgagaagcgccgtgagcagcctggccagagtggacgacttccactgcgccgagaagatcggcgccggcttcttcagcgaggtgtacaaggtgagacacagacagagcggccaggtgatggtgctgaagatgaacaagctgcccagcaacagaggcaacaccctgagagaggtgcagctgatgaacagactgagacaccccaacatcctgagattcatgggcgtgtgcgtgcaccagggccagctgcacgccctgaccgagtacatgaacggcggcaccctggagcagctgctgagcagccccgagcccctgagctggcccgtgagactgcacctggccctggacatcgccagaggcctgagatacctgcacagcaagggcgtgttccacagagacctgaccagcaagaactgcctggtgagaagagaggacagaggcttcaccgccgtggtgggcgacttcggcctggccgagaagatccccgtgtacagagagggcgccagaaaggagcccctggccgtggtgggcagcccctactggatggcccccgaggtgctgagaggcgagctgtacgacgagaaggccgacgtgttcgccttcggcatcgtgctgtgcgagctgatcgccagagtgcccgccgaccccgactacctgcccagaaccgaggacttcggcctggacgtgcccgccttcagaaccctggtgggcgacgactgccccctgcccttcctgctgctggccatccactgctgcaacctggagcccagcaccagagcccccttcaccgagatcacccagcacctggagtggatcctggagcagctgcccgagcccgcccccctgaccagaaccgccctgacccacaaccagggcagcgtggccagaggcggccccagcgccaccctgcccagacccgaccccagactgagcagaagcagaagcgacctgttcctgccccccagccccgagagcccccccaactggggcgacaacctgaccagagtgaaccccttcagcctgagagaggacctgagaggcggcaagatcaagctgctggacacccccagcaagcccgtgctgcccctggtgccccccagccccttccccagcacccagctgcccctggtgaccacccccgagaccctggtgcagcccggcacccccgccagaagatgcagaagcctgcccagcagccccgagctgcccagaagaatggagaccgccctgcccggccccggcccccccgccgtgggccccagcgccgaggagaagatggagtgcgagggcagcagccccgagcccgagccccccggccccgccccccagctgcccctggccgtggccaccgacaacttcatcagcacctgcagcagcgccagccagccctggagccccagaagcggccccgtgctgaacaacaacccccccgccgtggtggtgaacagcccccagggctgggccggcgagccctggaacagagcccagcacagcctgcccagagccgccgccctggagagaaccgagcccagccccccccccagcgcccccagagagcccgacgagggcctgccctgccccggctgctgcctgggccccttcagcttcggcttcctgagcatgtgccccagacccacccccgccgtggccagatacagaaacctgaactgcgaggccggcagcctgctgtgccacagaggccaccacgccaagccccccacccccagcctgcagctgcccggcgccagaagctag

SEQ ID NO: 102209 - DNA, 474 bp, Artificial Sequence
  Description of Artificial Sequence: Synthetic coding sequence
agcgccagagccgccgccctgagcagaaacctgcagggccagagacccctgcccctggccgtggccaccgacaacttcatcagcacctgcagcagcgccagccagccctggagccccagaagcggccccgtgctgaacaacaacccccccgccgtggtggtgaacagcccccagggctgggccggcgagccctggaacagagcccagcacagcctgcccagagccgccgccctggagagaaccgagcccagccccccccccagcgcccccagagagcccgacgagggcctgccctgccccggctgctgcctgggccccttcagcttcggcttcctgagcatgtgccccagacccacccccgccgtggccagatacagaaacctgaactgcgaggccggcagcctgctgtgccacagaggccaccacgccaagccccccacccccagcctgcagctgcccggcgccagaagctag

SEQ ID NO: 102210 - DNA, 1077 bp, Artificial Sequence
  Description of Artificial Sequence: Synthetic coding sequence
atggacgacgccaccgtgctgagaaagaagggctacatcgtgggcatcaacctgggcaagggcagctacgccaaggtgaagagcgcctacagcgagagactgaagttcaacgtggccgtgaagatcatcgacagaaagaagacccccaccgacttcgtggagagattcctgcccagagagatggacatcctggccaccgtgaaccacggcagcatcatcaagacctacgagatcttcgagaccagcgacggcagaatctacatcatcatggagctgggcgtgcagggcgacctgctggagttcatcaagtgccagggcgccctgcacgaggacgtggccagaaagatgttcagacagctgagcagcgccgtgaagtactgccacgacctggacatcgtgcacagagacctgaagtgcgagaacctgctgctggacaaggacttcaacatcaagctgagcgacttcggcttcagcaagagatgcctgagagacagcaacggcagaatcatcctgagcaagaccttctgcggcagcgccgcctacgccgcccccgaggtgctgcagagcatcccctaccagcccaaggtgtacgacatctggagcctgggcgtgatcctgtacatcatggtgtgcggcagcatgccctacgacgacagcgacatcagaaagatgctgagaatccagaaggagcacagagtggacttccccagaagcaagaacctgacctgcgagtgcaaggacctgatctacagaatgctgcagcccgacgtgagccagagactgcacatcgacgagatcctgagccacagctggctgcagccccccaagcccaaggccaccagcagcgccagcttcaagagagagggcgagggcaagtacagagccgagtgcaagctggacaccaagaccggcctgagacccgaccacagacccgaccacaagctgggcgccaagacccagcacagactgctggtggtgcccgagaacgagaacagaatggaggacagactggccgagaccagcagagccaaggaccaccacatcagcggcgccgaggtgggcaaggccagcacctag

SEQ ID NO: 102211 - DNA, 807 bp, Artificial Sequence
  Description of Artificial Sequence: Synthetic coding sequence
atggaggacttcctgctgagcaacggctaccagctgggcaagaccatcggcgagggcacctacagcaaggtgaaggaggccttcagcaagaagcaccagagaaaggtggccatcaaggtgatcgacaagatgggcggccccgaggagttcatccagagattcctgcccagagagctgcagatcgtgagaaccctggaccacaagaacatcatccaggtgtacgagatgctggagagcgccgacggcaagatctgcctggtgatggagctggccgagggcggcgacgtgttcgactgcgtgctgaacggcggccccctgcccgagagcagagccaaggccctgttcagacagatggtggaggccatcagatactgccacggctgcggcgtggcccacagagacctgaagtgcgagaacgccctgctgcagggcttcaacctgaagctgaccgacttcggcttcgccaaggtgctgcccaagagccacagagagctgagccagaccttctgcggcagcaccgcctacgccgcccccgaggtgctgcagggcatcccccacgacagcaagaagggcgacgtgtggagcatgggcgtggtgctgtacgtgatgctgtgcgccagcctgcccttcgacgacaccgacatccccaagatgctgtggcagcagcagaagggcgtgagcttccccacccacctgagcatcagcgccgactgccaggacctgctgaagagactgctggagcccgacatgatcctgagacccagcatcgaggaggtgagctggcacccctggctggccagcacctag

SEQ ID NO: 102212 - DNA, 987 bp, Artificial Sequence
  Description of Artificial Sequence: Synthetic coding sequence
atgggcaagggcgacgtgctggaggccgcccccaccaccaccgcctaccacagcctgatggacgagtacggctacgaggtgggcaaggccatcggccacggcagctacggcagcgtgtacgaggccttctacaccaagcagaaggtgatggtggccgtgaagatcatcagcaagaagaaggccagcgacgactacctgaacaagttcctgcccagagagatccaggtgatgaaggtgctgagacacaagtacctgatcaacttctacagagccatcgagagcaccagcagagtgtacatcatcctggagctggcccagggcggcgacgtgctggagtggatccagagatacggcgcctgcagcgagcccctggccggcaagtggttcagccagctgaccctgggcatcgcctacctgcacagcaagagcatcgtgcacagagacctgaagctggagaacctgctgctggacaagtgggagaacgtgaagatcagcgacttcggcttcgccaagatggtgcccagcaaccagcccgtgggctgcagccccagctacagacaggtgaactgcttcagccacctgagccagacctactgcggcagcttcgcctacgcctgccccgagatcctgagaggcctgccctacaaccccttcctgagcgacacctggagcatgggcgtgatcctgtacaccctggtggtggcccacctgcccttcgacgacaccaacctgaagaagctgctgagagagacccagaaggaggtgaccttccccgccaaccacaccatcagccaggagtgcaagaacctgatcctgcagatgctgagacaggccaccaagagagccaccatcctggacatcatcaaggacagctgggtgctgaagttccagcccgagcagcccacccacgagatcagactgctggaggccatgtgccagctgcacaacaccaccaagcagcaccagagcctgcagatcaccacctag

SEQ ID NO: 102213 - DNA, 1017 bp, Artificial Sequence
  Description of Artificial Sequence: Synthetic coding sequence
atgggcaagggcgacgtgctggaggccgcccccaccaccaccgcctaccacagcctgatggacgagtacggctacgaggtgggcaaggccatcggccacggcagctacggcagcgtgtacgaggccttctacaccaagcagaaggtgatggtggccgtgaagatcatcagcaagaagaaggccagcgacgactacctgaacaagttcctgcccagagagatccaggtgatgaaggtgctgagacacaagtacctgatcaacttctacagagccatcgagagcaccagcagagtgtacatcatcctggagctggcccagggcggcgacgtgctggagtggatccagagatacggcgcctgcagcgagcccctggccggcaagtggttcagccagctgaccctgggcatcgcctacctgcacagcaagagcatcgtgcacagactgatgcccagcctgagcgccgccggcagagacctgaagctggagaacctgctgctggacaagtgggagaacgtgaagatcagcgacttcggcttcgccaagatggtgcccagcaaccagcccgtgggctgcagccccagctacagacaggtgaactgcttcagccacctgagccagacctactgcggcagcttcgcctacgcctgccccgagatcctgagaggcctgccctacaaccccttcctgagcgacacctggagcatgggcgtgatcctgtacaccctggtggtggcccacctgcccttcgacgacaccaacctgaagaagctgctgagagagacccagaaggaggtgaccttccccgccaaccacaccatcagccaggagtgcaagaacctgatcctgcagatgctgagacaggccaccaagagagccaccatcctggacatcatcaaggacagctgggtgctgaagttccagcccgagcagcccacccacgagatcagactgctggaggccatgtgccagctgcacaacaccaccaagcagcaccagagcctgcagatcaccacctag

SEQ ID NO: 102214 - DNA, 759 bp, Artificial Sequence
  Description of Artificial Sequence: Synthetic coding sequence
atgaaggtgctgagacacaagtacctgatcaacttctacagagccatcgagagcaccagcagagtgtacatcatcctggagctggcccagggcggcgacgtgctggagtggatccagagatacggcgcctgcagcgagcccctggccggcaagtggttcagccagctgaccctgggcatcgcctacctgcacagcaagagcatcgtgcacagagacctgaagctggagaacctgctgctggacaagtgggagaacgtgaagatcagcgacttcggcttcgccaagatggtgcccagcaaccagcccgtgggctgcagccccagctacagacaggtgaactgcttcagccacctgagccagacctactgcggcagcttcgcctacgcctgccccgagatcctgagaggcctgccctacaaccccttcctgagcgacacctggagcatgggcgtgatcctgtacaccctggtggtggcccacctgcccttcgacgacaccaacctgaagaagctgctgagagagacccagaaggaggtgaccttccccgccaaccacaccatcagccaggagtgcaagaacctgatcctgcagatgctgagacaggccaccaagagagccaccatcctggacatcatcaaggacagctgggtgctgaagttccagcccgagcagcccacccacgagatcagactgctggaggccatgtgccagctgcacaacaccaccaagcagcaccagagcctgcagatcaccacctag

SEQ ID NO: 102215 - DNA, 822 bp, Artificial Sequence
  Description of Artificial Sequence: Synthetic coding sequence
atgagcggcgacaagctgctgagcgagctgggctacaagctgggcagaaccatcggcgagggcagctacagcaaggtgaaggtggccaccagcaagaagtacaagggcaccgtggccatcaaggtggtggacagaagaagagccccccccgacttcgtgaacaagttcctgcccagagagctgagcatcctgagaggcgtgagacacccccacatcgtgcacgtgttcgagttcatcgaggtgtgcaacggcaagctgtacatcgtgatggaggccgccgccaccgacctgctgcaggccgtgcagagaaacggcagaatccccggcgtgcaggccagagacctgttcgcccagatcgccggcgccgtgagatacctgcacgaccaccacctggtgcacagagacctgaagtgcgagaacgtgctgctgagccccgacgagagaagagtgaagctgaccgacttcggcttcggcagacaggcccacggctaccccgacctgagcaccacctactgcggcagcgccgcctacgccagccccgaggtgctgctgggcatcccctacgaccccaagaagtacgacgtgtggagcatgggcgtggtgctgtacgtgatggtgaccggctgcatgcccttcgacgacagcgacatcgccggcctgcccagaagacagaagagaggcgtgctgtaccccgagggcctggagctgagcgagagatgcaaggccctgatcgccgagctgctgcagttcagccccagcgccagacccagcgccggccaggtggccagaaactgctggctgagagccggcgacagcggctag

SEQ ID NO: 102216 - DNA, 822 bp, Artificial Sequence; identical to SEQ ID NO: 102215
  Description of Artificial Sequence: Synthetic coding sequence

SEQ ID NO: 102217 - DNA, 6411 bp, Artificial Sequence
  Description of Artificial Sequence: Synthetic coding sequence
atgagcagaagcagacacgccagacccagcagactggtgagaaaggaggacgtgaacaagaagaagaagaacagccagctgagaaagaccaccaagggcgccaacaagaacgtggccagcgtgaagaccctgagccccggcaagctgaagcagctgatccaggagagagacgtgaagaagaagaccgagcccaagccccccgtgcccgtgagaagcctgctgaccagagccggcgccgccagaatgaacctggacagaaccgaggtgctgttccagaaccccgagagcctgacctgcaacggcttcaccatggccctgagaagcaccagcctgagcagaagactgagccagccccccctggtggtggccaagagcaagaaggtgcccctgagcaagggcctggagaagcagcacgactgcgactacaagatcctgcccgccctgggcgtgaagcacagcgagaacgacagcgtgcccatgcaggacacccaggtgctgcccgacatcgagaccctgatcggcgtgcagaaccccagcctgctgaagggcaagagccaggagaccacccagttctggagccagagagtggaggacagcaagatcaacatccccacccacagcggccccgccgccgagatcctgcccggccccctggagggcaccagatgcggcgagggcctgttcagcgaggagaccctgaacgacaccagcggcagccccaagatgttcgcccaggacaccgtgtgcgcccccttcccccagagagccacccccaaggtgaccagccagggcaaccccagcatccagctggaggagctgggcagcagagtggagagcctgaagctgagcgacagctacctggaccccatcaagagcgagcacgactgctaccccaccagcagcctgaacaaggtgatccccgacctgaacctgagaaactgcctggccctgggcggcagcaccagccccaccagcgtgatcaagttcctgctggccggcagcaagcaggccaccctgggcgccaagcccgaccaccaggaggccttcgaggccaccgccaaccagcaggaggtgagcgacaccaccagcttcctgggccaggccttcggcgccatcccccaccagtgggagctgcccggcgccgaccccgtgcacggcgaggccctgggcgagacccccgacctgcccgagatccccggcgccatccccgtgcagggcgaggtgttcggcaccatcctggaccagcaggagaccctgggcatgagcggcagcgtggtgcccgacctgcccgtgttcctgcccgtgccccccaaccccatcgccaccttcaacgcccccagcaagtggcccgagccccagagcaccgtgagctacggcctggccgtgcagggcgccatccagatcctgcccctgggcagcggccacaccccccagagcagcagcaacagcgagaagaacagcctgccccccgtgatggccatcagcaacgtggagaacgagaagcaggtgcacatcagcttcctgcccgccaacacccagggcttccccctggcccccgagagaggcctgttccacgccagcctgggcatcgcccagctgagccaggccggccccagcaagagcgacagaggcagcagccaggtgagcgtgaccagcaccgtgcacgtggtgaacaccaccgtggtgaccatgcccgtgcccatggtgagcaccagcagcagcagctacaccaccctgctgcccaccctggagaagaagaagagaaagagatgcggcgtgtgcgagccctgccagcagaagaccaactgcggcgagtgcacctactgcaagaacagaaagaacagccaccagatctgcaagaagagaaagtgcgaggagctgaagaagaagcccagcgtggtggtgcccctggaggtgatcaaggagaacaagagaccccagagagagaagaagcccaaggtgctgaaggccgacttcgacaacaagcccgtgaacggccccaagagcgagagcatggactacagcagatgcggccacggcgaggagcagaagctggagctgaacccccacaccgtggagaacgtgaccaagaacgaggacagcatgaccggcatcgaggtggagaagtggacccagaacaagaagagccagctgaccgaccacgtgaagggcgacttcagcgccaacgtgcccgaggccgagaagagcaagaacagcgaggtggacaagaagagaaccaagagccccaagctgttcgtgcagaccgtgagaaacggcatcaagcacgtgcactgcctgcccgccgagaccaacgtgagcttcaagaagttcaacatcgaggagttcggcaagaccctggagaacaacagctacaagttcctgaaggacaccgccaaccacaagaacgccatgagcagcgtggccaccgacatgagctgcgaccacctgaagggcagaagcaacgtgctggtgttccagcagcccggcttcaactgcagcagcatcccccacagcagccacagcatcatcaaccaccacgccagcatccacaacgagggcgaccagcccaagacccccgagaacatccccagcaaggagcccaaggacggcagccccgtgcagcccagcctgctgagcctgatgaaggacagaagactgaccctggagcaggtggtggccatcgaggccctgacccagctgagcgaggcccccagcgagaacagcagccccagcaagagcgagaaggacgaggagagcgagcagagaaccgccagcctgctgaacagctgcaaggccatcctgtacaccgtgagaaaggacctgcaggaccccaacctgcagggcgagccccccaagctgaaccactgccccagcctggagaagcagagcagctgcaacaccgtggtgttcaacggccagaccaccaccctgagcaacagccacatcaacagcgccaccaaccaggccagcaccaagagccacgagtacagcaaggtgaccaacagcctgagcctgttcatccccaagagcaacagcagcaagatcgacaccaacaagagcatcgcccagggcatcatcaccctggacaactgcagcaacgacctgcaccagctgccccccagaaacaacgaggtggagtactgcaaccagctgctggacagcagcaagaagctggacagcgacgacctgagctgccaggacgccacccacacccagatcgaggaggacgtggccacccagctgacccagctggccagcatcatcaagatcaactacatcaagcccgaggacaagaaggtggagagcacccccaccagcctggtgacctgcaacgtgcagcagaagtacaaccaggagaagggcaccatccagcagaagccccccagcagcgtgcacaacaaccacggcagcagcctgaccaagcagaagaaccccacccagaagaagaccaagagcacccccagcagagacagaagaaagaagaagcccaccgtggtgagctaccaggagaacgacagacagaagtgggagaagctgagctacatgtacggcaccatctgcgacatctggatcgccagcaagttccagaacttcggccagttctgcccccacgacttccccaccgtgttcggcaagatcagcagcagcaccaagatctggaagcccctggcccagaccagaagcatcatgcagcccaagaccgtgttcccccccctgacccagatcaagctgcagagataccccgagagcgccgaggagaaggtgaaggtggagcccctggacagcctgagcctgttccacctgaagaccgagagcaacggcaaggccttcaccgacaaggcctacaacagccaggtgcagctgaccgtgaacgccaaccagaaggcccaccccctgacccagcccagcagcccccccaaccagtgcgccaacgtgatggccggcgacgaccagatcagattccagcaggtggtgaaggagcagctgatgcaccagagactgcccaccctgcccggcatcagccacgagacccccctgcccgagagcgccctgaccctgagaaacgtgaacgtggtgtgcagcggcggcatcaccgtggtgagcaccaagagcgaggaggaggtgtgcagcagcagcttcggcaccagcgagttcagcaccgtggacagcgcccagaagaacttcaacgactacgccatgaacttcttcaccaaccccaccaagaacctggtgagcatcaccaaggacagcgagctgcccacctgcagctgcctggacagagtgatccagaaggacaagggcccctactacacccacctgggcgccggccccagcgtggccgccgtgagagagatcatggagaacagatacggccagaagggcaacgccatcagaatcgagatcgtggtgtacaccggcaaggagggcaagagcagccacggctgccccatcgccaagtgggtgctgagaagaagcagcgacgaggagaaggtgctgtgcctggtgagacagagaaccggccaccactgccccaccgccgtgatggtggtgctgatcatggtgtgggacggcatccccctgcccatggccgacagactgtacaccgagctgaccgagaacctgaagagctacaacggccaccccaccgacagaagatgcaccctgaacgagaacagaacctgcacctgccagggcatcgaccccgagacctgcggcgccagcttcagcttcggctgcagctggagcatgtacttcaacggctgcaagttcggcagaagccccagccccagaagattcagaatcgaccccagcagccccctgcacgagaagaacctggaggacaacctgcagagcctggccaccagactggcccccatctacaagcagtacgcccccgtggcctaccagaaccaggtggagtacgagaacgtggccagagagtgcagactgggcagcaaggagggcagacccttcagcggcgtgaccgcctgcctggacttctgcgcccacccccacagagacatccacaacatgaacaacggcagcaccgtggtgtgcaccctgaccagagaggacaacagaagcctgggcgtgatcccccaggacgagcagctgcacgtgctgcccctgtacaagctgagcgacaccgacgagttcggcagcaaggagggcatggaggccaagatcaagagcggcgccatcgaggtgctggcccccagaagaaagaagagaacctgcttcacccagcccgtgcccagaagcggcaagaagagagccgccatgatgaccgaggtgctggcccacaagatcagagccgtggagaagaagcccatccccagaatcaagagaaagaacaacagcaccaccaccaacaacagcaagcccagcagcctgcccaccctgggcagcaacaccgagaccgtgcagcccgaggtgaagagcgagaccgagccccacttcatcctgaagagcagcgacaacaccaagacctacagcctgatgcccagcgccccccaccccgtgaaggaggccagccccggcttcagctggagccccaagaccgccagcgccacccccgcccccctgaagaacgacgccaccgccagctgcggcttcagcgagagaagcagcaccccccactgcaccatgcccagcggcagactgagcggcgccaacgccgccgccgccgacggccccggcatcagccagctgggcgaggtggcccccctgcccaccctgagcgcccccgtgatggagcccctgatcaacagcgagcccagcaccggcgtgaccgagcccctgaccccccaccagcccaaccaccagcccagcttcctgaccagcccccaggacctggccagcagccccatggaggaggacgagcagcacagcgaggccgacgagccccccagcgacgagcccctgagcgacgaccccctgagccccgccgaggagaagctgccccacatcgacgagtactggagcgacagcgagcacatcttcctggacgccaacatcggcggcgtggccatcgcccccgcccacggcagcgtgctgatcgagtgcgccagaagagagctgcacgccaccacccccgtggagcaccccaacagaaaccaccccaccagactgagcctggtgttctaccagcacaagaacctgaacaagccccagcacggcttcgagctgaacaagatcaagttcgaggccaaggaggccaagaacaagaagatgaaggccagcgagcagaaggaccaggccgccaacgagggccccgagcagagcagcgaggtgaacgagctgaaccagatccccagccacaaggccctgaccctgacccacgacaacgtggtgaccgtgagcccctacgccctgacccacgtggccggcccctacaaccactgggtgtag

SEQ ID NO: 102218 - DNA, 330 bp, Artificial Sequence
  Description of Artificial Sequence: Synthetic coding sequence
atggccgacagactgtacaccgagctgaccgagaacctgaagagctacaacggccaccccaccgacagaagatgcaccctgaacgagaacagaacctgcacctgccagggcatcgaccccgagacctgcggcgccagcttcagcttcggctgcagctggagcatgtacttcaacggctgcaagttcggcagaagccccagccccagaagattcagaatcgaccccagcagccccctgcacacctactacgagagaatcaccaagggcagaaaccccgagagaagatacatgaagcccgagagaatcagccccggccacgaggccatgtag

SEQ ID NO: 102219 - DNA, 726 bp, Artificial Sequence
  Description of Artificial Sequence: Synthetic coding sequence
atgcagtgcttcagcttcatcaagaccatgatgatcctgttcaacctgctgatcttcctgtgcggcgccgccctgctggccgtgggcatctgggtgagcatcgacggcgccagcttcctgaagatcttcggccccctgagcagcagcgccatgcagttcgtgaacgtgggctacttcctgatcgccgccggcgtggtggtgttcgccctgggcttcctgggctgctacggcgccaagaccgagagcaagtgcgccctggtgaccttcttcttcatcctgctgctgatcttcatcgccgaggtggccgccgccgtggtggccctggtgtacaccaccatggccgagcacttcctgaccctgctggtggtgcccgccatcaagaaggactacggcagccaggaggacttcacccaggtgtggaacaccaccatgaagggcctgaagtgctgcggcttcaccaactacaccgacttcgaggacagcccctacttcaaggagaacagcgccttcccccccttctgctgcaacgacaacgtgaccaacaccgccaacgagacctgcaccaagcagaaggcccacgaccagaaggtggagggctgcttcaaccagctgctgtacgacatcagaaccaacgccgtgaccgtgggcggcgtggccgccggcatcggcggcctggagctggccgccatgatcgtgagcatgtacctgtactgcaacctgcagtag

SEQ ID NO: 102220 - DNA, 702 bp, Artificial Sequence
  Description of Artificial Sequence: Synthetic coding sequence
atgagcagctacttcgtgaaccccaccttccccggcagcctgcccagcggccaggacagcttcctgggccagctgcccctgtaccaggccggctacgacgccctgagacccttccccgccagctacggcgccagcagcctgcccgacaagacctacaccagcccctgcttctaccagcagagcaacagcgtgctggcctgcaacagagccagctacgagtacggcgccagctgcttctacagcgacaaggacctgagcggcgccagccccagcggcagcggcaagcagagaggccccggcgactacctgcacttcagccccgagcagcagtacaagcccgacagcagcagcggccagggcaaggccctgcacgacgagggcgccgacagaaagtacaccagccccgtgtacccctggatgcagagaatgaacagctgcgccggcgccgtgtacggcagccacggcagaagaggcagacagacctacaccagataccagaccctggagctggagaaggagttccacttcaacagatacctgaccagaagaagaagaatcgagatcgccaacgccctgtgcctgaccgagagacagatcaagatctggttccagaacagaagaatgaagtggaagaaggagaacaagctgatcaacagcacccagcccagcggcgaggacagcgaggccaaggccggcgagtag

SEQ ID NO: 102221 - DNA, 918 bp, Artificial Sequence; identical to SEQ ID NO: 84680
  Description of Artificial Sequence: Synthetic coding sequence

SEQ ID NO: 102222 - DNA, 339 bp, Artificial Sequence
  Description of Artificial Sequence: Synthetic coding sequence
atggccagagaggacagcgtgaagtgcctgagatgcctgctgtacgccctgaacctgctgttctggctgatgagcatcagcgtgctggccgtgagcgcctggatgagagactacctgaacaacgtgctgaccctgaccgccgagaccagagtggaggaggccgtgatcctgacctacttccccgtggtgcaccccgtgatgatcgccgtgtgctgcttcctgatcatcgtgggcatgctgggctactgcggcaccgtgaagagaaacctgctgctgctggcctggtacttcggcagcctgctggtgatcttctgcgtggagctggcctgcggcgtgtag

SEQ ID NO: 102223 - DNA, 288 bp, Artificial Sequence
  Description of Artificial Sequence: Synthetic coding sequence
atggccagagaggacagcgtgaagtgcctgagatgcctgctgtacgccctgaacctgctgttctggctgatgagcatcagcgtgctggccgtgagcgcctggatgagagactacctgaacaacgtgctgaccctgaccgccgagaccagagtggaggaggccgtgatcctgacctacttccccgtggtgcaccccgtgatgatcgccgtgtgctgcttcctgatcatcgtgggcatgctgggctactgcggcaccgtgaagagaaacctgctgctgctggcctggtag

SEQ ID NO: 102224 - DNA, 363 bp, Artificial Sequence
  Description of Artificial Sequence: Synthetic coding sequence
atggccagagaggacagcgtgaagtgcctgagatgcctgctgtacgccctgaacctgctgttctggctgatgagcatcagcgtgctggccgtgagcgcctggatgagagactacctgaacaacgtgctgaccctgaccgccgagaccagagtggaggaggccgtgatcctgacctacttccccgtggtgcaccccgtgatgatcgccgtgtgctgcttcctgatcatcgtgggcatgctgggctactgcggcaccgtgaagagaaacctgctgctgctggcctggtacttcggcagcctgctggtgatcttctgcgtggagctggcctgcggcgtgtggacctacgagcaggagctgatgtag

SEQ ID NO: 102225 - DNA, 444 bp, Artificial Sequence
  Description of Artificial Sequence: Synthetic coding sequence
atggccagagaggacagcgtgaagtgcctgagatgcctgctgtacgccctgaacctgctgttctggctgatgagcatcagcgtgctggccgtgagcgcctggatgagagactacctgaacaacgtgctgaccctgaccgccgagaccagagtggaggaggccgtgatcctgacctacttccccgtggtgcaccccgtgatgatcgccgtgtgctgcttcctgatcatcgtgggcatgctgggctactgcggcaccgtgaagagaaacctgctgctgctggcctggtacttcggcagcctgctggtgatcttctgcgtggagctggcctgcggcgtgtggacctacgagcaggagctgatggtgcccgtgcagtggagcgacatggtgaccctgaaggccagaatgaccaactacggcctgcccagatacagatggctgacctag

SEQ ID NO: 102226 - DNA, 885 bp, Artificial Sequence
  Description of Artificial Sequence: Synthetic coding sequence
atgcccagaggcgacagcgagcaggtgagatactgcgccagattcagctacctgtggctgaagttcagcctgatcatctacagcaccgtgttctggctgatcggcgccctggtgctgagcgtgggcatctacgccgaggtggagagacagaagtacaagaccctggagagcgccttcctggcccccgccatcatcctgatcctgctgggcgtggtgatgttcatggtgagcttcatcggcgtgctggccagcctgagagacaacctgtacctgctgcaggccttcatgtacatcctgggcatctgcctgatcatggagctgatcggcggcgtggtggccctgaccttcagaaaccagaccatcgacttcctgaacgacaacatcagaagaggcatcgagaactactacgacgacctggacttcaagaacatcatggacttcgtgcagaagaagttcaagtgctgcggcggcgaggactacagagactggagcaagaaccagtaccacgactgcagcgcccccggccccctggcctgcggcgtgccctacacctgctgcatcagaaacaccaccgaggtggtgaacaccatgtgcggctacaagaccatcgacaaggagagattcagcgtgcaggacgtgatctacgtgagaggctgcaccaacgccgtgatcatctggttcatggacaactacaccatcatggccggcatcctgctgggcatcctgctgccccagttcctgggcgtgctgctgaccctgctgtacatcaccagagtggaggacatcatcatggagcacagcgtgaccgacggcctgctgggccccggcgccaagcccagcgtggaggccgccggcaccggctgctgcctgtgctaccccaactag

SEQ ID NO: 102227 - DNA, 582 bp, Artificial Sequence
  Description of Artificial Sequence: Synthetic coding sequence
atgggcagattcagaggcggcctgagatgcatcaagtacctgctgctgggcttcaacctgctgttctggctggccggcagcgccgtgatcgccttcggcctgtggttcagattcggcggcgccatcaaggagctgagcagcgaggacaagagccccgagtacttctacgtgggcctgtacgtgctggtgggcgccggcgccctgatgatggccgtgggcttcttcggctgctgcggcgccatgagagagagccagtgcgtgctgggcagcttcttcacctgcctgctggtgatcttcgccgccgaggtgaccaccggcgtgttcgccttcatcggcaagggcgtggccatcagacacgtgcagaccatgtacgaggaggcctacaacgactacctgaaggacagaggcaagggcaacggcaccctgatcaccttccacagcaccttccagtgctgcggcaaggagagcagcgagcaggtgcagcccacctgccccaaggagctgctgggccacaagatcttcggcatgatcttcagcatggtgctgtgctgcgccatcagaaacagcagagacgtgatctag

SEQ ID NO: 102228 - DNA, 591 bp, Artificial Sequence
  Description of Artificial Sequence: Synthetic coding sequence
atgggcagattcagaggcggcctgagatgcatcaagtacctgctgctgggcttcaacctgctgttctggctggccggcagcgccgtgatcgccttcggcctgtggttcagattcggcggcgccatcaaggagctgagcagcgaggacaagagccccgagtacttctacgtgggcctgtacgtgctggtgggcgccggcgccctgatgatggccgtgggcttcttcggctgctgcggcgccatgagagagagccagtgcgtgctgggcagcgccatcagacacgtgcagaccatgtacgaggaggcctacaacgactacctgaaggacagaggcaagggcaacggcaccctgatcaccttccacagcaccttccagtgctgcggcaaggagagcagcgagcaggtgcagcccacctgccccaaggagctgctgggccacaagaactgcatcgacgagatcgagaccatcatcagcgtgaagctgcagctgatcggcatcgtgggcatcggcatcgccggcctgaccatcttcggcatgatcttcagcatggtgctgtgctgcgccatcagaaacagcagagacgtgatctag

SEQ ID NO: 102229 - DNA, 666 bp, Artificial Sequence
  Description of Artificial Sequence: Synthetic coding sequence
atgggcagattcagaggcggcctgagatgcatcaagtacctgctgctgggcttcaacctgctgttctggctggccggcagcgccgtgatcgccttcggcctgtggttcagattcggcggcgccatcaaggagctgagcagcgaggacaagagccccgagtacttctacgtgggcctgtacgtgctggtgggcgccggcgccctgatgatggccgtgggcttcttcggctgctgcggcgccatgagagagagccagtgcgtgctgggcagcttcttcacctgcctgctggtgatcttcgccgccgaggtgaccaccggcgtgttcgccttcatcggcaagggcgtggccatcagacacgtgcagaccatgtacgaggaggcctacaacgactacctgaaggacagaggcaagggcaacggcaccctgatcaccttccacagcaccttccagtgctgcggcaaggagagcagcgagcaggtgcagcccacctgccccaaggagctgctgggccacaagaactgcatcgacgagatcgagaccatcatcagcgtgaagctgcagctgatcggcatcgtgggcatcggcatcgccggcctgaccatcttcggcatgatcttcagcatggtgctgtgctgcgccatcagaaacagcagagacgtgatctag

SEQ ID NO: 102230 - DNA, 564 bp, Artificial Sequence
  Description of Artificial Sequence: Synthetic coding sequence
ggcctgagatgcatcaagtacctgctgctgggcttcaacctgctgttctggctggccggcagcgccgtgatcgccttcggcctgtggttcagattcggcggcgccatcaaggagctgagcagcgaggacaagagccccgagtacttctacgtgggcctgtacgtgctggtgggcgccggcgccctgatgatggccgtgggcttcttcggctgctgcggcgccatgagagagagccagtgcgtgctgggcagcttcttcacctgcctgctggtgatcttcgccgccgaggtgaccaccggcgtgttcgccttcatcggcaagggcgtggccatcagacacgtgcagaccatgtacgaggaggcctacaacgactacctgaaggacagaggcaagggcaacggcaccctgatcaccttccacagcaccttccagtgctgcggcaaggagagcagcgagcaggtgcagcccacctgccccaaggagctgctgggccacaagatcttcggcatgatcttcagcatggtgctgtgctgcgccatcagaaacagcagagacgtgatctag

SEQ ID NO: 102231 - DNA, 762 bp, Artificial Sequence
  Description of Artificial Sequence: Synthetic coding sequence
atgggccagtgcggcatcaccagcagcaagaccgtgctggtgttcctgaacctgatcttctggggcgccgccggcatcctgtgctacgtgggcgcctacgtgttcatcacctacgacgactacgaccacttcttcgaggacgtgtacaccctgatccccgccgtggtgatcatcgccgtgggcgccctgctgttcatcatcggcctgatcggctgctgcgccaccatcagagagagcagatgcggcctggccaccttcgtgatcatcctgctgctggtgttcgtgaccgaggtggtggtggtggtgctgggctacgtgtacagagccaaggtggagaacgaggtggacagaagcatccagaaggtgtacaagacctacaacggcaccaaccccgacgccgccagcagagccatcgactacgtgcagagacagctgcactgctgcggcatccacaactacagcgactgggagaacaccgactggttcaaggagaccaagaaccagagcgtgcccctgagctgctgcagagagaccgccagcaactgcaacggcagcctggcccaccccagcgacctgtacgccgagggctgcgaggccctggtggtgaagaagctgcaggagatcatgatgcacgtgatctgggccgccctggccttcgccgccatccagctgctgggcatgctgtgcgcctgcatcgtgctgtgcagaagaagcagagaccccgcctacgagctgctgatcaccggcggcacctacgcctag

SEQ ID NO: 102232 - DNA, 687 bp, Artificial Sequence
  Description of Artificial Sequence: Synthetic coding sequence
atgggccagtgcggcatcaccagcagcaagaccgtgctggtgttcctgaacctgatcttctggggcgccgccggcatcctgtgctacgtgggcgcctacgtgttcatcacctacgacgactacgaccacttcttcgaggacgtgtacaccctgatccccgccgtggtgatcatcgccgtgggcgccctgctgttcatcatcggcctgatcggctgctgcgccaccatcagagagagcagatgcggcctggccaccgtggagaacgaggtggacagaagcatccagaaggtgtacaagacctacaacggcaccaaccccgacgccgccagcagagccatcgactacgtgcagagacagctgcactgctgcggcatccacaactacagcgactgggagaacaccgactggttcaaggagaccaagaaccagagcgtgcccctgagctgctgcagagagaccgccagcaactgcaacggcagcctggcccaccccagcgacctgtacgccgagggctgcgaggccctggtggtgaagaagctgcaggagatcatgatgcacgtgatctgggccgccctggccttcgccgccatccagctgctgggcatgctgtgcgcctgcatcgtgctgtgcagaagaagcagagaccccgcctacgagctgctgatcaccggcggcacctacgcctag

SEQ ID NO: 102233 - DNA, 651 bp, Artificial Sequence
  Description of Artificial Sequence: Synthetic coding sequence
atgtgggagcccatgagcagcagcctgatgatgaccatgaccaccagcctgaagatgtgcaccagaagcagcctgctgttcatcatcggcctgatcggctgctgcgccaccatcagagagagcagatgcggcctggccaccttcgtgatcatcctgctgctggtgttcgtgaccgaggtggtggtggtggtgctgggctacgtgtacagagccaaggtggagaacgaggtggacagaagcatccagaaggtgtacaagacctacaacggcaccaaccccgacgccgccagcagagccatcgactacgtgcagagacagctgcactgctgcggcatccacaactacagcgactgggagaacaccgactggttcaaggagaccaagaaccagagcgtgcccctgagctgctgcagagagaccgccagcaactgcaacggcagcctggcccaccccagcgacctgtacgccgagggctgcgaggccctggtggtgaagaagctgcaggagatcatgatgcacgtgatctgggccgccctggccttcgccgccatccagcagctgctgggcatgctgtgcgcctgcatcgtgctgtgcagaagaagcagagaccccgcctacgagctgctgatcaccggcggcacctacgcctag

SEQ ID NO: 102234 - DNA, 570 bp, Artificial Sequence
  Description of Artificial Sequence: Synthetic coding sequence
atgggccagtgcggcatcaccagcagcaagaccgtgctggtgttcctgaacctgatcttctggttcgtgatcatcctgctgctggtgttcgtgaccgaggtggtggtggtggtgctgggctacgtgtacagagccaaggtggagaacgaggtggacagaagcatccagaaggtgtacaagacctacaacggcaccaaccccgacgccgccagcagagccatcgactacgtgcagagacagctgcactgctgcggcatccacaactacagcgactgggagaacaccgactggttcaaggagaccaagaaccagagcgtgcccctgagctgctgcagagagaccgccagcaactgcaacggcagcctggcccaccccagcgacctgtacgccgagggctgcgaggccctggtggtgaagaagctgcaggagatcatgatgcacgtgatctgggccgccctggccttcgccgccatccagctgctgggcatgctgtgcgcctgcatcgtgctgtgcagaagaagcagagaccccgcctacgagctgctgatcaccggcggcacctacgcctag

SEQ ID NO: 102235 - DNA, 633 bp, Artificial Sequence
  Description of Artificial Sequence: Synthetic coding sequence
atggtgtgcggcggcttcgcctgcagcaagaacgccctgtgcgccctgaacgtggtgtacatgctggtgagcctgctgctgatcggcgtggccgcctggggcaagggcctgggcctggtgagcagcatccacatcatcggcggcgtgatcgccgtgggcgtgttcctgctgctgatcgccgtggccggcctggtgggcgccgtgaaccaccaccaggtgctgctgttcttctacatgatcatcctgggcctggtgttcatcttccagttcgtgatcagctgcagctgcctggccatcaacagaagcaagcagaccgacgtgatcaacgccagctggtgggtgatgagcaacaagaccagagacgagctggagagaagcttcgactgctgcggcctgttcaacctgaccaccctgtaccagcaggactacgacttctgcaccgccatctgcaagagccagagccccacctgccagatgtgcggcgagaagttcctgaagcacagcgacgaggccctgaagatcctgggcggcgtgggcctgttcttcagcttcaccgagatcctgggcgtgtggctggccatgagattcagaaaccagaaggaccccagagccaaccccagcgccttcctgtag

SEQ ID NO: 102236 - DNA, 963 bp, Artificial Sequence
  Description of Artificial Sequence: Synthetic coding sequence
atgggcccctggagcagagtgagagtggccaagtgccagatgctggtgacctgcttcttcatcctgctgctgggcctgagcgtggccaccatggtgaccctgacctacttcggcgcccacttcgccgtgatcagaagagccagcctggagaagaacccctaccaggccgtgcaccagtgggccttcagcgccggcctgagcctggtgggcctgctgaccctgggcgccgtgctgagcgccgccgccaccgtgagagaggcccagggcctgatggccggcggcttcctgtgcttcagcctggccttctgcgcccaggtgcaggtggtgttctggagactgcacagccccacccaggtggaggacgccatgctggacacctacgacctggtgtacgagcaggccatgaagggcaccagccacgtgagaagacaggagctggccgccatccaggacgtgttcctgtgctgcggcaagaagagccccttcagcagactgggcagcaccgaggccgacctgtgccagggcgaggaggccgccagagaggactgcctgcagggcatcagaagcttcctgagaacccaccagcaggtggccagcagcctgaccagcatcggcctggccctgaccgtgagcgccctgctgttcagcagcttcctgtggttcgccatcagatgcggctgcagcctggacagaaagggcaagtacaccctgacccccagagcctgcggcagacagccccaggagcccagcctgctgagatgcagccagggcggccccacccactgcctgcacagcgaggccgtggccatcggccccagaggctgcagcggcagcctgagatggctgcaggagagcgacgccgcccccctgcccctgagctgccacctggccgcccacagagccctgcagggcagaagcagaggcggcctgagcggctgccccgagagaggcctgagcgactag

SEQ ID NO: 102237 - DNA, 762 bp, Artificial Sequence
  Description of Artificial Sequence: Synthetic coding sequence
atgggcccctggagcagagtgagagtggccaagtgccagatgctggtgacctgcttcttcatcctgctgctgggcctgagcgtggccaccatggtgaccctgacctacttcggcgcccacttcgccgtgatcagaagagccagcctggagaagaacccctaccaggccgtgcaccagtgggccttcagcgccggcctgagcctggtgggcctgctgaccctgggcgccgtgctgagcgccgccgccaccgtgagagaggcccagggcctgatggccggcggcttcctgtgcttcagcctggccttctgcgcccaggtgcaggtggtgttctggagactgcacagccccacccaggtggaggacgccatgctggacacctacgacctggtgtacgagcaggccatgaagggcaccagccacgtgagaagacaggagctggccgccatccaggacgtgttcctgtgctgcggcaagaagagccccttcagcagactgggcagcaccgaggccgacctgtgccagggcgaggaggccgccagagaggactgcctgcagggcatcagaagcttcctgagaacccaccagcaggtggccagcagcctgaccagcatcggcctggccctgaccgtgagcgccctgctgttcagcagcttcctgtggttcgccatcagatgcggctgcagcctggacagaaagggcaagtacaccctgacccccagaagccccggccagaagagcagatgggcccagtgggtgccctag

SEQ ID NO: 102238 - DNA, 525 bp, Artificial Sequence
  Description of Artificial Sequence: Synthetic coding sequence
atggccatcggcttcgtgggctgcctgggcgccatcaaggagaacaagtgcctgctgctgaccttcttcctgctgctgctgctggtgttcctgctggaggccaccatcgccatcctgttcttcgcctacaccgacaagatcgacagatacgcccagcaggacctgaagaagggcctgcacctgtacggcacccagggcaacgtgggcctgaccaacgcctggagcatcatccagaccgacttcagatgctgcggcgtgagcaactacaccgactggttcgaggtgtacaacgccaccagagtgcccgacagctgctgcctggagttcagcgagagctgcggcctgcacgcccccggcacctggtggaaggccccctgctacgagaccgtgaaggtgtggctgcaggagaacctgctggccgtgggcatcttcggcctgtgcaccgccctggtgcagatcctgggcctgaccttcgccatgaccatgtactgccaggtggtgaaggccgacacctactgcgcctag

SEQ ID NO: 102239 - DNA, 717 bp, Artificial Sequence
  Description of Artificial Sequence: Synthetic coding sequence
atggccagagcctgcctgcaggccgtgaagtacctgatgttcgccttcaacctgctgttctggctgggcggctgcggcgtgctgggcgtgggcatctggctggccgccacccagggcagcttcgccaccctgagcagcagcttccccagcctgagcgccgccaacctgctgatcatcaccggcgccttcgtgatggccatcggcttcgtgggctgcctgggcgccatcaaggagaacaagtgcctgctgctgaccttcttcctgctgctgctgctggtgttcctgctggaggccaccatcgccatcctgttcttcgcctacaccgacaagatcgacagatacgcccagcaggacctgaagaagggcctgcacctgtacggcacccagggcaacgtgggcctgaccaacgcctggagcatcatccagaccgacttcagatgctgcggcgtgagcaactacaccgactggttcgaggtgtacaacgccaccagagtgcccgacagctgctgcctggagttcagcgagagctgcggcctgcacgcccccggcacctggtggaaggccccctgctacgagaccgtgaaggtgtggctgcaggagaacctgctggccgtgggcatcttcggcctgtgcaccgccctggtgcagatcctgggcctgaccttcgccatgaccatgtactgccaggtggtgaaggccgacacctactgcgcctag

SEQ ID NO: 102240 - DNA, 717 bp, Artificial Sequence; identical to SEQ ID NO: 102239
  Description of Artificial Sequence: Synthetic coding sequence

SEQ ID NO: 102241 - DNA, 717 bp, Artificial Sequence; identical to SEQ ID NO: 102239
  Description of Artificial Sequence: Synthetic coding sequence

SEQ ID NO: 102242 - DNA, 717 bp, Artificial Sequence; identical to SEQ ID NO: 102239
  Description of Artificial Sequence: Synthetic coding sequence

SEQ ID NO: 102243 - DNA, 717 bp, Artificial Sequence; identical to SEQ ID NO: 102239
  Description of Artificial Sequence: Synthetic coding sequence

SEQ ID NO: 102244 - DNA, 774 bp, Artificial Sequence
  Description of Artificial Sequence: Synthetic coding sequence
atgacccccagaagcgccggcaccagcgcccacggcgccgagctgaagagatgcggcatggccagagcctgcctgcaggccgtgaagtacctgatgttcgccttcaacctgctgttctggctgggcggctgcggcgtgctgggcgtgggcatctggctggccgccacccagggcagcttcgccaccctgagcagcagcttccccagcctgagcgccgccaacctgctgatcatcaccggcgccttcgtgatggccatcggcttcgtgggctgcctgggcgccatcaaggagaacaagtgcctgctgctgaccttcttcctgctgctgctgctggtgttcctgctggaggccaccatcgccatcctgttcttcgcctacaccgacaagatcgacagatacgcccagcaggacctgaagaagggcctgcacctgtacggcacccagggcaacgtgggcctgaccaacgcctggagcatcatccagaccgacttcagatgctgcggcgtgagcaactacaccgactggttcgaggtgtacaacgccaccagagtgcccgacagctgctgcctggagttcagcgagagctgcggcctgcacgcccccggcacctggtggaaggccccctgctacgagaccgtgaaggtgtggctgcaggagaacctgctggccgtgggcatcttcggcctgtgcaccgccctggtgcagatcctgggcctgaccttcgccatgaccatgtactgccaggtggtgaaggccgacacctactgcgcctag

SEQ ID NO: 102245 - DNA, 717 bp, Artificial Sequence; identical to SEQ ID NO: 102239
  Description of Artificial Sequence: Synthetic coding sequence

SEQ ID NO: 102246 - DNA, 525 bp, Artificial Sequence; identical to SEQ ID NO: 102238
  Description of Artificial Sequence: Synthetic coding sequence

SEQ ID NO: 102247 - DNA, 303 bp, Artificial Sequence
  Description of Artificial Sequence: Synthetic coding sequence
atggccatcggcttcgtgggctgcctgggcgccatcaaggagaacaagtgcctgctgctgaccttcttcctgctgctgctgctggtgttcctgctggaggccaccatcgccatcctgttcttcgcctacaccgacaagatcgacagatacgcccagcaggacctgaagaagggcctgcacctgtacggcacccagggcaacgtgggcctgaccaacgcctggagcatcatccagaccgacttcagatgctgcggcgtgagcaactacaccgactggttcgaggtgtacaacgccaccagatag

SEQ ID NO: 102248 - DNA, 480 bp, Artificial Sequence
  Description of Artificial Sequence: Synthetic coding sequence
atggccagagcctgcctgcaggccgtgaagtacctgatgttcgccttcaacctgctgttctggctgggcggctgcggcgtgctgggcgtgggcatctggctggccgccacccagggcagcttcgccaccctgagcagcagcttccccagcctgagcgccgccaacctgctgatcatcaccggcgccttcgtgatggccatcggcttcgtgggctgcctgggcgccatcaaggagaacaagtgcctgctgctgaccttcttcctgctgctgctgctggtgttcctgctggaggccaccatcgccatcctgttcttcgcctacaccgacaagatcgacagatacgcccagcaggacctgaagaagggcctgcacctgtacggcacccagggcaacgtgggcctgaccaacgcctggagcatcatccagaccgacttcagatgctgcggcgtgagcaactacaccgactggttcgaggtgtag

SEQ ID NO: 102249 - DNA, 258 bp, Artificial Sequence
  Description of Artificial Sequence: Synthetic coding sequence
atggccagagcctgcctgcaggccgtgaagtacctgatgttcgccttcaacctgctgttctggctgggcggctgcggcgtgctgggcgtgggcatctggctggccgccacccagggcagcttcgccaccctgagcagcagcttccccagcctgagcgccgccaacctgctgatcatcaccggcgccttcgtgatggccatcggcttcgtgggctgcctgggcgccatcaaggagaacaagtgcctgctgctgacctag

SEQ ID NO: 102250 - DNA, 807 bp, Artificial Sequence
  Description of Artificial Sequence: Synthetic coding sequence
atgagcggcaagcactacaagggccccgaggtgagctgctgcatcaagtacttcatcttcggcttcaacgtgatcttctggttcctgggcatcaccttcctgggcatcggcctgtgggcctggaacgagaagggcgtgctgagcaacatcagcagcatcaccgacctgggcggcttcgaccccgtgtggctgttcctggtggtgggcggcgtgatgttcatcctgggcttcgccggctgcatcggcgccctgagagagaacaccttcctgctgaagttcttcagcgtgttcctgggcatcatcttcttcctggagctgaccgccggcgtgctggccttcgtgttcaaggactggatcaaggaccagctgtacttcttcatcaacaacaacatcagagcctacagagacgacatcgacctgcagaacctgatcgacttcacccaggagtactggcagtgctgcggcgccttcggcgccgacgactggaacctgaacatctacttcaactgcaccgacagcaacgccagcagagagagatgcggcgtgcccttcagctgctgcaccaaggaccccgccgaggacgtgatcaacacccagtgcggctacgacgccagacagaagcccgaggtggaccagcagatcgtgatctacaccaagggctgcgtgccccagttcgagaagtggctgcaggacaacctgaccatcgtggccggcatcttcatcggcatcgccctgctgcagatcttcggcatctgcctggcccagaacctggtgagcgacatcgaggccgtgagagccagctggtag

SEQ ID NO: 102251 - DNA, 594 bp, Artificial Sequence
  Description of Artificial Sequence: Synthetic coding sequence
atgttcatcctgggcttcgccggctgcatcggcgccctgagagagaacaccttcctgctgaagttcttcagcgtgttcctgggcatcatcttcttcctggagctgaccgccggcgtgctggccttcgtgttcaaggactggatcaaggaccagctgtacttcttcatcaacaacaacatcagagcctacagagacgacatcgacctgcagaacctgatcgacttcacccaggagtactggcagtgctgcggcgccttcggcgccgacgactggaacctgaacatctacttcaactgcaccgacagcaacgccagcagagagagatgcggcgtgcccttcagctgctgcaccaaggaccccgccgaggacgtgatcaacacccagtgcggctacgacgccagacagaagcccgaggtggaccagcagatcgtgatctacaccaagggctgcgtgccccagttcgagaagtggctgcaggacaacctgaccatcgtggccggcatcttcatcggcatcgccctgctgcagatcttcggcatctgcctggcccagaacctggtgagcgacatcgaggccgtgagagccagctggtag

SEQ ID NO: 102252 - DNA, 801 bp, Artificial Sequence
  Description of Artificial Sequence: Synthetic coding sequence
atggccagcagaagaatggagaccaagcccgtgatcacctgcctgaagaccctgctgatcatctacagcttcgtgttctggaaggagaaggccgccggcttctgcggcagacaggacgtggccatggccctgatcaccggcgtgatcctgctggccgtgggcgtgtggggcaagctgaccctgggcacctacatcagcctgatcgccgagaacagcaccaacgccccctacgtgctgatcggcaccggcaccaccatcgtggtgttcggcctgttcggctgcttcgccacctgcagaggcagcccctggatgctgaagctgtacgccatgttcctgagcctggtgttcctggccgagctggtggccggcatcagcggcttcgtgttcagacacgagatcaaggacaccttcctgagaacctacaccgacgccatgcagacctacaacggcaacgacgagagaagcagagccgtggaccacgtgcagagaagcctgagctgctgcggcgtgcagaactacaccaactggagcaccagcccctacttcctggagcacggcatcccccccagctgctgcatgaacgagaccgactgcaacccccaggacctgcacaacctgaccgtggccgccaccaaggtgaaccagaagggctgctacgacctggtgaccagcttcatggagaccaacatgggcatcatcgccggcgtggccttcggcatcgccttcagccagctgatcggcatgctgctggcctgctgcctgagcagattcatcaccgccaaccagtacgagatggtgtag

SEQ ID NO: 102253 - DNA, 750 bp, Artificial Sequence
  Description of Artificial Sequence: Synthetic coding sequence
atggccagcagaagaatggagaccaagcccgtgatcacctgcctgaagaccctgctgatcatctacagcttcgtgttctggatcaccggcgtgatcctgctggccgtgggcgtgtggggcaagctgaccctgggcacctacatcagcctgatcgccgagaacagcaccaacgccccctacgtgctgatcggcaccggcaccaccatcgtggtgttcggcctgttcggctgcttcgccacctgcagaggcagcccctggatgctgaagctgtacgccatgttcctgagcctggtgttcctggccgagctggtggccggcatcagcggcttcgtgttcagacacgagatcaaggacaccttcctgagaacctacaccgacgccatgcagacctacaacggcaacgacgagagaagcagagccgtggaccacgtgcagagaagcctgagctgctgcggcgtgcagaactacaccaactggagcaccagcccctacttcctggagcacggcatcccccccagctgctgcatgaacgagaccgactgcaacccccaggacctgcacaacctgaccgtggccgccaccaaggtgaaccagaagggctgctacgacctggtgaccagcttcatggagaccaacatgggcatcatcgccggcgtggccttcggcatcgccttcagccagctgatcggcatgctgctggcctgctgcctgagcagattcatcaccgccaaccagtacgagatggtgtag

SEQ ID NO: 102254 - DNA, 828 bp, Artificial Sequence
  Description of Artificial Sequence: Synthetic coding sequence
atggccaacagaaccgtgtgcaacggccagggcagaagcagagacctgctgagaatcaagaacatccccaacgcccccggccacttcctgatcgccggcgtgggcggcagcagcagccagggcagaagcatcgaggaggagggcaagacccacctgggcatcaccggcgtgatcctgctggccgtgggcgtgtggggcaagctgaccctgggcacctacatcagcctgatcgccgagaacagcaccaacgccccctacgtgctgatcggcaccggcaccaccatcgtggtgttcggcctgttcggctgcttcgccacctgcagaggcagcccctggatgctgaagctgtacgccatgttcctgagcctggtgttcctggccgagctggtggccggcatcagcggcttcgtgttcagacacgagatcaaggacaccttcctgagaacctacaccgacgccatgcagacctacaacggcaacgacgagagaagcagagccgtggaccacgtgcagagaagcctgagctgctgcggcgtgcagaactacaccaactggagcaccagcccctacttcctggagcacggcatcccccccagctgctgcatgaacgagaccgactgcaacccccaggacctgcacaacctgaccgtggccgccaccaaggtgaaccagaagggctgctacgacctggtgaccagcttcatggagaccaacatgggcatcatcgccggcgtggccttcggcatcgccttcagccagctgatcggcatgctgctggcctgctgcctgagcagattcatcaccgccaaccagtacgagatggtgtag

SEQ ID NO: 102255 - DNA, 672 bp, Artificial Sequence
  Description of Artificial Sequence: Synthetic coding sequence
atgatcaccggcgtgatcctgctggccgtgggcgtgtggggcaagctgaccctgggcacctacatcagcctgatcgccgagaacagcaccaacgccccctacgtgctgatcggcaccggcaccaccatcgtggtgttcggcctgttcggctgcttcgccacctgcagaggcagcccctggatgctgaagctgtacgccatgttcctgagcctggtgttcctggccgagctggtggccggcatcagcggcttcgtgttcagacacgagatcaaggacaccttcctgagaacctacaccgacgccatgcagacctacaacggcaacgacgagagaagcagagccgtggaccacgtgcagagaagcctgagctgctgcggcgtgcagaactacaccaactggagcaccagcccctacttcctggagcacggcatcccccccagctgctgcatgaacgagaccgactgcaacccccaggacctgcacaacctgaccgtggccgccaccaaggtgaaccagaagggctgctacgacctggtgaccagcttcatggagaccaacatgggcatcatcgccggcgtggccttcggcatcgccttcagccagctgatcggcatgctgctggcctgctgcctgagcagattcatcaccgccaaccagtacgagatggtgtag

SEQ ID NO: 102256 - DNA, 714 bp, Artificial Sequence
  Description of Artificial Sequence: Synthetic coding sequence
atggccggcgtgagcgcctgcatcaagtacagcatgttcaccttcaacttcctgttctggctgtgcggcatcctgatcctggccctggccatctgggtgagagtgagcaacgacagccaggccatcttcggcagcgaggacgtgggcagcagcagctacgtggccgtggacatcctgatcgccgtgggcgccatcatcatgatcctgggcttcctgggctgctgcggcgccatcaaggagagcagatgcatgctgctgctgttcttcatcggcctgctgctgatcctgctgctgcaggtggccaccggcatcctgggcgccgtgttcaagagcaagagcgacagaatcgtgaacgagaccctgtacgagaacaccaagctgctgagcgccaccggcgagagcgagaagcagttccaggaggccatcatcgtgttccaggaggagttcaagtgctgcggcctggtgaacggcgccgccgactggggcaacaacttccagcactaccccgagctgtgcgcctgcctggacaagcagagaccctgccagagctacaacggcaagcaggtgtacaaggagacctgcatcagcttcatcaaggacttcctggccaagaacctgatcatcgtgatcggcatcagcttcggcctggccgtgatcgagatcctgggcctggtgttcagcatggtgctgtactgccagatcggcaacaagtag

SEQ ID NO: 102257 - DNA, 714 bp, Artificial Sequence; identical to SEQ ID NO: 102256
  Description of Artificial Sequence: Synthetic coding sequence

SEQ ID NO: 102258 - DNA, 714 bp, Artificial Sequence; identical to SEQ ID NO: 102256
  Description of Artificial Sequence: Synthetic coding sequence

SEQ ID NO: 102259 - DNA, 720 bp, Artificial Sequence
  Description of Artificial Sequence: Synthetic coding sequence
atggccagaggctgcctgtgctgcctgaagtacatgatgttcctgttcaacctgatcttctggctgtgcggctgcggcctgctgggcgtgggcatctggctgagcgtgagccagggcaacttcgccaccttcagccccagcttccccagcctgagcgccgccaacctggtgatcgccatcggcaccatcgtgatggtgaccggcttcctgggctgcctgggcgccatcaaggagaacaagtgcctgctgctgagcttcttcatcgtgctgctggtgatcctgctggccgagctgatcctgctgatcctgttcttcgtgtacatggacaaggtgaacgagaacgccaagaaggacctgaaggagggcctgctgctgtaccacaccgagaacaacgtgggcctgaagaacgcctggaacatcatccaggccgagatgagatgctgcggcgtgaccgactacaccgactggtaccccgtgctgggcgagaacaccgtgcccgacagatgctgcatggagaacagccagggctgcggcagaaacgccaccacccccctgtggagaaccggctgctacgagaaggtgaagatgtggttcgacgacaacaagcacgtgctgggcaccgtgggcatgtgcatcctgatcatgcagatcctgggcatggccttcagcatgaccctgttccagcacatccacagaaccggcaagaagtacgacgcctag

SEQ ID NO: 102260 - DNA, 720 bp, Artificial Sequence; identical to SEQ ID NO: 102259
  Description of Artificial Sequence: Synthetic coding sequence

SEQ ID NO: 102261 - DNA, 1044 bp, Artificial Sequence
  Description of Artificial Sequence: Synthetic coding sequence
atggccctgatgctgagcctggtgctgagcctgctgaagctgggcagcggccagtggcaggtgttcggccccgacaagcccgtgcaggccctggtgggcgaggacgccgccttcagctgcttcctgagccccaagaccaacgccgaggccatggaggtgagattcttcagaggccagttcagcagcgtggtgcacctgtacagagacggcaaggaccagcccttcatgcagatgccccagtaccagggcagaaccaagctggtgaaggacagcatcgccgagggcagaatcagcctgagactggagaacatcaccgtgctggacgccggcctgtacggctgcagaatcagcagccagagctactaccagaaggccatctgggagctgcaggtgagcgccctgggcagcgtgcccctgatcagcatcaccggctacgtggacagagacatccagctgctgtgccagagcagcggctggttccccagacccaccgccaagtggaagggcccccagggccaggacctgagcaccgacagcagaaccaacagagacatgcacggcctgttcgacgtggagatcagcctgaccgtgcaggagaacgccggcagcatcagctgcagcatgagacacgcccacctgagcagagaggtggagagcagagtgcagatcggcgacaccttcttcgagcccatcagctggcacctggccaccaaggtgctgggcatcctgtgctgcggcctgttcttcggcatcgtgggcctgaagatcttcttcagcaagttccagtgcaagagagagagagaggcctgggccggcgccctgttcatggtgcccgccggcaccggcagcgagatgctgccccaccccgccgccagcctgctgctggtgctggccagcagaggccccggccccaagaaggagaaccccggcggcaccggcctggagaagaaggccagaaccggcagaatcgagagaagacccgagaccagaagcggcggcgacagcggcagcagagacggcagccccgaggccctgagattctag

SEQ ID NO: 102262 - DNA, 879 bp, Artificial Sequence
  Description of Artificial Sequence: Synthetic coding sequence
atgggcgagaagagcgagaactgcggcgtgcccgaggacctgctgaacggcctgaaggtgaccgacacccaggaggccgagtgcgccggcccccccgtgcccgaccccaagaaccagcacagccagagcaagctgctgagagacgacgaggcccacctgcaggaggaccagggcgaggaggagtgcttccacgactgcagcgccagcttcgaggaggagcccggcgccgacaaggtggagaacaagagcaacgaggacgtgaacagcagcgagctggacgaggagtacctgatcgagctggagaagaacatgagcgacgaggagaagcagaagagaagagaggagagcaccagactgaaggaggagggcaacgagcagttcaagaagggcgactacatcgaggccgagagcagctacagcagagccctggagatgtgccccagctgcttccagaaggagagaagcatcctgttcagcaacagagccgccgccagaatgaagcaggacaagaaggagatggccatcaacgactgcagcaaggccatccagctgaaccccagctacatcagagccatcctgagaagagccgagctgtacgagaagaccgacaagctggacgaggccctggaggactacaagagcatcctggagaaggaccccagcatccaccaggccagagaggcctgcatgagactgcccaagcagatcgaggagagaaacgagagactgaaggaggagatgctgggcaagctgaaggacctgggcaacctggtgctgagacccttcggcctgagcaccgagaacttccagatcaagcaggacagcagcaccggcagctacagcatcaacttcgtgcagaaccccaacaacaacagatag

SEQ ID NO: 102263 - DNA, 2199 bp, Artificial Sequence
  Description of Artificial Sequence: Synthetic coding sequence
atggacgccgacaaggagaaggacctgcagaagttcctgaagaacgtggacgagatcagcaacctgatccaggagatgaacagcgacgaccccgtggtgcagcagaaggccgtgctggagaccgagaagagactgctgctgatggaggaggaccaggaggaggacgagtgcagaaccaccctgaacaagaccatgatcagccccccccagaccgccatgaagagcgccgaggagatcaacagcgaggccttcctggccagcgtggagaaggacgccaaggagagagccaagagaagaagagagaacaaggtgctggccgacgccctgaaggagaagggcaacgaggccttcgccgagggcaactacgagaccgccatcctgagatacagcgagggcctggagaagctgaaggacatgaaggtgctgtacaccaacagagcccaggcctacatgaagctggaggactacgagaaggccctggtggactgcgagtgggccctgaagtgcgacgagaagtgcaccaaggcctacttccacatgggcaaggccaacctggccctgaagaactacagcgtgagcagagagtgctacaagaagatcctggagatcaaccccaagctgcagacccaggtgaagggctacctgaaccaggtggacctgcaggagaaggccgacctgcaggagaaggaggcccacgagctgctggacagcggcaagaacaccgccgtgaccaccaagaacctgctggagaccctgagcaagcccgaccagatccccctgttctacgccggcggcatcgagatcctgaccgagatgatcaacgagtgcaccgagcagaccctgttcagaatgcacaacggcttcagcatcatcagcgacaacgaggtgatcagaagatgcttcagcaccgccggcaacgacgccgtggaggagatggtgtgcgtgagcgtgctgaagctgtggcaggccgtgtgcagcagaaacgaggagaaccagagagtgctggtgatccaccacgacagagccagactgctggccgccctgctgagcagcaaggtgctggccatcagacagcagagcttcgccctgctgctgcacctggcccagaccgagagcggcagaagcctgatcatcaaccacctggacctgaccagactgctggaggccctggtgagcttcctggacttcagcgacaaggaggccaacaccgccatgggcctgttcaccgacctggccctggaggagagattccaggtgtggttccaggccaacctgcccggcgtgctgcccgccctgaccggcgtgctgaagaccgaccccaaggtgagcagcagcagcgccctgtgccagtgcatcgccatcatgggcaacctgagcgccgagcccaccaccagaagacacatggccgcctgcgaggagttcggcgacggctgcctgagcctgctggccagatgcgaggaggacgtggacctgttcagagaggtgatctacaccctgctgggcctgatgatgaacctgtgcctgcaggcccccttcgtgagcgaggtgtgggccgtggaggtgagcagaagatgcctgagcctgctgaacagccaggacggcggcatcctgaccagagccgccggcgtgctgagcagaaccctgagcagcagcctgaagatcgtggaggaggccctgagagccggcgtggtgaagaagatgatgaagttcctgaagaccggcggcgagaccgccagcagatacgccatcaagatcctggccatctgcaccaacagctaccacgaggccagagaggaggtgatcagactggacaagaagctgagcgtgatgatgaagctgctgagcagcgaggacgaggtgctggtgggcaacgccgccctgtgcctgggcaactgcatggaggtgcccaacgtggccagcagcctgctgaagaccgacctgctgcaggtgctgctgaagctggccggcagcgacacccagaagaccgccgtgcaggtgaacgccggcatcgccctgggcaagctgtgcaccgccgagcccagagtgcccgccgagagcagccacctgcagttcggcagagagagcgccgcccccgaggccctgagccccagaagatgggaggagatgttccacatgctggtgttcagcctgagcagcgtggaccccccccccccccccccccagacctgctacccctag

SEQ ID NO: 102264 - DNA, 324 bp, Artificial Sequence
  Description of Artificial Sequence: Synthetic coding sequence
atggacgccgacaaggagaaggacctgcagaagttcctgaagaacgtggacgagatcagcaacctgatccaggagatgaacagcgacgaccccgtggtgcagcagaaggccgtgctggagaccgagaagagactgctgctgatggaggaggaccaggaggaggacgagtgcagaaccaccctgaacaagaccatgatcagccccccccagaccgccatgaagagcgccgaggagatcaacagcgaggccttcctggccagcgtggagaaggacgccaaggagagagccaagagaagaagagagaacaaggtgctggccgactag

SEQ ID NO: 102265 - DNA, 609 bp, Artificial Sequence
  Description of Artificial Sequence: Synthetic coding sequence
atggacgccgacaaggagaaggacctgcagaagttcctgaagaacgtggacgagatcagcaacctgatccaggagatgaacagcgacgaccccgtggtgcagcagaaggccgtgctggagaccgagaagagactgctgctgatggaggaggaccaggaggaggacgagtgcagaaccaccctgaacaagaccatgatcagccccccccagaccgccatgaagagcgccgaggagatcaacagcgaggccttcctggccagcgtggagaaggacgccaaggagagagccaagagaagaagagagaacaaggtgctggccgacgccctgaaggagaagggcaacgaggccttcgccgagggcaactacgagaccgccatcctgagatacagcgagggcctggagaagctgaaggacatgaaggtgctgtacaccaacagagcccaggcctacatgaagctggaggactacgagaaggccctggtggactgcgagtgggccctgaagtgcgacgagaagtgcaccaaggcctacttccacatgggcaaggccaacctggccctgaagaactacagcgtgagcagagagtgctacaagaagatcctggagtag

SEQ ID NO: 102266 - DNA, 504 bp, Artificial Sequence
  Description of Artificial Sequence: Synthetic coding sequence
atggacgccgacaaggagaaggacctgcagaagttcctgaagaacgtggacgagatcagcaacctgatccaggagatgaacagcgacgaccccgtggtgcagcagaaggccgtgctggagaccgagaagagactgctgctgatggaggaggaccaggaggaggacgagtgcagaaccaccctgaacaagaccatgatcagccccccccagaccgccatgaagagcgccgaggagatcaacagcgaggccttcctggccagcgtggagaaggacgccaaggagagagccaagagaagaagagagaacaaggtgctggccgacgccctgaaggagaagggcaacgaggccttcgccgagggcaactacgagaccgccatcctgagatacagcgagggcctggagaagctgaaggacatgaaggtgctgtacaccaacagagcccaggcctacatgaagctggaggactacgagaaggccctggtggactgcgagtgggccctgtag

SEQ ID NO: 102267 - DNA, 2118 bp, Artificial Sequence
  Description of Artificial Sequence: Synthetic coding sequence
atggacgccgacaaggagaaggacctgcagaagttcctgaagaacgtggacgagatcagcaacctgatccaggagatgaacagcgacgaccccgtggtgcagcagaaggccgtgctggagaccgagaagagactgctgctgatggaggaggaccaggaggaggacgagtgcagaaccaccctgaacaagaccatgatcagccccccccagaccgccatgaagagcgccgaggagatcaacagcgaggccttcctggccagcgtggagaaggacgccaaggagagagccaagagaagaagagagaacaaggtgctggccgacgccctgaaggagaagggcaacgaggccttcgccgagggcaactacgagaccgccatcctgagatacagcgagggcctggagaagctgaaggacatgaaggtgctgtacaccaacagagcccaggcctacatgaagctggaggactacgagaaggccctggtggactgcgagtgggccctgaagtgcgacgagaagtgcaccaaggcctacttccacatgggcaaggccaacctggccctgaagaactacagcgtgagcagagagtgctacaagaagatcctggagatcaaccccaagctgcagacccaggtgaagggctacctgaaccaggtggacctgcaggagaaggccgacctgcaggagaaggaggcccacgagctgctggacagcggcaagaacaccgccgtgaccaccaagaacctgctggagaccctgagcaagcccgaccagatccccctgttctacgccggcggcatcgagatcctgaccgagatgatcaacgagtgcaccgagcagaccctgttcagaatgcacaacggcttcagcatcatcagcgacaacgaggtgatcagaagatgcttcagcaccgccggcaacgacgccgtggaggagatggtgtgcgtgagcgtgctgaagctgtggcaggccgtgtgcagcagaaacgaggagaaccagagagtgctggtgatccaccacgacagagccagactgctggccgccctgctgagcagcaaggtgctggccatcagacagcagagcttcgccctgctgctgcacctggcccagaccgagagcggcagaagcctgatcatcaaccacctggacctgaccagactgctggaggccctggtgagcttcctggacttcagcgacaaggaggccaacaccgccatgggcctgttcaccgacctggccctggaggagagattccaggtgtggttccaggccaacctgcccggcgtgctgcccgccctgaccggcgtgctgaagaccgaccccaaggtgagcagcagcagcgccctgtgccagtgcatcgccatcatgggcaacctgagcgccgagcccaccaccagaagacacatggccgcctgcgaggagttcggcgacggctgcctgagcctgctggccagatgcgaggaggacgtggacctgttcagagaggtgatctacaccctgctgggcctgatgatgaacctgtgcctgcaggcccccttcgtgagcgaggtgtgggccgtggaggtgagcagaagatgcctgagcctgctgaacagccaggacggcggcatcctgaccagagccgccggcgtgctgagcagaaccctgagcagcagcctgaagatcgtggaggaggccctgagagccggcgtggtgaagaagatgatgaagttcctgaagaccggcggcgagaccgccagcagatacgccatcaagatcctggccatctgcaccaacagctaccacgaggccagagaggaggtgatcagactggacaagaagctgagcgtgatgatgaagctgctgagcagcgaggacgaggtgctggtgggcaacgccgccctgtgcctgggcaactgcatggaggtgcccaacgtggccagcagcctgctgaagaccgacctgctgcaggtgctgctgaagctggccggcagcgacacccagaagaccgccgtgcaggtgaacgccggcatcgccctgggcaagctgtgcaccgccgagcccagattcgccgcccagctgagaaagctgcacggcctggagatcctgaacagcaccatgaagtacatcagcgacagctag

SEQ ID NO: 102268 - DNA, 1143 bp, Artificial Sequence
  Description of Artificial Sequence: Synthetic coding sequence
atgttcagactgctgagctggagcctgggcagaggcttcctgagagccgccggcagaagatgcagaggctgcagcgccagactgctgcccggcctggccggcggccccggccccgaggtgcaggtgccccccagcagagtggccccccacggcagaggccccggcctgctgcccctgctggccgccctggcctggttcagcagacccgccgccgccgaggaggaggagcagcagggcgccgacggcgccgccgccgaggacggcgccgacgaggccgaggccgagatcatccagctgctgaagagagccaagctgagcatcatgaaggacgagcccgaggaggccgagctgatcctgcacgacgccctgagactggcctaccagaccgacaacaagaaggccatcacctacacctacgacctgatggccaacctggccttcatcagaggccagctggagaacgccgagcagctgttcaaggccaccatgagctacctgctgggcggcggcatgaagcaggaggacaacgccatcatcgagatcagcctgaagctggccagcatctacgccgcccagaacagacaggagttcgccgtggccggctacgagttctgcatcagcaccctggaggagaagatcgagagagagaaggagctggccgaggacatcatgagcgtggaggagaaggccaacacccacctgctgctgggcatgtgcctggacgcctgcgccagatacctgctgttcagcaagcagcccagccaggcccagagaatgtacgagaaggccctgcagatcagcgaggagatccagggcgagagacacccccagaccatcgtgctgatgagcgacctggccaccaccctggacgcccagggcagattcgacgaggcctacatctacatgcagagagccagcgacctggccagacagatcaaccaccccgagctgcacatggtgctgagcaacctggccgccgtgctgatgcacagagagagatacacccaggccaaggagatctaccaggaggccctgaagcaggccaagctgaagaaggacgagatcagcgtgcagcacatcagagaggagctggccgagctgagcaagaagagcagacccctgaccaacagcgtgaagctgtag

SEQ ID NO: 102269 - DNA, 1143 bp, Artificial Sequence; identical to SEQ ID NO: 102268
  Description of Artificial Sequence: Synthetic coding sequence

SEQ ID NO: 102270 - DNA, 1506 bp, Artificial Sequence
  Description of Artificial Sequence: Synthetic coding sequence
atggcccagccccacaccaccagcgtgccctacttcgccagaagccccgccccccccccccccagcagaagcggcgcccccccccagccccccgccaccctgagacccagcagaagaagaaccagaccccccagacccgccgacagaagagacgcccccgccgactgcgcctacctgtggagaatcctgacccccagaagaggcagagccagaagaagcgacgtgggcgccagacacagagcctgcggcagaagagacgtgctgctgagcagacagggccccgccaaccccgagggcgccagaagagtggtgggcggccaggagagagtgtggcccgccgtgagaagaggcagaggcggcagcatgttcagactgctgagctggagcctgggcagaggcttcctgagagccgccggcagaagatgcagaggctgcagcgccagactgctgcccggcctggccggcggccccggccccgaggtgcaggtgccccccagcagagtggccccccacggcagaggccccggcctgctgcccctgctggccgccctggcctggttcagcagacccgccgccgccgaggaggaggagcagcagggcgccgacggcgccgccgccgaggacggcgccgacgaggccgaggccgagatcatccagctgctgaagagagccaagctgagcatcatgaaggacgagcccgaggaggccgagctgatcctgcacgacgccctgagactggcctaccagaccgacaacaagaaggccatcacctacacctacgacctgatggccaacctggccttcatcagaggccagctggagaacgccgagcagctgttcaaggccaccatgagctacctgctgggcggcggcatgaagcaggaggacaacgccatcatcgagatcagcctgaagctggccagcatctacgccgcccagaacagacaggagttcgccgtggccggctacgagttctgcatcagcaccctggaggagaagatcgagagagagaaggagctggccgaggacatcatgagcgtggaggagaaggccaacacccacctgctgctgggcatgtgcctggacgcctgcgccagatacctgctgttcagcaagcagcccagccaggcccagagaatgtacgagaaggccctgcagatcagcgaggagatccagggcgagagacacccccagaccatcgtgctgatgagcgacctggccaccaccctggacgcccagggcagattcgacgaggcctacatctacatgcagagagccagcgacctggccagacagatcaaccaccccgagctgcacatggtgctgagcaacctggccgccgtgctgatgcacagagagagatacacccaggccaaggagatctaccaggaggccctgaagcaggccaagctgaagaaggacgagatcagcgtgcagcacatcagagaggagctggccgagctgagcaagaagagcagacccctgaccaacagcgtgaagctgtag

SEQ ID NO: 102271 - DNA, 501 bp, Artificial Sequence
  Description of Artificial Sequence: Synthetic coding sequence
tgacaggagagagtgtggcccgccgtgagaagaggcagaggcggcagcatgttcagactgctgagctggagcctgggcagaggcttcctgagagccgccggcagaagatgcagaggctgcagcgccagactgctgcccggcctggccggcggccccggccccgaggtgcaggtgccccccagcagagtggccccccacggcagaggccccggcctgctgcccctgctggccgccctggcctggttcagcagacccgccgccgccgaggaggaggagcagcagggcgccgacggcgccgccgccgaggacggcgccgacgaggccgaggccgagatcatccagctgctgaagagagccaaggtgagaagactgagagccctgagacccgccgagagaggcagcctgtgcgagagaggcctgggcgtggccgcccactacagcctgagactggccgaggagtggatggaggcccccagagtgaagctgcccagaatgagctag

SEQ ID NO: 102272 - DNA, 3951 bp, Artificial Sequence
  Description of Artificial Sequence: Synthetic coding sequence
atggacagccaggagctgaagaccctgatcaactactactgccaggagagatacttccaccacgtgctgctggtggccagcgagggcatcaagagatacggcagcgaccccgtgttcagattctaccacgcctacggcaccctgatggagggcaagacccaggaggccctgagagagttcgaggccatcaagaacaagcaggacgtgagcctgtgcagcctgctggccctgatctacgcccacaagatgagccccaaccccgacagagaggccatcctggagagcgacgccagagtgaaggagcagagaaagggcgccggcgagaaggccctgtaccacgccggcctgttcctgtggcacatcggcagacacgacaaggccagagagtacatcgacagaatgatcaagatcagcgacggcagcaagcagggccacgtgctgaaggcctggctggacatcaccagaggcaaggagccctacaccaagaaggccctgaagtacttcgaggagggcctgcaggacggcaacgacaccttcgccctgctgggcaaggcccagtgcctggagatgagacagaactacagcggcgccctggagaccgtgaaccagatcatcgtgaacttccccagcttcctgcccgccttcgtgaagaagatgaagctgcagctggccctgcaggactgggaccagaccgtggagaccgcccagagactgctgctgcaggacagccagaacgtggaggccctgagaatgcaggccctgtactacgtgtgcagagagggcgacatcgagaaggccagcaccaagctggagaacctgggcaacaccctggacgccatggagccccagaacgcccagctgttctacaacatcaccctggccttcagcagaacctgcggcagaagccagctgatcctgcagaagatccagaccctgctggagagagccttcagcctgaacccccagcagagcgagttcgccaccgagctgggctaccagatgatcctgcagggcagagtgaaggaggccctgaagtggtacaagaccgccatgaccctggacgagaccagcgtgagcgccctggtgggcttcatccagtgccagctgatcgagggccagctgcaggacgccgaccagcagctggagttcctgaacgagatccagcagagcatcggcaagagcgccgagctgatctacctgcacgccgtgctggccatgaagaagaacaagagacaggaggaggtgatcaacctgctgaacgacgtgctggacacccacttcagccagctggagggcctgcccctgggcatccagtacttcgagaagctgaaccccgacttcctgctggagatcgtgatggagtacctgagcttctgccccatgcagcccgccagccccggccagcccctgtgccccctgctgagaagatgcatcagcgtgctggagaccgtggtgagaaccgtgcccggcctgctgcagaccgtgttcctgatcgccaaggtgaagtacctgagcggcgacatcgaggccgccttcaacaacctgcagcactgcctggagcacaaccccagctacgccgacgcccacctgctgctggcccaggtgtacctgagccaggagaaggtgaagctgtgcagccagagcctggagctgtgcctgagctacgacttcaaggtgagagactaccccctgtaccacctgatcaaggcccagagccagaagaagatgggcgagatcgccgacgccatcaagaccctgcacatggccatgagcctgcccggcatgaagagaatcggcgccagcaccaagagcaaggacagaaagaccgaggtggacaccagccacagactgagcatcttcctggagctgatcgacgtgcacagactgaacggcgagcagcacgaggccaccaaggtgctgcaggacgccatccacgagttcagcggcaccagcgaggaggtgagagtgaccatcgccaacgccgacctggccctggcccagggcgacatcgagagagccctgagcatcctgcagaacgtgaccgccgagcagccctacttcatcgaggccagagagaagatggccgacatctacctgaagcacagaaaggacaagatgctgtacatcacctgcttcagagagatcgccgagagaatggccaaccccagaagcttcctgctgctgggcgacgcctacatgaacatcctggagcccgaggaggccatcgtggcctacgagcaggccctgaaccagaaccccaaggacggcaccctggccagcaagatgggcaaggccctgatcaagacccacaactacagcatggccatcacctactacgaggccgccctgaagaccggccagaagaactacctgtgctacgacctggccgagctgctgctgaagctgaagtggtacgacaaggccgagaaggtgctgcagcacgccctggcccacgagcccgtgaacgagctgagcgccctgatggaggacggcagatgccaggtgctgctggccaaggtgtacagcaagatggagaagctgggcgacgccatcaccgccctgcagcaggccagagagctgcaggccagagtgctgaagagagtgcagatggagcagcccgacgccgtgcccgcccagaagcacctggccgccgagatctgcgccgagatcgccaagcacagcgtggcccagagagactacgagaaggccatcaagttctacagagaggccctggtgcactgcgagaccgacaacaagatcatgctggagctggccagactgtacctggcccaggacgaccccgacagctgcctgagacagtgcgccctgctgctgcagagcgaccaggacaacgaggccgccaccatgatgatggccgacctgatgttcagaaagcaggactacgagcaggccgtgttccacctgcagcagctgctggagagaaagcccgacaactacatgaccctgagcagactgatcgacctgctgagaagatgcggcaagctggaggacgtgcccagattcttcagcatggccgagaagagaaacagcagagccaagctggagcccggcttccagtactgcaagggcctgtacctgtggtacaccggcgagcccaacgacgccctgagacacttcaacaaggccagaaaggacagagactggggccagaacgccctgtacaacatgatcgagatctgcctgaaccccgacaacgagaccgtgggcggcgaggtgttcgagaacctggacggcgacctgggcaacagcaccgagaagcaggagagcgtgcagctggccgtgagaaccgccgagaagctgctgaaggagctgaagccccagaccgtgcagggccacgtgcagctgagaatcatggagaactactgcctgatggccaccaagcagaagagcaacgtggagcaggccctgaacaccttcaccgagatcgccgccagcgagaaggagcacatccccgccctgctgggcatggccaccgcctacatgatcctgaagcagacccccagagccagaaaccagctgaagagaatcgccaagatgaactggaacgccatcgacgccgaggagttcgagaagagctggctgctgctggccgacatctacatccagagcgccaagtacgacatggccgaggacctgctgaagagatgcctgagacacaacagaagctgctgcaaggcctacgagtacatgggctacatcatggagaaggagcaggcctacaccgacgccgccctgaactacgagatggcctggaagtacagcaacagaaccaaccccgccgtgggctacaagctggccttcaactacctgaaggccaagagatacgtggacagcatcgacatctgccaccaggtgctggaggcccaccccacctaccccaagatcagaaaggacatcctggacaaggccagagccagcctgagaccctag

SEQ ID NO: 102273 - DNA, 765 bp, Artificial Sequence
  Description of Artificial Sequence: Synthetic coding sequence
atgatcgagatctgcctgaaccccgacaacgagaccgtgggcggcgaggtgttcgagaacctggacggcgacctgggcaacagcaccgagaagcaggagagcgtgcagctggccgtgagaaccgccgagaagctgctgaaggagctgaagccccagaccgtgcagggccacgtgcagctgagaatcatggagaactactgcctgatggccaccaagcagaagagcaacgtggagcaggccctgaacaccttcaccgagatcgccgccagcgagaaggagcacatccccgccctgctgggcatggccaccgcctacatgatcctgaagcagacccccagagccagaaaccagctgaagagaatcgccaagatgaactggaacgccatcgacgccgaggagttcgagaagagctggctgctgctggccgacatctacatccagagcgccaagtacgacatggccgaggacctgctgaagagatgcctgagacacaacagaagctgctgcaaggcctacgagtacatgggctacatcatggagaaggagcaggcctacaccgacgccgccctgaactacgagatggcctggaagtacagcaacagaaccaaccccgccgtgggctacaagctggccttcaactacctgaaggccaagagatacgtggacagcatcgacatctgccaccaggtgctggaggcccaccccacctaccccaagatcagaaaggacatcctggacaaggccagagccagcctgagaccctag

SEQ ID NO: 102274 - DNA, 6078 bp, Artificial Sequence
  Description of Artificial Sequence: Synthetic coding sequence
atggacaacttcgccgagggcgacttcaccgtggccgactacgccctgctggaggactgcccccacgtggacgactgcgtgttcgccgccgagttcatgagcaacgactacgtgagagtgacccagctgtactgcgacggcgtgggcgtgcagtacaaggactacatccagagcgagagaaacctggagttcgacatctgcagcatctggtgcagcaagcccatcagcgtgctgcaggactactgcgacgccatcaagatcaacatcttctggcccctgctgttccagcaccagaacagcagcgtgatcagcagactgcacccctgcgtggacgccaacaacagcagagccagcgagatcaacctgaagaagctgcagcacctggagctgatggaggacatcgtggacctggccaagaaggtggccaacgacagcttcctgatcggcggcctgctgagaatcggctgcaagatcgagaacaagatcctggccatggaggaggccctgaactggatcaagtacgccggcgacgtgaccatcctgaccaagctgggcagcatcgacaactgctggcccatgctgagcatcttcttcaccgagtacaagtaccacatcaccaagatcgtgatggaggactgcaacctgctggaggagctgaagacccagagctgcatggactgcatcgaggagggcgagctgatgaagatgaagggcaacgaggagttcagcaaggagagattcgacatcgccatcatctactacaccagagccatcgagtacagacccgagaactacctgctgtacggcaacagagccctgtgcttcctgagaaccggccagttcagaaacgccctgggcgacggcaagagagccaccatcctgaagaacacctggcccaagggccactacagatactgcgacgccctgagcatgctgggcgagtacgactgggccctgcaggccaacatcaaggcccagaagctgtgcaagaacgaccccgagggcatcaaggacctgatccagcagcacgtgaagctgcagaagcagatcgaggacctgcagggcagaaccgccaacaaggaccccatcaaggccttctacgagaacagagcctacacccccagaagcctgagcgcccccatcttcaccaccagcctgaacttcgtggagaaggagagagacttcagaaagatcaaccacgagatggccaacggcggcaaccagaacctgaaggtggccgacgaggccctgaaggtggacgactgcgactgccaccccgagttcagcccccccagcagccagccccccaagcacaagggcaagcagaagagcagaaacaacgagagcgagaagttcagcagcagcagccccctgaccctgcccgccgacctgaagaacatcctggagaagcagttcagcaagagcagcagagccgcccaccaggacttcgccaacatcatgaagatgctgagaagcctgatccaggacggctacatggccctgctggagcagagatgcagaagcgccgcccaggccttcaccgagctgctgaacggcctggacccccagaagatcaagcagctgaacctggccatgatcaactacgtgctggtggtgtacggcctggccatcagcctgctgggcatcggccagcccgaggagctgagcgaggccgagaaccagttcaagagaatcatcgagcactaccccagcgagggcctggactgcctggcctactgcggcatcggcaaggtgtacctgaagaagaacagattcctggaggccctgaaccacttcgagaaggccagaaccctgatctacagactgcccggcgtgctgacctggcccaccagcaacgtgatcatcgaggagagccagccccagaagatcaagatgctgctggagaagttcgtggaggagtgcaagttcccccccgtgcccgacgccatctgctgctaccagaagtgccacggctacagcaagatccagatctacatcaccgaccccgacttcaagggcttcatcagaatcagctgctgccagtactgcaagatcgagttccacatgaactgctggaagaagctgaagaccaccaccttcaacgacaagatcgacaaggacttcctgcagggcatctgcctgacccccgactgcgagggcgtgatcagcaagatcatcatcttcagcagcggcggcgaggtgaagtgcgagttcgagcacaaggtgatcaaggagaaggtgccccccagacccatcctgaagcagaagtgcagcagcctggagaagctgagactgaaggaggacaagaagctgaagagaaagatccagaagaaggaggccaagaagctggcccaggagagaatggaggaggacctgagagagagcaacccccccaagaacgaggagcagaaggagaccgtggacaacgtgcagagatgccagttcctggacgacagaatcctgcagtgcatcaagcagtacgccgacaagatcaagagcggcatccagaacaccgccatgctgctgaaggagctgctgagctggaaggtgctgagcaccgaggactacaccacctgcttcagcagcagaaacttcctgaacgaggccgtggactacgtgatcagacacctgatccaggagaacaacagagtgaagaccagaatcttcctgcacgtgctgagcgagctgaaggaggtggagcccaagctggccgcctggatccagaagctgaacagcttcggcctggacgccaccggcaccttcttcagcagatacggcgccagcctgaagctgctggacttcagcatcatgaccttcctgtggaacgagaagtacggccacaagctggacagcatcgagggcaagcagctggactacttcagcgagcccgccagcctgaaggaggccagatgcctgatctggctgctggaggagcacagagacaagttccccgccctgcacagcgccctggacgagttcttcgacatcatggacagcagatgcaccgtgctgagaaagcaggacagcggcgaggcccccttcagcagcaccaaggtgaagaacaagagcaagaagaagaagcccaaggacagcaagcccatgctggtgggcagcggcaccaccagcgtgaccagcaacaacgagatcatcaccagcagcgaggaccacagcaacagaaacagcgacagcgccggccccttcgccgtgcccgaccacctgagacaggacgtggaggagttcgaggccctgtacgaccagcacagcaacgagtacgtggtgagaaacaagaagctgtgggacatgaaccccaagcagaagtgcagcaccctgtacgactacttcagccagttcctggaggagcacggccccctggacatgagcaacaagatgttcagcgccgagtacgagttcttccccgaggagaccagacagatcctggagaaggccggcggcctgaagcccttcctgctgggctgccccagattcgtggtgatcgacaactgcatcgccctgaagaaggtggccagcagactgaagaagaagagaaagaagaagaacatcaagaccaaggtggaggagatcagcaaggccggcgagtacgtgagagtgaagctgcagctgaaccccgccgccagagagttcaagcccgacgtgaagagcaagcccgtgagcgacagcagcagcgcccccgccttcgagaacgtgaagcccaagcccgtgagcgccaacagccccaagcccgcctgcgaggacgtgaaggccaagcccgtgagcgacaacagcagcagacaggtgagcgaggacggccagcccaagggcgtgagcagcaacagccccaagcccggcagcgaggacgccaactacaagagagtgagctgcaacagccccaagcccgtgctggaggacgtgaagcccacctactgggcccagagccacctggtgaccggctactgcacctacctgcccttccagagattcgacatcacccagaccccccccgcctacatcaacgtgctgcccggcctgccccagtacaccagcatctacacccccctggccagcctgagccccgagtaccagctgcccagaagcgtgcccgtggtgcccagcttcgtggccaacgacagagccgacaagaacgccgccgcctacttcgagggccaccacctgaacgccgagaacgtggccggccaccagatcgccagcgagacccagatcctggagggcagcctgggcatcagcgtgaagagccactgcagcaccggcgacgcccacaccgtgctgagcgagagcaacagaaacgacgagcactgcggcaacagcaacaacaagtgcgaggtgatccccgagagcaccagcgccgtgaccaacatcccccacgtgcagatggtggccatccaggtgagctggaacatcatccaccaggaggtgaacaccgagccctacaaccccttcgaggagagacagggcgagatcagcagaatcgagaaggagcaccaggtgctgcaggaccagctgcaggaggtgtacgagaactacgagcagatcaagctgaagggcctggaggagaccagagacctggaggagaagctgaagagacacctggaggagaacaagatcagcaagaccgagctggactggttcctgcaggacctggagagagagatcaagaagtggcagcaggagaagaaggagatccaggagagactgaagagcctgaagaagaagatcaagaaggtgagcaacgccagcgagatgtacacccagaagaacgacggcaaggagaaggagcacgagctgcacctggaccagagcctggagatcagcaacaccctgaccaacgagaagatgaagatcgaggagtacatcaagaagggcaaggaggactacgaggagagccaccagagagccgtggccgccgaggtgagcgtgctggagaactggaaggagagcgaggtgtacaagctgcagatcatggagagccaggccgaggccttcctgaagaagctgggcctgatcagcagagaccccgccgcctaccccgacatggagagcgacatcagaagctgggagctgttcctgagcaacgtgaccaaggagatcgagaaggccaagagccagttcgaggagcagatcaaggccatcaagaacggcagcagactgagcgagctgagcaaggtgcagatcagcgagctgagcttccccgcctgcaacaccgtgcaccccgagctgctgcccgagagcagcggcgacgacggccagggcctggtgaccagcgccagcgacgtgaccggcaaccacgccgccctgcacagagaccccagcgtgttcagcgccggcgacagccccggcgaggcccccagcgccctgctgcccggccccccccccggccagcccgaggccacccagctgaccggccccaagagagccggccaggccgccctgagcgagagaagccccgtggccgacagaaagcagcccgtgccccccggcagagccgccagaagcagccagagccccaagaagcccttcaacagcatcatcgagcacctgagcgtggtgttcccctgctacaacagcaccgagctggccggcttcatcaagaaggtgagaagcaagaacaagaacagcctgagcggcctgagcatcgacgagatcgtgcagagagtgaccgagcacatcctggacgagcagaagaagaagaagcccaaccccggcaaggacaagagaacctacgagcccagcagcgccacccccgtgaccagaagcagccagggcagccccagcgtggtggtggcccccagccccaagaccaagggccagaaggccgaggacgtgcccgtgagaatcgccctgggcgccagcagctgcgagatctgccacgaggtgttcaagagcaagaacgtgagagtgctgaagtgcggccacaagtaccacaagggctgcttcaagcagtggctgaagggccagagcgcctgccccgcctgccagggcagagacctgctgaccgaggagagccccagcggcagaggctggcccagccagaaccaggagctgcccagctgcagcagcagatag

SEQ ID NO: 102275 - DNA, 6078 bp, Artificial Sequence; identical to SEQ ID NO: 102274
  Description of Artificial Sequence: Synthetic coding sequence

SEQ ID NO: 102276 - DNA, 6078 bp, Artificial Sequence; identical to SEQ ID NO: 102274
  Description of Artificial Sequence: Synthetic coding sequence

SEQ ID NO: 102277 - DNA, 3540 bp, Artificial Sequence
  Description of Artificial Sequence: Synthetic coding sequence
atggacaacttcgccgagggcgacttcaccgtggccgactacgccctgctggaggactgcccccacgtggacgactgcgtgttcgccgccgagttcatgagcaacgactacgtgagagtgacccagctgtactgcgacggcgtgggcgtgcagtacaaggactacatccagagcgagagaaacctggagttcgacatctgcagcatctggtgcagcaagcccatcagcgtgctgcaggactactgcgacgccatcaagatcaacatcttctggcccctgctgttccagcaccagaacagcagcgtgatcagcagactgcacccctgcgtggacgccaacaacagcagagccagcgagatcaacctgaagaagctgcagcacctggagctgatggaggacatcgtggacctggccaagaaggtggccaacgacagcttcctgatcggcggcctgctgagaatcggctgcaagatcgagaacaagatcctggccatggaggaggccctgaactggatcaagtacgccggcgacgtgaccatcctgaccaagctgggcagcatcgacaactgctggcccatgctgagcatcttcttcaccgagtacaagtaccacatcaccaagatcgtgatggaggactgcaacctgctggaggagctgaagacccagagctgcatggactgcatcgaggagggcgagctgatgaagatgaagggcaacgaggagttcagcaaggagagattcgacatcgccatcatctactacaccagagccatcgagtacagacccgagaactacctgctgtacggcaacagagccctgtgcttcctgagaaccggccagttcagaaacgccctgggcgacggcaagagagccaccatcctgaagaacacctggcccaagggccactacagatactgcgacgccctgagcatgctgggcgagtacgactgggccctgcaggccaacatcaaggcccagaagctgtgcaagaacgaccccgagggcatcaaggacctgatccagcagcacgtgaagctgcagaagcagatcgaggacctgcagggcagaaccgccaacaaggaccccatcaaggccttctacgagaacagagcctacacccccagaagcctgagcgcccccatcttcaccaccagcctgaacttcgtggagaaggagagagacttcagaaagatcaaccacgagatggccaacggcggcaaccagaacctgaaggtggccgacgaggccctgaaggtggacgactgcgactgccaccccgagttcagcccccccagcagccagccccccaagcacaagggcaagcagaagagcagaaacaacgagagcgagaagttcagcagcagcagccccctgaccctgcccgccgacctgaagaacatcctggagaagcagttcagcaagagcagcagagccgcccaccaggacttcgccaacatcatgaagatgctgagaagcctgatccaggacggctacatggccctgctggagcagagatgcagaagcgccgcccaggccttcaccgagctgctgaacggcctggacccccagaagatcaagcagctgaacctggccatgatcaactacgtgctggtggtgtacggcctggccatcagcctgctgggcatcggccagcccgaggagctgagcgaggccgagaaccagttcaagagaatcatcgagcactaccccagcgagggcctggactgcctggcctactgcggcatcggcaaggtgtacctgaagaagaacagattcctggaggccctgaaccacttcgagaaggccagaaccctgatctacagactgcccggcgtgctgacctggcccaccagcaacgtgatcatcgaggagagccagccccagaagatcaagatgctgctggagaagttcgtggaggagtgcaagttcccccccgtgcccgacgccatctgctgctaccagaagtgccacggctacagcaagatccagatctacatcaccgaccccgacttcaagggcttcatcagaatcagctgctgccagtactgcaagatcgagttccacatgaactgctggaagaagctgaagaccaccaccttcaacgacaagatcgacaaggacttcctgcagggcatctgcctgacccccgactgcgagggcgtgatcagcaagatcatcatcttcagcagcggcggcgaggtgaagtgcgagttcgagcacaaggtgatcaaggagaaggtgccccccagacccatcctgaagcagaagtgcagcagcctggagaagctgagactgaaggaggacaagaagctgaagagaaagatccagaagaaggaggccaagaagctggcccaggagagaatggaggaggacctgagagagagcaacccccccaagaacgaggagcagaaggagaccgtggacaacgtgcagagatgccagttcctggacgacagaatcctgcagtgcatcaagcagtacgccgacaagatcaagagcggcatccagaacaccgccatgctgctgaaggagctgctgagctggaaggtgctgagcaccgaggactacaccacctgcttcagcagcagaaacttcctgaacgaggccgtggactacgtgatcagacacctgatccaggagaacaacagagtgaagaccagaatcttcctgcacgtgctgagcgagctgaaggaggtggagcccaagctggccgcctggatccagaagctgaacagcttcggcctggacgccaccggcaccttcttcagcagatacggcgccagcctgaagctgctggacttcagcatcatgaccttcctgtggaacgagaagtacggccacaagctggacagcatcgagggcaagcagctggactacttcagcgagcccgccagcctgaaggaggccagatgcctgatctggctgctggaggagcacagagacaagttccccgccctgcacagcgccctggacgagttcttcgacatcatggacagcagatgcaccgtgctgagaaagcaggacagcggcgaggcccccttcagcagcaccaaggtgaagaacaagagcaagaagaagaagcccaaggacagcaagcccatgctggtgggcagcggcaccaccagcgtgaccagcaacaacgagatcatcaccagcagcgaggaccacagcaacagaaacagcgacagcgccggccccttcgccgtgcccgaccacctgagacaggacgtggaggagttcgaggccctgtacgaccagcacagcaacgagtacgtggtgagaaacaagaagctgtgggacatgaaccccaagcagaagtgcagcaccctgtacgactacttcagccagttcctggaggagcacggccccctggacatgagcaacaagatgttcagcgccgagtacgagttcttccccgaggagaccagacagatcctggagaaggccggcggcctgaagcccttcctgctgggctgccccagattcgtggtgatcgacaactgcatcgccctgaagaaggtggccagcagactgaagtag

SEQ ID NO: 102278 - DNA, 2343 bp, Artificial Sequence
  Description of Artificial Sequence: Synthetic coding sequence
atggacaacttcgccgagggcgacttcaccgtggccgactacgccctgctggaggactgcccccacgtggacgactgcgtgttcgccgccgagttcatgagcaacgactacgtgagagtgacccagctgtactgcgacggcgtgggcgtgcagtacaaggactacatccagagcgagagaaacctggagttcgacatctgcagcatctggtgcagcaagcccatcagcgtgctgcaggactactgcgacgccatcaagatcaacatcttctggcccctgctgttccagcaccagaacagcagcgtgatcagcagactgcacccctgcgtggacgccaacaacagcagagccagcgagatcaacctgaagaagctgcagcacctggagctgatggaggacatcgtggacctggccaagaaggtggccaacgacagcttcctgatcggcggcctgctgagaatcggctgcaagatcgagaacaagatcctggccatggaggaggccctgaactggatcaagtacgccggcgacgtgaccatcctgaccaagctgggcagcatcgacaactgctggcccatgctgagcatcttcttcaccgagtacaagtaccacatcaccaagatcgtgatggaggactgcaacctgctggaggagctgaagacccagagctgcatggactgcatcgaggagggcgagctgatgaagatgaagggcaacgaggagttcagcaaggagagattcgacatcgccatcatctactacaccagagccatcgagtacagacccgagaactacctgctgtacggcaacagagccctgtgcttcctgagaaccggccagttcagaaacgccctgggcgacggcaagagagccaccatcctgaagaacacctggcccaagggccactacagatactgcgacgccctgagcatgctgggcgagtacgactgggccctgcaggccaacatcaaggcccagaagctgtgcaagaacgaccccgagggcatcaaggacctgatccagcagcacgtgaagctgcagaagcagatcgaggacctgcagggcagaaccgccaacaaggaccccatcaaggccttctacgagaacagagcctacacccccagaagcctgagcgcccccatcttcaccaccagcctgaacttcgtggagaaggagagagacttcagaaagatcaaccacgagatggccaacggcggcaaccagaacctgaaggtggccgacgaggccctgaaggtggacgactgcgactgccaccccgagttcagcccccccagcagccagccccccaagcacaagggcaagcagaagagcagaaacaacgagagcgagaagttcagcagcagcagccccctgaccctgcccgccgacctgaagaacatcctggagaagcagttcagcaagagcagcagagccgcccaccaggacttcgccaacatcatgaagatgctgagaagcctgatccaggacggctacatggccctgctggagcagagatgcagaagcgccgcccaggccttcaccgagctgctgaacggcctggacccccagaagatcaagcagctgaacctggccatgatcaactacgtgctggtggtgtacggcctggccatcagcctgctgggcatcggccagcccgaggagctgagcgaggccgagaaccagttcaagagaatcatcgagcactaccccagcgagggcctggactgcctggcctactgcggcatcggcaaggtgtacctgaagaagaacagattcctggaggccctgaaccacttcgagaaggccagaaccctgatctacagactgcccggcgtgctgacctggcccaccagcaacgtgatcatcgaggagagccagccccagaagatcaagatgctgctggagaagttcgtggaggagtgcaagttcccccccgtgcccgacgccatctgctgctaccagaagtgccacggctacagcaagatccagatctacatcaccgaccccgacttcaagggcttcatcagaatcagctgctgccagtactgcaagatcgagttccacatgaactgctggaagaagctgaagaccaccaccttcaacgacaagatcgacaaggacttcctgcagggcatctgcctgacccccgactgcgagggcgtgatcagcaagatcatcatcttcagcagcggcggcgaggtgaagtgcgagttcgagcacaaggtgatcaaggagaaggtgccccccagacccatcctgaagcagaagtgcagcagcctggagaagctgagactgaaggaggacaagaagctgaagagaaagatccagaagaaggaggcctag

SEQ ID NO: 102279 - DNA, 1839 bp, Artificial Sequence
  Description of Artificial Sequence: Synthetic coding sequence
atgctgggcgagtacgactgggccctgcaggccaacatcaaggcccagaagctgtgcaagaacgaccccgagggcatcaaggacctgatccagcagcacgtgaagctgcagaagcagatcgaggacctgcagggcagaaccgccaacaaggaccccatcaaggccttctacgagaacagagcctacacccccagaagcctgagcgcccccatcttcaccaccagcctgaacttcgtggagaaggagagagacttcagaaagatcaaccacgagatggccaacggcggcaaccagaacctgaaggtggccgacgaggccctgaaggtggacgactgcgactgccaccccgagttcagcccccccagcagccagccccccaagcacaagggcaagcagaagagcagaaacaacgagagcgagaagttcagcagcagcagccccctgaccctgcccgccgacctgaagaacatcctggagaagcagttcagcaagagcagcagagccgcccaccaggacttcgccaacatcatgaagatgctgagaagcctgatccaggacggctacatggccctgctggagcagagatgcagaagcgccgcccaggccttcaccgagctgctgaacggcctggacccccagaagatcaagcagctgaacctggccatgatcaactacgtgctggtggtgtacggcctggccatcagcctgctgggcatcggccagcccgaggagctgagcgaggccgagaaccagttcaagagaatcatcgagcactaccccagcgagggcctggactgcctggcctactgcggcatcggcaaggtgtacctgaagaagaacagattcctggaggccctgaaccacttcgagaaggccagaaccctgatctacagactgcccggcgtgctgacctggcccaccagcaacgtgatcatcgaggagagccagccccagaagatcaagatgctgctggagaagttcgtggaggagtgcaagttcccccccgtgcccgacgccatctgctgctaccagaagtgccacggctacagcaagatccagatctacatcaccgaccccgacttcaagggcttcatcagaatcagctgctgccagtactgcaagatcgagttccacatgaactgctggaagaagctgaagaccaccaccttcaacgacaagatcgacaaggacttcctgcagggcatctgcctgacccccgactgcgagggcgtgatcagcaagatcatcatcttcagcagcggcggcgaggtgaagtgcgagttcgagcacaaggtgatcaaggagaaggtgccccccagacccatcctgaagcagaagtgcagcagcctggagaagctgagactgaaggaggacaagaagctgaagagaaagatccagaagaaggaggccaagaagctggcccaggagagaatggaggaggacctgagagagagcaacccccccaagaacgaggagcagaaggagaccgtggacaacgtgcagagatgccagttcctggacgacagaatcctgcagtgcatcaagcagtacgccgacaagatcaagagcggcatccagaacaccgccatgctgctgaaggagctgctgagctggaaggtgctgagcaccgaggactacaccacctgcttcagcagcagaaacttcctgaacgaggccgtggactacgtgatcagacacctgatccaggagaacaacagagtgaagaccagaatcttcctgcacgtgctgagcgagctgaaggaggtggagcccaagctggccgcctggatccagaagctgaacagcttcggcatgagcctgtacatccccgagcagtag

SEQ ID NO: 102280 - DNA, 1842 bp, Artificial Sequence
  Description of Artificial Sequence: Synthetic coding sequence
atggacgccgtgctggcctgcagactgagaggcagaggcaacagagtggccgccctgagacccagacccagacccggcggcagcgccggccccagccccttcgccctgctgtgcgccggcctgagccccgagcccagagccggcgtgggcagcgagttccccgcctggttcctgggcggcagcagccagagaagaaacatggccctgctgggcagcagagccgagctggaggccgacgaggacgtgttcgaggacgccctggagaccatcagcatggccaaggagagcatgtaccacgccctgggctacagcaccatcgtggtgctgcaggccgtgctgaccttcgagcagcaggacatccagaacggcatcagcgccatgaaggacgccctgcagacctgccagaagtacagaaagaagtacaccgtggtggagagcttcagcagcctgctgagcagaggcagcctggagcagctgagcgaggaggagatgcacgccgagatctgctacgccgagtgcctgctgcagaaggccgccctgaccttcgtgcaggacgagaacatgatcaacttcatcaagggcggcctgaagatcagaaccagctaccagatctacaaggagtgcctgagcatcctgcacgagatccagaagaacaagctgcagcaggagttcttctacgagttcgagggcggcgtgaagctgggcagcggcgccttcaacctgatgctgagcctgctgcccgccagaatcatcagactgctggagttcatcggcttcagcggcaacagagagctgggcctgctgcagctgagagagggcgccagcggcagaagcatgagaagcgccctgtgctgcctgaccatcctggccttccacacctacatcagcctgatcctgggcaccggcgaggtgaacgtggccgaggccgagagactgctggcccccttcctgcagcagttccccaacggcagcctggtgctgttctaccacgccagaatcgagctgctgaagggcaacctggaggaggcccaggaggtgttccagaagtgcatcagcgtgcaggaggagtggaagcagttccaccacctgtgctactgggagctgatgtggatcaacgtgttccagcagaactggatgcaggcctactactacagcgacctgctgtgcaaggagagcaagtggagcaaggccacctacgtgttcctgaaggccgccatcctgagcatgctgcccgaggaggacgtggtggccaccaacgagaacgtggtgaccctgttcagacaggtggacagcctgaagcagagaatcgccggcaagagcatccccaccgagaagttcgccgtgagaaaggccagaagatacagcgccagcctgcccgcccccgtgaagctgatcctgcccgccctggagatgatgtacgtgtggaacggcttcagcatcgtgagcaagagaaaggacctgagcgagaacctgctggtgaccgtggagaaggccgaggccgccctgcagagccagaacttcaacagcttcagcgtggacgacgagtgcctggtgaagctgctgaagggctgctgcctgaagaacctgcagagacccctgcaggccgagctgtgctacaaccacgtggtggagagcgagaagctgctgaagtacgaccactacctggtgcccttcaccctgttcgagctggccagcctgtacaagagccagggcgagatcgacaaggccatcaagttcctggagaccgccagaaacaactacaaggactacagcctggagagcagactgcacttcagaatccaggccgccctgcacctgtggagaaagcccagcagcgactag

SEQ ID NO: 102281 - DNA, 1851 bp, Artificial Sequence
  Description of Artificial Sequence: Synthetic coding sequence
atggccctgctgggcagcagagccgagctggaggccgacgaggacgtgttcgaggacgccctggagaccatcagcatcagcagccacagcgacatggccaccagcagcctgcacttcgccagctgcgacacccagcaggcccccagacagagaggcgccagcaccgtgagcagcagcagcagcaccaaggtggacctgaagagcggcctggaggagtgcgccgtggccctgaacctgttcctgagcaacaagttcaccgacgccctggagctgctgagaccctgggccaaggagagcatgtaccacgccctgggctacagcaccatcgtggtgctgcaggccgtgctgaccttcgagcagcaggacatccagaacggcatcagcgccatgaaggacgccctgcagacctgccagaagtacagaaagaagtacaccgtggtggagagcttcagcagcctgctgagcagaggcagcctggagcagctgagcgaggaggagatgcacgccgagatctgctacgccgagtgcctgctgcagaaggccgccctgaccttcgtgcaggacgagaacatgatcaacttcatcaagggcggcctgaagatcagaaccagctaccagatctacaaggagtgcctgagcatcctgcacgagatccagaagaacaagctgcagcaggagttcttctacgagttcgagggcggcgtgaagctgggcagcggcgccttcaacctgatgctgagcctgctgcccgccagaatcatcagactgctggagttcatcggcttcagcggcaacagagagctgggcctgctgcagctgagagagggcgccagcggcagaagcatgagaagcgccctgtgctgcctgaccatcctggccttccacacctacatcagcctgatcctgggcaccggcgaggtgaacgtggccgaggccgagagactgctggcccccttcctgcagcagttccccaacggcagcctggtgctgttctaccacgccagaatcgagctgctgaagggcaacctggaggaggcccaggaggtgttccagaagtgcatcagcgtgcaggaggagtggaagcagttccaccacctgtgctactgggagctgatgtggatcaacgtgttccagcagaactggatgcaggcctactactacagcgacctgctgtgcaaggagagcaagtggagcaaggccacctacgtgttcctgaaggccgccatcctgagcatgctgcccgaggaggacgtggtggccaccaacgagaacgtggtgaccctgttcagacaggtggacagcctgaagcagagaatcgccggcaagagcatccccaccgagaagttcgccgtgagaaaggccagaagatacagcgccagcctgcccgcccccgtgaagctgatcctgcccgccctggagatgatgtacgtgtggaacggcttcagcatcgtgagcaagagaaaggacctgagcgagaacctgctggtgaccgtggagaaggccgaggccgccctgcagagccagaacttcaacagcttcagcgtggacgacgagtgcctggtgaagctgctgaagggctgctgcctgaagaacctgcagagacccctgcaggccgagctgtgctacaaccacgtggtggagagcgagaagctgctgaagtacgaccactacctggtgcccttcaccctgttcgagctggccagcctgtacaagagccagggcgagatcgacaaggccatcaagttcctggagaccgccagaaacaactacaaggactacagcctggagagcagactgcacttcagaatccaggccgccctgcacctgtggagaaagcccagcagcgactag

SEQ ID NO: 102282 - DNA, 2010 bp, Artificial Sequence
  Description of Artificial Sequence: Synthetic coding sequence
atggacgccgtgctggcctgcagactgagaggcagaggcaacagagtggccgccctgagacccagacccagacccggcggcagcgccggccccagccccttcgccctgctgtgcgccggcctgagccccgagcccagagccggcgtgggcagcgagttccccgcctggttcctgggcggcagcagccagagaagaaacatggccctgctgggcagcagagccgagctggaggccgacgaggacgtgttcgaggacgccctggagaccatcagcatcagcagccacagcgacatggccaccagcagcctgcacttcgccagctgcgacacccagcaggcccccagacagagaggcgccagcaccgtgagcagcagcagcagcaccaaggtggacctgaagagcggcctggaggagtgcgccgtggccctgaacctgttcctgagcaacaagttcaccgacgccctggagctgctgagaccctgggccaaggagagcatgtaccacgccctgggctacagcaccatcgtggtgctgcaggccgtgctgaccttcgagcagcaggacatccagaacggcatcagcgccatgaaggacgccctgcagacctgccagaagtacagaaagaagtacaccgtggtggagagcttcagcagcctgctgagcagaggcagcctggagcagctgagcgaggaggagatgcacgccgagatctgctacgccgagtgcctgctgcagaaggccgccctgaccttcgtgcaggacgagaacatgatcaacttcatcaagggcggcctgaagatcagaaccagctaccagatctacaaggagtgcctgagcatcctgcacgagatccagaagaacaagctgcagcaggagttcttctacgagttcgagggcggcgtgaagctgggcagcggcgccttcaacctgatgctgagcctgctgcccgccagaatcatcagactgctggagttcatcggcttcagcggcaacagagagctgggcctgctgcagctgagagagggcgccagcggcagaagcatgagaagcgccctgtgctgcctgaccatcctggccttccacacctacatcagcctgatcctgggcaccggcgaggtgaacgtggccgaggccgagagactgctggcccccttcctgcagcagttccccaacgtgagaagcgtgttccagagcgcccaggaggtgttccagaagtgcatcagcgtgcaggaggagtggaagcagttccaccacctgtgctactgggagctgatgtggatcaacgtgttccagcagaactggatgcaggcctactactacagcgacctgctgtgcaaggagagcaagtggagcaaggccacctacgtgttcctgaaggccgccatcctgagcatgctgcccgaggaggacgtggtggccaccaacgagaacgtggtgaccctgttcagacaggtggacagcctgaagcagagaatcgccggcaagagcatccccaccgagaagttcgccgtgagaaaggccagaagatacagcgccagcctgcccgcccccgtgaagctgatcctgcccgccctggagatgatgtacgtgtggaacggcttcagcatcgtgagcaagagaaaggacctgagcgagaacctgctggtgaccgtggagaaggccgaggccgccctgcagagccagaacttcaacagcttcagcgtggacgacgagtgcctggtgaagctgctgaagggctgctgcctgaagaacctgcagagacccctgcaggccgagctgtgctacaaccacgtggtggagagcgagaagctgctgaagtacgaccactacctggtgcccttcaccctgttcgagctggccagcctgtacaagagccagggcgagatcgacaaggccatcaagttcctggagaccgccagaaacaactacaaggactacagcctggagagcagactgcacttcagaatccaggccgccctgcacctgtggagaaagcccagcagcgactag

SEQ ID NO: 102283 - DNA, 2049 bp, Artificial Sequence
  Description of Artificial Sequence: Synthetic coding sequence
atggacgccgtgctggcctgcagactgagaggcagaggcaacagagtggccgccctgagacccagacccagacccggcggcagcgccggccccagccccttcgccctgctgtgcgccggcctgagccccgagcccagagccggcgtgggcagcgagttccccgcctggttcctgggcggcagcagccagagaagaaacatggccctgctgggcagcagagccgagctggaggccgacgaggacgtgttcgaggacgccctggagaccatcagcatcagcagccacagcgacatggccaccagcagcctgcacttcgccagctgcgacacccagcaggcccccagacagagaggcgccagcaccgtgagcagcagcagcagcaccaaggtggacctgaagagcggcctggaggagtgcgccgtggccctgaacctgttcctgagcaacaagttcaccgacgccctggagctgctgagaccctgggccaaggagagcatgtaccacgccctgggctacagcaccatcgtggtgctgcaggccgtgctgaccttcgagcagcaggacatccagaacggcatcagcgccatgaaggacgccctgcagacctgccagaagtacagaaagaagtacaccgtggtggagagcttcagcagcctgctgagcagaggcagcctggagcagctgagcgaggaggagatgcacgccgagatctgctacgccgagtgcctgctgcagaaggccgccctgaccttcgtgcaggacgagaacatgatcaacttcatcaagggcggcctgaagatcagaaccagctaccagatctacaaggagtgcctgagcatcctgcacgagatccagaagaacaagctgcagcaggagttcttctacgagttcgagggcggcgtgaagctgggcagcggcgccttcaacctgatgctgagcctgctgcccgccagaatcatcagactgctggagttcatcggcttcagcggcaacagagagctgggcctgctgcagctgagagagggcgccagcggcagaagcatgagaagcgccctgtgctgcctgaccatcctggccttccacacctacatcagcctgatcctgggcaccggcgaggtgaacgtggccgaggccgagagactgctggcccccttcctgcagcagttccccaacggcagcctggtgctgttctaccacgccagaatcgagctgctgaagggcaacctggaggaggcccaggaggtgttccagaagtgcatcagcgtgcaggaggagtggaagcagttccaccacctgtgctactgggagctgatgtggatcaacgtgttccagcagaactggatgcaggcctactactacagcgacctgctgtgcaaggagagcaagtggagcaaggccacctacgtgttcctgaaggccgccatcctgagcatgctgcccgaggaggacgtggtggccaccaacgagaacgtggtgaccctgttcagacaggtggacagcctgaagcagagaatcgccggcaagagcatccccaccgagaagttcgccgtgagaaaggccagaagatacagcgccagcctgcccgcccccgtgaagctgatcctgcccgccctggagatgatgtacgtgtggaacggcttcagcatcgtgagcaagagaaaggacctgagcgagaacctgctggtgaccgtggagaaggccgaggccgccctgcagagccagaacttcaacagcttcagcgtggacgacgagtgcctggtgaagctgctgaagggctgctgcctgaagaacctgcagagacccctgcaggccgagctgtgctacaaccacgtggtggagagcgagaagctgctgaagtacgaccactacctggtgcccttcaccctgttcgagctggccagcctgtacaagagccagggcgagatcgacaaggccatcaagttcctggagaccgccagaaacaactacaaggactacagcctggagagcagactgcacttcagaatccaggccgccctgcacctgtggagaaagcccagcagcgactag

SEQ ID NO: 102284 - DNA, 585 bp, Artificial Sequence
  Description of Artificial Sequence: Synthetic coding sequence
atggccctgctgggcagcagagccgagctggaggccgacgaggacgtgttcgaggacgccctggagaccatcagcatcagcagccacagcgacatggccaccagcagcctgcacttcgccagctgcgacacccagcaggcccccagacagagaggcgccagcaccgtgagcagcagcagcagcaccaaggtggacctgaagagcggcctggaggagtgcgccgtggccctgaacctgttcctgagcaacaagttcaccgacgccctggagctgctgagaccctgggccaaggagagcatgtaccacgccctgggctacagcaccatcgtggtgctgcaggccgtgctgaccttcgagcagcaggacatccagaacggcatcagcgccatgaaggacgccctgcagacctgccagaagtacagaaagaagtacaccgtggtggagagcttcagcagcctgctgagcagaggcagcctggagcagctgagcgaggaggagatgcacgccgagatctgctacgccgagtgcctgctgcagaaggccgccctgaccttcgtgcagagaatgagcttctaccccgcctag

SEQ ID NO: 102285 - DNA, 1164 bp, Artificial Sequence
  Description of Artificial Sequence: Synthetic coding sequence
atggagcagcccggccaggaccccaccagcgacgacgtgatggacagcttcctggagaagttccagagccagccctacagaggcggcttccacgaggaccagtgggagaaggagttcgagaaggtgcccctgttcatgagcagagcccccagcgagatcgaccccagagagaaccccgacctggcctgcctgcagagcatcatcttcgacgaggagagaagccccgaggagcaggccaagacctacaaggacgagggcaacgactacttcaaggagaaggactacaagaaggccgtgatcagctacaccgagggcctgaagaagaagtgcgccgaccccgacctgaacgccgtgctgtacaccaacagagccgccgcccagtactacctgggcaacttcagaagcgccctgaacgacgtgaccgccgccagaaagctgaagccctgccacctgaaggccatcatcagaggcgccctgtgccacctggagctgaagcacttcgccgaggccgtgaactggtgcgacgagggcctgcagatcgacgccaaggagaagaagctgctggagatgagagccaaggccgacaagctgaagagaatcgagcagagagacgtgagaaaggccaacctgaaggagaagaaggagagaaaccagaacgaggccctgctgcaggccatcaaggccagaaacatcagactgagcgaggccgcctgcgaggacgaggacagcgccagcgagggcctgggcgagctgttcctggacggcctgagcaccgagaacccccacggcgccagactgagcctggacggccagggcagactgagctggcccgtgctgttcctgtaccccgagtacgcccagagcgacttcatcagcgccttccacgaggacagcagattcatcgaccacctgatggtgatgttcggcgagacccccagctgggacctggagcagaagtactgccccgacaacctggaggtgtacttcgaggacgaggacagagccgagctgtacagagtgcccgccaagagcaccctgctgcaggtgctgcagcaccagagatacttcgtgaaggccctgacccccgccttcctggtgtgcgtgggcagcagccccttctgcaagaacttcctgagaggcagaaaggtgtaccagatcagatag

SEQ ID NO: 102286 - DNA, 1515 bp, Artificial Sequence
  Description of Artificial Sequence: Synthetic coding sequence
atggccaccagagacgtggtgctgagcagagtgcccgagcaggaggaggacagaaccgtgagcctgcagaacgccgccgccatctacgacctgctgagcatcaccctgggcagaagaggccagtacgtgatgctgagcgagtgcctggagagagccatgaagttcgccttcggcgagttccacctgtggtaccaggtggccctgagcatggtggcctgcggcaagagcgcctacgccgtgagcctgctgagagagtgcgtgaagctgagacccagcgaccccaccgtgcccctgatggccgccaaggtgtgcatcggcagcctgagatggctggaggaggccgagcacttcgccatgatggtgatcagcctgggcgaggaggccggcgagttcctgcccaagggctacctggccctgggcctgacctacagcctgcaggccaccgacgccaccctgaagagcaagcaggacgagctgcacagaaaggccctgcagaccctggagagagcccagcagctggcccccagcgacccccaggtgatcctgtacgtgagcctgcagctggccctggtgagacagatcagcagcgccatggagcagctgcaggaggccctgaaggtgagaaaggacgacgcccacgccctgcacctgctggccctgctgttcagcgcccagaagcaccaccagcacgccctggacgtggtgaacatggccatcaccgagcaccccgagaacttcaacctgatgttcaccaaggtgaagctggagcaggtgctgaagggccccgaggaggccctggtgacctgcagacaggtgctgagactgtggcagaccctgtacagcttcagccagctgggcggcctggagaaggacggcagcttcggcgagggcctgaccatgaagaagcagagcggcatgcacctgaccctgcccgacgcccacgacgccgacagcggcagcagaagagccagcagcatcgccgccagcagactggaggaggccatgagcgagctgaccatgcccagcagcgtgctgaagcagggccccatgcagctgtggaccaccctggagcagatctggctgcaggccgccgagctgttcatggagcagcagcacctgaaggaggccggcttctgcatccaggaggccgccggcctgttccccaccagccacagcgtgctgtacatgagaggcagactggccgaggtgaagggcaacctggaggaggccaagcagctgtacaaggaggccctgaccgtgaaccccgacggcgtgagaatcatgcacagcctgggcctgatgctgagcagactgggccacaagagcctggcccagaaggtgctgagagacgccgtggagagacagagcacctgccacgaggcctggcagggcctgggcgaggtgctgcaggcccagggccagaacgaggccgccgtggactgcttcctgaccgccctggagctggaggccagcagccccgtgctgcccttcagcatcatccccagagagctgtag

SEQ ID NO: 102287 - DNA, 2577 bp, Artificial Sequence
  Description of Artificial Sequence: Synthetic coding sequence
atggccgccaagggcgcccacggcagctacctgaaggtggagagcgagctggagagatgcagagccgagggccactgggacagaatgcccgagctggtgagacagctgcagaccctgagcatgcccggcggcggcggcaacagaagaggcagccccagcgccgccttcaccttccccgacaccgacgacttcggcaagctgctgctggccgaggccctgctggagcagtgcctgaaggagaaccacgccaagatcaaggacagcatgcccctgctggagaagaacgagcccaagatgagcgaggccaagaactacctgagcagcatcctgaaccacggcagactgagcccccagtacatgtgcgaggccatgctgatcctgggcaagctgcactacgtggagggcagctacagagacgccatcagcatgtacgccagagccggcatcgacgacatgagcatggagaacaagcccctgtaccagatgagactgctgagcgaggccttcgtgatcaagggcctgagcctggagagactgcccaacagcatcgccagcagattcagactgaccgagagagaggaggaggtgatcacctgcttcgagagagccagctggatcgcccaggtgttcctgcaggagctggagaagaccaccaacaacagcaccagcagacacctgaagggctgccaccccctggactacgagctgacctacttcctggaggccgccctgcagagcgcctacgtgaagaacctgaagaagggcaacatcgtgaagggcatgagagagctgagagaggtgctgagaaccgtggagaccaaggccacccagaacttcaaggtgatggccgccaagcacctggccggcgtgctgctgcacagcctgagcgaggagtgctactggagccccctgagccaccccctgcccgagttcatgggcaaggaggagagcagcttcgccacccaggccctgagaaagccccacctgtacgagggcgacaacctgtactgccccaaggacaacatcgaggaggccctgctgctgctgctgatcagcgagagcatggccaccagagacgtggtgctgagcagagtgcccgagcaggaggaggacagaaccgtgagcctgcagaacgccgccgccatctacgacctgctgagcatcaccctgggcagaagaggccagtacgtgatgctgagcgagtgcctggagagagccatgaagttcgccttcggcgagttccacctgtggtaccaggtggccctgagcatggtggcctgcggcaagagcgcctacgccgtgagcctgctgagagagtgcgtgaagctgagacccagcgaccccaccgtgcccctgatggccgccaaggtgtgcatcggcagcctgagatggctggaggaggccgagcacttcgccatgatggtgatcagcctgggcgaggaggccggcgagttcctgcccaagggctacctggccctgggcctgacctacagcctgcaggccaccgacgccaccctgaagagcaagcaggacgagctgcacagaaaggccctgcagaccctggagagagcccagcagctggcccccagcgacccccaggtgatcctgtacgtgagcctgcagctggccctggtgagacagatcagcagcgccatggagcagctgcaggaggccctgaaggtgagaaaggacgacgcccacgccctgcacctgctggccctgctgttcagcgcccagaagcaccaccagcacgccctggacgtggtgaacatggccatcaccgagcaccccgagaacttcaacctgatgttcaccaaggtgaagctggagcaggtgctgaagggccccgaggaggccctggtgacctgcagacaggtgctgagactgtggcagaccctgtacagcttcagccagctgggcggcctggagaaggacggcagcttcggcgagggcctgaccatgaagaagcagagcggcatgcacctgaccctgcccgacgcccacgacgccgacagcggcagcagaagagccagcagcatcgccgccagcagactggaggaggccatgagcgagctgaccatgcccagcagcgtgctgaagcagggccccatgcagctgtggaccaccctggagcagatctggctgcaggccgccgagctgttcatggagcagcagcacctgaaggaggccggcttctgcatccaggaggccgccggcctgttccccaccagccacagcgtgctgtacatgagaggcagactggccgaggtgaagggcaacctggaggaggccaagcagctgtacaaggaggccctgaccgtgaaccccgacggcgtgagaatcatgcacagcctgggcctgatgctgagcagactgggccacaagagcctggcccagaaggtgctgagagacgccgtggagagacagagcacctgccacgaggcctggcagggcctgggcgaggtgctgcaggcccagggccagaacgaggccgccgtggactgcttcctgaccgccctggagctggaggccagcagccccgtgctgcccttcagcatcatccccagagagctgtag

SEQ ID NO: 102288 - DNA, 2058 bp, Artificial Sequence
  Description of Artificial Sequence: Synthetic coding sequence
aagaagaagatcaacttcttcaagaagccccacagcctgagcctgagaaagaagagagaggaggaggtgatcacctgcttcgagagagccagctggatcgcccaggtgttcctgcaggagctggagaagaccaccaacaacagcaccagcagacacctgaagggctgccaccccctggactacgagctgacctacttcctggaggccgccctgcagagcgcctacgtgaagaacctgaagaagggcaacatcgtgaagggcatgagagagctgagagaggtgctgagaaccgtggagaccaaggccacccagaacttcaaggtgatggccgccaagcacctggccggcgtgctgctgcacagcctgagcgaggagtgctactggagccccctgagccaccccctgcccgagttcatgggcaaggaggagagcagcttcgccacccaggccctgagaaagccccacctgtacgagggcgacaacctgtactgccccaaggacaacatcgaggaggccctgctgctgctgctgatcagcgagagcatggccaccagagacgtggtgctgagcagagtgcccgagcaggaggaggacagaaccgtgagcctgcagaacgccgccgccatctacgacctgctgagcatcaccctgggcagaagaggccagtacgtgatgctgagcgagtgcctggagagagccatgaagttcgccttcggcgagttccacctgtggtaccaggtggccctgagcatggtggcctgcggcaagagcgcctacgccgtgagcctgctgagagagtgcgtgaagctgagacccagcgaccccaccgtgcccctgatggccgccaaggtgtgcatcggcagcctgagatggctggaggaggccgagcacttcgccatgatggtgatcagcctgggcgaggaggccggcgagttcctgcccaagggctacctggccctgggcctgacctacagcctgcaggccaccgacgccaccctgaagagcaagcaggacgagctgcacagaaaggccctgcagaccctggagagagcccagcagctggcccccagcgacccccaggtgatcctgtacgtgagcctgcagctggccctggtgagacagatcagcagcgccatggagcagctgcaggaggccctgaaggtgagaaaggacgacgcccacgccctgcacctgctggccctgctgttcagcgcccagaagcaccaccagcacgccctggacgtggtgaacatggccatcaccgagcaccccgagaacttcaacctgatgttcaccaaggtgaagctggagcaggtgctgaagggccccgaggaggccctggtgacctgcagacaggtgctgagactgtggcagaccctgtacagcttcagccagctgggcggcctggagaaggacggcagcttcggcgagggcctgaccatgaagaagcagagcggcatgcacctgaccctgcccgacgcccacgacgccgacagcggcagcagaagagccagcagcatcgccgccagcagactggaggaggccatgagcgagctgaccatgcccagcagcgtgctgaagcagggccccatgcagctgtggaccaccctggagcagatctggctgcaggccgccgagctgttcatggagcagcagcacctgaaggaggccggcttctgcatccaggaggccgccggcctgttccccaccagccacagcgtgctgtacatgagaggcagactggccgaggtgaagggcaacctggaggaggccaagcagctgtacaaggaggccctgaccgtgaaccccgacggcgtgagaatcatgcacagcctgggcctgatgctgagcagactgggccacaagagcctggcccagaaggtgctgagagacgccgtggagagacagagcacctgccacgaggcctggcagggcctgggcgaggtgctgcaggcccagggccagaacgaggccgccgtggactgcttcctgaccgccctggagctggaggccagcagccccgtgctgcccttcagcatcatccccagagagctgtag

SEQ ID NO: 102289 - DNA, 441 bp, Artificial Sequence
  Description of Artificial Sequence: Synthetic coding sequence
atggccgccaagggcgcccacggcagctacctgaaggtggagagcgagctggagagatgcagagccgagggccactgggacagaatgcccgagctggtgagacagctgcagaccctgagcatgcccggcggcggcggcaacagaagaggcagccccagcgccgccttcaccttccccgacaccgacgacttcggcaagctgctgctggccgaggccctgctggagcagtgcctgaaggagaaccacgccaagatcaaggacagcatgcccctgctggagaagaacgagcccaagatgagcgaggccaagaactacctgagcagcatcctgaaccacggcagactgagcggcctggccgtgctgctgagactggtgagcaacagctgggcccaggccatcctgctgctgcagccccccgaggccctgggcctgcaggagtag

SEQ ID NO: 102290 - DNA, 1596 bp, Artificial Sequence
  Description of Artificial Sequence: Synthetic coding sequence
atgagcagcgagatggagcccctgctgctggcctggagctacttcagaagaagaaagttccagctgtgcgccgacctgtgcacccagatgctggagaagagcccctacgaccaggccgcctggatcctgaaggccagagccctgaccgagatggtgtacatcgacgagatcgacgtggaccaggagggcatcgccgagatgatgctggacgagaacgccatcgcccaggtgcccagacccggcaccagcctgaagctgcccggcaccaaccagaccggcggccccagccaggccgtgagacccatcacccaggccggcagacccatcaccggcttcctgagacccagcacccagagcggcagacccggcaccatggagcaggccatcagaacccccagaaccgcctacaccgccagacccatcaccagcagcagcggcagattcgtgagactgggcaccgccagcatgctgaccagccccgacggccccttcatcaacctgagcagactgaacctgaccaagtacagccagaagcccaagctggccaaggccctgttcgagtacatcttccaccacgagaacgacgtgaagaccatccacctggaggacgtggtgctgcacctgggcatctaccccttcctgctgagaaacaagaaccacatcgagaagaacgccctggacctggccgccctgagcaccgagcacagccagtacaaggactggtggtggaaggtgcagatcggcaagtgctactacagactgggcatgtacagagaggccgagaagcagttcaagagcgccctgaagcagcaggagatggtggacaccttcctgtacctggccaaggtgtacgtgagcctggaccagcccgtgaccgccctgaacctgttcaagcagggcctggacaagttccccggcgaggtgaccctgctgtgcggcatcgccagaatctacgaggagatgaacaacatgagcagcgccgccgagtactacaaggaggtgctgaagcaggacaacacccacgtggaggccatcgcctgcatcggcagcaaccacttctacagcgaccagcccgagatcgccctgagattctacagaagactgctgcagatgggcatctacaacggccagctgttcaacaacctgggcctgtgctgcttctacgcccagcagtacgacatgaccctgaccagcttcgagagagccctgagcctggccgagaacgaggaggaggccgccgacgtgtggtacaacctgggccacgtggccgtgggcatcggcgacaccaacctggcccaccagtgcttcagactggccctggtgaacaacaacaaccacgccgaggcctacaacaacctggccgtgctggagatgagaaagggccacgtggagcaggccagagccctgctgcagaccgccagcagcctggccccccacatgtacgagccccacttcaacttcgccaccatcagcgacaagatcggcgacctgcagagaagctacgtggccgcccagaagagcgaggccgccttccccgaccacgtggacacccagcacctgatcaagcagctgagacagcacttcgccatgctgtag

SEQ ID NO: 102291 - DNA, 636 bp, Artificial Sequence
  Description of Artificial Sequence: Synthetic coding sequence
atgagcagcgagatggagcccctgctgctggcctggagctacttcagaagaagaaagttccagctgtgcgccgacctgtgcacccagatgctggagaagagcccctacgaccagaagatcagctgggcctggtggcacgtgcccgtgatccccgccacctgggaggccgaggccggcgagctgctggagcccagaaagagaagactgcagcaggccgagatcacccccctgtacagcagcctgggcaacaagagcaagacccccagccagaaggccgcctggatcctgaaggccagagccctgaccgagatggtgtacatcgacgagatcgacgtggaccaggagggcatcgccgagatgatgctggacgagaacgccatcgcccaggtgcccagacccggcaccagcctgaagctgcccggcaccaaccagaccggcggccccagccaggccgccaaccacaccagctggaagacccactacagattcccccaggcccagcacgccgagtggaaggccagacactacggcaccggctaccagaacacccagaacagactgcacagccccccctaccaccagctgctgagaaagatctgccaggccggcaacggcttccacgcctacaagagctag

SEQ ID NO: 102292 - DNA, 1518 bp, Artificial Sequence
  Description of Artificial Sequence: Synthetic coding sequence
atgagcagcgagatggagcccctgctgctggcctggagctacttcagaagaagaaagttccagctgtgcgccgacctgtgcacccagatgctggagaagagcccctacgaccaggccgcctggatcctgaaggccagagccctgaccgagatggtgtacatcgacgagatcgacgtggaccaggagggcatcgccgagatgatgctggacgagaacgccatcgcccaggtgcccagacccggcaccagcctgaagctgcccggcaccaaccagaccggcggccccagccaggccgtgagacccatcacccaggccggcagacccatcaccggcttcctgagacccagcacccagagcggcagacccggcaccatggagcaggccatcagaacccccagaaccgcctacaccgccagacccatcaccagcagcagcggcagattcgtgagactgggcaccgccagcatgctgaccagccccgacggccccttcatcaacctgagcagactgaacctgaccaagtacagccagaagcccaagctggccaaggccctgttcgagtacatcttccaccacgagaacgacgtgaagaccgccctggacctggccgccctgagcaccgagcacagccagtacaaggactggtggtggaaggtgcagatcggcaagtgctactacagactgggcatgtacagagaggccgagaagcagttcaagagcgccctgaagcagcaggagatggtggacaccttcctgtacctggccaaggtgtacgtgagcctggaccagcccgtgaccgccctgaacctgttcaagcagggcctggacaagttccccggcgaggtgaccctgctgtgcggcatcgccagaatctacgaggagatgaacaacatgagcagcgccgccgagtactacaaggaggtgctgaagcaggacaacacccacgtggaggccatcgcctgcatcggcagcaaccacttctacagcgaccagcccgagatcgccctgagattctacagaagactgctgcagatgggcatctacaacggccagctgttcaacaacctgggcctgtgctgcttctacgcccagcagtacgacatgaccctgaccagcttcgagagagccctgagcctggccgagaacgaggaggaggccgccgacgtgtggtacaacctgggccacgtggccgtgggcatcggcgacaccaacctggcccaccagtgcttcagactggccctggtgaacaacaacaaccacgccgaggcctacaacaacctggccgtgctggagatgagaaagggccacgtggagcaggccagagccctgctgcagaccgccagcagcctggccccccacatgtacgagccccacttcaacttcgccaccatcagcgacaagatcggcgacctgcagagaagctacgtggccgcccagaagagcgaggccgccttccccgaccacgtggacacccagcacctgatcaagcagctgagacagcacttcgccatgctgtag

SEQ ID NO: 102293 - DNA, 1428 bp, Artificial Sequence
  Description of Artificial Sequence: Synthetic coding sequence
atgagcagcgagatggagcccctgctgctggcctggagctacttcagaagaagaaagttccagctgtgcgccgacctgtgcacccagatgctggagaagagcccctacgaccaggccgcctggatcctgaaggccagagccctgaccgagatggtgtacatcgacgagatcgacgtggaccaggagggcatcgccgagatgatgctggacgagaacgccatcgcccaggtgcccagacccggcaccagcctgaagctgcccggcaccaaccagaccggcggccccagccaggccgtgagacccatcacccaggccggcagacccatcaccggcttcctgagacccagcacccagagcggcagacccggcaccatggagcaggccatcagaacccccagaaccgcctacaccgccagacccatcaccagcagcagcggcagattcgtgagactgggcaccgccctgttcgagtacatcttccaccacgagaacgacgtgaagaccgccctggacctggccgccctgagcaccgagcacagccagtacaaggactggtggtggaaggtgcagatcggcaagtgctactacagactgggcatgtacagagaggccgagaagcagttcaagagcgccctgaagcagcaggagatggtggacaccttcctgtacctggccaaggtgtacgtgagcctggaccagcccgtgaccgccctgaacctgttcaagcagggcctggacaagttccccggcgaggtgaccctgctgtgcggcatcgccagaatctacgaggagatgaacaacatgagcagcgccgccgagtactacaaggaggtgctgaagcaggacaacacccacgtggaggccatcgcctgcatcggcagcaaccacttctacagcgaccagcccgagatcgccctgagattctacagaagactgctgcagatgggcatctacaacggccagctgttcaacaacctgggcctgtgctgcttctacgcccagcagtacgacatgaccctgaccagcttcgagagagccctgagcctggccgagaacgaggaggaggccgccgacgtgtggtacaacctgggccacgtggccgtgggcatcggcgacaccaacctggcccaccagtgcttcagactggccctggtgaacaacaacaaccacgccgaggcctacaacaacctggccgtgctggagatgagaaagggccacgtggagcaggccagagccctgctgcagaccgccagcagcctggccccccacatgtacgagccccacttcaacttcgccaccatcagcgacaagatcggcgacctgcagagaagctacgtggccgcccagaagagcgaggccgccttccccgaccacgtggacacccagcacctgatcaagcagctgagacagcacttcgccatgctgtag

SEQ ID NO: 102294 - DNA, 753 bp, Artificial Sequence
  Description of Artificial Sequence: Synthetic coding sequence
atgagcagcgagatggagcccctgctgctggcctggagctacttcagaagaagaaagttccagctgtgcgccgacctgtgcacccagatgctggagaagagcccctacgaccaggagatgaacaacatgagcagcgccgccgagtactacaaggaggtgctgaagcaggacaacacccacgtggaggccatcgcctgcatcggcagcaaccacttctacagcgaccagcccgagatcgccctgagattctacagaagactgctgcagatgggcatctacaacggccagctgttcaacaacctgggcctgtgctgcttctacgcccagcagtacgacatgaccctgaccagcttcgagagagccctgagcctggccgagaacgaggaggaggccgccgacgtgtggtacaacctgggccacgtggccgtgggcatcggcgacaccaacctggcccaccagtgcttcagactggccctggtgaacaacaacaaccacgccgaggcctacaacaacctggccgtgctggagatgagaaagggccacgtggagcaggccagagccctgctgcagaccgccagcagcctggccccccacatgtacgagccccacttcaacttcgccaccatcagcgacaagatcggcgacctgcagagaagctacgtggccgcccagaagagcgaggccgccttccccgaccacgtggacacccagcacctgatcaagcagctgagacagcacttcgccatgctgtag

SEQ ID NO: 102295 - DNA, 954 bp, Artificial Sequence
  Description of Artificial Sequence: Synthetic coding sequence
atgatcctgagctacgaggtgatcctgcacgccctggacctggccgccctgagcaccgagcacagccagtacaaggactggtggtggaaggtgcagatcggcaagtgctactacagactgggcatgtacagagaggccgagaagcagttcaagagcgccctgaagcagcaggagatggtggacaccttcctgtacctggccaaggtgtacgtgagcctggaccagcccgtgaccgccctgaacctgttcaagcagggcctggacaagttccccggcgaggtgaccctgctgtgcggcatcgccagaatctacgaggagatgaacaacatgagcagcgccgccgagtactacaaggaggtgctgaagcaggacaacacccacgtggaggccatcgcctgcatcggcagcaaccacttctacagcgaccagcccgagatcgccctgagattctacagaagactgctgcagatgggcatctacaacggccagctgttcaacaacctgggcctgtgctgcttctacgcccagcagtacgacatgaccctgaccagcttcgagagagccctgagcctggccgagaacgaggaggaggccgccgacgtgtggtacaacctgggccacgtggccgtgggcatcggcgacaccaacctggcccaccagtgcttcagactggccctggtgaacaacaacaaccacgccgaggcctacaacaacctggccgtgctggagatgagaaagggccacgtggagcaggccagagccctgctgcagaccgccagcagcctggccccccacatgtacgagccccacttcaacttcgccaccatcagcgacaagatcggcgacctgcagagaagctacgtggccgcccagaagagcgaggccgccttccccgaccacgtggacacccagcacctgatcaagcagctgagacagcacttcgccatgctgtag

SEQ ID NO: 102296 - DNA, 1548 bp, Artificial Sequence
  Description of Artificial Sequence: Synthetic coding sequence
atgagcagcgagatggagcccctgctgctggcctggagctacttcagaagaagaaagttccagctgtgcgccgacctgtgcacccagatgctggagaagagcccctacgaccaggagcccgaccccgagctgcccgtgcaccaggccgcctggatcctgaaggccagagccctgaccgagatggtgtacatcgacgagatcgacgtggaccaggagggcatcgccgagatgatgctggacgagaacgccatcgcccaggtgcccagacccggcaccagcctgaagctgcccggcaccaaccagaccggcggccccagccaggccgtgagacccatcacccaggccggcagacccatcaccggcttcctgagacccagcacccagagcggcagacccggcaccatggagcaggccatcagaacccccagaaccgcctacaccgccagacccatcaccagcagcagcggcagattcgtgagactgggcaccgccagcatgctgaccagccccgacggccccttcatcaacctgagcagactgaacctgaccaagtacagccagaagcccaagctggccaaggccctgttcgagtacatcttccaccacgagaacgacgtgaagaccgccctggacctggccgccctgagcaccgagcacagccagtacaaggactggtggtggaaggtgcagatcggcaagtgctactacagactgggcatgtacagagaggccgagaagcagttcaagagcgccctgaagcagcaggagatggtggacaccttcctgtacctggccaaggtgtacgtgagcctggaccagcccgtgaccgccctgaacctgttcaagcagggcctggacaagttccccggcgaggtgaccctgctgtgcggcatcgccagaatctacgaggagatgaacaacatgagcagcgccgccgagtactacaaggaggtgctgaagcaggacaacacccacgtggaggccatcgcctgcatcggcagcaaccacttctacagcgaccagcccgagatcgccctgagattctacagaagactgctgcagatgggcatctacaacggccagctgttcaacaacctgggcctgtgctgcttctacgcccagcagtacgacatgaccctgaccagcttcgagagagccctgagcctggccgagaacgaggaggaggccgccgacgtgtggtacaacctgggccacgtggccgtgggcatcggcgacaccaacctggcccaccagtgcttcagactggccctggtgaacaacaacaaccacgccgaggcctacaacaacctggccgtgctggagatgagaaagggccacgtggagcaggccagagccctgctgcagaccgccagcagcctggccccccacatgtacgagccccacttcaacttcgccaccatcagcgacaagatcggcgacctgcagagaagctacgtggccgcccagaagagcgaggccgccttccccgaccacgtggacacccagcacctgatcaagcagctgagacagcacttcgccatgctgtag

SEQ ID NO: 102297 - DNA, 831 bp, Artificial Sequence
  Description of Artificial Sequence: Synthetic coding sequence
atgtacagagaggccgagaagcagttcaagagcgccctgaagcagcaggagatggtggacaccttcctgtacctggccaaggtgtacgtgagcctggaccagcccgtgaccgccctgaacctgttcaagcagggcctggacaagttccccggcgaggtgaccctgctgtgcggcatcgccagaatctacgaggagatgaacaacatgagcagcgccgccgagtactacaaggaggtgctgaagcaggacaacacccacgtggaggccatcgcctgcatcggcagcaaccacttctacagcgaccagcccgagatcgccctgagattctacagaagactgctgcagatgggcatctacaacggccagctgttcaacaacctgggcctgtgctgcttctacgcccagcagtacgacatgaccctgaccagcttcgagagagccctgagcctggccgagaacgaggaggaggccgccgacgtgtggtacaacctgggccacgtggccgtgggcatcggcgacaccaacctggcccaccagtgcttcagactggccctggtgaacaacaacaaccacgccgaggcctacaacaacctggccgtgctggagatgagaaagggccacgtggagcaggccagagccctgctgcagaccgccagcagcctggccccccacatgtacgagccccacttcaacttcgccaccatcagcgacaagatcggcgacctgcagagaagctacgtggccgcccagaagagcgaggccgccttccccgaccacgtggacacccagcacctgatcaagcagctgagacagcacttcgccatgctgtag

SEQ ID NO: 102298 - DNA, 348 bp, Artificial Sequence
  Description of Artificial Sequence: Synthetic coding sequence
atgagcagccccagcagccccttcagagagcagagcttcctgtgcgccgccggcgacgccggcgaggagagcagagtgcaggtgctgaagaacgaggtgagaagaggcagccccgtgctgctgggctgggtggagcaggcctacgccgacaagtgcgtgtgcggccccagcgccccccccgcccccaccccccccagcctgagccagagagtgatgtgcaacgacctgttcaaggtgaaccccttccagctgcagcagttcagagccgaccccagcaccgccagcctgctgctgtgccccggcggcctggaccacaagctgaacctgagaggcaaggcctggggctag

SEQ ID NO: 102299 - DNA, 348 bp, Artificial Sequence; identical to SEQ ID NO: 102298
  Description of Artificial Sequence: Synthetic coding sequence

SEQ ID NO: 102300 - DNA, 357 bp, Artificial Sequence
  Description of Artificial Sequence: Synthetic coding sequence
atggagggcggcgcctacggcgccggcaaggccggcggcgccttcgacccctacaccctggtgagacagccccacaccatcctgagagtggtgagctggctgttcagcatcgtggtgttcggcagcatcgtgaacgagggctacctgaacagcgccagcgagggcgaggagttctgcatctacaacagaaaccccaacgcctgcagctacggcgtggccgtgggcgtgctggccttcctgacctgcctgctgtacctggccctggacgtgtacttcccccagatcagcagcgtgaaggacagaaagaaggccgtgctgagcgacatcggcgtgagcgcctgggagatgcacagctag

SEQ ID NO: 102301 - DNA, 1389 bp, Artificial Sequence
  Description of Artificial Sequence: Synthetic coding sequence
atggccgcccagagaagaagcctgctgcagagcgagcagcagcccagctggaccgacgacctgcccctgtgccacctgagcggcgtgggcagcgccagcaacagaagctacagcgccgacggcaagggcaccgagagccacccccccgaggacagctggctgaagttcagaagcgagaacaactgcttcctgtacggcgtgttcaacggctacgacggcaacagagtgaccaacttcgtggcccagagactgagcgccgagctgctgctgggccagctgaacgccgagcacgccgaggccgacgtgagaagagtgctgctgcaggccttcgacgtggtggagagaagcttcctggagagcatcgacgacgccctggccgagaaggccagcctgcagagccagctgcccgagggcgtgccccagcaccagctgcccccccagtaccagaagatcctggagagactgaagaccctggagagagagatcagcggcggcgccatggccgtggtggccgtgctgctgaacaacaagctgtacgtggccaacgtgggcaccaacagagccctgctgtgcaagagcaccgtggacggcctgcaggtgacccagctgaacgtggaccacaccaccgagaacgaggacgagctgttcagactgagccagctgggcctggacgccggcaagatcaagcaggtgggcatcatctgcggccaggagagcaccagaagaatcggcgactacaaggtgaagtacggctacaccgacatcgacctgctgagcgccgccaagagcaagcccatcatcgccgagcccgagatccacggcgcccagcccctggacggcgtgaccggcttcctggtgctgatgagcgagggcctgtacaaggccctggaggccgcccacggccccggccaggccaaccaggagatcgccgccatgatcgacaccgagttcgccaagcagaccagcctggacgccgtggcccaggccgtggtggacagagtgaagagaatccacagcgacaccttcgccagcggcggcgagagagccagattctgccccagacacgaggacatgaccctgctggtgagaaacttcggctaccccctgggcgagatgagccagcccacccccagccccgcccccgccgccggcggcagagtgtaccccgtgagcgtgccctacagcagcgcccagagcaccagcaagaccagcgtgaccctgagcctggtgatgcccagccagggccagatggtgaacggcgcccacagcgccagcaccctggacgaggccacccccaccctgaccaaggaccccagcagacccgccagcgacctgaccgccatcccccagtgccagctgaacctgctgggcagcctgacccccggctag

SEQ ID NO: 102302 - DNA, 2082 bp, Artificial Sequence
  Description of Artificial Sequence: Synthetic coding sequence
atggcccagggcagccaccagatcgacttccaggtgctgcacgacctgagacagaagttccccgaggtgcccgaggtggtggtgagcagatgcatgctgcagaacaacaacaacctggacgcctgctgcgccgtgctgagccaggagagcaccagatacctgtacggcgagggcgacctgaacttcagcgacgacagcggcatcagcggcctgagaaaccacatgaccagcctgaacctggacctgcagagccagaacatctaccaccacggcagagagggcagcagaatgaacggcagcagaaccctgacccacagcatcagcgacggccagctgcagggcggccagagcaacagcgagctgttccagcaggagccccagaccgcccccgcccaggtgccccagggcttcaacgtgttcggcatgagcagcagcagcggcgccagcaacagcgccccccacctgggcttccacctgggcagcaagggcaccagcagcctgagccagcagacccccagattcaaccccatcatggtgaccctggcccccaacatccagaccggcagaaacacccccaccagcctgcacatccacggcgtgcccccccccgtgctgaacagcccccagggcaacagcatctacatcagaccctacatcaccacccccggcggcaccaccagacagacccagcagcacagcggctgggtgagccagttcaaccccatgaacccccagcaggtgtaccagcccagccagcccggcccctggaccacctgccccgccagcaaccccctgagccacaccagcagccagcagcccaaccagcagggccaccagaccagccacgtgtacatgcccatcagcagccccaccaccagccagccccccaccatccacagcagcggcagcagccagagcagcgcccacagccagtacaacatccagaacatcagcaccggccccagaaagaaccagatcgagatcaagctggagcccccccagagaaacaacagcagcaagctgagaagcagcggccccagaaccagcagcaccagcagcagcgtgaacagccagaccctgaacagaaaccagcccaccgtgtacatcgccgccagcccccccaacaccgacgagctgatgagcagaagccagcccaaggtgtacatcagcgccaacgccgccaccggcgacgagcaggtgatgagaaaccagcccaccctgttcatcagcaccaacagcggcgccagcgccgccagcagaaacatgagcggccaggtgagcatgggccccgccttcatccaccaccacccccccaagagcagagccatcggcaacaacagcgccaccagccccagagtggtggtgacccagcccaacaccaagtacaccttcaagatcaccgtgagccccaacaagccccccgccgtgagccccggcgtggtgagccccaccttcgagctgaccaacctgctgaaccaccccgaccactacgtggagaccgagaacatccagcacctgaccgaccccaccctggcccacgtggacagaatcagcgagaccagaaagctgagcatgggcagcgacgacgccgcctacacccaggccctgctggtgcaccagaaggccagaatggagagactgcagagagagctggagatccagaagaagaagctggacaagctgaagagcgaggtgaacgagatggagaacaacctgaccagaagaagactgaagagaagcaacagcatcagccagatccccagcctggaggagatgcagcagctgagaagctgcaacagacagctgcagatcgacatcgactgcctgaccaaggagatcgacctgttccaggccagaggcccccacttcaaccccagcgccatccacaacttctacgacaacatcggcttcgtgggccccgtgccccccaagcccaaggaccagagaagcatcatcaagacccccaagacccaggacaccgaggacgacgagggcgcccagtggaactgcaccgcctgcaccttcctgaaccaccccgccctgatcagatgcgagcagtgcgagatgcccagacacttctag

SEQ ID NO: 102303 - DNA, 2082 bp, Artificial Sequence; identical to SEQ ID NO: 102302
  Description of Artificial Sequence: Synthetic coding sequence

SEQ ID NO: 102304 - DNA, 1611 bp, Artificial Sequence
  Description of Artificial Sequence: Synthetic coding sequence
atggcccagggcagccaccagatcgacttccaggtgctgcacgacctgagacagaagttccccgaggtgcccgaggtggtggtgagcagatgcatgctgcagaacaacaacaacctggacgcctgctgcgccgtgctgagccaggagagcaccagatacctgtacggcgagggcgacctgaacttcagcgacgacagcggcatcagcggcctgagaaaccacatgaccagcctgaacctggacctgcagagccagaacatctaccaccacggcagagagggcagcagaatgaacggcagcagaaccctgacccacagcatcagcgacggccagctgcagggcggccagagcaacagcgagctgttccagcaggagccccagaccgcccccgcccaggtgccccagggcttcaacgtgttcggcatgagcagcagcagcggcgccagcaacagcgccccccacctgggcttccacctgggcagcaagggcaccagcagcctgagccagcagacccccagattcaaccccatcatggtgaccctggcccccaacatccagaccggcagaaacacccccaccagcctgcacatccacggcgtgcccccccccgtgctgaacagcccccagggcaacagcatctacatcagaccctacatcaccacccccggcggcaccaccagacagacccagcagcacagcggctgggtgagccagttcaaccccatgaacccccagcaggtgtaccagcccagccagcccggcccctggaccacctgccccgccagcaaccccctgagccacaccagcagccagcagcccaaccagcagggccaccagaccagccacgtgtacatgcccatcagcagccccaccaccagccagccccccaccatccacagcagcggcagcagccagagcagcgcccacagccagtacaacatccagaacatcagcaccggccccagaaagaaccagatcgagatcaagctggagcccccccagagaaacaacagcagcaagctgagaagcagcggccccagaaccagcagcaccagcagcagcgtgaacagccagaccctgaacagaaaccagcccaccgtgtacatcgccgccagcccccccaacaccgacgagctgatgagcagaagccagcccaaggtgtacatcagcgccaacgccgccaccggcgacgagcaggtgatgagaaaccagcccaccctgttcatcagcaccaacagcggcgccagcgccgccagcagaaacatgagcggccaggtgagcatgggccccgccttcatccaccaccacccccccaagagcagagccatcggcaacaacagcgccaccagccccagagtggtggtgacccagcccaacaccaagtacaccttcaagatcaccgtgagccccaacaagccccccgccgtgagccccggcgtggtgagccccaccttcgagctgaccaacctgctgaaccaccccgaccactacgtggagaccgagaacatccagcacctgaccgaccccaccctggcccacgtggacagaatcagcgagaccagaaagctgagcatgggcagcgacgacgccgcctacacccaggacatctag

SEQ ID NO: 102305 - DNA, 1986 bp, Artificial Sequence
  Description of Artificial Sequence: Synthetic coding sequence
atgcagaacaacaacaacctggacgcctgctgcgccgtgctgagccaggagagcaccagatacctgtacggcgagggcgacctgaacttcagcgacgacagcggcatcagcggcctgagaaaccacatgaccagcctgaacctggacctgcagagccagaacatctaccaccacggcagagagggcagcagaatgaacggcagcagaaccctgacccacagcatcagcgacggccagctgcagggcggccagagcaacagcgagctgttccagcaggagccccagaccgcccccgcccaggtgccccagggcttcaacgtgttcggcatgagcagcagcagcggcgccagcaacagcgccccccacctgggcttccacctgggcagcaagggcaccagcagcctgagccagcagacccccagattcaaccccatcatggtgaccctggcccccaacatccagaccggcagaaacacccccaccagcctgcacatccacggcgtgcccccccccgtgctgaacagcccccagggcaacagcatctacatcagaccctacatcaccacccccggcggcaccaccagacagacccagcagcacagcggctgggtgagccagttcaaccccatgaacccccagcaggtgtaccagcccagccagcccggcccctggaccacctgccccgccagcaaccccctgagccacaccagcagccagcagcccaaccagcagggccaccagaccagccacgtgtacatgcccatcagcagccccaccaccagccagccccccaccatccacagcagcggcagcagccagagcagcgcccacagccagtacaacatccagaacatcagcaccggccccagaaagaaccagatcgagatcaagctggagcccccccagagaaacaacagcagcaagctgagaagcagcggccccagaaccagcagcaccagcagcagcgtgaacagccagaccctgaacagaaaccagcccaccgtgtacatcgccgccagcccccccaacaccgacgagctgatgagcagaagccagcccaaggtgtacatcagcgccaacgccgccaccggcgacgagcaggtgatgagaaaccagcccaccctgttcatcagcaccaacagcggcgccagcgccgccagcagaaacatgagcggccaggtgagcatgggccccgccttcatccaccaccacccccccaagagcagagccatcggcaacaacagcgccaccagccccagagtggtggtgacccagcccaacaccaagtacaccttcaagatcaccgtgagccccaacaagccccccgccgtgagccccggcgtggtgagccccaccttcgagctgaccaacctgctgaaccaccccgaccactacgtggagaccgagaacatccagcacctgaccgaccccaccctggcccacgtggacagaatcagcgagaccagaaagctgagcatgggcagcgacgacgccgcctacacccaggccctgctggtgcaccagaaggccagaatggagagactgcagagagagctggagatccagaagaagaagctggacaagctgaagagcgaggtgaacgagatggagaacaacctgaccagaagaagactgaagagaagcaacagcatcagccagatccccagcctggaggagatgcagcagctgagaagctgcaacagacagctgcagatcgacatcgactgcctgaccaaggagatcgacctgttccaggccagaggcccccacttcaaccccagcgccatccacaacttctacgacaacatcggcttcgtgggccccgtgccccccaagcccaaggaccagagaagcatcatcaagacccccaagacccaggacaccgaggacgacgagggcgcccagtggaactgcaccgcctgcaccttcctgaaccaccccgccctgatcagatgcgagcagtgcgagatgcccagacacttctag

SEQ ID NO: 102306 - DNA, 2082 bp, Artificial Sequence; identical to SEQ ID NO: 102302
  Description of Artificial Sequence: Synthetic coding sequence

SEQ ID NO: 102307 - DNA, 714 bp, Artificial Sequence
  Description of Artificial Sequence: Synthetic coding sequence
atgagcgacagcgacctgggcgaggacgagggcctgctgagcctggccggcaagagaaagagaagaggcaacctgcccaaggagagcgtgaagatcctgagagactggctgtacctgcacagatacaacgcctaccccagcgagcaggagaagctgagcctgagcggccagaccaacctgagcgtgctgcagatctgcaactggttcatcaacgccagaagaagactgctgcccgacatgctgagaaaggacggcaaggaccccaaccagttcaccatcagcagaagaggcggcaaggccagcgacgtggccctgcccagaggcagcagccccagcgtgctggccgtgagcgtgcccgcccccaccaacgtgctgagcctgagcgtgtgcagcatgcccctgcacagcggccagggcgagaagcccgccgcccccttccccagaggcgagctggagagccccaagcccctggtgacccccggcagcaccctgaccctgctgaccagagccgaggccggcagccccaccggcggcctgttcaacacccccccccccaccccccccgagcaggacaaggaggacttcagcagcttccagctgctggtggaggtggccctgcagagagccgccgagatggagctgcagaagcagcaggaccccagcctgcccctgctgcacacccccatccccctggtgagcgagaacccccagtag

SEQ ID NO: 102308 - DNA, 714 bp, Artificial Sequence; identical to SEQ ID NO: 102307
  Description of Artificial Sequence: Synthetic coding sequence

SEQ ID NO: 102309 - DNA, 525 bp, Artificial Sequence
  Description of Artificial Sequence: Synthetic coding sequence
atgagcgacagcgacctgggcgaggacgagggcctgctgagcctggccggcaagagaaagagaagaggcaacctgcccaaggagagcgtgaagatcctgagagactggctgtacctgcacagatacaacgcctaccccagcgagcaggagaagctgagcctgagcggccagaccaacctgagcgtgctgcagatctgcaactggttcatcaacgccagaagaagactgctgcccgacatgctgagaaaggacggcaaggaccccaaccagttcaccatcagcagaagaggcggcaaggccagcgacgtggccctgcccagaggcagcagccccagcgtgctggccgtgagcgtgcccgcccccaccaacgtgctgagcctgagcgtgtgcagcatgcccctgcacagcggccagggcgagaagcccgccgcccccttccccagaggcgagctggagagccccaagcccctggtgacccccggcagcaccctgaccctgctgaccagagccgaggccggcagctag

SEQ ID NO: 102310 - DNA, 714 bp, Artificial Sequence; identical to SEQ ID NO: 102307
  Description of Artificial Sequence: Synthetic coding sequence

SEQ ID NO: 102311 - DNA, 726 bp, Artificial Sequence
  Description of Artificial Sequence: Synthetic coding sequence
atggaggccgccgccgacggccccgccgagacccagagccccgtggagaaggacagccccgccaagacccagagccccgcccaggacaccagcatcatgagcagaaacaacgccgacaccggcagagtgctggccctgcccgagcacaagaagaagagaaagggcaacctgcccgccgagagcgtgaagatcctgagagactggatgtacaagcacagattcaaggcctaccccagcgaggaggagaagcagatgctgagcgagaagaccaacctgagcctgctgcagatcagcaactggttcatcaacgccagaagaagaatcctgcccgacatgctgcagcagagaagaaacgaccccatcatcggccacaagaccggcaaggacgcccacgccacccacctgcagagcaccgaggccagcgtgcccgccaagagcggccccagcggccccgacaacgtgcagagcctgcccctgtggcccctgcccaagggccagatgagcagagagaagcagcccgaccccgagagcgcccccagccagaagctgaccggcatcgcccagcccaagaagaaggtgaaggtgagcgtgaccagccccagcagccccgagctggtgagccccgaggagcacgccgacttcagcagcttcctgctgctggtggacgccgccgtgcagagagccgccgagctggagctggagaagaagcaggagcccaacccctag

SEQ ID NO: 102312 - DNA, 726 bp, Artificial Sequence; identical to SEQ ID NO: 102311
  Description of Artificial Sequence: Synthetic coding sequence

SEQ ID NO: 102313 - DNA, 558 bp, Artificial Sequence
  Description of Artificial Sequence: Synthetic coding sequence
atggaggccgccgccgacggccccgccgagacccagagccccgtggagaaggacagccccgccaagacccagagccccgcccaggacaccagcatcatgagcagaaacaacgccgacaccggcagagtgctggccctgcccgagcacaagaagaagagaaagggcaacctgcccgccgagagcgtgaagatcctgagagactggatgtacaagcacagattcaaggcctaccccagcgaggaggagaagcagatgctgagcgagaagaccaacctgagcctgctgagaatcagcaactggttcatcaacgccagaagaagaatcctgcccgacatgctgcagcagagaagaaacgaccccatcatcggccacaagaccggcaaggacgcccacgccacccacctgcagagcaccgaggccagcgtgcccgccaagagcggccccgtggtgcagaccatgtacaaggcctgcccctgcggcccctgccagagagccagatgccaggagagaagcaaccagatcagaagcagacccctggccagaagcagccccgagtag

SEQ ID NO: 102314 - DNA, 558 bp, Artificial Sequence; identical to SEQ ID NO: 102313
  Description of Artificial Sequence: Synthetic coding sequence

SEQ ID NO: 102315 - DNA, 1773 bp, Artificial Sequence
  Description of Artificial Sequence: Synthetic coding sequence
atggccggcgccgtgcccggcgccatcatggacgaggactactacggcagcgccgccgagtggggcgacgaggccgacggcggccagcaggaggacgacagcggcgagggcgaggacgacgccgaggtgcagcaggagtgcctgcacaagttcagcaccagagactacatcatggagcccagcatcttcaacaccctgaagagatacttccaggccggcggcagccccgagaacgtgatccagctgctgagcgagaactacaccgccgtggcccagaccgtgaacctgctggccgagtggctgatccagaccggcgtggagcccgtgcaggtgcaggagaccgtggagaaccacctgaagagcctgctgatcaagcacttcgaccccagaaaggccgacagcatcttcaccgaggagggcgagacccccgcctggctggagcagatgatcgcccacaccacctggagagacctgttctacaagctggccgaggcccaccccgactgcctgatgctgaacttcaccgtgaagctgatcagcgacgccggctaccagggcgagatcaccagcgtgagcaccgcctgccagcagctggaggtgttcagcagagtgctgagaaccagcctggccaccatcctggacggcggcgaggagaacctggagaagaacctgcccgagttcgccaagatggtgtgccacggcgagcacacctacctgttcgcccaggccatgatgagcgtgctggcccaggaggagcagggcggcagcgccgtgagaagaatcgcccaggaggtgcagagattcgcccaggagaagggccacgacgccagccagatcaccctggccctgggcaccgccgccagctaccccagagcctgccaggccctgggcgccatgctgagcaagggcgccctgaaccccgccgacatcaccgtgctgttcaagatgttcaccagcatggaccccccccccgtggagctgatcagagtgcccgccttcctggacctgttcatgcagagcctgttcaagcccggcgccagaatcaaccaggaccacaagcacaagtacatccacatcctggcctacgccgccagcgtggtggagacctggaagaagaacaagagagtgagcatcaacaaggacgagctgaagagcaccagcaaggccgtggagaccgtgcacaacctgtgctgcaacgagaacaagggcgccagcgagctggtggccgagctgagcaccctgtaccagtgcatcagattccccgtggtggccatgggcgtgctgaagtgggtggactggaccgtgagcgagcccagatacttccagctgcagaccgaccacacccccgtgcacctggccctgctggacgagatcagcacctgccaccagctgctgcacccccaggtgctgcagctgctggtgaagctgttcgagaccgagcacagccagctggacgtgatggagcagctggagctgaagaagaccctgctggacagaatggtgcacctgctgagcagaggctacgtgctgcccgtggtgagctacatcagaaagtgcctggagaagctggacaccgacatcagcctgatcagatacttcgtgaccgaggtgctggacgtgatcgcccccccctacaccagcgacttcgtgcagctgttcctgcccatcctggagaacgacagcatcgccggcaccatcaagaccgagggcgagcacgaccccgtgaccgagttcatcgcccactgcaagagcaacttcatcatggtgaactag

SEQ ID NO: 102316 - DNA, 1773 bp, Artificial Sequence; identical to SEQ ID NO: 102315
  Description of Artificial Sequence: Synthetic coding sequence

SEQ ID NO: 102317 - DNA, 774 bp, Artificial Sequence
  Description of Artificial Sequence: Synthetic coding sequence
atgcccgccagatgcgtggccgcccactgcggcaacaccaccaagagcggcaagagcctgttcagattccccaaggacagagccgtgagactgctgtgggacagattcgtgagaggctgcagagccgactggtacggcggcaacgacagaagcgtgatctgcagcgaccacttcgcccccgcctgcttcgacgtgagcagcgtgatccagaagaacctgagattcagccagagactgagactggtggccggcgccgtgcccaccctgcacagagtgcccgcccccgcccccaagagaggcgaggagggcgaccaggccggcagactggacaccagaggcgagctgcaggccgccagacacagcgaggccgcccccggccccgtgagctgcaccagacccagagccggcaagcaggccgccgccagccagatcacctgcgagaacgagctggtgcagacccagccccacgccgacaaccccagcaacaccgtgaccagcgtgcccacccactgcgaggagggccccgtgcacaagagcacccagatcagcctgaagagacccagacacagaagcgtgggcatccaggccaaggtgaaggccttcggcaagagactgtgcaacgccaccacccagaccgaggagctgtggagcagaaccagcagcctgttcgacatctacagcagcgacagcgagaccgacaccgactgggacatcaagagcgagcagagcgacctgagctacatggccgtgcaggtgaaggaggagacctgctag

SEQ ID NO: 102318 - DNA, 498 bp, Artificial Sequence
  Description of Artificial Sequence: Synthetic coding sequence
atggagccccccaagatgaaccccgtggtggagcccctgagctggatgctgggcacctggctgagcgacccccccggcgccggcacctaccccaccctgcagcccttccagtacctggaggaggtgcacatcagccacgtgggccagcccatgctgaacttcagcttcaacagcttccaccccgacaccagaaagcccatgcacagagagtgcggcttcatcagactgaagcccgacaccaacaaggtggccttcgtgagcgcccagaacaccggcgtggtggaggtggaggagggcgaggtgaacggccaggagctgtgcatcgccagccacagcatcgccagaatcagcttcgccaaggagccccacgtggagcagatcaccagaaagttcagactgaacagcgagggcaagctggagcagaccgtgagcatggccaccaccacccagcccatgacccagcacctgcacgtgacctacaagaaggtgaccccctag

SEQ ID NO: 102319 - DNA, 1734 bp, Artificial Sequence
  Description of Artificial Sequence: Synthetic coding sequence
atggtgatctgctgcgccgccgtgaactgcagcaacagacagggcaagggcgagaagagagccgtgagcttccacagattccccctgaaggacagcaagagactgatccagtggctgaaggccgtgcagagagacaactggacccccaccaagtacagcttcctgtgcagcgagcacttcaccaaggacagcttcagcaagagactggaggaccagcacagactgctgaagcccaccgccgtgcccagcatcttccacctgaccgagaagaagagaggcgccggcggccacggcagaaccagaagaaaggacgccagcaaggccaccggcggcgtgagaggccacagcagcgccgccaccagcagaggcgccgccggctggagccccagcagcagcggcaaccccatggccaagcccgagagcagaagactgaagcaggccgccctgcagggcgaggccacccccagagccgcccaggaggccgccagccaggagcaggcccagcaggccctggagagaacccccggcgacggcctggccaccatggtggccggcagccagggcaaggccgaggccagcgccaccgacgccggcgacgagagcgccaccagcagcatcgagggcggcgtgaccgacaagagcggcatcagcatggacgacttcaccccccccggcagcggcgcctgcaagttcatcggcagcctgcacagctacagcttcagcagcaagcacaccagagagagacccagcgtgcccagagagcccatcgacagaaagagactgaagaaggacgtggagcccagctgcagcggcagcagcctgggccccgacaagggcctggcccagagcccccccagcagcagcctgaccgccaccccccagaagcccagccagagccccagcgccccccccgccgacgtgacccccaagcccgccaccgaggccgtgcagagcgagcacagcgacgccagccccatgagcatcaacgaggtgatcctgagcgccagcggcgcctgcaagctgatcgacagcctgcacagctactgcttcagcagcagacagaacaagagccaggtgtgctgcctgagagagcaggtggagaagaagaacggcgagctgaagagcctgagacagagagtgagcagaagcgacagccaggtgagaaagctgcaggagaagctggacgagctgagaagagtgagcgtgccctaccccagcagcctgctgagccccagcagagagccccccaagatgaaccccgtggtggagcccctgagctggatgctgggcacctggctgagcgacccccccggcgccggcacctaccccaccctgcagcccttccagtacctggaggaggtgcacatcagccacgtgggccagcccatgctgaacttcagcttcaacagcttccaccccgacaccagaaagcccatgcacagagagtgcggcttcatcagactgaagcccgacaccaacaaggtggccttcgtgagcgcccagaacaccggcgtggtggaggtggaggagggcgaggtgaacggccaggagctgtgcatcgccagccacagcatcgccagaatcagcttcgccaaggagccccacgtggagcagatcaccagaaagttcagactgaacagcgagggcaagctggagcagaccgtgagcatggccaccaccacccagcccatgacccagcacctgcacgtgacctacaagaaggtgaccccctag

SEQ ID NO: 102320 - DNA, 510 bp, Artificial Sequence
  Description of Artificial Sequence: Synthetic coding sequence
atgagcatcaacgaggtgatcctgagcgccagcggcgcctgcaagctgatcgacagcctgcacagctactgcttcagcagcagacagaacaagagccaggtgtgctgcctgagagagcaggtggagaagaagaacggcgagctgaagagcctgagacagagagtgagcagaagcgacagccaggtgagaaagctgcaggagaagctggacgagctgagaagagtgagcgtgccctaccccagcagcctgctgagccccagcagagagccccccaagatgaaccccgtggtggagcccctgagctggatgctgggcacctggctgagcgacccccccggcgccggcacctaccccaccctgcagcccttccagtacctggaggaggtgcacatcagccacgtgggccagcccatgctgaacttcagcttcaacagcttccaccccgacaccagaaagcccatgcacagagagtgcggcttcatcagactgaagcccggcagcagcggctag

SEQ ID NO: 102321 - DNA, 1062 bp, Artificial Sequence
  Description of Artificial Sequence: Synthetic coding sequence
atgaagagagacagctgggtgcccagcaagtaccagttcctgtgcagcgaccacttcacccccgacagcctggacatcagatggggcatcagatacctgaagcagaccgccgtgcccaccatcttcagcctgcccgaggacaaccagggcaaggaccccagcaagaagaagagccagaagaagaacctggaggacgagaaggaggtgtgccccaaggccaagagcgaggagagcttcgtgctgaacgagaccaagaagaacatcgtgaacaccgacgtgccccaccagcaccccgagctgctgcacagcagcagcctggtgaagccccccgcccccaagaccggcagcatccagaacaacatgctgaccctgaacctggtgaagcagcacaccggcaagcccgagagcaccctggagaccagcgtgaaccaggacaccggcagaggcggcttccacacctgcttcgagaacctgaacagcaccaccatcaccctgaccaccagcaacagcgagagcatccaccagagcctggagacccaggaggtgctggaggtgaccaccagccacctggccaaccccaacttcaccagcaacagcatggagatcaagagcgcccaggagaaccccttcctgttcagcaccatcaaccagaccgtggaggagctgaacaccaacaaggagagcgtgatcgccatcttcgtgcccgccgagaacagcaagcccagcgtgaacagcttcatcagcgcccagaaggagaccaccgagatggaggacaccgacatcgaggacagcctgtacaaggacgtggactacggcaccgaggtgctgcagatcgagcacagctactgcagacaggacatcaacaaggagcacctgtggcagaaggtgagcaagctgcacagcaagatcaccctgctggagctgaaggagcagcagaccctgggcagactgaagagcctggaggccctgatcagacagctgaagcaggagaactggctgagcgaggagaacgtgaagatcatcgagaaccacttcaccacctacgaggtgaccatgatctag

SEQ ID NO: 102322 - DNA, 1188 bp, Artificial Sequence
  Description of Artificial Sequence: Synthetic coding sequence
atgcccagatactgcgccgccatctgctgcaagaacagaagaggcagaaacaacaaggacagaaagctgagcttctaccccttccccctgcacgacaaggagagactggagaagtggctgaagaacatgaagagagacagctgggtgcccagcaagtaccagttcctgtgcagcgaccacttcacccccgacagcctggacatcagatggggcatcagatacctgaagcagaccgccgtgcccaccatcttcagcctgcccgaggacaaccagggcaaggaccccagcaagaagaagagccagaagaagaacctggaggacgagaaggaggtgtgccccaaggccaagagcgaggagagcttcgtgctgaacgagaccaagaagaacatcgtgaacaccgacgtgccccaccagcaccccgagctgctgcacagcagcagcctggtgaagccccccgcccccaagaccggcagcatccagaacaacatgctgaccctgaacctggtgaagcagcacaccggcaagcccgagagcaccctggagaccagcgtgaaccaggacaccggcagaggcggcttccacacctgcttcgagaacctgaacagcaccaccatcaccctgaccaccagcaacagcgagagcatccaccagagcctggagacccaggaggtgctggaggtgaccaccagccacctggccaaccccaacttcaccagcaacagcatggagatcaagagcgcccaggagaaccccttcctgttcagcaccatcaaccagaccgtggaggagctgaacaccaacaaggagagcgtgatcgccatcttcgtgcccgccgagaacagcaagcccagcgtgaacagcttcatcagcgcccagaaggagaccaccgagatggaggacaccgacatcgaggacagcctgtacaaggacgtggactacggcaccgaggtgctgcagatcgagcacagctactgcagacaggacatcaacaaggagcacctgtggcagaaggtgagcaagctgcacagcaagatcaccctgctggagctgaaggagcagcagaccctgggcagactgaagagcctggaggccctgatcagacagctgaagcaggagaactggctgagcgaggagaacgtgaagatcatcgagaaccacttcaccacctacgaggtgaccatgatctag

SEQ ID NO: 102323 - DNA, 669 bp, Artificial Sequence
  Description of Artificial Sequence: Synthetic coding sequence
atggtgaagtgctgcagcgccatcggctgcgccagcagatgcctgcccaacagcaagctgaagggcctgaccttccacgtgttccccaccgacgagaacatcaagagaaagtgggtgctggccatgaagagactggacgtgaacgccgccggcatctgggagcccaagaagggcgacgtgctgtgcagcagacacttcaagaagaccgacttcgacagaagcgcccccaacatcaagctgaagcccggcgtgatccccagcatcttcgacagcccctaccacctgcagggcaagagagagaagctgcactgcagaaagaacttcaccctgaagaccgtgcccgccaccaactacaaccaccacctggtgggcgccagcagctgcatcgaggagttccagagccagttcatcttcgagcacagctacagcgtgatggacagccccaagaagctgaagcacaagctggaccacgtgatcggcgagctggaggacaccaaggagagcctgagaaacgtgctggacagagagaagagattccagaagagcctgagaaagaccatcagagagctgaaggacgagtgcctgatcagccaggagaccgccaacagactggacaccttctgctgggactgctgccaggagagcatcgagcaggactacatcagctag

SEQ ID NO: 102324 - DNA, 99 bp, Artificial Sequence
  Description of Artificial Sequence: Synthetic coding sequence
atggtgaagtgctgcagcgccatcggctgcgccagcagatgcctgcccaacagcaagctgaagggcctgaccttccacgtgttccccaccgacgagtag

SEQ ID NO: 102325 - DNA, 243 bp, Artificial Sequence
  Description of Artificial Sequence: Synthetic coding sequence
atggtgaagtgctgcagcgccatcggctgcgccagcagatgcctgcccaacagcaagctgaagggcctgaccttccacgtgttccccaccgacgagaacatcaagagaaagtgggtgctggccatgaagagactggacgtgaacgccgccggcatctgggagcccaagaagggcgacgtgctgtgcagcagacacttcaagaagaccgacttcgacagaagcgcccccaacatcaagctgtag

SEQ ID NO: 102326 - DNA, 669 bp, Artificial Sequence; identical to SEQ ID NO: 102323
  Description of Artificial Sequence: Synthetic coding sequence

SEQ ID NO: 102327 - DNA, 825 bp, Artificial Sequence
  Description of Artificial Sequence: Synthetic coding sequence
atgcccaagtactgcagagcccccaactgcagcaacaccgccggcagactgggcgccgacaacagacccgtgagcttctacaagttccccctgaaggacggccccagactgcaggcctggctgcagcacatgggctgcgagcactgggtgcccagctgccaccagcacctgtgcagcgagcacttcacccccagctgcttccagtggagatggggcgtgagatacctgagacccgacgccgtgcccagcatcttcagcagaggcccccccgccaagagccagagaagaaccagaagcacccagaagcccgtgagcccccccccccccctgcagaagaacacccccctgccccagagccccgccatccccgtgagcggccccgtgagactggtggtgctgggccccaccagcggcagccccaagaccgtggccaccatgctgctgacccccctggcccccgcccccacccccgagagaagccagcccgaggtgcccgcccagcaggcccagaccggcctgggccccgtgctgggcgccctgcagagaagagtgagaagactgcagagatgccaggagagacaccaggcccagctgcaggccctggagagactggcccagcagctgcacggcgagagcctgctggccagagccagaagaggcctgcagagactgaccaccgcccagaccctgggccccgaggagagccagaccttcaccatcatctgcggcggccccgacatcgccatggtgctggcccaggaccccgcccccgccaccgtggacgccaagcccgagctgctggacaccagaatccccagcgcctag

SEQ ID NO: 102328 - DNA, 825 bp, Artificial Sequence; identical to SEQ ID NO: 102327
  Description of Artificial Sequence: Synthetic coding sequence

SEQ ID NO: 102329 - DNA, 390 bp, Artificial Sequence
  Description of Artificial Sequence: Synthetic coding sequence
atgctgctgacccccctggcccccgcccccacccccgagagaagccagcccgaggtgcccgcccagcaggcccagaccggcctgggccccgtgctgggcgccctgcagagaagagtgagaagactgcagagatgccaggagagacaccaggcccagctgcaggccctggagagactggcccagcagctgcacggcgagagcctgctggccagagccagaagaggcctgcagagactgaccaccgcccagaccctgggccccgaggagagccagaccttcaccatcatctgcggcggccccgacatcgccatggtgctggcccaggaccccgcccccgccaccgtggacgccaagcccgagctgctggacaccagaatccccagcgcctag

SEQ ID NO: 102330 - DNA, 2712 bp, Artificial Sequence
  Description of Artificial Sequence: Synthetic coding sequence
atgaccagaagctgcagcgccgtgggctgcagcaccagagacaccgtgctgagcagagagagaggcctgagcttccaccagttccccaccgacaccatccagagaagcaagtggatcagagccgtgaacagagtggaccccagaagcaagaagatctggatccccggccccggcgccatcctgtgcagcaagcacttccaggagagcgacttcgagagctacggcatcagaagaaagctgaagaagggcgccgtgcccagcgtgagcctgtacaagatcccccagggcgtgcacctgaagggcaaggccagacagaagatcctgaagcagcccctgcccgacaacagccaggaggtggccaccgaggaccacaactacagcctgaagacccccctgaccatcggcgccgagaagctggccgaggtgcagcagatgctgcaggtgagcaagaagagactgatcagcgtgaagaactacagaatgatcaagaagagaaagggcctgagactgatcgacgccctggtggaggagaagctgctgagcgaggagaccgagtgcctgctgagagcccagttcagcgacttcaagtgggagctgtacaactggagagagaccgacgagtacagcgccgagatgaagcagttcgcctgcaccctgtacctgtgcagcagcaaggtgtacgactacgtgagaaagatcctgaagctgccccacagcagcatcctgagaacctggctgagcaagtgccagcccagccccggcttcaacagcaacatcttcagcttcctgcagagaagagtggagaacggcgaccagctgtaccagtactgcagcctgctgatcaagagcatgcccctgaagcagcagctgcagtgggaccccagcagccacagcctgcagggcttcatggacttcggcctgggcaagctggacgccgacgagacccccctggccagcgagaccgtgctgctgatggccgtgggcatcttcggccactggagaacccccctgggctacttcttcgtgaacagagccagcggctacctgcaggcccagctgctgagactgaccatcggcaagctgagcgacatcggcatcaccgtgctggccgtgaccagcgacgccaccgcccacagcgtgcagatggccaaggccctgggcatccacatcgacggcgacgacatgaagtgcaccttccagcaccccagcagcagcagccagcagatcgcctacttcttcgacagctgccacctgctgagactgatcagaaacgccttccagaacttccagagcatccagttcatcaacggcatcgcccactggcagcacctggtggagctggtggccctggaggagcaggagctgagcaacatggagagaatccccagcaccctggccaacctgaagaaccacgtgctgaaggtgaacagcgccacccagctgttcagcgagagcgtggccagcgccctggagtacctgctgagcctggacctgccccccttccagaactgcatcggcaccatccacttcctgagactgatcaacaacctgttcgacatcttcaacagcagaaactgctacggcaagggcctgaagggccccctgctgcccgagacctacagcaagatcaaccacgtgctgatcgaggccaagaccatcttcgtgaccctgagcgacaccagcaacaaccagatcatcaagggcaagcagaagctgggcttcctgggcttcctgctgaacgccgagagcctgaagtggctgtaccagaactacgtgttccccaaggtgatgcccttcccctacctgctgacctacaagttcagccacgaccacctggagctgttcctgaagatgctgagacaggtgctggtgaccagcagcagccccacctgcatggccttccagaaggcctactacaacctggagaccagatacaagttccaggacgaggtgttcctgagcaaggtgagcatcttcgacatcagcatcgccagaagaaaggacctggccctgtggaccgtgcagagacagtacggcgtgagcgtgaccaagaccgtgttccacgaggagggcatctgccaggactggagccactgcagcctgagcgaggccctgctggacctgagcgaccacagaagaaacctgatctgctacgccggctacgtggccaacaagctgagcgccctgctgacctgcgaggactgcatcaccgccctgtacgccagcgacctgaaggccagcaagatcggcagcctgctgttcgtgaagaagaagaacggcctgcacttccccagcgagagcctgtgcagagtgatcaacatctgcgagagagtggtgagaacccacagcagaatggccatcttcgagctggtgagcaagcagagagagctgtacctgcagcagaagatcctgtgcgagctgagcggccacatcaacctgttcgtggacgtgaacaagcacctgttcgacggcgaggtgtgcgccatcaaccacttcgtgaagctgctgaaggacatcatcatctgcttcctgaacatcagagccaagaacgtggcccagaaccccctgaagcaccacagcgagagaaccgacatgaagaccctgagcagaaagcactggagcagcgtgcaggactacaagtgcagcagcttcgccaacaccagcagcaagttcagacacctgctgagcaacgacggctaccccttcaagtag

SEQ ID NO: 102331 - DNA, 2712 bp, Artificial Sequence; identical to SEQ ID NO: 102330
  Description of Artificial Sequence: Synthetic coding sequence

SEQ ID NO: 102332 - DNA, 642 bp, Artificial Sequence
  Description of Artificial Sequence: Synthetic coding sequence
atggtgcagagctgcagcgcctacggctgcaagaacagatacgacaaggacaagcccgtgagcttccacaagttccccctgaccagacccagcctgtgcaaggagtgggaggccgccgtgagaagaaagaacttcaagcccaccaagtacagcagcatctgcagcgagcacttcacccccgactgcttcaagagagagtgcaacaacaagctgctgaaggagaacgccgtgcccaccatcttcctgtgcaccgagccccacgacaagaaggaggacctgctggagccccaggagcagctgccccccccccccctgcccccccccgtgagccaggtggacgccgccatcggcctgctgatgccccccctgcagacccccgtgaacctgagcgtgttctgcgaccacaactacaccgtggaggacaccatgcaccagagaaagagaatccaccagctggagcagcaggtggagaagctgagaaagaagctgaagaccgcccagcagagatgcagaagacaggagagacagctggagaagctgaaggaggtggtgcacttccagaaggagaaggacgacgtgagcgagagaggctacgtgatcctgcccaacgactacttcgagatcgtggaggtgcccgcctag

SEQ ID NO: 102333 - DNA, 162 bp, Artificial Sequence
  Description of Artificial Sequence: Synthetic coding sequence
atggtgcagagctgcagcgcctacggctgcaagaacagatacgacaaggacaagcccgtgagcttccacaagaagaagatcttctggagccacagaaacagcttcccccacctgctgtacagactgctgttccccagactgatgctgctgctggactactag

SEQ ID NO: 102334 - DNA, 687 bp, Artificial Sequence
  Description of Artificial Sequence: Synthetic coding sequence
atgcccaccaactgcgccgccgccggctgcgccaccacctacaacaagcacatcaacatcagcttccacagattccccctggaccccaagagaagaaaggagtgggtgagactggtgagaagaaagaacttcgtgcccggcaagcacaccttcctgtgcagcaagcacttcgaggccagctgcttcgacctgaccggccagaccagaagactgaagatggacgccgtgcccaccatcttcgacttctgcacccacatcaagagcatgaagctgaagagcagaaacctgctgaagaagaacaacagctgcagccccgccggccccagcaacctgaagagcaacatcagcagccagcaggtgctgctggagcacagctacgccttcagaaaccccatggaggccaagaagagaatcatcaagctggagaaggagatcgccagcctgagaagaaagatgaagacctgcctgcagaaggagagaagagccaccagaagatggatcaaggccacctgcctggtgaagaacctggaggccaacagcgtgctgcccaagggcaccagcgagcacatgctgcccaccgccctgagcagcctgcccctggaggacttcaagatcctggagcaggaccagcaggacaagaccctgctgagcctgaacctgaagcagaccaagagcaccttcatctag

SEQ ID NO: 102335 - DNA, 720 bp, Artificial Sequence
  Description of Artificial Sequence: Synthetic coding sequence
atgcccaagagctgcgccgccagacagtgctgcaacagatacagcagcagaagaaagcagctgaccttccacagattccccttcagcagacccgagctgctgaaggagtgggtgctgaacatcggcagaggcaacttcaagcccaagcagcacaccgtgatctgcagcgagcacttcagacccgagtgcttcagcgccttcggcaacagaaagaacctgaagcacaacgccgtgcccaccgtgttcgccttccaggaccccacccagcaggtgagagagaacaccgaccccgccagcgagagaggcaacgccagcagcagccagaaggagaaggtgctgcccgaggccggcgccggcgaggacagccccggcagaaacatggacaccgccctggaggagctgcagctgccccccaacgccgagggccacgtgaagcaggtgagccccagaagaccccaggccaccgaggccgtgggcagacccaccggccccgccggcctgagaagaacccccaacaagcagcccagcgaccacagctacgccctgctggacctggacagcctgaagaagaagctgttcctgaccctgaaggagaacgagaagctgagaaagagactgcaggcccagagactggtgatgagaagaatgagcagcagactgagagcctgcaagggccaccagggcctgcaggccagactgggccccgagcagcagagctag

SEQ ID NO: 102336 - DNA, 717 bp, Artificial Sequence
  Description of Artificial Sequence: Synthetic coding sequence
atgcccaagagctgcgccgccagacagtgctgcaacagatacagcagcagaagaaagcagctgaccttccacagattccccttcagcagacccgagctgctgaaggagtgggtgctgaacatcggcagaggcaacttcaagcccaagcagcacaccgtgatctgcagcgagcacttcagacccgagtgcttcagcgccttcggcaacagaaagaacctgaagcacaacgccgtgcccaccgtgttcgccttccaggaccccacccaggtgagagagaacaccgaccccgccagcgagagaggcaacgccagcagcagccagaaggagaaggtgctgcccgaggccggcgccggcgaggacagccccggcagaaacatggacaccgccctggaggagctgcagctgccccccaacgccgagggccacgtgaagcaggtgagccccagaagaccccaggccaccgaggccgtgggcagacccaccggccccgccggcctgagaagaacccccaacaagcagcccagcgaccacagctacgccctgctggacctggacagcctgaagaagaagctgttcctgaccctgaaggagaacgagaagctgagaaagagactgcaggcccagagactggtgatgagaagaatgagcagcagactgagagcctgcaagggccaccagggcctgcaggccagactgggccccgagcagcagagctag

SEQ ID NO: 102337 - DNA, 528 bp, Artificial Sequence
  Description of Artificial Sequence: Synthetic coding sequence
atgcccaagagctgcgccgccagacagtgctgcaacagatacagcagcagaagaaagcagctgaccttccacagattccccttcagcagacccgagctgctgaaggagtgggtgctgaacatcggcagaggcaacttcaagcccaagcagcacaccgtgatctgcagcgagcacttcagacccgagtgcttcagcgccttcggcaacagaaagaacctgaagcacaacgccgtgcccaccgtgttcgccttccaggaccccacccagcaggtgagagagaacaccgaccccgccagcgagagaggcaacgccagcagcagccagaaggagaagaccagcccctgcagaagccaggtgctgcccgaggccggcgccggcgaggacagccccggcagaaacatggacaccgccctggaggagctgcagctgccccccaacgccgagggccacgtgaagcaggccatgctgttcaacgtggagaacggcacccccgccagcagagaggccctgtggctgagcgaggagtag

SEQ ID NO: 102338 - DNA, 732 bp, Artificial Sequence
  Description of Artificial Sequence: Synthetic coding sequence
atggagcacgccttcacccccctggagcccctgctgagcaccggcaacctgaagtactgcctggtgatcctgaaccagcccctggacaactacttcagacacctgtggaacaaggccctgctgagagcctgcgccgacggcggcgccaacagactgtacgacatcaccgagggcgagagagagagcttcctgcccgagttcatcaacggcgacttcgacagcatcagacccgaggtgagagagtactacgccaccaagggctgcgagctgatcagcacccccgaccaggaccacaccgacttcaccaagtgcctgaagatgctgcagaagaagatcgaggagaaggacctgaaggtggacgtgatcgtgaccctgggcggcctggccggcagattcgaccagatcatggccagcgtgaacaccctgttccaggccacccacatcacccccttccccatcatcatcatccaggaggagagcctgatctacctgctgcagcccggcaagcacagactgcacgtggacaccggcatggagggcgactggtgcggcctgatccccgtgggccagccctgcatgcaggtgaccaccaccggcctgaagtggaacctgaccaacgacgtgctggccttcggcaccctggtgagcaccagcaacacctacgacggcagcggcgtggtgaccgtggagaccgaccaccccctgctgtggaccatggccatcaagagctag

SEQ ID NO: 102339 - DNA, 585 bp, Artificial Sequence
  Description of Artificial Sequence: Synthetic coding sequence
atggagcacgccttcacccccctggagcccctgctgagcaccggcaacctgaagtactgcctggtgatcctgaaccagcccctggacaactacttcagacacctgtggaacaaggccctgctgagagcctgcgccgacggcggcgccaacagactgtacgacatcaccgagggcgagagagagagcttcctgcccgagttcatcaacggcgacttcgacagcatcagacccgaggtgagagagtactacgccaccaagggctgcgagctgatcagcacccccgaccaggaccacaccgacttcaccaagtgcctgaagatgctgcagaagaagatcgaggagaaggacctgaagggcaagcacagactgcacgtggacaccggcatggagggcgactggtgcggcctgatccccgtgggccagccctgcatgcaggtgaccaccaccggcctgaagtggaacctgaccaacgacgtgctggccttcggcaccctggtgagcaccagcaacacctacgacggcagcggcgtggtgaccgtggagaccgaccaccccctgctgtggaccatggccatcaagagctag

SEQ ID NO: 102340 - DNA, 375 bp, Artificial Sequence
  Description of Artificial Sequence: Synthetic coding sequence
atggtggacgtgatcgtgaccctgggcggcctggccggcagattcgaccagatcatggccagcgtgaacaccctgttccaggccacccacatcacccccttccccatcatcatcatccaggaggagagcctgatctacctgctgcagcccggcaagcacagactgcacgtggacaccggcatggagggcgactggtgcggcctgatccccgtgggccagccctgcatgcaggtgaccaccaccggcctgaagtggaacctgagaacctgcgactacaccagaaccacctggatcgccaaggacaaccccgtgcccagactgatcagactgatcagactgaaccacatctgcaaggtgcccctggccatcaagtag

SEQ ID NO: 102341 - DNA, 504 bp, Artificial Sequence
  Description of Artificial Sequence: Synthetic coding sequence
atggagcacgccttcacccccctggagcccctgctgagcaccggcaacctgaagtactgcctggtgatcctgaaccagcccctggacaactacttcagacacctgtggaacaaggccctgctgagagcctgcgccgacggcggcgccaacagactgtacgacatcaccgagggcgagagagagagcttcctgcccgagttcatcaacggcgacttcgacagcatcagacccgaggtgagagagtactacgccaccaagggctgcgagctgatcagcacccccgaccaggaccacaccgacttcaccaagtgcctgaagatgctgcagaagaagatcgaggagaaggacctgaaggtggacgtgatcgtgaccctgggcggcctggccggcagattcgaccagatcatggccagcgtgaacaccctgttccaggccacccacatcacccccttccccatcatcatcatccaggaggagagcctgatctacctgctgcagccctag

SEQ ID NO: 102342 - DNA, 693 bp, Artificial Sequence
  Description of Artificial Sequence: Synthetic coding sequence
atggcccagggcctgatcgaggtggagagaaagttcctgcccggccccggcaccgaggagagactgcaggagctgggcggcaccctggagtacagagtgaccttcagagacacctactacgacacccccgagctgagcctgatgcaggccgaccactggctgagaagaagagaggacagcggctgggagctgaagtgccccggcgccgccggcgtgctgggcccccacaccgagtacaaggagctgaccgccgagcccaccatcgtggcccagctgtgcaaggtgctgagagccgacggcctgggcgccggcgacgtggccgccgtgctgggccccctgggcctgcaggaggtggccagcttcgtgaccaagagaagcgcctggaagctggtgctgctgggcgccgacgaggaggagccccagctgagagtggacctggacaccgccgacttcggctacgccgtgggcgaggtggaggccctggtgcacgaggaggccgaggtgcccaccgccctggagaagatccacagactgagcagcatgctgggcgtgcccgcccaggagaccgcccccgccaagctgatcgtgtacctgcagagattcagaccccaggactaccagagactgctggaggtgaacagcagcagagagagaccccaggagaccgaggaccccgaccactgcctgggctag

SEQ ID NO: 102343 - DNA, 693 bp, Artificial Sequence; identical to SEQ ID NO: 102342
  Description of Artificial Sequence: Synthetic coding sequence

SEQ ID NO: 102344 - DNA, 372 bp, Artificial Sequence
  Description of Artificial Sequence: Synthetic coding sequence
atggcccagggcctgatcgaggtggagagaaagttcctgcccggccccggcaccgaggagagactgcaggagctgggcggcaccctggagtacagagtgaccttcagagacacctactacgacacccccgagctgagcctgatgcaggccgaccactggctgagaagaagagaggacagcggctgggagctgaagtgccccggcgccgccggcgtgctgggcccccacaccgagtacaaggagctgaccgccgagcccaccatcgtggcccagctgtgcaaggtgctgagagccgacggcctgggcgccggcgacgtggccgccgtgctgggccccctgggcctgcaggaggtggccagcttcgtgacctag

SEQ ID NO: 102345 - DNA, 2070 bp, Artificial Sequence
  Description of Artificial Sequence: Synthetic coding sequence
atgaagccccccgccgcctgcgccggcgacatggccgacgccgccagcccctgcagcgtggtgaacgacctgagatgggacctgagcgcccagcagatcgaggagagaaccagagagctgatcgagcagaccaagagagtgtacgaccaggtgggcacccaggagttcgaggacgtgagctacgagagcaccctgaaggccctggccgacgtggaggtgacctacaccgtgcagagaaacatcctggacttcccccagcacgtgagccccagcaaggacatcagaaccgccagcaccgaggccgacaagaagctgagcgagttcgacgtggagatgagcatgagagaggacgtgtaccagagaatcgtgtggctgcaggagaaggtgcagaaggacagcctgagacccgaggccgccagatacctggagagactgatcaagctgggcagaagaaacggcctgcacctgcccagagagacccaggagaacatcaagagaatcaagaagaagctgagcctgctgtgcatcgacttcaacaagaacctgaacgaggacaccaccttcctgcccttcaccctgcaggagctgggcggcctgcccgaggacttcctgaacagcctggagaagatggaggacggcaagctgaaggtgaccctgaagtacccccactacttccccctgctgaagaagtgccacgtgcccgagaccagaagaaaggtggaggaggccttcaactgcagatgcaaggaggagaactgcgccatcctgaaggagctggtgaccctgagagcccagaagagcagactgctgggcttccacacccacgccgactacgtgctggagatgaacatggccaagaccagccagaccgtggccaccttcctggacgagctggcccagaagctgaagcccctgggcgagcaggagagagccgtgatcctggagctgaagagagccgagtgcgagagaagaggcctgcccttcgacggcagaatcagagcctgggacatgagatactacatgaaccaggtggaggagaccagatactgcgtggaccagaacctgctgaaggagtacttccccgtgcaggtggtgacccacggcctgctgggcatctaccaggagctgctgggcctggccttccaccacgaggagggcgccagcgcctggcacgaggacgtgagactgtacaccgccagagacgccgccagcggcgaggtggtgggcaagttctacctggacctgtaccccagagagggcaagtacggccacgccgcctgcttcggcctgcagcccggctgcctgagacaggacggcagcagacagatcgccatcgccgccatggtggccaacttcaccaagcccaccgccgacgcccccagcctgctgcagcacgacgaggtggagacctacttccacgagttcggccacgtgatgcaccagctgtgcagccaggccgagttcgccatgttcagcggcacccacgtggagagagacttcgtggaggcccccagccagatgctggagaactgggtgtgggagcaggagcccctgctgagaatgagcagacactacagaaccggcagcgccgtgcccagagagctgctggagaagctgatcgagagcagacaggccaacaccggcctgttcaacctgagacagatcgtgctggccaaggtggaccaggccctgcacacccagaccgacgccgaccccgccgaggagtacgccagactgtgccaggagatcctgggcgtgcccgccacccccggcaccaacatgcccgccaccttcggccacctggccggcggctacgacgcccagtactacggctacctgtggagcgaggtgtacagcatggacatgttccacaccagattcaagcaggagggcgtgctgaacagcaaggtgggcatggactacagaagctgcatcctgagacccggcggcagcgaggacgccagcgccatgctgagaagattcctgggcagagaccccaagcaggacgccttcctgctgagcaagggcctgcaggtgggcggctgcgagcccgagccccaggtgtgctag

SEQ ID NO: 102346 - DNA, 777 bp, Artificial Sequence
  Description of Artificial Sequence: Synthetic coding sequence
atgttcagcggcacccacgtggagagagacttcgtggaggcccccagccagatgctggagaactgggtgtgggagcaggagcccctgctgagaatgagcagacactacagaaccggcagcgccgtgcccagagagctgctggagaagctgatcgagagcagacaggccaacaccggcctgttcaacctgagacagatcgtgctggccaaggtggaccaggccctgcacacccagaccgacgccgaccccgccgaggagtacgccagactgtgccaggagatcctgggcgtgcccgccacccccggcaccaacatgcccgccaccttcggccacctggccggcggctacgacgcccagtactacggctacctgtggagcgaggtgtacagcatggacatgttccacaccagattcaagcaggagggcgtgctgaacagcaagttcccccactacgaggtgagacccctgagacacgtgagcctgtgcctgcccctgacctggtgcgaccccggcagcggccagccccccgagagcctgaccagaaacagatggctgcccgccctgagagccggccccgccctgcccggctgcaacatcgccctgggcagcctgcaggtgggcatggactacagaagctgcatcctgagacccggcggcagcgaggacgccagcgccatgctgagaagattcctgggcagagaccccaagcaggacgccttcctgctgagcaagggcctgcaggtgggcggctgcgagcccgagccccaggtgtgctag

SEQ ID NO: 102347 - DNA, 738 bp, Artificial Sequence
  Description of Artificial Sequence: Synthetic coding sequence
atggacggcaccagaaccagcctggacatcgaggagtacagcgacaccgaggtgcagaagaaccaggtgctgaccctggaggagtggcaggacaagtgggtgaacggcaagaccgccttccaccaggagcagggccaccagctgctgaagaagcacctggacaccttcctgaagggcaagagcggcctgagagtgttcttccccctgtgcggcaaggccgtggagatgaagtggttcgccgacagaggccacagcgtggtgggcgtggagatcagcgagctgggcatccaggagttcttcaccgagcagaacctgagctacagcgaggagcccatcaccgagatccccggcaccaaggtgttcaagagcagcagcggcaacatcagcctgtactgctgcagcatcttcgacctgcccagaaccaacatcggcaagttcgacatgatctgggacagaggcgccctggtggccatcaaccccggcgacagaaagtgctacgccgacaccatgttcagcctgctgggcaagaagttccagtacctgctgtgcgtgctgagctacgaccccaccaagcaccccggcccccccttctacgtgccccacgccgagatcgagagactgttcggcaagatctgcaacatcagatgcctggagaaggtggacgccttcgaggagagacacaagagctggggcatcgactgcctgttcgagaagctgtacctgctgaccgagaagtag

SEQ ID NO: 102348 - DNA, 519 bp, Artificial Sequence
  Description of Artificial Sequence: Synthetic coding sequence
atggagaccagacccagactgggcgccacctgcctgctgggcttcagcttcctgctgctggtgatcagcagcgacggccacaacggcctgggcaagggcttcggcgaccacatccactggagaaccctggaggacggcaagaaggaggccgccgccagcggcctgcccctgatggtgatcatccacaagagctggtgcggcgcctgcaaggccctgaagcccaagttcgccgagagcaccgagatcagcgagctgagccacaacttcgtgatggtgaacctggaggacgaggaggagcccaaggacgaggacttcagccccgacggcggctacatccccagaatcctgttcctggaccccagcggcaaggtgcaccccgagatcatcaacgagaacggcaaccccagctacaagtacttctacgtgagcgccgagcaggtggtgcagggcatgaaggaggcccaggagagactgaccggcgacgccttcagaaagaagcacctggaggacgagctgtag

SEQ ID NO: 102349 - DNA, 1767 bp, Artificial Sequence
  Description of Artificial Sequence: Synthetic coding sequence
atggccagcaagaagagagaggtgcagctgcagaccgtgatcaacaaccagagcctgtgggacgagatgctgcagaacaagggcctgaccgtgatcgacgtgtaccaggcctggtgcggcccctgcagagccatgcagcccctgttcagaaagctgaagaacgagctgaacgaggacgagatcctgcacttcgccgtggccgaggccgacaacatcgtgaccctgcagcccttcagagacaagtgcgagcccgtgttcctgttcagcgtgaacggcaagatcatcgagaagatccagggcgccaacgcccccctggtgaacaagaaggtgatcaacctgatcgacgaggagagaaagatcgccgccggcgagatggccagaccccagtaccccgagatccccctggtggacagcgacagcgaggtgagcgaggagagcccctgcgagagcgtgcaggagctgtacagcatcgccatcatcaagcccgacgccgtgatcagcaagaaggtgctggagatcaagagaaagatcaccaaggccggcttcatcatcgaggccgagcacaagaccgtgctgaccgaggagcaggtggtgaacttctacagcagaatcgccgaccagtgcgacttcgaggagttcgtgagcttcatgaccagcggcctgagctacatcctggtggtgagccagggcagcaagcacaacccccccagcgaggagaccgagccccagaccgacaccgagcccaacgagagaagcgaggaccagcccgaggtggaggcccaggtgacccccggcatgatgaagaacaagcaggacagcctgcaggagtacctggagagacagcacctggcccagctgtgcgacatcgaggaggacgccgccaacgtggccaagttcatggacgccttcttccccgacttcaagaagatgaagagcatgaagctggagaagaccctggccctgctgagacccaacctgttccacgagagaaaggacgacgtgctgagaatcatcaaggacgaggacttcaagatcctggagcagagacaggtggtgctgagcgagaaggaggcccaggccctgtgcaaggagtacgagaacgaggactacttcaacaagctgatcgagaacatgaccagcggccccagcctggccctggtgctgctgagagacaacggcctgcagtactggaagcagctgctgggccccagaaccgtggaggaggccatcgagtacttccccgagagcctgtgcgcccagttcgccatggacagcctgcccgtgaaccagctgtacggcagcgacagcctggagaccgccgagagagagatccagcacttcttccccctgcagagcaccctgggcctgatcaagccccacgccaccagcgagcagagagagcagatcctgaagatcgtgaaggaggccggcttcgacctgacccaggtgaagaagatgttcctgacccccgagcagatcgagaagatctaccccaaggtgaccggcaaggacttctacaaggacctgctggagatgctgagcgtgggccccagcatggtgatgatcctgaccaagtggaacgccgtggccgagtggagaagactgatgggccccaccgaccccgaggaggccaagctgctgagccccgacagcatcagagcccagttcggcatcagcaagctgaagaacatcgtgcacggcgccagcaacgcctacgaggccaaggaggtggtgaacagactgttcgaggaccccgaggagaactag

SEQ ID NO: 102350 - DNA, 1767 bp, Artificial Sequence; identical to SEQ ID NO: 102349
  Description of Artificial Sequence: Synthetic coding sequence

SEQ ID NO: 102351 - DNA, 681 bp, Artificial Sequence
  Description of Artificial Sequence: Synthetic coding sequence
atggaggccgacgccagcgtggacatgttcagcaaggtgctggagcaccagctgctgcagaccaccaagctggtggaggagcacctggacagcgagatccagaagctggaccagatggacgaggacgagctggagagactgaaggagaagagactgcaggccctgagaaaggcccagcagcagaagcaggagtggctgagcaagggccacggcgagtacagagagatccccagcgagagagacttcttccaggaggtgaaggagagcgagaacgtggtgtgccacttctacagagacagcaccttcagatgcaagatcctggacagacacctggccatcctgagcaagaagcacctggagaccaagttcctgaagctgaacgtggagaaggcccccttcctgtgcgagagactgcacatcaaggtgatccccaccctggccctgctgaaggacggcaagacccaggactacgtggtgggcttcaccgacctgggcaacaccgacgacttcaccaccgagaccctggagtggagactgggcagcagcgacatcctgaactacagcggcaacctgatggagccccccttccagaaccagaagaagttcggcaccaacttcaccaagctggagaagaagaccatcagaggcaagaagtacgacagcgacagcgacgacgactag

SEQ ID NO: 102352 - DNA, 408 bp, Artificial Sequence
  Description of Artificial Sequence: Synthetic coding sequence
atggaggccgacgccagcgtggacatgttcagcaaggtgctggagcaccagctgctgcagaccaccaagctggtggaggagcacctggacagcgagatccagaagctggaccagatggacgaggacgagctggagagactgaaggagaagagactgcaggccctgagaaaggcccagcagcagaagcaggagtggctgagcaagggccacggcgagtacagagagatccccagcgagagagacttcttccaggaggtgaaggagagcgagaacgtggtgtgccacttctacagagacagcaccttcagatgcaagatcctggacagacacctggccatcctgagcaagaagcacctggagaccaagttcctgaagctgaacgtggagaaggcccccttcctgtgctag

SEQ ID NO: 102353 - DNA, 627 bp, Artificial Sequence
  Description of Artificial Sequence: Synthetic coding sequence
atgagccagaagagcctggcccccagactgaacagcgtgcccttcggcagaatggaggccgacgccagcgtggacatgttcagcaaggtgctggagcaccagctgctgcagaccaccaagctggtggaggagcacctggacagcgagatccagaagctggaccagatggacgaggacgagctggagagactgaaggagaagagactgcaggccctgagaaaggcccagcagcagaagcaggagtggctgagcaagggccacggcgagtacagagagatccccagcgagagagacttcttccaggaggtgaaggagagcgagaacgtggtgtgccacttctacagagacagcaccttcagatgcaagatcctggacagacacctggccatcctgagcaagaagcacctggagaccaagttcctgaagctgaacgtggagaaggcccccttcctgtgcgagagactgcacatcaaggtgatccccaccctggccctgctgaaggacggcaagacccaggactacgtggtgggcttcaccgacctgggcaacaccgacgacttcaccaccgagaccctggagtggagactgggcagcagcgacatcctgaactacagatggtggccctag

SEQ ID NO: 102354 - DNA, 1017 bp, Artificial Sequence
  Description of Artificial Sequence: Synthetic coding sequence
atggccgccatggccgtggccctgagaggcctgggcggcagattcagatggagaacccaggccgtggccggcggcgtgagaggcgccgccagaggcgccgccgccggccagagagactacgacctgctggtggtgggcggcggcagcggcggcctggcctgcgccaaggaggccgcccagctgggcagaaaggtggccgtggtggactacgtggagcccagcccccagggcaccagatggggcctgggcggcacctgcgtgaacgtgggctgcatccccaagaagctgatgcaccaggccgccctgctgggcggcctgatccaggacgcccccaactacggctgggaggtggcccagcccgtgccccacgactggagaaagatggccgaggccgtgcagaaccacgtgaagagcctgaactggggccacagagtgcagctgcaggacagaaaggtgaagtacttcaacatcaaggccagcttcgtggacgagcacaccgtgtgcggcgtggccaagggcggcaaggagatcctgctgagcgccgaccacatcatcatcgccaccggcggcagacccagataccccacccacatcgagggcgccctggagtacggcatcaccagcgacgacatcttctggctgaaggagagccccggcaagaccctggtggtgggcgccagctacgtggccctggagtgcgccggcttcctgaccggcatcggcctggacaccaccatcatgatgagaagcatccccctgagaggcttcgaccagcagatgagcagcatggtgatcgagcacatggccagccacggcaccagattcctgagaggctgcgcccccagcagagtgagaagactgcccgacggccagctgcaggtgacctgggaggacagcaccaccggcaaggaggacaccggcaccttcgacaccgtgctgtgggccatcgccccctgcatcagcgcctgcctgcccaccaccgtgggccacgccggcaagaaccagagaagagactag

SEQ ID NO: 102355 - DNA, 1485 bp, Artificial Sequence
  Description of Artificial Sequence: Synthetic coding sequence
  Description of Combined DNA/RNA Molecule: Synthetic coding sequence
atggaggaccaggccggccagagagactacgacctgctggtggtgggcggcggcagcggcggcctggcctgcgccaaggaggccgcccagctgggcagaaaggtggccgtggtggactacgtggagcccagcccccagggcaccagatggggcctgggcggcacctgcgtgaacgtgggctgcatccccaagaagctgatgcaccaggccgccctgctgggcggcctgatccaggacgcccccaactacggctgggaggtggcccagcccgtgccccacgactggagaaagatggccgaggccgtgcagaaccacgtgaagagcctgaactggggccacagagtgcagctgcaggacagaaaggtgaagtacttcaacatcaaggccagcttcgtggacgagcacaccgtgtgcggcgtggccaagggcggcaaggagatcctgctgagcgccgaccacatcatcatcgccaccggcggcagacccagataccccacccacatcgagggcgccctggagtacggcatcaccagcgacgacatcttctggctgaaggagagccccggcaagaccctggtggtgggcgccagctacgtggccctggagtgcgccggcttcctgaccggcatcggcctggacaccaccatcatgatgagaagcatccccctgagaggcttcgaccagcagatgagcagcatggtgatcgagcacatggccagccacggcaccagattcctgagaggctgcgcccccagcagagtgagaagactgcccgacggccagctgcaggtgacctgggaggacagcaccaccggcaaggaggacaccggcaccttcgacaccgtgctgtgggccatcggcagagtgcccgacaccagaagcctgaacctggagaaggccggcgtggacaccagccccgacacccagaagatcctggtggacagcagagaggccaccagcgtgccccacatctacgccatcggcgacgtggtggagggcagacccgagctgacccccatcgccatcatggccggcagactgctggtgcagagactgttcggcggcagcagcgacctgatggactacgacaacgtgcccaccaccgtgttcacccccctggagtacggctgcgtgggcctgagcgaggaggaggccgtggccagacacggccaggagcacgtggaggtgtaccacgcccactacaagcccctggagttcaccgtggccggcagagacgccagccagtgctacgtgaagatggtgtgcctgagagagcccccccagctggtgctgggcctgcacttcctgggccccaacgccggcgaggtgacccagggcttcgccctgggcatcaagtgcggcgccagctacgcccaggtgatgagaaccgtgggcatccaccccacctgcagcgaggaggtggtgaagctgagaatcagcaagagaagcggcctggaccccaccgtgaccggctgcugaggctag

SEQ ID NO: 102356 - DNA, 1575 bp, Artificial Sequence
  Description of Artificial Sequence: Synthetic coding sequence
  Description of Combined DNA/RNA Molecule: Synthetic coding sequence
atggccgccatggccgtggccctgagaggcctgggcggcagattcagatggagaacccaggccgtggccggcggcgtgagaggcgccgccagaggcgccgccgccggccagagagactacgacctgctggtggtgggcggcggcagcggcggcctggcctgcgccaaggaggccgcccagctgggcagaaaggtggccgtggtggactacgtggagcccagcccccagggcaccagatggggcctgggcggcacctgcgtgaacgtgggctgcatccccaagaagctgatgcaccaggccgccctgctgggcggcctgatccaggacgcccccaactacggctgggaggtggcccagcccgtgccccacgactggagaaagatggccgaggccgtgcagaaccacgtgaagagcctgaactggggccacagagtgcagctgcaggacagaaaggtgaagtacttcaacatcaaggccagcttcgtggacgagcacaccgtgtgcggcgtggccaagggcggcaaggagatcctgctgagcgccgaccacatcatcatcgccaccggcggcagacccagataccccacccacatcgagggcgccctggagtacggcatcaccagcgacgacatcttctggctgaaggagagccccggcaagaccctggtggtgggcgccagctacgtggccctggagtgcgccggcttcctgaccggcatcggcctggacaccaccatcatgatgagaagcatccccctgagaggcttcgaccagcagatgagcagcatggtgatcgagcacatggccagccacggcaccagattcctgagaggctgcgcccccagcagagtgagaagactgcccgacggccagctgcaggtgacctgggaggacagcaccaccggcaaggaggacaccggcaccttcgacaccgtgctgtgggccatcggcagagtgcccgacaccagaagcctgaacctggagaaggccggcgtggacaccagccccgacacccagaagatcctggtggacagcagagaggccaccagcgtgccccacatctacgccatcggcgacgtggtggagggcagacccgagctgacccccatcgccatcatggccggcagactgctggtgcagagactgttcggcggcagcagcgacctgatggactacgacaacgtgcccaccaccgtgttcacccccctggagtacggctgcgtgggcctgagcgaggaggaggccgtggccagacacggccaggagcacgtggaggtgtaccacgcccactacaagcccctggagttcaccgtggccggcagagacgccagccagtgctacgtgaagatggtgtgcctgagagagcccccccagctggtgctgggcctgcacttcctgggccccaacgccggcgaggtgacccagggcttcgccctgggcatcaagtgcggcgccagctacgcccaggtgatgagaaccgtgggcatccaccccacctgcagcgaggaggtggtgaagctgagaatcagcaagagaagcggcctggaccccaccgtgaccggctgcugaggctag

SEQ ID NO: 102357 - DNA, 1566 bp, Artificial Sequence
  Description of Artificial Sequence: Synthetic coding sequence
atggccgccatggccgtggccctgagaggcctgggcggcagattcagatggagaacccaggccgtggccggcggcgtgagaggcgccgccagaggcgccgccggccagagagactacgacctgctggtggtgggcggcggcagcggcggcctggcctgcgccaaggaggccgcccagctgggcagaaaggtggccgtggtggactacgtggagcccagcccccagggcaccagatggggcctgggcggcacctgcgtgaacgtgggctgcatccccaagaagctgatgcaccaggccgccctgctgggcggcctgatccaggacgcccccaactacggctgggaggtggcccagcccgtgccccacgactggagaaagatggccgaggccgtgcagaaccacgtgaagagcctgaactggggccacagagtgcagctgcaggacagaaaggtgaagtacttcaacatcaaggccagcttcgtggacgagcacaccgtgtgcggcgtggccaagggcggcaaggagatcctgctgagcgccgaccacatcatcatcgccaccggcggcagacccagataccccacccacatcgagggcgccctggagtacggcatcaccagcgacgacatcttctggctgaaggagagccccggcaagaccctggtggtgggcgccagctacgtggccctggagtgcgccggcttcctgaccggcatcggcctggacaccaccatcatgatgagaagcatccccctgagaggcttcgaccagcagatgagcagcatggtgatcgagcacatggccagccacggcaccagattcctgagaggctgcgcccccagcagagtgagaagactgcccgacggccagctgcaggtgacctgggaggacagcaccaccggcaaggaggacaccggcaccttcgacaccgtgctgtgggccatcggcagagtgcccgacaccagaagcctgaacctggagaaggccggcgtggacaccagccccgacacccagaagatcctggtggacagcagagaggccaccagcgtgccccacatctacgccatcggcgacgtggtggagggcagacccgagctgacccccatcgccatcatggccggcagactgctggtgcagagactgttcggcggcagcagcgacctgatggactacgacaacgtgcccaccaccgtgttcacccccctggagtacggctgcgtgggcctgagcgaggaggaggccgtggccagacacggccaggagcacgtggaggtgtaccacgcccactacaagcccctggagttcaccgtggccggcagagacgccagccagtgctacgtgaagatggtgtgcctgagagagcccccccagctggtgctgggcctgcacttcctgggccccaacgccggcgaggtgacccagggcttcgccctgggcatcaagtgcggcgccagctacgcccaggtgatgagaaccgtgggcatccaccccacctgcagcgaggaggtggtgaagctgagaatcagcaagagaagcggcctggaccccaccgtgaccggctgctag

SEQ ID NO: 102358 - DNA, 1569 bp, Artificial Sequence
  Description of Artificial Sequence: Synthetic coding sequence
atggccgccatggccgtggccctgagaggcctgggcggcagattcagatggagaacccaggccgtggccggcggcgtgagaggcgccgccagaggcgccgccgccggccagagagactacgacctgctggtggtgggcggcggcagcggcggcctggcctgcgccaaggaggccgcccagctgggcagaaaggtggccgtggtggactacgtggagcccagcccccagggcaccagatggggcctgggcggcacctgcgtgaacgtgggctgcatccccaagaagctgatgcaccaggccgccctgctgggcggcctgatccaggacgcccccaactacggctgggaggtggcccagcccgtgccccacgactggagaaagatggccgaggccgtgcagaaccacgtgaagagcctgaactggggccacagagtgcagctgcaggacagaaaggtgaagtacttcaacatcaaggccagcttcgtggacgagcacaccgtgtgcggcgtggccaagggcggcaaggagatcctgctgagcgccgaccacatcatcatcgccaccggcggcagacccagataccccacccacatcgagggcgccctggagtacggcatcaccagcgacgacatcttctggctgaaggagagccccggcaagaccctgcccgtgagcgtgagctacgtggccctggagtgcgccggcttcctgaccggcatcggcctggacaccaccatcatgatgagaagcatccccctgagaggcttcgaccagcagatgagcagcatggtgatcgagcacatggccagccacggcaccagattcctgagaggctgcgcccccagcagagtgagaagactgcccgacggccagctgcaggtgacctgggaggacagcaccaccggcaaggaggacaccggcaccttcgacaccgtgctgtgggccatcggcagagtgcccgacaccagaagcctgaacctggagaaggccggcgtggacaccagccccgacacccagaagatcctggtggacagcagagaggccaccagcgtgccccacatctacgccatcggcgacgtggtggagggcagacccgagctgacccccatcgccatcatggccggcagactgctggtgcagagactgttcggcggcagcagcgacctgatggactacgacaacgtgcccaccaccgtgttcacccccctggagtacggctgcgtgggcctgagcgaggaggaggccgtggccagacacggccaggagcacgtggaggtgtaccacgcccactacaagcccctggagttcaccgtggccggcagagacgccagccagtgctacgtgaagatggtgtgcctgagagagcccccccagctggtgctgggcctgcacttcctgggccccaacgccggcgaggtgacccagggcttcgccctgggcatcaagtgcggcgccagctacgcccaggtgatgagaaccgtgggcatccaccccacctgcagcgaggaggtggtgaagctgagaatcagcaagagaagcggcctggaccccaccgtgaccggctgctag

SEQ ID NO: 102359 - DNA, 1281 bp, Artificial Sequence
  Description of Artificial Sequence: Synthetic coding sequence
atgcaccaggccgccctgctgggcggcctgatccaggacgcccccaactacggctgggaggtggcccagcccgtgccccacgactggagaaagatggccgaggccgtgcagaaccacgtgaagagcctgaactggggccacagagtgcagctgcaggacagaaaggtgaagtacttcaacatcaaggccagcttcgtggacgagcacaccgtgtgcggcgtggccaagggcggcaaggagatcctgctgagcgccgaccacatcatcatcgccaccggcggcagacccagataccccacccacatcgagggcgccctggagtacggcatcaccagcgacgacatcttctggctgaaggagagccccggcaagacctgcgtggtggcccacgcctacgtggccctggagtgcgccggcttcctgaccggcatcggcctggacaccaccatcatgatgagaagcatccccctgagaggcttcgaccagcagatgagcagcatggtgatcgagcacatggccagccacggcaccagattcctgagaggctgcgcccccagcagagtgagaagactgcccgacggccagctgcaggtgacctgggaggacagcaccaccggcaaggaggacaccggcaccttcgacaccgtgctgtgggccatcggcagagtgcccgacaccagaagcctgaacctggagaaggccggcgtggacaccagccccgacacccagaagatcctggtggacagcagagaggccaccagcgtgccccacatctacgccatcggcgacgtggtggagggcagacccgagctgacccccatcgccatcatggccggcagactgctggtgcagagactgttcggcggcagcagcgacctgatggactacgacaacgtgcccaccaccgtgttcacccccctggagtacggctgcgtgggcctgagcgaggaggaggccgtggccagacacggccaggagcacgtggaggtgtaccacgcccactacaagcccctggagttcaccgtggccggcagagacgccagccagtgctacgtgaagatggtgtgcctgagagagcccccccagctggtgctgggcctgcacttcctgggccccaacgccggcgaggtgacccagggcttcgccctgggcatcaagtgcggcgccagctacgcccaggtgatgagaaccgtgggcatccaccccacctgcagcgaggaggtggtgaagctgagaatcagcaagagaagcggcctggaccccaccgtgaccggctgctag

SEQ ID NO: 102360 - DNA, 1479 bp, Artificial Sequence
  Description of Artificial Sequence: Synthetic coding sequence
atggaggaccaggccggccagagagactacgacctgctggtggtgggcggcggcagcggcggcctggcctgcgccaaggaggccgcccagctgggcagaaaggtggccgtggtggactacgtggagcccagcccccagggcaccagatggggcctgggcggcacctgcgtgaacgtgggctgcatccccaagaagctgatgcaccaggccgccctgctgggcggcctgatccaggacgcccccaactacggctgggaggtggcccagcccgtgccccacgactggagaaagatggccgaggccgtgcagaaccacgtgaagagcctgaactggggccacagagtgcagctgcaggacagaaaggtgaagtacttcaacatcaaggccagcttcgtggacgagcacaccgtgtgcggcgtggccaagggcggcaaggagatcctgctgagcgccgaccacatcatcatcgccaccggcggcagacccagataccccacccacatcgagggcgccctggagtacggcatcaccagcgacgacatcttctggctgaaggagagccccggcaagaccctggtggtgggcgccagctacgtggccctggagtgcgccggcttcctgaccggcatcggcctggacaccaccatcatgatgagaagcatccccctgagaggcttcgaccagcagatgagcagcatggtgatcgagcacatggccagccacggcaccagattcctgagaggctgcgcccccagcagagtgagaagactgcccgacggccagctgcaggtgacctgggaggacagcaccaccggcaaggaggacaccggcaccttcgacaccgtgctgtgggccatcggcagagtgcccgacaccagaagcctgaacctggagaaggccggcgtggacaccagccccgacacccagaagatcctggtggacagcagagaggccaccagcgtgccccacatctacgccatcggcgacgtggtggagggcagacccgagctgacccccatcgccatcatggccggcagactgctggtgcagagactgttcggcggcagcagcgacctgatggactacgacaacgtgcccaccaccgtgttcacccccctggagtacggctgcgtgggcctgagcgaggaggaggccgtggccagacacggccaggagcacgtggaggtgtaccacgcccactacaagcccctggagttcaccgtggccggcagagacgccagccagtgctacgtgaagatggtgtgcctgagagagcccccccagctggtgctgggcctgcacttcctgggccccaacgccggcgaggtgacccagggcttcgccctgggcatcaagtgcggcgccagctacgcccaggtgatgagaaccgtgggcatccaccccacctgcagcgaggaggtggtgaagctgagaatcagcaagagaagcggcctggaccccaccgtgaccggctgctag

SEQ ID NO: 102361 - DNA, 429 bp, Artificial Sequence
  Description of Artificial Sequence: Synthetic coding sequence
atgagctacatgctgccccacctgcacaacggctggcaggtggaccaggccatcctgagcgaggaggacagagtggtggtgatcagattcggccacgactgggaccccacctgcatgaagatggacgaggtgctgtacagcatcgccgagaaggtgaagaacttcgccgtgatctacctggtggacatcaccgaggtgcccgacttcaacaagatgtacgagctgtacgacccctgcaccgtgatgttcttcttcagaaacaagcacatcatgatcgacctgggcaccggcaacaacaacaagatcaactgggccatggaggacaagcaggagatggtggacatcatcgagaccgtgtacagaggcgccagaaagggcagaggcctggtggtgagccccaaggactacagcaccaagtacagatactag

SEQ ID NO: 102362 - DNA, 276 bp, Artificial Sequence
  Description of Artificial Sequence: Synthetic coding sequence
atgagctacatgctgccccacctgcacaacggctggcaggtggaccaggccatcctgagcgaggaggacagagtggtggtgatcagattcggccacgactgggaccccacctgcatgaagatggacgaggtgctgtacagcatcgccgagaaggtgaagaacttcgccgtgatctacctggtggacatcaccgaggtgcccgacttcaacaagatgtacgagctgtacgacccctgcaccgtgatgttcttcttcagctaccacagaggctggtag

SEQ ID NO: 102363 - DNA, 894 bp, Artificial Sequence
  Description of Artificial Sequence: Synthetic coding sequence
atggtgcaccaggtgctgtacagagccctggtgagcaccaagtggctggccgagagcatcagaaccggcaagctgggccccggcctgagagtgctggacgccagctggtacagccccggcaccagagaggccagaaaggagtacctggagagacacgtgcccggcgccagcttcttcgacatcgaggagtgcagagacaccgccagcccctacgagatgatgctgcccagcgaggccggcttcgccgagtacgtgggcagactgggcatcagcaaccacacccacgtggtggtgtacgacggcgagcacctgggcagcttctacgcccccagagtgtggtggatgttcagagtgttcggccacagaaccgtgagcgtgctgaacggcggcttcagaaactggctgaaggagggccaccccgtgaccagcgagcccagcagacccgagcccgccgtgttcaaggccaccctggacagaagcctgctgaagacctacgagcaggtgctggagaacctggagagcaagagattccagctggtggacagcagaagccagggcagattcctgggcaccgagcccgagcccgacgccgtgggcctggacagcggccacatcagaggcgccgtgaacatgcccttcatggacttcctgaccgaggacggcttcgagaagggccccgaggagctgagagccctgttccagaccaagaaggtggacctgagccagcccctgatcgccacctgcagaaagggcgtgaccgcctgccacgtggccctggccgcctacctgtgcggcaagcccgacgtggccgtgtacgacggcagctggagcgagtggttcagaagagccccccccgagagcagagtgagccagggcaagagcgagaaggcctag

SEQ ID NO: 102364 - DNA, 894 bp, Artificial Sequence; identical to SEQ ID NO: 102363
  Description of Artificial Sequence: Synthetic coding sequence

SEQ ID NO: 102365 - DNA, 735 bp, Artificial Sequence
  Description of Artificial Sequence: Synthetic coding sequence
atggtgcaccaggtgctgtacagagccctggtgagcaccaagtggctggccgagagcatcagaaccggcaagctgggccccggcctgagagtgctggacgccagctggtacagccccggcaccagagaggccagaaaggagtacctggagagacacgtgcccggcgccagcttcttcgacatcgaggagtgcagagacaccgccagcccctacgagatgatgctgcccagcgaggccggcttcgccgagtacgtgggcagactgggcatcagcaaccacacccacgtggtggtgtacgacggcgagcacctgggcagcttctacgcccccagagtgtggtggatgttcagagtgttcggccacagaaccgtgagcgtgctgaacggcggcttcagaaactggctgaaggagggccaccccgtgaccagcgagcccagcagacccgagcccgccgtgttcaaggccaccctggacagaagcctgctgaagacctacgagcaggtgctggagaacctggagagcaagagattccagctggtggacagcagaagccagggcagattcctgggcaccgagcccgagcccgacgccgtgggcctggacagcggccacatcagaggcgccgtgaacatgcccttcatggacttcctgaccgaggacggcagctggagcgagtggttcagaagagccccccccgagagcagagtgagccagggcaagagcgagaaggcctag

SEQ ID NO: 102366 - DNA, 375 bp, Artificial Sequence
  Description of Artificial Sequence: Synthetic coding sequence
atggtgcaccaggtgctgtacagagccctggtgagcaccaagtggctggccgagagcatcagaaccggcaagctgggccccggcctgagagtgctggacgccagctggtacagccccggcaccagagaggccagaaaggagtacctggagagacacgtgcccggcgccagcttcttcgacatcgaggagtgcagagacaccgccagcccctacgagatgatgctgcccagcgaggccggcttcgccgagtacgtgggcagactgggcatcagcaaccacacccacgtggtggtgtacgacggcgagcacctgggcagcttctacgcccccagagtgtggtggatgttcagagtgttcggccacagaaccgtgtag

SEQ ID NO: 102367 - DNA, 1974 bp, Artificial Sequence
  Description of Artificial Sequence: Synthetic coding sequence
atgagccccaccccccccctgttcagcctgcccgaggccagaaccagattcaccaagagcaccagagaggccctgaacaacaagaacatcaagcccctgctgagcaccttcagccaggtgcccggcagcgagaacgagaagaagtgcaccctggaccaggccttcagaggcatcctggaggaggagatcatcaaccacagcagctgcgagaacgtgctggccatcatcagcctggccatcggcggcgtgaccgagggcatctgcaccgccagcacccccttcgtgctgctgggcgacgtgctggactgcctgcccctggaccagtgcgacaccatcttcaccttcgtggagaagaacgtggccacctggaagagcaacaccttctacagcgccggcaagaactacctgctgagaatgtgcaacgacctgctgagaagactgagcaagagccagaacaccgtgttctgcggcagaatccagctgttcctggccagactgttccccctgagcgagaagagcggcctgaacctgcagagccagttcaacctggagaacgtgaccgtgttcaacaccaacgagcaggagagcaccctgggccagaagcacaccgaggacagagaggagggcatggacgtggaggagggcgagatgggcgacgaggaggcccccaccacctgcagcatccccatcgactacaacctgtacagaaagttctggagcctgcaggactacttcagaaaccccgtgcagtgctacgagaagatcagctggaagaccttcctgaagtacagcgaggaggtgctggccgtgttcaagagctacaagctggacgacacccaggccagcagaaagaagatggaggagctgaagaccggcggcgagcacgtgtacttcgccaagttcctgaccagcgagaagctgatggacctgcagctgagcgacagcaacttcagaagacacatcctgctgcagtacctgatcctgttccagtacctgaagggccaggtgaagttcaagagcagcaactacgtgctgaccgacgagcagagcctgtggatcgaggacaccaccaagagcgtgtaccagctgctgagcgagaacccccccgacggcgagagattcagcaagatggtggagcacatcctgaacaccgaggagaactggaacagctggaagaacgagggctgccccagcttcgtgaaggagagaaccagcgacaccaagcccaccagaatcatcagaaagagaaccgcccccgaggacttcctgggcaagggccccaccaagaagatcctgatgggcaacgaggagctgaccagactgtggaacctgtgccccgacaacatggaggcctgcaagagcgagaccagagagcacatgcccaccctggaggagttcttcgaggaggccatcgagcaggccgaccccgagaacatggtggagaacgagtacaaggccgtgaacaacagcaactacggctggagagccctgagactgctggccagaagaagcccccacttcttccagcccaccaaccagcagttcaagagcctgcccgagtacctggagaacatggtgatcaagctggccaaggagctgcccccccccagcgaggagatcaagaccggcgaggacgaggacgaggaggacaacgacgccctgctgaaggagaacgagagccccgacgtgagaagagacaagcccgtgaccggcgagcagatcgaggtgttcgccaacaagctgggcgagcagtggaagatcctggccccctacctggagatgaaggacagcgagatcagacagatcgagtgcgacagcgaggacatgaagatgagagccaagcagctgctggtggcctggcaggaccaggagggcgtgcacgccacccccgagaacctgatcaacgccctgaacaagagcggcctgagcgacctggccgagagcctgaccaacgacaacgagaccaacagctag

SEQ ID NO: 102368 - DNA, 4782 bp, Artificial Sequence
  Description of Artificial Sequence: Synthetic coding sequence
atggccgccgccgccgtggtggtgcccgccgagtggatcaagaactgggagaagagcggcagaggcgagttcctgcacctgtgcagaatcctgagcgagaacaagagccacgacagcagcacctacagagacttccagcaggccctgtacgagctgagctaccacgtgatcaagggcaacctgaagcacgagcaggccagcaacgtgctgagcgacatcagcgagttcagagaggacatgcccagcatcctggccgacgtgttctgcatcctggacatcgagaccaactgcctggaggagaagagcaagagagactacttcacccagctggtgctggcctgcctgtacctggtgagcgacaccgtgctgaaggagagactggaccccgagaccctggagagcctgggcctgatcaagcagagccagcagttcaaccagaagagcgtgaagatcaagaccaagctgttctacaagcagcagaagttcaacctgctgagagaggagaacgagggctacgccaagctgatcgccgagctgggccaggacctgagcggcagcatcaccagcgacctgatcctggagaacatcaagagcctgatcggctgcttcaacctggaccccaacagagtgctggacgtgatcctggaggtgttcgagtgcagacccgagcacgacgacttcttcatcagcctgctggagagctacatgagcatgtgcgagccccagaccctgtgccacatcctgggcttcaagttcaagttctaccaggagcccaacggcgagacccccagcagcctgtacagagtggccgccgtgctgctgcagttcaacctgatcgacctggacgacctgtacgtgcacctgctgcccgccgacaactgcatcatggacgagcacaagagagagatcgccgaggccaagcagatcgtgagaaagctgaccatggtggtgctgagcagcgagaagatggacgagagagagaaggagaaggagaaggaggaggagaaggtggagaagccccccgacaaccagaagctgggcctgctggaggccctgctgaagatcggcgactggcagcacgcccagaacatcatggaccagatgcccccctactacgccgccagccacaagctgatcgccctggccatctgcaagctgatccacatcaccatcgagcccctgtacagaagagtgggcgtgcccaagggcgccaagggcagccccgtgaacgccctgcagaacaagagagcccccaagcaggccgagagcttcgaggacctgagaagagacgtgttcaacatgttctgctacctgggcccccacctgagccacgaccccatcctgttcgccaaggtggtgagaatcggcaagagcttcatgaaggagttccagagcgacggcagcaagcaggaggacaaggagaagaccgaggtgatcctgagctgcctgctgagcatcaccgaccaggtgctgctgcccagcctgagcctgatggactgcaacgcctgcatgagcgaggagctgtggggcatgttcaagaccttcccctaccagcacagatacagactgtacggccagtggaagaacgagacctacaacagccaccccctgctggtgaaggtgaaggcccagaccatcgacagagccaagtacatcatgaagagactgaccaaggagaacgtgaagcccagcggcagacagatcggcaagctgagccacagcaaccccaccatcctgttcgactacatcctgagccagatccagaagtacgacaacctgatcacccccgtggtggacagcctgaagtacctgaccagcctgaactacgacgtgctggcctactgcatcatcgaggccctggccaaccccgagaaggagagaatgaagcacgacgacaccaccatcagcagctggctgcagagcctggccagcttctgcggcgccgtgttcagaaagtaccccatcgacctggccggcctgctgcagtacgtggccaaccagctgaaggccggcaagagcttcgacctgctgatcctgaaggaggtggtgcagaagatggccggcatcgagatcaccgaggagatgaccatggagcagctggaggccatgaccggcggcgagcagctgaaggccgagggcggctacttcggccagatcagaaacaccaagaagagcagccagagactgaaggacgccctgctggaccacgacctggccctgcccctgtgcctgctgatggcccagcagagaaacggcgtgatcttccaggagggcggcgagaagcacctgaagctggtgggcaagctgtacgaccagtgccacgacaccctggtgcagttcggcggcttcctggccagcaacctgagcaccgaggactacatcaagagagtgcccagcatcgacgtgctgtgcaacgagttccacaccccccacgacgccgccttcttcctgagcagacccatgtacgcccaccacatcagcagcaagtacgacgagctgaagaagagcgagaagggcagcaagcagcagcacaaggtgcacaagtacatcaccagctgcgagatggtgatggcccccgtgcacgaggccgtggtgagcctgcacgtgagcaaggtgtgggacgacatcagcccccagttctacgccaccttctggagcctgaccatgtacgacctggccgtgccccacaccagctacgagagagaggtgaacaagctgaaggtgcagatgaaggccatcgacgacaaccaggagatgccccccaacaagaagaagaaggagaaggagagatgcaccgccctgcaggacaagctgctggaggaggagaagaagcagatggagcacgtgcagagagtgctgcagagactgaagctggagaaggacaactggctgctggccaagagcaccaagaacgagaccatcaccaagttcctgcagctgtgcatcttccccagatgcatcttcagcgccatcgacgccgtgtactgcgccagattcgtggagctggtgcaccagcagaagacccccaacttcagcaccctgctgtgctacgacagagtgttcagcgacatcatctacaccgtggccagctgcaccgagaacgaggccagcagatacggcagattcctgtgctgcatgctggagaccgtgaccagatggcacagcgacagagccacctacgagaaggagtgcggcaactaccccggcttcctgaccatcctgagagccaccggcttcgacggcggcaacaaggccgaccagctggactacgagaacttcagacacgtggtgcacaagtggcactacaagctgaccaaggccagcgtgcactgcctggagaccggcgagtacacccacatcagaaacatcctgatcgtgctgaccaagatcctgccctggtaccccaaggtgctgaacctgggccaggccctggagagaagagtgcacaagatctgccaggaggagaaggagaagagacccgacctgtacgccctggccatgggctacagcggccagctgaagagcagaaagagctacatgatccccgagaacgagttccaccacaaggaccccccccccagaaacgccgtggccagcgtgcagaacggccccggcggcggccccagcagcagcagcatcggcagcgccagcaagagcgacgagagcagcaccgaggagaccgacaagagcagagagagaagccagtgcggcgtgaaggccgtgaacaaggccagcagcaccacccccaagggcaacagcagcaacggcaacagcggcagcaacagcaacaaggccgtgaaggagaacgacaaggagaagggcaaggagaaggagaaggagaagaaggagaagacccccgccaccacccccgaggccagagtgctgggcaaggacggcaaggagaagcccaaggaggagagacccaacaaggacgagaaggccagagagaccaaggagagaacccccaagagcgacaaggagaaggagaagttcaagaaggaggagaaggccaaggacgagaagttcaagaccaccgtgcccaacgccgagagcaagagcacccaggagagagagagagagaaggagcccagcagagagagagacatcgccaaggagatgaagagcaaggagaacgtgaagggcggcgagaagacccccgtgagcggcagcctgaagagccccgtgcccagaagcgacatccccgagcccgagagagagcagaagagaagaaagatcgacacccaccccagccccagccacagcagcaccgtgaaggacagcctgatcgagctgaaggagagcagcgccaagctgtacatcaaccacacccccccccccctgagcaagagcaaggagagagagatggacaagaaggacctggacaagagcagagagagaagcagagagagagagaagaaggacgagaaggacagaaaggagagaaagagagaccacagcaacaacgacagagaggtgccccccgacctgaccaagagaagaaaggaggagaacggcaccatgggcgtgagcaagcacaagagcgagagcccctgcgagagcccctaccccaacgagaaggacaaggagaagaacaagagcaagagcagcggcaaggagaagggcagcgacagcttcaagagcgagaagatggacaagatcagcagcggcggcaagaaggagagcagacacgacaaggagaagatcgagaagaaggagaagagagacagcagcggcggcaaggaggagaagaagcaccacaagagcagcgacaagcacagatag

SEQ ID NO: 102369 - DNA, 4782 bp, Artificial Sequence; identical to SEQ ID NO: 102368
  Description of Artificial Sequence: Synthetic coding sequence

SEQ ID NO: 102370 - DNA, 2547 bp, Artificial Sequence
  Description of Artificial Sequence: Synthetic coding sequence
atgcccagcatcctggccgacgtgttctgcatcctggacatcgagaccaactgcctggaggagaagagcaagagagactacttcacccagctggtgctggcctgcctgtacctggtgagcgacaccgtgctgaaggagagactggaccccgagaccctggagagcctgggcctgatcaagcagagccagcagttcaaccagaagagcgtgaagatcaagaccaagctgttctacaagcagcagaagttcaacctgctgagagaggagaacgagggctacgccaagctgatcgccgagctgggccaggacctgagcggcagcatcaccagcgacctgatcctggagaacatcaagagcctgatcggctgcttcaacctggaccccaacagagtgctggacgtgatcctggaggtgttcgagtgcagacccgagcacgacgacttcttcatcagcctgctggagagctacatgagcatgtgcgagccccagaccctgtgccacatcctgggcttcaagttcaagttctaccaggagcccaacggcgagacccccagcagcctgtacagagtggccgccgtgctgctgcagttcaacctgatcgacctggacgacctgtacgtgcacctgctgcccgccgacaactgcatcatggacgagcacaagagagagatcgccgaggccaagcagatcgtgagaaagctgaccatggtggtgctgagcagcgagaagatggacgagagagagaaggagaaggagaaggaggaggagaaggtggagaagccccccgacaaccagaagctgggcctgctggaggccctgctgaagatcggcgactggcagcacgcccagaacatcatggaccagatgcccccctactacgccgccagccacaagctgatcgccctggccatctgcaagctgatccacatcaccatcgagcccctgtacagaagagtgggcgtgcccaagggcgccaagggcagccccgtgaacgccctgcagaacaagagagcccccaagcaggccgagagcttcgaggacctgagaagagacgtgttcaacatgttctgctacctgggcccccacctgagccacgaccccatcctgttcgccaaggtggtgagaatcggcaagagcttcatgaaggagttccagagcgacggcagcaagcaggaggacaaggagaagaccgaggtgatcctgagctgcctgctgagcatcaccgaccaggtgctgctgcccagcctgagcctgatggactgcaacgcctgcatgagcgaggagctgtggggcatgttcaagaccttcccctaccagcacagatacagactgtacggccagtggaagaacgagacctacaacagccaccccctgctggtgaaggtgaaggcccagaccatcgacagagccaagtacatcatgaagagactgaccaaggagaacgtgaagcccagcggcagacagatcggcaagctgagccacagcaaccccaccatcctgttcgactacgtgtgcttcgagatcctgagccagatccagaagtacgacaacctgatcacccccgtggtggacagcctgaagtacctgaccagcctgaactacgacgtgctggcctactgcatcatcgaggccctggccaaccccgagaaggagagaatgaagcacgacgacaccaccatcagcagctggctgcagagcctggccagcttctgcggcgccgtgttcagaaagtaccccatcgacctggccggcctgctgcagtacgtggccaaccagctgaaggccggcaagagcttcgacctgctgatcctgaaggaggtggtgcagaagatggccggcatcgagatcaccgaggagatgaccatggagcagctggaggccatgaccggcggcgagcagctgaaggccgagggcggctacttcggccagatcagaaacaccaagaagagcagccagagactgaaggacgccctgctggaccacgacctggccctgcccctgtgcctgctgatggcccagcagagaaacggcgtgatcttccaggagggcggcgagaagcacctgaagctggtgggcaagctgtacgaccagtgccacgacaccctggtgcagttcggcggcttcctggccagcaacctgagcaccgaggactacatcaagagagtgcccagcatcgacgtgctgtgcaacgagttccacaccccccacgacgccgccttcttcctgagcagacccatgtacgcccaccacatcagcagcaagtacgacgagctgaagaagagcgagaagggcagcaagcagcagcacaaggtgcacaagtacatcaccagctgcgagatggtgatggcccccgtgcacgaggccgtggtgagcctgcacgtgagcaaggtgtgggacgacatcagcccccagttctacgccaccttctggagcctgaccatgtacgacctggccgtgccccacaccagctacgagagagaggtgaacaagctgaaggtgcagatgaaggccatcgacgacaaccaggagatgatccccccccagtag

SEQ ID NO: 102371 - DNA, 570 bp, Artificial Sequence
  Description of Artificial Sequence: Synthetic coding sequence
tgagagcagaagagaagaaagatcgacacccaccccagccccagccacagcagcaccgtgaaggacagcctgatcgagctgaaggagagcagcgccaagctgtacatcaaccacacccccccccccctgagcaagagcaaggagagagagatggacaagaaggacctggacaagagcagagagagaagcagagagagagagaagaaggacgagaaggacagaaaggagagaaagagagaccacagcaacaacgacagagaggtgccccccgacctgaccaagagaagaaaggaggagaacggcaccatgggcgtgagcaagcacaagagcgagagcccctgcgagagcccctaccccaacgagaaggacaaggagaagaacaagagcaagagcagcggcaaggagaagggcagcgacagcttcaagagcgagaagatggacaagatcagcagcggcggcaagaaggagagcagacacgacaaggagaagatcgagaagaaggagaagagagacagcagcggcggcaaggaggagaagaagcaccacaagagcagcgacaagcacagatag

SEQ ID NO: 102372 - DNA, 1056 bp, Artificial Sequence
  Description of Artificial Sequence: Synthetic coding sequence
atggccgtgcccgccgccgccatgggccccagcgccctgggccagagcggccccggcagcatggccccctggtgcagcgtgagcagcggccccagcagatacgtgctgggcatgcaggagctgttcagaggccacagcaagaccagagagttcctggcccacagcgccaaggtgcacagcgtggcctggagctgcgacggcagaagactggccagcggcagcttcgacaagaccgccagcgtgttcctgctggagaaggacagactggtgaaggagaacaactacagaggccacggcgacagcgtggaccagctgtgctggcaccccagcaaccccgacctgttcgtgaccgccagcggcgacaagaccatcagaatctgggacgtgagaaccaccaagtgcatcgccaccgtgaacaccaagggcgagaacatcaacatctgctggagccccgacggccagaccatcgccgtgggcaacaaggacgacgtggtgaccttcatcgacgccaagacccacagaagcaaggccgaggagcagttcaagttcgaggtgaacgagatcagctggaacaacgacaacaacatgttcttcctgaccaacggcaacggctgcatcaacatcctgagctaccccgagctgaagcccgtgcagagcatcaacgcccaccccagcaactgcatctgcatcaagttcgaccccatgggcaagtacttcgccaccggcagcgccgacgccctggtgagcctgtgggacgtggacgagctggtgtgcgtgagatgcttcagcagactggactggcccgtgagaaccctgagcttcagccacgacggcaagatgctggccagcgccagcgaggaccacttcatcgacatcgccgaggtggagaccggcgacaagctgtgggaggtgcagtgcgagagccccaccttcaccgtggcctggcaccccaagagacccctgctggccttcgcctgcgacgacaaggacggcaagtacgacagcagcagagaggccggcaccgtgaagctgttcggcctgcccaacgacagctag

SEQ ID NO: 102373 - DNA, 2052 bp, Artificial Sequence
  Description of Artificial Sequence: Synthetic coding sequence
atgagcagcgagagcagcaagaagagaaagcccaaggtgatcagaagcgacggcgcccccgccgagggcaagagaaacagaagcgacaccgagcaggagggcaagtactacagcgaggaggccgaggtggacctgagagaccccggcagagactacgagctgtacaagtacacctgccaggagctgcagagactgatggccgagatccaggacctgaagagcagaggcggcaaggacgtggccatcgagatcgaggagagaagaatccagagctgcgtgcacttcatgaccctgaagaagctgaacagactggcccacatcagactgaagaagggcagagaccagacccacgaggccaagcagaaggtggacgcctaccacctgcagctgcagaacctgctgtacgaggtgatgcacctgcagaaggagatcaccaagtgcctggagttcaagagcaagcacgaggagatcgacctggtgagcctggaggagttctacaaggaggccccccccgacatcagcaaggccgaggtgaccatgggcgacccccaccagcagaccctggccagactggactgggagctggagcagagaaagagactggccgagaagtacagagagtgcctgagcaacaaggagaagatcctgaaggagatcgaggtgaagaaggagtacctgagcagcctgcagcccagactgaacagcatcatgcaggccagcctgcccgtgcaggagtacctgttcatgcccttcgaccaggcccacaagcagtacgagaccgccagacacctgcccccccccctgtacgtgctgttcgtgcaggccaccgcctacggccaggcctgcgacaagaccctgagcgtggccatcgagggcagcgtggacgaggccaaggccctgttcaagccccccgaggacagccaggacgacgagagcgacagcgacgccgaggaggagcagaccaccaagagaagaagacccaccctgggcgtgcagctggacgacaagagaaaggagatgctgaagagacaccccctgagcgtgatgctggacctgaagtgcaaggacgacagcgtgctgcacctgaccttctactacctgatgaacctgaacatcatgaccgtgaaggccaaggtgaccaccgccatggagctgatcacccccatcagcgccggcgacctgctgagccccgacagcgtgctgagctgcctgtaccccggcgaccacggcaagaagacccccaaccccgccaaccagtaccagttcgacaaggtgggcatcctgaccctgagcgactacgtgctggagctgggccacccctacctgtgggtgcagaagctgggcggcctgcacttccccaaggagcagccccagcagaccgtgatcgccgaccacagcctgagcgccagccacatggagaccaccatgaagctgctgaagaccagagtgcagagcagactggccctgcacaagcagttcgccagcctggagcacggcatcgtgcccgtgaccagcgactgccagtacctgttccccgccaaggtggtgagcagactggtgaagtgggtgaccgtggcccacgaggactacatggagctgcacttcaccaaggacatcgtggacgccggcctggccggcgacaccaacctgtactacatggccctgatcgagagaggcaccgccaagctgcaggccgccgtggtgctgaaccccggctacagcagcatcccccccgtgttccagctgtgcctgaactggaagggcgagaagaccaacagcaacgacgacaacatcagagccatggagggcgaggtgaacgtgtgctacaaggagctgtgcggcccctggcccagccaccagctgctgaccaaccagctgcagagactgtgcgtgctgctggacgtgtacctggagaccgagagccacgacgacagcgtggagggccccaaggagttcccccaggagaagatgtgcctgagactgttcagaggccccagcagaatgaagcccttcaagtacaaccacccccagggcttcttcagccacagatag

SEQ ID NO: 102374 - DNA, 2052 bp, Artificial Sequence; identical to SEQ ID NO: 102373
  Description of Artificial Sequence: Synthetic coding sequence

SEQ ID NO: 102375 - DNA, 2052 bp, Artificial Sequence; identical to SEQ ID NO: 102373
  Description of Artificial Sequence: Synthetic coding sequence

SEQ ID NO: 102376 - DNA, 282 bp, Artificial Sequence
  Description of Artificial Sequence: Synthetic coding sequence
atgagcagcgagagcagcaagaagagaaagcccaaggtgatcagaagcgacggcgcccccgccgagggcaagagaaacagaagcgacaccgagcaggagggcaagtactacagcgaggaggccgaggtggacctgagagaccccggcagagactacgagctgtacaagtacacctgccaggagctgcagagactgatggccgagatccaggacctgaagagcagaggcggcaaggacgtggccatcgagatcgaggagagaagaatccagagctgcgtgtag

SEQ ID NO: 102377 - DNA, 486 bp, Artificial Sequence
  Description of Artificial Sequence: Synthetic coding sequence
atgagcagcgagagcagcaagaagagaaagcccaaggtgatcagaagcgacggcgcccccgccgagggcaagagaaacagaagcgacaccgagcaggagggcaagtactacagcgaggaggccgaggtggacctgagagaccccggcagagactacgagctgtacaagtacacctgccaggagctgcagagactgatggccgagatccaggacctgaagagcagaggcggcaaggacgtggccatcgagatcgaggagagaagaatccagagctgcgtgcacttcatgaccctgaagaagctgaacagactggcccacatcagactgaagaagggcagagaccagacccacgaggccaagcagaaggtggacgcctaccacctgcagctgcagaacctgctgtacgaggtgatgcacctgcagaaggagatcaccaagtgcctggagttcaagagcaagcacgaggagatcgacctggtgagctag

SEQ ID NO: 102378 - DNA, 672 bp, Artificial Sequence
  Description of Artificial Sequence: Synthetic coding sequence
atgagcagcgagagcagcaagaagagaaagcccaaggtgatcagaagcgacggcgcccccgccgagggcaagagaaacagaagcgacaccgagcaggagggcaagtactacagcgaggaggccgaggtggacctgagagaccccggcagagactacgagctgtacaagtacacctgccaggagctgcagagactgatggccgagatccaggacctgaagagcagaggcggcaaggacgtggccatcgagatcgaggagagaagaatccagagctgcgtgcacttcatgaccctgaagaagctgaacagactggcccacatcagactgaagaagggcagagaccagacccacgaggccaagcagaaggtggacgcctaccacctgcagctgcagaacctgctgtacgaggtgatgcacctgcagaaggagatcaccaagtgcctggagttcaagagcaagcacgaggagatcgacctggtgagcctggaggagttctacaaggaggccccccccgacatcagcaaggccgaggtgaccatgggcgacccccaccagcagaccctggccagactggactgggagctggagcagagaaagagactggccgagaagtacagagagtgcctgagcaacaaggagaagatcctgaaggagatcgaggtgaagaagtag

SEQ ID NO: 102379 - DNA, 2052 bp, Artificial Sequence; identical to SEQ ID NO: 102373
  Description of Artificial Sequence: Synthetic coding sequence

SEQ ID NO: 102380 - DNA, 615 bp, Artificial Sequence
  Description of Artificial Sequence: Synthetic coding sequence
atgggcgccgtgaccgacgacgaggtgatcagaaagagactgctgatcgacggcgacggcgccggcgacgacagaagaatcaacctgctggtgaagagcttcatcaagtggtgcaacagcggcagccaggaggagggctacagccagtaccagagaatgctgagcaccctgagccagtgcgagttcagcatgggcaagaccctgctggtgtacgacatgaacctgagagagatggagaactacgagaagatctacaaggagatcgagtgcagcatcgccggcgcccacgagaagatcgccgagtgcaagaagcagatcctgcaggccaagagaatcagaaagaacagacaggagtacgacgccctggccaaggtgatccagcaccaccccgacagacacgagaccctgaaggagctggaggccctgggcaaggagctggagcacctgagccacatcaaggagagcgtggaggacaagctggagctgagaagaaagcagttccacgtgctgctgagcaccatccacgagctgcagcagaccctggagaacgacgagaagctgagcgaggtggaggaggcccaggaggccagcatggagaccgaccccaagccctag

SEQ ID NO: 102381 - DNA, 711 bp, Artificial Sequence
  Description of Artificial Sequence: Synthetic coding sequence
atgagcgaggcccccagagccgagaccttcgtgttcctggacctggaggccaccggcctgcccagcgtggagcccgagatcgccgagctgagcctgttcgccgtgcacagaagcagcctggagaaccccgagcacgacgagagcggcgccctggtgctgcccagagtgctggacaagctgaccctgtgcatgtgccccgagagacccttcaccgccaaggccagcgagatcaccggcctgagcagcgagggcctggccagatgcagaaaggccggcttcgacggcgccgtggtgagaaccctgcaggccttcctgagcagacaggccggccccatctgcctggtggcccacaacggcttcgactacgacttccccctgctgtgcgccgagctgagaagactgggcgccagactgcccagagacaccgtgtgcctggacaccctgcccgccctgagaggcctggacagagcccacagccacggcaccagagccagaggcagacagggctacagcctgggcagcctgttccacagatacttcagagccgagcccagcgccgcccacagcgccgagggcgacgtgcacaccctgctgctgatcttcctgcacagagccgccgagctgctggcctgggccgacgagcaggccagaggctgggcccacatcgagcccatgtacctgccccccgacgaccccagcctggaggcctag

SEQ ID NO: 102382 - DNA, 840 bp, Artificial Sequence
  Description of Artificial Sequence: Synthetic coding sequence
atgggcagagccggcagccccctgcccagaagcagctggcccagaatggacgactgcggcagcagaagcagatgcagccccaccctgtgcagcagcctgagaacctgctaccccagaggcaacatcaccatgagcgaggcccccagagccgagaccttcgtgttcctggacctggaggccaccggcctgcccagcgtggagcccgagatcgccgagctgagcctgttcgccgtgcacagaagcagcctggagaaccccgagcacgacgagagcggcgccctggtgctgcccagagtgctggacaagctgaccctgtgcatgtgccccgagagacccttcaccgccaaggccagcgagatcaccggcctgagcagcgagggcctggccagatgcagaaaggccggcttcgacggcgccgtggtgagaaccctgcaggccttcctgagcagacaggccggccccatctgcctggtggcccacaacggcttcgactacgacttccccctgctgtgcgccgagctgagaagactgggcgccagactgcccagagacaccgtgtgcctggacaccctgcccgccctgagaggcctggacagagcccacagccacggcaccagagccagaggcagacagggctacagcctgggcagcctgttccacagatacttcagagccgagcccagcgccgcccacagcgccgagggcgacgtgcacaccctgctgctgatcttcctgcacagagccgccgagctgctggcctgggccgacgagcaggccagaggctgggcccacatcgagcccatgtacctgccccccgacgaccccagcctggaggcctag

SEQ ID NO: 102383 - DNA, 711 bp, Artificial Sequence; identical to SEQ ID NO: 102381
  Description of Artificial Sequence: Synthetic coding sequence

SEQ ID NO: 102384 - DNA, 711 bp, Artificial Sequence; identical to SEQ ID NO: 102381
  Description of Artificial Sequence: Synthetic coding sequence

SEQ ID NO: 102385 - DNA, 840 bp, Artificial Sequence; identical to SEQ ID NO: 102382
  Description of Artificial Sequence: Synthetic coding sequence

SEQ ID NO: 102386 - DNA, 711 bp, Artificial Sequence; identical to SEQ ID NO: 102381
  Description of Artificial Sequence: Synthetic coding sequence

SEQ ID NO: 102387 - DNA, 840 bp, Artificial Sequence; identical to SEQ ID NO: 102382
  Description of Artificial Sequence: Synthetic coding sequence

SEQ ID NO: 102388 - DNA, 837 bp, Artificial Sequence
  Description of Artificial Sequence: Synthetic coding sequence
atgatcgtggccgccgaggccgtggccgcccccagatgcgccctggtgggcgacagaagcggcgccgacgcccccagagccaagggccacagcctgagaacctgctaccccagaggcaacatcaccatgagcgaggcccccagagccgagaccttcgtgttcctggacctggaggccaccggcctgcccagcgtggagcccgagatcgccgagctgagcctgttcgccgtgcacagaagcagcctggagaaccccgagcacgacgagagcggcgccctggtgctgcccagagtgctggacaagctgaccctgtgcatgtgccccgagagacccttcaccgccaaggccagcgagatcaccggcctgagcagcgagggcctggccagatgcagaaaggccggcttcgacggcgccgtggtgagaaccctgcaggccttcctgagcagacaggccggccccatctgcctggtggcccacaacggcttcgactacgacttccccctgctgtgcgccgagctgagaagactgggcgccagactgcccagagacaccgtgtgcctggacaccctgcccgccctgagaggcctggacagagcccacagccacggcaccagagccagaggcagacagggctacagcctgggcagcctgttccacagatacttcagagccgagcccagcgccgcccacagcgccgagggcgacgtgcacaccctgctgctgatcttcctgcacagagccgccgagctgctggcctgggccgacgagcaggccagaggctgggcccacatcgagcccatgtacctgccccccgacgaccccagcctggaggcctag

SEQ ID NO: 102389 - DNA, 2172 bp, Artificial Sequence
  Description of Artificial Sequence: Synthetic coding sequence
atgttcgaggagaaggccagcagccccagcggcaagatgggcggcgaggagaagcccatcggcgccggcgaggagaagcagaaggagggcggcaagaagaagaacaaggagggcagcggcgacggcggcagagccgagctgaacccctggcccgagtacatctacaccagactggagatgtacaacatcctgaaggccgagcacgacagcatcctggccgagaaggccgagaaggacagcaagcccatcaaggtgaccctgcccgacggcaagcaggtggacgccgagagctggaagaccaccccctaccagatcgcctgcggcatcagccagggcctggccgacaacaccgtgatcgccaaggtgaacaacgtggtgtgggacctggacagacccctggaggaggactgcaccctggagctgctgaagttcgaggacgaggaggcccaggccgtgtactggcacagcagcgcccacatcatgggcgaggccatggagagagtgtacggcggctgcctgtgctacggcccccccatcgagaacggcttctactacgacatgtacctggaggagggcggcgtgagcagcaacgacttcagcagcctggaggccctgtgcaagaagatcatcaaggagaagcaggccttcgagagactggaggtgaagaaggagaccctgctggccatgttcaagtacaacaagttcaagtgcagaatcctgaacgagaaggtgaacacccccaccaccaccgtgtacagatgcggccccctgatcgacctgtgcagaggcccccacgtgagacacaccggcaagatcaaggccctgaagatccacaagaacagcagcacctactgggagggcaaggccgacatggagaccctgcagagaatctacggcatcagcttccccgaccccaagatgctgaaggagtgggagaagttccaggaggaggccaagaacagagaccacagaaagatcggcagagaccaggagctgtacttcttccacgagctgagccccggcagctgcttcttcctgcccaagggcgcctacatctacaacgccctgatcgagttcatcagaagcgagtacagaaagagaggcttccaggaggtggtgacccccaacatcttcaacagcagactgtggatgaccagcggccactggcagcactacagcgagaacatgttcagcttcgaggtggagaaggagctgttcgccctgaagcccatgaactgccccggccactgcctgatgttcgaccacagacccagaagctggagagagctgcccctgagactggccgacttcggcgtgctgcacagaaacgagctgagcggcgccctgaccggcctgaccagagtgagaagattccagcaggacgacgcccacatcttctgcgccatggagcagatcgaggacgagatcaagggctgcctggacttcctgagaaccgtgtacagcgtgttcggcttcagcttcaagctgaacctgagcaccagacccgagaagttcctgggcgacatcgaggtgtgggaccaggccgagaagcagctggagaacagcctgaacgagttcggcgagaagtgggagctgaacagcggcgacggcgccttctacggccccaagatcgacatccagatcaaggacgccatcggcagataccaccagtgcgccaccatccagctggacttccagctgcccatcagattcaacctgacctacgtgagccacgacggcgacgacaagaagagacccgtgatcgtgcacagagccatcctgggcagcgtggagagaatgatcgccatcctgaccgagaactacggcggcaagtggcccttctggctgagccccagacaggtgatggtggtgcccgtgggccccacctgcgacgagtacgcccagaaggtgagacagcagttccacgacgccaagttcatggccgacatcgacctggaccccggctgcaccctgaacaagaagatcagaaacgcccagctggcccagtacaacttcatcctggtggtgggcgagaaggagaagatcagcggcaccgtgaacatcagaaccagagacaacaaggtgcacggcgagagaaccatcagcgagaccatcgagagactgcagcagctgaaggagttcagaagcaagcaggccgaggaggagttctag

SEQ ID NO: 102390 - DNA, 1809 bp, Artificial Sequence
  Description of Artificial Sequence: Synthetic coding sequence
atgatccccttctggcagaagagacagaagaagatcgccagccagctgaagagcctgtgcctgatggtgaacagactgatgagaaacctgggcaagctgcaccacatcaagctgcccgtggagctggccatggagagagtgtacggcggctgcctgtgctacggcccccccatcgagaacggcttctactacgacatgtacctggaggagggcggcgtgagcagcaacgacttcagcagcctggaggccctgtgcaagaagatcatcaaggagaagcaggccttcgagagactggaggtgaagaaggagaccctgctggccatgttcaagtacaacaagttcaagtgcagaatcctgaacgagaaggtgaacacccccaccaccaccgtgtacagatgcggccccctgatcgacctgtgcagaggcccccacgtgagacacaccggcaagatcaaggccctgaagatccacaagaacagcagcacctactgggagggcaaggccgacatggagaccctgcagagaatctacggcatcagcttccccgaccccaagatgctgaaggagtgggagaagttccaggaggaggccaagaacagagaccacagaaagatcggcagagaccaggagctgtacttcttccacgagctgagccccggcagctgcttcttcctgcccaagggcgcctacatctacaacgccctgatcgagttcatcagaagcgagtacagaaagagaggcttccaggaggtggtgacccccaacatcttcaacagcagactgtggatgaccagcggccactggcagcactacagcgagaacatgttcagcttcgaggtggagaaggagctgttcgccctgaagcccatgaactgccccggccactgcctgatgttcgaccacagacccagaagctggagagagctgcccctgagactggccgacttcggcgtgctgcacagaaacgagctgagcggcgccctgaccggcctgaccagagtgagaagattccagcaggacgacgcccacatcttctgcgccatggagcagatcgaggacgagatcaagggctgcctggacttcctgagaaccgtgtacagcgtgttcggcttcagcttcaagctgaacctgagcaccagacccgagaagttcctgggcgacatcgaggtgtgggaccaggccgagaagcagctggagaacagcctgaacgagttcggcgagaagtgggagctgaacagcggcgacggcgccttctacggccccaagatcgacatccagatcaaggacgccatcggcagataccaccagtgcgccaccatccagctggacttccagctgcccatcagattcaacctgacctacgtgagccacgacggcgacgacaagaagagacccgtgatcgtgcacagagccatcctgggcagcgtggagagaatgatcgccatcctgaccgagaactacggcggcaagtggcccttctggctgagccccagacaggtgatggtggtgcccgtgggccccacctgcgacgagtacgcccagaaggtgagacagcagttccacgacgccaagttcatggccgacatcgacctggaccccggctgcaccctgaacaagaagatcagaaacgcccagctggcccagtacaacttcatcctggtggtgggcgagaaggagaagatcagcggcaccgtgaacatcagaaccagagacaacaaggtgcacggcgagagaaccatcagcgagaccatcgagagactgcagcagctgaaggagttcagaagcaagcaggccgaggaggagttctag

SEQ ID NO: 102391 - DNA, 2271 bp, Artificial Sequence
  Description of Artificial Sequence: Synthetic coding sequence
atgttcgaggagaaggccagcagccccagcggcaagatgggcggcgaggagaagcccatcggcgccggcgaggagaagcagaaggagggcggcaagaagaagaacaaggagggcagcggcgacggcggcagagccgagctgaacccctggcccgagtacatctacaccagactggagatgtacaacatcctgaaggccgagcacgacagcatcctggccgagaaggccgagaaggacagcaagcccatcaaggtgaccctgcccgacggcaagcaggtggacgccgagagctggaagaccaccccctaccagatcgcctgcggcatcagccacaccgccagctgcaagaacctgagcagcctggccagcctgctggccagcgtggccatccccagcagcggcatgccctggccccccctgttcttcctgcagggcctggccgacaacaccgtgatcgccaaggtgaacaacgtggtgtgggacctggacagacccctggaggaggactgcaccctggagctgctgaagttcgaggacgaggaggcccaggccgtgtactggcacagcagcgcccacatcatgggcgaggccatggagagagtgtacggcggctgcctgtgctacggcccccccatcgagaacggcttctactacgacatgtacctggaggagggcggcgtgagcagcaacgacttcagcagcctggaggccctgtgcaagaagatcatcaaggagaagcaggccttcgagagactggaggtgaagaaggagaccctgctggccatgttcaagtacaacaagttcaagtgcagaatcctgaacgagaaggtgaacacccccaccaccaccgtgtacagatgcggccccctgatcgacctgtgcagaggcccccacgtgagacacaccggcaagatcaaggccctgaagatccacaagaacagcagcacctactgggagggcaaggccgacatggagaccctgcagagaatctacggcatcagcttccccgaccccaagatgctgaaggagtgggagaagttccaggaggaggccaagaacagagaccacagaaagatcggcagagaccaggagctgtacttcttccacgagctgagccccggcagctgcttcttcctgcccaagggcgcctacatctacaacgccctgatcgagttcatcagaagcgagtacagaaagagaggcttccaggaggtggtgacccccaacatcttcaacagcagactgtggatgaccagcggccactggcagcactacagcgagaacatgttcagcttcgaggtggagaaggagctgttcgccctgaagcccatgaactgccccggccactgcctgatgttcgaccacagacccagaagctggagagagctgcccctgagactggccgacttcggcgtgctgcacagaaacgagctgagcggcgccctgaccggcctgaccagagtgagaagattccagcaggacgacgcccacatcttctgcgccatggagcagatcgaggacgagatcaagggctgcctggacttcctgagaaccgtgtacagcgtgttcggcttcagcttcaagctgaacctgagcaccagacccgagaagttcctgggcgacatcgaggtgtgggaccaggccgagaagcagctggagaacagcctgaacgagttcggcgagaagtgggagctgaacagcggcgacggcgccttctacggccccaagatcgacatccagatcaaggacgccatcggcagataccaccagtgcgccaccatccagctggacttccagctgcccatcagattcaacctgacctacgtgagccacgacggcgacgacaagaagagacccgtgatcgtgcacagagccatcctgggcagcgtggagagaatgatcgccatcctgaccgagaactacggcggcaagtggcccttctggctgagccccagacaggtgatggtggtgcccgtgggccccacctgcgacgagtacgcccagaaggtgagacagcagttccacgacgccaagttcatggccgacatcgacctggaccccggctgcaccctgaacaagaagatcagaaacgcccagctggcccagtacaacttcatcctggtggtgggcgagaaggagaagatcagcggcaccgtgaacatcagaaccagagacaacaaggtgcacggcgagagaaccatcagcgagaccatcgagagactgcagcagctgaaggagttcagaagcaagcaggccgaggaggagttctag

SEQ ID NO: 102392 - DNA, 2172 bp, Artificial Sequence; identical to SEQ ID NO: 102389
  Description of Artificial Sequence: Synthetic coding sequence

SEQ ID NO: 102393 - DNA, 390 bp, Artificial Sequence
  Description of Artificial Sequence: Synthetic coding sequence
atgttcgaggagaaggccagcagccccagcggcaagatgggcggcgaggagaagcccatcggcgccggcgaggagaagcagaaggagggcggcaagaagaagaacaaggagggcagcggcgacggcggcagagccgagctgaacccctggcccgagtacatctacaccagactggagatgtacaacatcctgaaggccgagcacgacagcatcctggccgagaaggccgagaaggacagcaagcccatcaaggtgaccctgcccgacggcaagcaggtggacgccgagagctggaagaccaccccctaccagatcgcctgcggcatcagccagggcctggccgacaacaccgtgatcgccaaggtgaacaacgtggtgtgggacctgtag

SEQ ID NO: 102394 - DNA, 1860 bp, Artificial Sequence
  Description of Artificial Sequence: Synthetic coding sequence
atggaggtggagctgagccagggcctggccgacaacaccgtgatcgccaaggtgaacaacgtggtgtgggacctggacagacccctggaggaggactgcaccctggagctgctgaagttcgaggacgaggaggcccaggccgtgtactggcacagcagcgcccacatcatgggcgaggccatggagagagtgtacggcggctgcctgtgctacggcccccccatcgagaacggcttctactacgacatgtacctggaggagggcggcgtgagcagcaacgacttcagcagcctggaggccctgtgcaagaagatcatcaaggagaagcaggccttcgagagactggaggtgaagaaggagaccctgctggccatgttcaagtacaacaagttcaagtgcagaatcctgaacgagaaggtgaacacccccaccaccaccgtgtacagatgcggccccctgatcgacctgtgcagaggcccccacgtgagacacaccggcaagatcaaggccctgaagatccacaagaacagcagcacctactgggagggcaaggccgacatggagaccctgcagagaatctacggcatcagcttccccgaccccaagatgctgaaggagtgggagaagttccaggaggaggccaagaacagagaccacagaaagatcggcagagaccaggagctgtacttcttccacgagctgagccccggcagctgcttcttcctgcccaagggcgcctacatctacaacgccctgatcgagttcatcagaagcgagtacagaaagagaggcttccaggaggtggtgacccccaacatcttcaacagcagactgtggatgaccagcggccactggcagcactacagcgagaacatgttcagcttcgaggtggagaaggagctgttcgccctgaagcccatgaactgccccggccactgcctgatgttcgaccacagacccagaagctggagagagctgcccctgagactggccgacttcggcgtgctgcacagaaacgagctgagcggcgccctgaccggcctgaccagagtgagaagattccagcaggacgacgcccacatcttctgcgccatggagcagatcgaggacgagatcaagggctgcctggacttcctgagaaccgtgtacagcgtgttcggcttcagcttcaagctgaacctgagcaccagacccgagaagttcctgggcgacatcgaggtgtgggaccaggccgagaagcagctggagaacagcctgaacgagttcggcgagaagtgggagctgaacagcggcgacggcgccttctacggccccaagatcgacatccagatcaaggacgccatcggcagataccaccagtgcgccaccatccagctggacttccagctgcccatcagattcaacctgacctacgtgagccacgacggcgacgacaagaagagacccgtgatcgtgcacagagccatcctgggcagcgtggagagaatgatcgccatcctgaccgagaactacggcggcaagtggcccttctggctgagccccagacaggtgatggtggtgcccgtgggccccacctgcgacgagtacgcccagaaggtgagacagcagttccacgacgccaagttcatggccgacatcgacctggaccccggctgcaccctgaacaagaagatcagaaacgcccagctggcccagtacaacttcatcctggtggtgggcgagaaggagaagatcagcggcaccgtgaacatcagaaccagagacaacaaggtgcacggcgagagaaccatcagcgagaccatcgagagactgcagcagctgaaggagttcagaagcaagcaggccgaggaggagttctag

SEQ ID NO: 102395 - DNA, 1332 bp, Artificial Sequence
  Description of Artificial Sequence: Synthetic coding sequence
atggagcacaaccccctgcccaccagccccgccgaccagttcaacaccggcagatactgcagcggccccagcaccgagtacggcttctaccacgacttcttcctgggcaaggagagatgcggcaccctggtggacctgtgccagggcccccacctgagacacaccggccagatcggcggcctgaagctgctgagcgccgagtacgcccacagaggcttcagcgaggtgaagacccccaccctgttcagcaccaagctgtgggagcagagcggccactgggagcactaccaggaggacatgttcgccgtgcagccccccggcagcgacagaccccccagcagccagagcgacgacagcaccagacacatcaccgacaccctggccctgaagcccatgaactgccccgcccactgcctgatgttcgcccacagacccagaagctggagagagctgcccctgagactggccgacttcggcgccctgcacagagccgaggccagcggcggcctgggcggcctgaccagactgagatgcttccagcaggacgacgcccacatcttctgcaccaccgaccagctggaggccgagatccagagctgcctggacttcctgagaagcgtgtacgccgtgctgggcttcagcttcagactggccctgagcaccagacccagcggcttcctgggcgacccctgcctgtgggaccaggccgagcaggtgctgaagcaggccctgaaggagttcggcgagccctgggacctgaacagcggcgacggcgccttctacggccccaagatcgacgtgcacctgcacgacgccctgggcagaccccaccagtgcggcaccatccagctggacttccagctgcccctgagattcgacctgcagtacaagggccaggccggcgccctggagagacccgtgctgatccacagagccgtgctgggcagcgtggagagactgctgggcgtgctggccgagagctgcggcggcaagtggcccctgtggctgagccccttccaggtggtggtgatccccgtgggcagcgagcaggaggagtacgccaaggaggcccagcagagcctgagagccgccggcctggtgagcgacctggacgccgacagcggcctgaccctgagcagaagaatcagaagagcccagctggcccactacaacttccagttcgtggtgggccagaaggagcagagcaagagaaccgtgaacatcagaaccagagacaacagaagactgggcgagtgggacctgcccgaggccgtgcagagactggtggagctgcagaacaccagagtgcccaacgccgaggagatcttctag

SEQ ID NO: 102396 - DNA, 1332 bp, Artificial Sequence
  Description of Artificial Sequence: Synthetic coding sequence
atggagcacaaccccctgcccaccagccccgccgaccagttcaacaccggcagatactgcagaggccccagcaccgagtacggcttctaccacgacttcttcctgggcaaggagagatgcggcaccctggtggacctgtgccagggcccccacctgagacacaccggccagatcggcggcctgaagctgctgagcgccgagtacgcccacagaggcttcagcgaggtgaagacccccaccctgttcagcaccaagctgtgggagcagagcggccactgggagcactaccaggaggacatgttcgccgtgcagccccccggcagcgacagaccccccagcagccagagcgacgacagcaccagacacatcaccgacaccctggccctgaagcccatgaactgccccgcccactgcctgatgttcgcccacagacccagaagctggagagagctgcccctgagactggccgacttcggcgccctgcacagagccgaggccagcggcggcctgggcggcctgaccagactgagatgcttccagcaggacgacgcccacatcttctgcaccaccgaccagctggaggccgagatccagagctgcctggacttcctgagaagcgtgtacgccgtgctgggcttcagcttcagactggccctgagcaccagacccagcggcttcctgggcgacccctgcctgtgggaccaggccgagcaggtgctgaagcaggccctgaaggagttcggcgagccctgggacctgaacagcggcgacggcgccttctacggccccaagatcgacgtgcacctgcacgacgccctgggcagaccccaccagtgcggcaccatccagctggacttccagctgcccctgagattcgacctgcagtacaagggccaggccggcgccctggagagacccgtgctgatccacagagccgtgctgggcagcgtggagagactgctgggcgtgctggccgagagctgcggcggcaagtggcccctgtggctgagccccttccaggtggtggtgatccccgtgggcagcgagcaggaggagtacgccaaggaggcccagcagagcctgagagccgccggcctggtgagcgacctggacgccgacagcggcctgaccctgagcagaagaatcagaagagcccagctggcccactacaacttccagttcgtggtgggccagaaggagcagagcaagagaaccgtgaacatcagaaccagagacaacagaagactgggcgagtgggacctgcccgaggccgtgcagagactggtggagctgcagaacaccagagtgcccaacgccgaggagatcttctag

SEQ ID NO: 102397 - DNA, 537 bp, Artificial Sequence
  Description of Artificial Sequence: Synthetic coding sequence
atggccctgtaccagagatggagatgcctgagactgcagggcctgcaggcctgcagactgcacaccgccgtggtgagcaccccccccagatggctggccgagagactgggcctgttcgaggagctgtgggccgcccaggtgaagagactggccagcatggcccagaaggagcccagaaccatcaagatcagcctgcccggcggccagaagatcgacgccgtggcctggaacaccaccccctaccagctggccagacagatcagcagcaccctggccgacaccgccgtggccgcccaggtgaacggcgagccctacgacctggagagacccctggagaccgacagcgacctgagattcctgaccttcgacagccccgagggcaaggccgtgagcttcttcctgatcagaaacaccgtgaccaccaagcccagagacatcgaggccggcaacagcaacatcctgttcttctgcagaagcttcagcatctgcagctgggagggcgacctgccccagaccgtgctgaccatcagcggctag

SEQ ID NO: 102398 - DNA, 1767 bp, Artificial Sequence
  Description of Artificial Sequence: Synthetic coding sequence
atggccctgtaccagagatggagatgcctgagactgcagggcctgcaggcctgcagactgcacaccgccgtggtgagcaccccccccagatggctggccgagagactgggcctgttcgaggagctgtgggccgcccaggtgaagagactggccagcatggcccagaaggagcccagaaccatcaagatcagcctgcccggcggccagaagatcgacgccgtggcctggaacaccaccccctaccagctggccagacagatcagcagcaccctggccgacaccgccgtggccgcccaggtgaacggcgagccctacgacctggagagacccctggagaccgacagcgacctgagattcctgaccttcgacagccccgagggcaaggccgtgttctggcacagcagcacccacgtgctgggcgccgccgccgagcagttcctgggcgccgtgctgtgcagaggccccagcaccgagtacggcttctaccacgacttcttcctgggcaaggagagaaccatcagaggcagcgagctgcccgtgctggagagaatctgccaggagctgaccgccgccgccagacccttcagaagactggaggccagcagagaccagctgagacagctgttcaaggccgagtacgcccacagaggcttcagcgaggtgaagacccccaccctgttcagcaccaagctgtgggagcagagcggccactgggagcactaccaggaggacatgttcgccgtgcagccccccggcagcgacagaccccccagcagccagagcgacgacagcaccagacacatcaccgacaccctggccctgaagcccatgaactgccccgcccactgcctgatgttcgcccacagacccagaagctggagagagctgcccctgagactggccgacttcggcgccctgcacagagccgaggccagcggcggcctgggcggcctgaccagactgagatgcttccagcaggacgacgcccacatcttctgcaccaccgaccagctggaggccgagatccagagctgcctggacttcctgagaagcgtgtacgccgtgctgggcttcagcttcagactggccctgagcaccagacccagcggcttcctgggcgacccctgcctgtgggaccaggccgagcaggtgctgaagcaggccctgaaggagttcggcgagccctgggacctgaacagcggcgacggcgccttctacggccccaagatcgacgtgcacctgcacgacgccctgggcagaccccaccagtgcggcaccatccagctggacttccagctgcccctgagattcgacctgcagtacaagggccaggccggcgccctggagagacccgtgctgatccacagagccgtgctgggcagcgtggagagactgctgggcgtgctggccgagagctgcggcggcaagtggcccctgtggctgagccccttccaggtggtggtgatccccgtgggcagcgagcaggaggagtacgccaaggaggcccagcagagcctgagagccgccggcctggtgagcgacctggacgccgacagcggcctgaccctgagcagaagaatcagaagagcccagctggcccactacaacttccagttcgtggtgggccagaaggagcagagcaagagaaccgtgaacatcagaaccagagacaacagaagactgggcgagtgggacctgcccgaggccgtgcagagactggtggagctgcagaacaccagagtgcccaacgccgaggagatcttctag

SEQ ID NO: 102399 - DNA, 2157 bp, Artificial Sequence
  Description of Artificial Sequence: Synthetic coding sequence
atggccctgtaccagagatggagatgcctgagactgcagggcctgcaggcctgcagactgcacaccgccgtggtgagcaccccccccagatggctggccgagagactgggcctgttcgaggagctgtgggccgcccaggtgaagagactggccagcatggcccagaaggagcccagaaccatcaagatcagcctgcccggcggccagaagatcgacgccgtggcctggaacaccaccccctaccagctggccagacagatcagcagcaccctggccgacaccgccgtggccgcccaggtgaacggcgagccctacgacctggagagacccctggagaccgacagcgacctgagattcctgaccttcgacagccccgagggcaaggccgtgttctggcacagcagcacccacgtgctgggcgccgccgccgagcagttcctgggcgccgtgctgtgcagaggccccagcaccgagtacggcttctaccacgacttcttcctgggcaaggagagaaccatcagaggcagcgagctgcccgtgctggagagaatctgccaggagctgaccgccgccgccagacccttcagaagactggaggccagcagagaccagctgagacagctgttcaaggacaaccccttcaagctgcacctgatcgaggagaaggtgaccggccccaccgccaccgtgtacggctgcggcaccctggtggacctgtgccagggcccccacctgagacacaccggccagatcggcggcctgaagctgctgagcaacagcagcagcctgtggagaagcagcggcgcccccgagaccctgcagagagtgagcggcatcagcttccccaccaccgagctgctgagagtgtgggaggcctggagagaggaggccgagctgagagaccacagaagaatcggcaaggagcaggagctgttcttcttccacgagctgagccccggcagctgcttcttcctgcccagaggcaccagagtgtacaacgccctggtggccttcatcagagccgagtacgcccacagaggcttcagcgaggtgaagacccccaccctgttcagcaccaagctgtgggagcagagcggccactgggagcactaccaggaggacatgttcgccgtgcagccccccggcagcgacagaccccccagcagccagagcgacgacagcaccagacacatcaccgacaccctggccctgaagcccatgaactgccccgcccactgcctgatgttcgcccacagacccagaagctggagagagctgcccctgagactggccgacttcggcgccctgcacagagccgaggccagcggcggcctgggcggcctgaccagactgagatgcttccagcaggacgacgcccacatcttctgcaccaccgaccagctggaggccgagatccagagctgcctggacttcctgagaagcgtgtacgccgtgctgggcttcagcttcagactggccctgagcaccagacccagcggcttcctgggcgacccctgcctgtgggaccaggccgagcaggtgctgaagcaggccctgaaggagttcggcgagccctgggacctgaacagcggcgacggcgccttctacggccccaagatcgacgtgcacctgcacgacgccctgggcagaccccaccagtgcggcaccatccagctggacttccagctgcccctgagattcgacctgcagtacaagggccaggccggcgccctggagagacccgtgctgatccacagagccgtgctgggcagcgtggagagactgctgggcgtgctggccgagagctgcggcggcaagtggcccctgtggctgagccccttccaggtggtggtgatccccgtgggcagcgagcaggaggagtacgccaaggaggcccagcagagcctgagagccgccggcctggtgagcgacctggacgccgacagcggcctgaccctgagcagaagaatcagaagagcccagctggcccactacaacttccagttcgtggtgggccagaaggagcagagcaagagaaccgtgaacatcagaaccagagacaacagaagactgggcgagtgggacctgcccgaggccgtgcagagactggtggagctgcagaacaccagagtgcccaacgccgaggagatcttctag

SEQ ID NO: 102400 - DNA, 510 bp, Artificial Sequence
  Description of Artificial Sequence: Synthetic coding sequence
atggccctgtaccagagatggagatgcctgagactgcagggcctgcaggcctgcagactgcacaccgccgtggtgagcaccccccccagatggctggccgagagactgggcctgttcgaggagctgtgggccgcccaggtgaagagactggccagcatggcccagaaggagcccagaaccatcaagatcagcctgcccggcggccagaagatcgacgccgtggcctggaacaccaccccctaccagctggccagacagatcagcagcaccctggccgacaccgccgtggccgcccaggtgaacggcgagccctacgacctggagagacccctggagaccgacagcgacctgagattcctgaccttcgacagccccgagggcaaggccgacaaccccggcctgagagccgcctgcttcggcgccgacctgcccggcacctacagctgctgcagcaccctgcccgaggccagaggcttcaccggcagcgccagccccgtggtgcagggctag

SEQ ID NO: 102401 - DNA, 4974 bp, Artificial Sequence
  Description of Artificial Sequence: Synthetic coding sequence
atgggcctgcaggccagaagatgggccagcggcagcagaggcgccgccggccccagaagaggcgtgctgcagctgctgcccctgcccctgcccctgcccctgctgctgctgctgctgctgagacccggcgccggcagagccgccgcccagggcgaggccgaggcccccaccctgtacctgtggaagaccggcccctggggcagatgcatgggcgacgagtgcggccccggcggcatccagaccagagccgtgtggtgcgcccacgtggagggctggaccaccctgcacaccaactgcaagcaggccgagagacccaacaaccagcagaactgcttcaaggtgtgcgactggcacaaggagctgtacgactggagactgggcccctggaaccagtgccagcccgtgatcagcaagagcctggagaagcccctggagtgcatcaagggcgaggagggcatccaggtgagagagatcgcctgcatccagaaggacaaggacatccccgccgaggacatcatctgcgagtacttcgagcccaagcccctgctggagcaggcctgcctgatcccctgccagcaggactgcatcgtgagcgagttcagcgcctggagcgagtgcagcaagacctgcggcagcggcctgcagcacagaaccagacacgtggtggcccccccccagttcggcggcagcggctgccccaacctgaccgagttccaggtgtgccagagcagcccctgcgaggccgaggagctgagatacagcctgcacgtgggcccctggagcacctgcagcatgccccacagcagacaggtgagacaggccagaagaagaggcaagaacaaggagagagagaaggacagaagcaagggcgtgaaggaccccgaggccagagagctgatcaagaagaagagaaacagaaacagacagaacagacaggagaacaagtactgggacatccagatcggctaccagaccagagaggtgatgtgcatcaacaagaccggcaaggccgccgacctgagcttctgccagcaggagaagctgcccatgaccttccagagctgcgtgatcaccaaggagtgccaggtgagcgagtggagcgagtggagcccctgcagcaagacctgccacgacatggtgagccccgccggcaccagagtgagaaccagaaccatcagacagttccccatcggcagcgagaaggagtgccccgagttcgaggagaaggagccctgcctgagccagggcgacggcgtggtgccctgcgccacctacggctggagaaccaccgagtggaccgagtgcagagtggaccccctgctgagccagcaggacaagagaagaggcaaccagaccgccctgtgcggcggcggcatccagaccagagaggtgtactgcgtgcaggccaacgagaacctgctgagccagctgagcacccacaagaacaaggaggccagcaagcccatggacctgaagctgtgcaccggccccatccccaacaccacccagctgtgccacatcccctgccccaccgagtgcgaggtgagcccctggagcgcctggggcccctgcacctacgagaactgcaacgaccagcagggcaagaagggcttcaagctgagaaagagaagaatcaccaacgagcccaccggcggcagcggcgtgaccggcaactgcccccacctgctggaggccatcccctgcgaggagcccgcctgctacgactggaaggccgtgagactgggcaactgcgagcccgacaacggcaaggagtgcggccccggcacccaggtgcaggaggtggtgtgcatcaacagcgacggcgaggaggtggacagacagctgtgcagagacgccatcttccccatccccgtggcctgcgacgccccctgccccaaggactgcgtgctgagcacctggagcacctggagcagctgcagccacacctgcagcggcaagaccaccgagggcaagcagatcagagccagaagcatcctggcctacgccggcgaggagggcggcatcagatgccccaacagcagcgccctgcaggaggtgagaagctgcaacgagcacccctgcaccgtgtaccactggcagaccggcccctggggccagtgcatcgaggacaccagcgtgagcagcttcaacaccaccaccacctggaacggcgaggccagctgcagcgtgggcatgcagaccagaaaggtgatctgcgtgagagtgaacgtgggccaggtgggccccaagaagtgccccgagagcctgagacccgagaccgtgagaccctgcctgctgccctgcaagaaggactgcatcgtgaccccctacagcgactggaccagctgccccagcagctgcaaggagggcgacagcagcatcagaaagcagagcagacacagagtgatcatccagctgcccgccaacggcggcagagactgcaccgaccccctgtacgaggagaaggcctgcgaggccccccaggcctgccagagctacagatggaagacccacaagtggagaagatgccagctggtgccctggagcgtgcagcaggacagccccggcgcccaggagggctgcggccccggcagacaggccagagccatcacctgcagaaagcaggacggcggccaggccggcatccacgagtgcctgcagtacgccggccccgtgcccgccctgacccaggcctgccagatcccctgccaggacgactgccagctgaccagctggagcaagttcagcagctgcaacggcgactgcggcgccgtgagaaccagaaagagaaccctggtgggcaagagcaagaagaaggagaagtgcaagaacagccacctgtaccccctgatcgagacccagtactgcccctgcgacaagtacaacgcccagcccgtgggcaactggagcgactgcatcctgcccgagggcaaggtggaggtgctgctgggcatgaaggtgcagggcgacatcaaggagtgcggccagggctacagataccaggccatggcctgctacgaccagaacggcagactggtggagaccagcagatgcaacagccacggctacatcgaggaggcctgcatcatcccctgccccagcgactgcaagctgagcgagtggagcaactggagcagatgcagcaagagctgcggcagcggcgtgaaggtgagaagcaagtggctgagagagaagccctacaacggcggcagaccctgccccaagctggaccacgtgaaccagttccaggtgtacgaggtggtgccctgccacagcgactgcaaccagtacctgtgggtgaccgagccctggagcatctgcaaggtgaccttcgtgaacatgagagagaactgcggcgagggcgtgcagaccagaaaggtgagatgcatgcagaacaccgccgacggccccagcgagcacgtggaggactacctgtgcgaccccgaggagatgcccctgggcagcagagtgtgcaagctgccctgccccgaggactgcgtgatcagcgagtggggcccctggacccagtgcgtgctgccctgcaaccagagcagcttcagacagagaagcgccgaccccatcagacagcccgccgacgagggcagaagctgccccaacgccgtggagaaggagccctgcaacctgaacaagaactgctaccactacgactacaacgtgaccgactggagcacctgccagctgagcgagaaggccgtgtgcggcaacggcatcaagaccagaatgctggactgcgtgagaagcgacggcaagagcgtggacctgaagtactgcgaggccctgggcctggagaagaactggcagatgaacaccagctgcatggtggagtgccccgtgaactgccagctgagcgactggagcccctggagcgagtgcagccagacctgcggcctgaccggcaagatgatcagaagaagaaccgtgacccagcccttccagggcgacggcagaccctgccccagcctgatggaccagagcaagccctgccccgtgaagccctgctacagatggcagtacggccagtggagcccctgccaggtgcaggaggcccagtgcggcgagggcaccagaaccagaaacatcagctgcgtggtgagcgacggcagcgccgacgacttcagcaaggtggtggacgaggagttctgcgccgacatcgagctgatcatcgacggcaacaagaacatggtgctggaggagagctgcagccagccctgccccggcgactgctacctgaaggactggagcagctggagcctgtgccagctgacctgcgtgaacggcgaggacctgggcttcggcggcatccaggtgagaagcagacccgtgatcatccaggagctggagaaccagcacctgtgccccgagcagatgctggagaccaagagctgctacgacggccagtgctacgagtacaagtggatggccagcgcctggaagggcagcagcagaaccgtgtggtgccagagaagcgacggcatcaacgtgaccggcggctgcctggtgatgagccagcccgacgccgacagaagctgcaaccccccctgcagccagccccacagctactgcagcgagaccaagacctgccactgcgaggagggctacaccgaggtgatgagcagcaacagcaccctggagcagtgcaccctgatccccgtggtggtgctgcccaccatggaggacaagagaggcgacgtgaagaccagcagagccgtgcaccccacccagcccagcagcaaccccgccggcagaggcagaacctggttcctgcagcccttcggccccgacggcagactgaagacctgggtgtacggcgtggccgccggcgccttcgtgctgctgatcttcatcgtgagcatgatctacctggcctgcaagaagcccaagaagccccagagaagacagaacaacagactgaagcccctgaccctggcctacgacggcgacgccgacatgtag

SEQ ID NO: 102402 - DNA, 4974 bp, Artificial Sequence
  Description of Artificial Sequence: Synthetic coding sequence
atgggcctgcaggccagaagatgggccagcggcagcagaggcgccgccggccccagaagaggcgtgctgcagctgctgcccctgcccctgcccctgcccctgctgctgctgctgctgctgagacccggcgccggcagagccgccgcccagggcgaggccgaggcccccaccctgtacctgtggaagaccggcccctggggcagatgcatgggcgacgagtgcggccccggcggcatccagaccagagccgtgtggtgcgcccacgtggagggctggaccaccctgcacaccaactgcaagcaggccgagagacccaacaaccagcagaactgcttcaaggtgtgcgactggcacaaggagctgtacgactggagactgggcccctggaaccagtgccagcccgtgatcagcaagagcctggagaagcccctggagtgcatcaagggcgaggagggcatccaggtgagagagatcgcctgcatccagaaggacaaggacatccccgccgaggacatcatctgcgagtacttcgagcccaagcccctgctggagcaggcctgcctgatcccctgccagcaggactgcatcgtgagcgagttcagcgcctggagcgagtgcagcaagacctgcggcagcggcctgcagcacagaaccagacacgtggtggcccccccccagttcggcggcagcggctgccccaacctgaccgagttccaggtgtgccagagcagcccctgcgaggccgaggagctgagatacagcctgcacgtgggcccctggagcacctgcagcatgccccacagcagacaggtgagacaggccagaagaagaggcaagaacaaggagagagagaaggacagaagcaagggcgtgaaggaccccgaggccagagagctgatcaagaagaagagaaacagaaacagacagaacagacaggagaacaagtactgggacatccagatcggctaccagaccagagaggtgatgtgcatcaacaagaccggcaaggccgccgacctgagcttctgccagcaggagaagctgcccatgaccttccagagctgcgtgatcaccaaggagtgccaggtgagcgagtggagcgagtggagcccctgcagcaagacctgccacgacatggtgagccccgccggcaccagagtgagaaccagaaccatcagacagttccccatcggcagcgagaaggagtgccccgagttcgaggagaaggagccctgcctgagccagggcgacggcgtggtgccctgcgccacctacggctggagaaccaccgagtggaccgagtgcagagtggaccccctgctgagccagcaggacaagagaagaggcaaccagaccgccctgtgcggcggcggcatccagaccagagaggtgtactgcgtgcaggccaacgagaacctgctgagccagctgagcacccacaagaacaaggaggccagcaagcccatggacctgaagctgtgcaccggccccatccccaacaccacccagctgtgccacatcccctgccccaccgagtgcgaggtgagcccctggagcgcctggggcccctgcacctacgagaactgcaacgaccagcagggcaagaagggcttcaagctgagaaagagaagaatcaccaacgagcccaccggcggcagcggcgtgaccggcaactgcccccacctgctggaggccatcccctgcgaggagcccgcctgctacgactggaaggccgtgagactgggcaactgcgagcccgacaacggcaaggagtgcggccccggcacccaggtgcaggaggtggtgtgcatcaacagcgacggcgaggaggtggacagacagctgtgcagagacgccatcttccccatccccgtggcctgcgacgccccctgccccaaggactgcgtgctgagcacctggagcacctggagcagctgcagccacacctgcagcggcaagaccaccgagggcaagcagatcagagccagaagcatcctggcctacgccggcgaggagggcggcatcagatgccccaacagcagcgccctgcaggaggtgagaagctgcaacgagcacccctgcaccgtgtaccactggcagaccggcccctggggccagtgcatcgaggacaccagcgtgagcagcttcaacaccaccaccacctggaacggcgaggccagctgcagcgtgggcatgcagaccagaaaggtgatctgcgtgagagtgaacgtgggccaggtgggccccaagaagtgccccgagagcctgagacccgagaccgtgagaccctgcctgctgccctgcaagaaggactgcatcgtgaccccctacagcgactggaccagctgccccagcagctgcaaggagggcgacagcagcatcagaaagcagagcagacacagagtgatcatccagctgcccgccaacggcggcagagactgcaccgaccccctgtacgaggagaaggcctgcgaggccccccaggcctgccagagctacagatggaagacccacaagtggagaagatgccagctggtgccctggagcgtgcagcaggacagccccggcgcccaggagggctgcggccccggcagacaggccagagccatcacctgcagaaagcaggacggcggccaggccggcatccacgagtgcctgcagtacgccggccccgtgcccgccctgacccaggcctgccagatcccctgccaggacgactgccagctgaccagctggagcaagttcagcagctgcaacggcgactgcggcgccgtgagaaccagaaagagaaccctggtgggcaagagcaagaagaaggagaagtgcaagaacagccacctgtaccccctgatcgagacccagtactgcccctgcgacaagtacaacgcccagcccgtgggcaactggagcgactgcatcctgcccgagggcaaggtggaggtgctgctgggcatgaaggtgcagggcgacatcaaggagtgcggccagggctacagataccaggccatggcctgctacgaccagaacggcagactggtggagaccagcagatgcaacagccacggctacatcgaggaggcctgcatcatcccctgccccagcgactgcaagctgagcgagtggagcaactggagcagatgcagcaagagctgcggcagcggcgtgaaggtgagaagcaagtggctgagagagaagccctacaacggcggcagaccctgccccaagctggaccacgtgaaccaggcccaggtgtacgaggtggtgccctgccacagcgactgcaaccagtacctgtgggtgaccgagccctggagcatctgcaaggtgaccttcgtgaacatgagagagaactgcggcgagggcgtgcagaccagaaaggtgagatgcatgcagaacaccgccgacggccccagcgagcacgtggaggactacctgtgcgaccccgaggagatgcccctgggcagcagagtgtgcaagctgccctgccccgaggactgcgtgatcagcgagtggggcccctggacccagtgcgtgctgccctgcaaccagagcagcttcagacagagaagcgccgaccccatcagacagcccgccgacgagggcagaagctgccccaacgccgtggagaaggagccctgcaacctgaacaagaactgctaccactacgactacaacgtgaccgactggagcacctgccagctgagcgagaaggccgtgtgcggcaacggcatcaagaccagaatgctggactgcgtgagaagcgacggcaagagcgtggacctgaagtactgcgaggccctgggcctggagaagaactggcagatgaacaccagctgcatggtggagtgccccgtgaactgccagctgagcgactggagcccctggagcgagtgcagccagacctgcggcctgaccggcaagatgatcagaagaagaaccgtgacccagcccttccagggcgacggcagaccctgccccagcctgatggaccagagcaagccctgccccgtgaagccctgctacagatggcagtacggccagtggagcccctgccaggtgcaggaggcccagtgcggcgagggcaccagaaccagaaacatcagctgcgtggtgagcgacggcagcgccgacgacttcagcaaggtggtggacgaggagttctgcgccgacatcgagctgatcatcgacggcaacaagaacatggtgctggaggagagctgcagccagccctgccccggcgactgctacctgaaggactggagcagctggagcctgtgccagctgacctgcgtgaacggcgaggacctgggcttcggcggcatccaggtgagaagcagacccgtgatcatccaggagctggagaaccagcacctgtgccccgagcagatgctggagaccaagagctgctacgacggccagtgctacgagtacaagtggatggccagcgcctggaagggcagcagcagaaccgtgtggtgccagagaagcgacggcatcaacgtgaccggcggctgcctggtgatgagccagcccgacgccgacagaagctgcaaccccccctgcagccagccccacagctactgcagcgagaccaagacctgccactgcgaggagggctacaccgaggtgatgagcagcaacagcaccctggagcagtgcaccctgatccccgtggtggtgctgcccaccatggaggacaagagaggcgacgtgaagaccagcagagccgtgcaccccacccagcccagcagcaaccccgccggcagaggcagaacctggttcctgcagcccttcggccccgacggcagactgaagacctgggtgtacggcgtggccgccggcgccttcgtgctgctgatcttcatcgtgagcatgatctacctggcctgcaagaagcccaagaagccccagagaagacagaacaacagactgaagcccctgaccctggcctacgacggcgacgccgacatgtag

SEQ ID NO: 102403 - DNA, 2010 bp, Artificial Sequence
  Description of Artificial Sequence: Synthetic coding sequence
atgagcgccctgctgagcctgtgcttcgtgctgcccctggccgcccccggccacggcacccagggctgggagccctgcaccgacctgagacccctggacatcctggccgaggtggtgcccagcgacggcgccaccagcggcatcagaatcgtgcaggtgcacggcgccagaggcctgcagctgagcgtggccgcccccagaaccatgagcttccccgccagcagaatcttcagccagtgcgacctgttccccgaggagttcagcatcgtggtgaccctgagagtgcccaacctgccccccaagagaaacgagtacctgctgaccgtggtggccgaggagagcgacctgctgctgctgggcctgagactgagccccgcccagctgcacttcctgttcctgagagaggacaccgccggcgcctggcagaccagagtgagcttcagaagccccgccctggtggacggcagatggcacaccctggtgctggccgtgagcgccggcgtgttcagcctgaccaccgactgcggcctgcccgtggacatcatggccgacgtgcccttccccgccaccctgagcgtgaagggcgccagattcttcgtgggcagcagaagaagagccaagggcctgttcatgggcctggtgagacagctggtgctgctgcccggcagcgacgccacccccagactgtgccccagcagaaacgcccccctggccgtgctgagcatccccagagtgctgcaggccctgaccggcaagcccgaggacaacgaggtgctgaagtacccctacgagaccaacatcagagtgaccctgggcccccagcccccctgcaccgaggtggaggacgcccagttctggttcgacgccagcagaaagggcctgtacctgtgcgtgggcaacgagtgggtgagcgtgctggccgccaaggagagactggactacgtggaggagcaccagaacctgagcaccaacagcgagaccctgggcatcgaggtgttcagaatcccccaggtgggcctgttcgtggccaccgccaacagaaaggccaccagcgccgtgtacaagtggaccgaggagaagttcgtgagctaccagaacatccccacccaccaggcccaggcctggagacacttcaccatcggcaagaagatcttcctggccgtggccaacttcgagcccgacgagaagggccaggagttcagcgtgatctacaagtggagccacagaaagctgaagttcaccccctaccagagcatcgccacccacagcgccagagactgggaggccttcgaggtggacggcgagcacttcctggccgtggccaaccacagagagggcgacaaccacaacatcgacagcgtgatctacaagtggaaccccgccaccagactgttcgaggccaaccagaccatcgccaccagcggcgcctacgactgggagttcttcagcgtgggcccctacagcttcctggtggtggccaacaccttcaacggcaccagcaccaaggtgcacagccacctgtacatcagactgctgggcagcttccagctgttccagagcttccccaccttcggcgccgccgactgggaggtgttccagatcggcgagagaatcttcctggccgtggccaacagccacagctacgacgtggagatgcaggtgcagaacgacagctacgtgatcaacagcgtgatctacgagctgaacgtgaccgcccaggccttcgtgaagttccaggacatcctgacctgcagcgccctggactgggagttcttcagcgtgggcgaggactacttcctggtggtggccaacagcttcgacggcagaaccttcagcgtgaacagcatcatctacagatggcagggctacgagggcttcgtggccgtgcacagcctgcccaccgtgggctgcagagactgggaggccttcagcaccaccgccggcgcctacctgatctacagcagcgccaaggagcccctgagcagagtgctgagactgagaaccagatag

SEQ ID NO: 102404 - DNA, 1800 bp, Artificial Sequence
  Description of Artificial Sequence: Synthetic coding sequence
atgagcgccctgctgagcctgtgcttcgtgctgcccctggccgcccccggccacggcacccagggctgggagccctgcaccgacctgagacccctggacatcctggccgaggtggtgcccagcgacggcgccaccagcggcatcagaatcgtgcaggtgcacggcgccagaggcctgcagctgagcgtggccgcccccagaaccatgagcttccccgccagcagaatcttcagccagtgcgacctgttccccgaggagttcagcatcgtggtgaccctgagagtgcccaacctgccccccaagagaaacgagtacctgctgaccgtggtggccgaggagagcgacctgctgctgctgggcctgagactgagccccgcccagctgcacttcctgttcctgagagaggacaccgccggcgcctggcagaccagagtgagcttcagaagccccgccctggtggacggcagatggcacaccctggtgctggccgtgagcgccggcgtgttcagcctgaccaccgactgcggcctgcccgtggacatcatggccgacgtgcccttccccgccaccctgagcgtgaagggcgccagattcttcgtgggcagcagaagaagagccaagggcctgttcatgggcctggtgagacagctggtgctgctgcccggcagcgacgccacccccagactgtgccccagcagaaacgcccccctggccgtgctgagcatccccagagtgctgcaggccctgaccggcaagcccgaggacaacgaggtgctgaagtacccctacgagaccaacatcagagtgaccctgggcccccagcccccctgcaccgaggtggaggacgcccagttctggttcgacgccagcagaaagggcctgtacctgtgcgtgggcaacgagtgggtgagcgtgctggccgaggccaaggagagactggactacgtggaggagcaccagaacctgagcaccaacagcgagaccctgggcatcgaggtgttcagaatcccccaggtgggcctgttcgtggccaccgccaacagaaaggccaccagcgccgtgtacaagtggaccgaggagaagttcgtgagctaccagaacatccccacccaccaggcccaggcctggagacacttcaccatcggcaagaagatcttcctggccgtggccaacttcgagcccgacgagaagggccaggagttcagcgtgatctacaagtggagccacagaaagctgaagttcaccccctaccagagcatcgccacccacagcgccagagactgggaggccttcgaggtggacggcgagcacttcctggccgtggccaaccacagagagggcgacaaccacaacatcgacagcgtgatctacaagtggaaccccgccaccagactgttcgaggccaaccagaccatcgccaccagcggcgcctacgactgggagttcttcagcgtgggcccctacagcttcctggtggtggccaacaccttcaacggcaccagcaccaaggtgcacagccacctgtacatcagactgctgggcagcttccagctgttccagagcttccccaccttcggcgccgccgactgggaggtgttccagatcggcgagagaatcttcctggccgtggccaacagccacagctacgacgtggagatgcaggtgcagaacgacagctacgtgatcaacagcgtgatctacgagctgaacgtgaccgcccaggccttcgtgaagttccaggacatcctgacctgcagcggcggcagaagaggcctgcacgccagaagagccgagggctag

SEQ ID NO: 102405 - DNA, 1569 bp, Artificial Sequence
  Description of Artificial Sequence: Synthetic coding sequence
atgagcgccctgctgagcctgtgcttcgtgctgcccctggccgcccccggccacggcacccagggctgggagccctgcaccgacctgagacccctggacatcctggccgaggtggtgcccagcgacggcgccaccagcggcatcagaatcgtgcaggtgcacggcgccagaggcctgcagctgagcgtggccgcccccagaaccatgagcttccccgccagcagaatcttcagccagtgcgacctgttccccgaggagttcagcatcgtggtgaccctgagagtgcccaacctgccccccaagagaaacgagtacctgctgaccgtggtggccgaggagagcgacctgctgctgctgggcctgagactgagccccgcccagcccccctgcaccgaggtggaggacgcccagttctggttcgacgccagcagaaagggcctgtacctgtgcgtgggcaacgagtgggtgagcgtgctggccgccaaggagagactggactacgtggaggagcaccagaacctgagcaccaacagcgagaccctgggcatcgaggtgttcagaatcccccaggtgggcctgttcgtggccaccgccaacagaaaggccaccagcgccgtgtacaagtggaccgaggagaagttcgtgagctaccagaacatccccacccaccaggcccaggcctggagacacttcaccatcggcaagaagatcttcctggccgtggccaacttcgagcccgacgagaagggccaggagttcagcgtgatctacaagtggagccacagaaagctgaagttcaccccctaccagagcatcgccacccacagcgccagagactgggaggccttcgaggtggacggcgagcacttcctggccgtggccaaccacagagagggcgacaaccacaacatcgacagcgtgatctacaagtggaaccccgccaccagactgttcgaggccaaccagaccatcgccaccagcggcgcctacgactgggagttcttcagcgtgggcccctacagcttcctggtggtggccaacaccttcaacggcaccagcaccaaggtgcacagccacctgtacatcagactgctgggcagcttccagctgttccagagcttccccaccttcggcgccgccgactgggaggtgttccagatcggcgagagaatcttcctggccgtggccaacagccacagctacgacgtggagatgcaggtgcagaacgacagctacgtgatcaacagcgtgatctacgagctgaacgtgaccgcccaggccttcgtgaagttccaggacatcctgacctgcagcgccctggactgggagttcttcagcgtgggcgaggactacttcctggtggtggccaacagcttcgacggcagaaccttcagcgtgaacagcatcatctacagatggcagggctacgagggcttcgtggccgtgcacagcctgcccaccgtgggctgcagagactgggaggccttcagcaccaccgccggcgcctacctgatctacagcagcgccaaggagcccctgagcagagtgctgagactgagaaccagatag

SEQ ID NO: 102406 - DNA, 1605 bp, Artificial Sequence
  Description of Artificial Sequence: Synthetic coding sequence
atgatggaggccctgggcttcctgaagctggaggtgaacggccccatggtgaccgtggccctgagcgtggccctgctggccctgctgaagtggtacagcaccagcgccttcagcagactggagaagctgggcctgagacaccccaagcccagccccttcatcggcaacctgaccttcttcagacagggcttctgggagagccagatggagctgagaaagctgtacggccccctgtgcggctactacctgggcagaagaatgttcatcgtgatcagcgagcccgacatgatcaagcaggtgctggtggagaacttcagcaacttcaccaacagaatggccagcggcctggagttcaagagcgtggccgacagcgtgctgttcctgagagacaagagatgggaggaggtgagaggcgccctgatgagcgccttcagccccgagaagctgaacgagatggtgcccctgatcagccaggcctgcgagctgctgctggcccacctgaagagatacgccgagagcggcgacgccttcgacatccagagatgctactgcaactacaccaccgacgtggtggccagcgtggccttcggcacccccgtggacagctggcaggcccccgaggaccccttcgtgaagcactgcaagagattcttcgagttctgcatccccagacccatcctggtgctgctgctgagcttccccagcatcatggtgcccctggccagaatcctgcccaacaagaacagagacgagctgaacggcttcttcaacaagctgatcagaaacgtgatcgccctgagagaccagcaggccgccgaggagagaagaagagacttcctgcagatggtgctggacgccagacacagcgccagccccatgggcgtgcaggacttcgacatcgtgagagacgtgttcagcagcaccggctgcaagcccaaccccagcagacagcaccagcccagccccatggccagacccctgaccgtggacgagatcgtgggccaggccttcatcttcctgatcgccggctacgagatcatcaccaacaccctgagcttcgccacctacctgctggccaccaaccccgactgccaggagaagctgctgagagaggtggacgtgttcaaggagaagcacatggcccccgagttctgcagcctggaggagggcctgccctacctggacatggtgatcgccgagaccctgagaatgtacccccccgccttcagattcaccagagaggccgcccaggactgcgaggtgctgggccagagaatccccgccggcgccgtgctggagatggccgtgggcgccctgcaccacgaccccgagcactggcccagccccgagaccttcaaccccgagagattcaccgccgaggccagacagcagcacagacccttcacctacctgcccttcggcgccggccccagaagctgcctgggcgtgagactgggcctgctggaggtgaagctgaccctgctgcacgtgctgcacaagttcagattccaggcctgccccgagacccaggtgcccctgcagctggagagcaagagcgccctgggccccaagaacggcgtgtacatcaagatcgtgagcagatag

SEQ ID NO: 102407 - DNA, 1602 bp, Artificial Sequence
  Description of Artificial Sequence: Synthetic coding sequence
atggaggccctgggcttcctgaagctggaggtgaacggccccatggtgaccgtggccctgagcgtggccctgctggccctgctgaagtggtacagcaccagcgccttcagcagactggagaagctgggcctgagacaccccaagcccagccccttcatcggcaacctgaccttcttcagacagggcttctgggagagccagatggagctgagaaagctgtacggccccctgtgcggctactacctgggcagaagaatgttcatcgtgatcagcgagcccgacatgatcaagcaggtgctggtggagaacttcagcaacttcaccaacagaatggccagcggcctggagttcaagagcgtggccgacagcgtgctgttcctgagagacaagagatgggaggaggtgagaggcgccctgatgagcgccttcagccccgagaagctgaacgagatggtgcccctgatcagccaggcctgcgagctgctgctggcccacctgaagagatacgccgagagcggcgacgccttcgacatccagagatgctactgcaactacaccaccgacgtggtggccagcgtggccttcggcacccccgtggacagctggcaggcccccgaggaccccttcgtgaagcactgcaagagattcttcgagttctgcatccccagacccatcctggtgctgctgctgagcttccccagcatcatggtgcccctggccagaatcctgcccaacaagaacagagacgagctgaacggcttcttcaacaagctgatcagaaacgtgatcgccctgagagaccagcaggccgccgaggagagaagaagagacttcctgcagatggtgctggacgccagacacagcgccagccccatgggcgtgcaggacttcgacatcgtgagagacgtgttcagcagcaccggctgcaagcccaaccccagcagacagcaccagcccagccccatggccagacccctgaccgtggacgagatcgtgggccaggccttcatcttcctgatcgccggctacgagatcatcaccaacaccctgagcttcgccacctacctgctggccaccaaccccgactgccaggagaagctgctgagagaggtggacgtgttcaaggagaagcacatggcccccgagttctgcagcctggaggagggcctgccctacctggacatggtgatcgccgagaccctgagaatgtacccccccgccttcagattcaccagagaggccgcccaggactgcgaggtgctgggccagagaatccccgccggcgccgtgctggagatggccgtgggcgccctgcaccacgaccccgagcactggcccagccccgagaccttcaaccccgagagattcaccgccgaggccagacagcagcacagacccttcacctacctgcccttcggcgccggccccagaagctgcctgggcgtgagactgggcctgctggaggtgaagctgaccctgctgcacgtgctgcacaagttcagattccaggcctgccccgagacccaggtgcccctgcagctggagagcaagagcgccctgggccccaagaacggcgtgtacatcaagatcgtgagcagatag

SEQ ID NO: 102408 - DNA, 1380 bp, Artificial Sequence
  Description of Artificial Sequence: Synthetic coding sequence
atggaggccctgggcttcctgaagctggaggtgaacggccccatggtgaccgtggccctgagcgtggccctgctggccctgctgaagtggtacagcaccagcgccttcagcagactggagaagctgggcctgagacaccccaagcccagccccttcatcggcaacctgaccttcttcagacagggcttctgggagagccagatggagctgagaaagctgtacggccccctgtgcggctactacctgggcagaagaatgttcatcgtgatcagcgagcccgacatgatcaagcaggtgctggtggagaacttcagcaacttcaccaacagaatggccagcggcctggagttcaagagcgtggccgacagcgtgctgttcctgagagacaagagatgggaggaggtgagaggcgccctgatgagcgccttcagccccgagaagctgaacgagatggtgcccctgatcagccaggcctgcgagctgctgctggcccacctgaagagatacgccgagagcggcgacgccttcgacatccagagatgctactgcaactacaccaccgacgtggtggccagcgtggccttcggcacccccgtggacagctggcaggcccccgaggaccccttcgtgaagcactgcaagagattcttcgagttctgcatccccagacccatcctggtgctgctgctgagcttccccagcatcatggtgcccctggccagaatcctgcccaacaagaacagagacgagctgaacggcttcttcaacaagctgatcagaaacgtgatcgccctgagagaccagcaggccgccgaggagagaagaagagacttcctgcagatggtgctggacgccagacacagcgccagccccatgggcgtgcaggacttcgacatcgtgagagacgtgttcagcagcaccggctgcaagcccaaccccagcagacagcaccagcccagccccatggccagacccctgaccgtggacgagatcgtgggccaggccttcatcttcctgatcgccggctacgagatcatcaccaacaccctgagcttcgccacctacctgctggccaccaaccccgactgccaggagaagctgctgagagaggtggacgtgttcaaggagaagcacatggcccccgagttctgcagcctggaggagggcctgccctacctggacatggtgatcgccgagaccctgagaatgtacccccccgccttcagattcaccagagaggccgcccaggactgcgaggtgctgggccagagaatccccgccggcgccgtgctggagatggccgtgggcgccctgcaccacgaccccgagcactggcccagccccgagaccttcaaccccgagagatacagatgcagctag

SEQ ID NO: 102409 - DNA, 1383 bp, Artificial Sequence
  Description of Artificial Sequence: Synthetic coding sequence
atgatggaggccctgggcttcctgaagctggaggtgaacggccccatggtgaccgtggccctgagcgtggccctgctggccctgctgaagtggtacagcaccagcgccttcagcagactggagaagctgggcctgagacaccccaagcccagccccttcatcggcaacctgaccttcttcagacagggcttctgggagagccagatggagctgagaaagctgtacggccccctgtgcggctactacctgggcagaagaatgttcatcgtgatcagcgagcccgacatgatcaagcaggtgctggtggagaacttcagcaacttcaccaacagaatggccagcggcctggagttcaagagcgtggccgacagcgtgctgttcctgagagacaagagatgggaggaggtgagaggcgccctgatgagcgccttcagccccgagaagctgaacgagatggtgcccctgatcagccaggcctgcgagctgctgctggcccacctgaagagatacgccgagagcggcgacgccttcgacatccagagatgctactgcaactacaccaccgacgtggtggccagcgtggccttcggcacccccgtggacagctggcaggcccccgaggaccccttcgtgaagcactgcaagagattcttcgagttctgcatccccagacccatcctggtgctgctgctgagcttccccagcatcatggtgcccctggccagaatcctgcccaacaagaacagagacgagctgaacggcttcttcaacaagctgatcagaaacgtgatcgccctgagagaccagcaggccgccgaggagagaagaagagacttcctgcagatggtgctggacgccagacacagcgccagccccatgggcgtgcaggacttcgacatcgtgagagacgtgttcagcagcaccggctgcaagcccaaccccagcagacagcaccagcccagccccatggccagacccctgaccgtggacgagatcgtgggccaggccttcatcttcctgatcgccggctacgagatcatcaccaacaccctgagcttcgccacctacctgctggccaccaaccccgactgccaggagaagctgctgagagaggtggacgtgttcaaggagaagcacatggcccccgagttctgcagcctggaggagggcctgccctacctggacatggtgatcgccgagaccctgagaatgtacccccccgccttcagattcaccagagaggccgcccaggactgcgaggtgctgggccagagaatccccgccggcgccgtgctggagatggccgtgggcgccctgcaccacgaccccgagcactggcccagccccgagaccttcaaccccgagagatacagatgcagctag

SEQ ID NO: 102410 - DNA, 1743 bp, Artificial Sequence
  Description of Artificial Sequence: Synthetic coding sequence
atgatggaggccctgggcttcctgaagctggaggtgaacggccccatggtgaccgtggccctgagcgtggccctgctggccctgctgaagtggtacagcaccagcgccttcagcagactggagaagctgggcctgagacaccccaagcccagccccttcatcggcaacctgaccttcttcagacagggcttctgggagagccagatggagctgagaaagctgtacggccccctgtgcggctactacctgggcagaagaatgttcatcgtgatcagcgagcccgacatgatcaagcaggtgctggtggagaacttcagcaacttcaccaacagaatggccagcggcctggagttcaagagcgtggccgacagcgtgctgttcctgagagacaagagatgggaggaggtgagaggcgccctgatgagcgccttcagccccgagaagctgaacgagctgggcctgctgatcatgcaggagagaatcaagggccacatgggcggccagcaggccccccagagaatcccccccaccagactgagcaagcccagcggcatctacgtgaacctgcactacgccaccctgcccttctgcatggtgcccctgatcagccaggcctgcgagctgctgctggcccacctgaagagatacgccgagagcggcgacgccttcgacatccagagatgctactgcaactacaccaccgacgtggtggccagcgtggccttcggcacccccgtggacagctggcaggcccccgaggaccccttcgtgaagcactgcaagagattcttcgagttctgcatccccagacccatcctggtgctgctgctgagcttccccagcatcatggtgcccctggccagaatcctgcccaacaagaacagagacgagctgaacggcttcttcaacaagctgatcagaaacgtgatcgccctgagagaccagcaggccgccgaggagagaagaagagacttcctgcagatggtgctggacgccagacacagcgccagccccatgggcgtgcaggacttcgacatcgtgagagacgtgttcagcagcaccggctgcaagcccaaccccagcagacagcaccagcccagccccatggccagacccctgaccgtggacgagatcgtgggccaggccttcatcttcctgatcgccggctacgagatcatcaccaacaccctgagcttcgccacctacctgctggccaccaaccccgactgccaggagaagctgctgagagaggtggacgtgttcaaggagaagcacatggcccccgagttctgcagcctggaggagggcctgccctacctggacatggtgatcgccgagaccctgagaatgtacccccccgccttcagattcaccagagaggccgcccaggactgcgaggtgctgggccagagaatccccgccggcgccgtgctggagatggccgtgggcgccctgcaccacgaccccgagcactggcccagccccgagaccttcaaccccgagagattcaccgccgaggccagacagcagcacagacccttcacctacctgcccttcggcgccggccccagaagctgcctgggcgtgagactgggcctgctggaggtgaagctgaccctgctgcacgtgctgcacaagttcagattccaggcctgccccgagacccaggtgcccctgcagctggagagcaagagcgccctgggccccaagaacggcgtgtacatcaagatcgtgagcagatag

SEQ ID NO: 102411 - DNA, 1605 bp, Artificial Sequence; identical to SEQ ID NO: 102406
  Description of Artificial Sequence: Synthetic coding sequence

SEQ ID NO: 102412 - DNA, 453 bp, Artificial Sequence
  Description of Artificial Sequence: Synthetic coding sequence
atggaggccctgggcttcctgaagctggaggtgaacggccccatggtgaccgtggccctgagcgtggccctgctggccctgctgaagtggtacagcaccagcgccttcagcagactggagaagctgggcctgagacaccccaagcccagccccttcatcggcaacctgaccttcttcagacagggcttctgggagagccagatggagctgagaaagctgtacggccccctgtgcggctactacctgggcagaagaatgttcatcgtgatcagcgagcccgacatgatcaagcaggtgctggtggagaacttcagcaacttcaccaacagaatggccagcggcctggagttcaagagcgtggccgacagcgtgctgttcctgagagacaagagatgggaggaggtgagaggcgccctgatgagcgccttcagccccgagaagctgaacgagtag

SEQ ID NO: 102413 - DNA, 1602 bp, Artificial Sequence; identical to SEQ ID NO: 102407
  Description of Artificial Sequence: Synthetic coding sequence

SEQ ID NO: 102414 - DNA, 459 bp, Artificial Sequence
  Description of Artificial Sequence: Synthetic coding sequence
atgatggaggccctgggcttcctgaagctggaggtgaacggccccatggtgaccgtggccctgagcgtggccctgctggccctgctgaagtggtacagcaccagcgccttcagcagactggagaagctgggcctgagacaccccaagcccagccccttcatcggcaacctgaccttcttcagacagggcttctgggagagccagatggagctgagaaagctgtacggccccctgtgcggctactacctgggcagaagaatgttcatcgtgatcagcgagcccgacatgatcaagcaggtgctggtggagaacttcagcaacttcaccaacagaatgccccagagcatcatgcccaacagcagacaccacgtggccagcagaggcatgtggcccggcggcagaagactggcctgctacctgcaccccttcagaatggccgagggcatcgccgaggtgtag

SEQ ID NO: 102415 - DNA, 1401 bp, Artificial Sequence
  Description of Artificial Sequence: Synthetic coding sequence
atggagctgagaaagctgtacggccccctgtgcggctactacctgggcagaagaatgttcatcgtgatcagcgagcccgacatgatcaagcaggtgctggtggagaacttcagcaacttcaccaacagaatggccagcggcctggagttcaagagcgtggccgacagcgtgctgttcctgagagacaagagatgggaggaggtgagaggcgccctgatgagcgccttcagccccgagaagctgaacgagatggtgcccctgatcagccaggcctgcgagctgctgctggcccacctgaagagatacgccgagagcggcgacgccttcgacatccagagatgctactgcaactacaccaccgacgtggtggccagcgtggccttcggcacccccgtggacagctggcaggcccccgaggaccccttcgtgaagcactgcaagagattcttcgagttctgcatccccagacccatcctggtgctgctgctgagcttccccagcatcatggtgcccctggccagaatcctgcccaacaagaacagagacgagctgaacggcttcttcaacaagctgatcagaaacgtgatcgccctgagagaccagcaggccgccgaggagagaagaagagacttcctgcagatggtgctggacgccagacacagcgccagccccatgggcgtgcaggacttcgacatcgtgagagacgtgttcagcagcaccggctgcaagcccaaccccagcagacagcaccagcccagccccatggccagacccctgaccgtggacgagatcgtgggccaggccttcatcttcctgatcgccggctacgagatcatcaccaacaccctgagcttcgccacctacctgctggccaccaaccccgactgccaggagaagctgctgagagaggtggacgtgttcaaggagaagcacatggcccccgagttctgcagcctggaggagggcctgccctacctggacatggtgatcgccgagaccctgagaatgtacccccccgccttcagattcaccagagaggccgcccaggactgcgaggtgctgggccagagaatccccgccggcgccgtgctggagatggccgtgggcgccctgcaccacgaccccgagcactggcccagccccgagaccttcaaccccgagagattcaccgccgaggccagacagcagcacagacccttcacctacctgcccttcggcgccggccccagaagctgcctgggcgtgagactgggcctgctggaggtgaagctgaccctgctgcacgtgctgcacaagttcagattccaggcctgccccgagacccaggtgcccctgcagctggagagcaagagcgccctgggccccaagaacggcgtgtacatcaagatcgtgagcagatag

SEQ ID NO: 102416 - DNA, 1032 bp, Artificial Sequence
  Description of Artificial Sequence: Synthetic coding sequence
atgtggcccaacggcagcagcctgggcccctgcttcagacccaccaacatcaccctggaggagagaagactgatcgccagcccctggttcgccgccagcttctgcgtggtgggcctggccagcaacctgctggccctgagcgtgctggccggcgccagacagggcggcagccacaccagaagcagcttcctgaccttcctgtgcggcctggtgctgaccgacttcctgggcctgctggtgaccggcaccatcgtggtgagccagcacgccgccctgttcgagtggcacgccgtggaccccggctgcagactgtgcagattcatgggcgtggtgatgatcttcttcggcctgagccccctgctgctgggcgccgccatggccagcgagagatacctgggcatcaccagacccttcagcagacccgccgtggccagccagagaagagcctgggccaccgtgggcctggtgtgggccgccgccctggccctgggcctgctgcccctgctgggcgtgggcagatacaccgtgcagtaccccggcagctggtgcttcctgaccctgggcgccgagagcggcgacgtggccttcggcctgctgttcagcatgctgggcggcctgagcgtgggcctgagcttcctgctgaacaccgtgagcgtggccaccctgtgccacgtgtaccacggccaggaggccgcccagcagagacccagagacagcgaggtggagatgatggcccagctgctgggcatcatggtggtggccagcgtgtgctggctgcccctgctggtgttcatcgcccagaccgtgctgagaaacccccccgccatgagccccgccggccagctgagcagaaccaccgagaaggagctgctgatctacctgagagtggccacctggaaccagatcctggacccctgggtgtacatcctgttcagaagagccgtgctgagaagactgcagcccagactgagcaccagacccagaagcctgagcctgcagccccagctgacccagagaagcggcctgcagtag

SEQ ID NO: 102417 - DNA, 1224 bp, Artificial Sequence
  Description of Artificial Sequence: Synthetic coding sequence
atgtggcccaacggcagcagcctgggcccctgcttcagacccaccaacatcaccctggaggagagaagactgatcgccagcccctggttcgccgccagcttctgcgtggtgggcctggccagcaacctgctggccctgagcgtgctggccggcgccagacagggcggcagccacaccagaagcagcttcctgaccttcctgtgcggcctggtgctgaccgacttcctgggcctgctggtgaccggcaccatcgtggtgagccagcacgccgccctgttcgagtggcacgccgtggaccccggctgcagactgtgcagattcatgggcgtggtgatgatcttcttcggcctgagccccctgctgctgggcgccgccatggccagcgagagatacctgggcatcaccagacccttcagcagacccgccgtggccagccagagaagagcctgggccaccgtgggcctggtgtgggccgccgccctggccctgggcctgctgcccctgctgggcgtgggcagatacaccgtgcagtaccccggcagctggtgcttcctgaccctgggcgccgagagcggcgacgtggccttcggcctgctgttcagcatgctgggcggcctgagcgtgggcctgagcttcctgctgaacaccgtgagcgtggccaccctgtgccacgtgtaccacggccaggaggccgcccagcagagacccagagacagcgaggtggagatgatggcccagctgctgggcatcatggtggtggccagcgtgtgctggctgcccctgctggtgttcatcgcccagaccgtgctgagaaacccccccgccatgagccccgccggccagctgagcagaaccaccgagaaggagctgctgatctacctgagagtggccacctggaaccagatcctggacccctgggtgtacatcctgttcagaagagccgtgctgagaagactgcagcccagactgagcaccagacccagaagaagcctgaccctgtggcccagcctggagtacagcggcaccatcagcgcccactgcaacctgagactgcccggcagcagcgacagcagagccagcgccagcagagccgccggcatcaccggcgtgagccactgcgccagaccctgcatgctgttcgaccccgagttcgacctgctggccggcgtgcagctgctgcccttcgagccccccaccggcaaggccctgagcagaaaggactag

SEQ ID NO: 102418 - DNA, 1422 bp, Artificial Sequence
  Description of Artificial Sequence: Synthetic coding sequence
atgagagaggtgagagccagactggccgccacccaggtggagtacatcagcggcaaggtgttcttcaccacctgcagcgacctgaacatgctgaagaagctgaagagcgccgagagactgttcctgctgatcaagaagcagttccccctgatcatcagcagcgtgagcaagggcaagatcttcaacgagatgcagagactgatcaacgaggaccccggcagctggctgaacgccatcagcatctggaagaacctgctggagctggacgccaagaaggagaagctgagccagagagacgacaaccagctgaagagaaaggtgggcgagaacgagatcatcgccaagaagctgaagatcgagcagatgcagaagatcgaggagaacagagactgccagctggagaagcagatcaaggaggagaccctggagcagagagacttcaccaccaagagcgagaagttccaggaggaggagttccagaacgacatcgagaaggccatcgacacccacaaccagaacgacctgaccttcagagtgagctgcagatgcagcggcaccatcggcaaggccttcaccgcccaggaggtgggcaaggtgatcggcatcgccatcatgaagcacttcggctggaaggccgacctgagaaacccccagctggagatcttcatccacctgaacgacatctacagcgtggtgggcatccccgtgttcagagtgagcctggccagcagagcctacatcaagaccgccggcctgagaagcaccatcgcctgggccatggccagcctggccgacatcaaggccggcgccttcgtgctggaccccatgtgcggcctgggcaccatcctgctggaggccgccaaggagtggcccgacgtgtactacgtgggcgccgacgtgagcgacagccagctgctgggcacctgggacaacctgaaggccgccggcctggaggacaagatcgagctgctgaagatcagcgtgatcgagctgcccctgcccagcgagagcgtggacatcatcatcagcgacatccccttcggcaagaagttcaagctgggcaaggacatcaagagcatcctgcaggagatggagagagtgctgcacgtgggcggcaccatcgtgctgctgctgagcgaggaccaccacagaagactgaccgactgcaaggagagcaacatccccttcaacagcaaggacagccacaccgacgagcccggcatcaagaagtgcctgaaccccgaggagaagaccggcgccttcaagaccgccagcaccagcttcgaggccagcaaccacaagttcctggacagaatgagccccttcggcagcctggtgcccgtggagtgctacaaggtgagcctgggcaagaccgacgccttcatctgcaagtacaagaagagccacagcagcggcctgtag

SEQ ID NO: 102419 - DNA, 873 bp, Artificial Sequence
  Description of Artificial Sequence: Synthetic coding sequence
atgagagaggtgagagccagactggccgccacccaggtggagtacatcagcggcaaggtgttcttcaccacctgcagcgacctgaacatgctgaagaagctgaagagcgccgagagactgttcctgctgatcaagaagcagttccccctgatcatcagcagcgtgagcaagggcaagatcttcaacgagatgcagagactgatcaacgaggaccccggcagctggctgaacgccatcagcatctggaagaacctgctggagctggacgccaagaaggagaagctgagccagagagacgacaaccagctgaagagaaaggtgggcgagaacgagatcatcgccaagaagctgaagatcgagcagatgcagaagatcgaggagaacagagactgccagctggagaagcagatcaaggaggagaccctggagcagagagacttcaccaccaagagcgagaagttccaggaggaggagttccagaacgacatcgagaaggccatcgacacccacaaccagaacgacctgaccttcagagtgagctgcagatgcagcggcaccatcggcaaggccttcaccgcccaggtgctgtacatgggcctgagccccggccccagactgcagatgcacatgagaagccagcagtgcagagaggagagaaccccccagaccgtggccatcaccagaccccaccagctggccctgaccaagttcagcgacgtgaagggccactggagcgagtacttcatcaacctgaagatcagccagaccctgaagggcggcagaaagagcaactggaactgctactacgagaccctgtggatggagagcagactggaggagagcaccatcagagacctgtacaccagcaagtag

SEQ ID NO: 102420 - DNA, 1512 bp, Artificial Sequence
  Description of Artificial Sequence: Synthetic coding sequence
atgagcgaggccagaggcgagcccggcagcggccccgaggccggcgccagattcttctgcaccgccggcagaggcctggagcccttcgtgatgagagaggtgagagccagactggccgccacccaggtggagtacatcagcggcaaggtgttcttcaccacctgcagcgacctgaacatgctgaagaagctgaagagcgccgagagactgttcctgctgatcaagaagcagttccccctgatcatcagcagcgtgagcaagggcaagatcttcaacgagatgcagagactgatcaacgaggaccccggcagctggctgaacgccatcagcatctggaagaacctgctggagctggacgccaagaaggagaagctgagccagagagacgacaaccagctgaagagaaaggtgggcgagaacgagatcatcgccaagaagctgaagatcgagcagatgcagaagatcgaggagaacagagactgccagctggagaagcagatcaaggaggagaccctggagcagagagacttcaccaccaagagcgagaagttccaggaggaggagttccagaacgacatcgagaaggccatcgacacccacaaccagaacgacctgaccttcagagtgagctgcagatgcagcggcaccatcggcaaggccttcaccgcccaggaggtgggcaaggtgatcggcatcgccatcatgaagcacttcggctggaaggccgacctgagaaacccccagctggagatcttcatccacctgaacgacatctacagcgtggtgggcatccccgtgttcagagtgagcctggccagcagagcctacatcaagaccgccggcctgagaagcaccatcgcctgggccatggccagcctggccgacatcaaggccggcgccttcgtgctggaccccatgtgcggcctgggcaccatcctgctggaggccgccaaggagtggcccgacgtgtactacgtgggcgccgacgtgagcgacagccagctgctgggcacctgggacaacctgaaggccgccggcctggaggacaagatcgagctgctgaagatcagcgtgatcgagctgcccctgcccagcgagagcgtggacatcatcatcagcgacatccccttcggcaagaagttcaagctgggcaaggacatcaagagcatcctgcaggagatggagagagtgctgcacgtgggcggcaccatcgtgctgctgctgagcgaggaccaccacagaagactgaccgactgcaaggagagcaacatccccttcaacagcaaggacagccacaccgacgagcccggcatcaagaagtgcctgaaccccgaggagaagaccggcgccttcaagaccgccagcaccagcttcgaggccagcaaccacaagttcctggacagaatgagccccttcggcagcctggtgcccgtggagtgctacaaggtgagcctgggcaagaccgacgccttcatctgcaagtacaagaagagccacagcagcggcctgtag

SEQ ID NO: 102421 - DNA, 486 bp, Artificial Sequence
  Description of Artificial Sequence: Synthetic coding sequence
atgaacctggccatcagcatcgccctgctgctgaccgtgctgcaggtgagcagaggccagaaggtgaccagcctgaccgcctgcctggtggaccagagcctgagactggactgcagacacgagaacaccagcagcagccccatccagtacgagttcagcctgaccagagagaccaagaagcacgtgctgttcggcaccgtgggcgtgcccgagcacacctacagaagcagaaccaacttcaccagcaagtacaacatgaaggtgctgtacctgagcgccttcaccagcaaggacgagggcacctacacctgcgccctgcaccacagcggccacagcccccccatcagcagccagaacgtgaccgtgctgagagacaagctggtgaagtgcgagggcatcagcctgctggcccagaacaccagctggctgctgctgctgctgctgagcctgagcctgctgcaggccaccgacttcatgagcctgtag

SEQ ID NO: 102422 - DNA, 486 bp, Artificial Sequence; identical to SEQ ID NO: 102421
  Description of Artificial Sequence: Synthetic coding sequence

SEQ ID NO: 102423 - DNA, 480 bp, Artificial Sequence
  Description of Artificial Sequence: Synthetic coding sequence
atgttccccttcgccctgctgtacgtgctgagcgtgagcttcagaaagatcttcatcctgcagctggtgggcctggtgctgacctacgacttcaccaactgcgacttcgagaagatcaaggccgcctacctgagcaccatcagcaaggacctgatcacctacatgagcggcaccaagagcaccgagttcaacaacaccgtgagctgcagcaacagaccccactgcctgaccgagatccagagcctgaccttcaaccccaccgccggctgcgccagcctggccaaggagatgttcgccatgaagaccaaggccgccctggccatctggtgccccggctacagcgagacccagatcaacgccacccaggccatgaagaagagaagaaagagaaaggtgaccaccaacaagtgcctggagcaggtgagccagctgcagggcctgtggagaagattcaacagacccctgctgaagcagcagtag

SEQ ID NO: 102424 - DNA, 192 bp, Artificial Sequence
  Description of Artificial Sequence: Synthetic coding sequence
atgttcgccatgaagaccaaggccgccctggccatctggtgccccggctacagcgagacccagatcaacgccacccaggccatgaagaagagaagaaagagaaaggtgaccaccaacaagtgcctggagcaggtgagccagctgcagggcctgtggagaagattcaacagacccctgctgaagcagcagtag

SEQ ID NO: 102425 - DNA, 705 bp, Artificial Sequence
  Description of Artificial Sequence: Synthetic coding sequence
atgagctgcatcaacctgcccaccgtgctgcccggcagccccagcaagaccagaggccagatccaggtgatcctgggccccatgttcagcggcaagagcaccgagctgatgagaagagtgagaagattccagatcgcccagtacaagtgcctggtgatcaagtacgccaaggacaccagatacagcagcagcttctgcacccacgacagaaacaccatggaggccctgcccgcctgcctgctgagagacgtggcccaggaggccctgggcgtggccgtgatcggcatcgacgagggccagttcttccccgacatcgtggagttctgcgaggccatggccaacgccggcaagaccgtgatcgtggccgccctggacggcaccttccagagaaagcccttcggcgccatcctgaacctggtgcccctggccgagagcgtggtgaagctgaccgccgtgtgcatggagtgcttcagagaggccgcctacaccaagagactgggcaccgagaaggaggtggaggtgatcggcggcgccgacaagtaccacagcgtgtgcagactgtgctacttcaagaaggccagcggccagcccgccggccccgacaacaaggagaactgccccgtgcccggcaagcccggcgaggccgtggccgccagaaagctgttcgccccccagcagatcctgcagtgcagccccgccaactag

SEQ ID NO: 102426 - DNA, 705 bp, Artificial Sequence; identical to SEQ ID NO: 102425
  Description of Artificial Sequence: Synthetic coding sequence

SEQ ID NO: 102427 - DNA, 924 bp, Artificial Sequence
  Description of Artificial Sequence: Synthetic coding sequence
atgagacccggcctgttcaagggccaggcccccggcagcagaagaagacccaccgccggcctggccgtggtgagagccgacagccacaagaaggagcccagagccagcggcagcgccagacccgccatgctgctgtggcccctgagaggctgggccgccagagccctgagatgcttcggccccggcagcagaggcagccccgccagcggccccggccccagaagagtgcagagaagagcctggccccccgacaaggagcaggagaaggagaagaagagcgtgatctgcgtggagggcaacatcgccagcggcaagaccacctgcctggagttcttcagcaacgccaccgacgtggaggtgctgaccgagcccgtgagcaagtggagaaacgtgagaggccacaaccccctgggcctgatgtaccacgacgccagcagatggggcctgaccctgcagacctacgtgcagctgaccatgctggacagacacaccagaccccaggtgagcagcgtgagactgatggagagaagcatccacagcgccagatacatcttcgtggagaacctgtacagaagcggcaagatgcccgaggtggactacgtggtgctgagcgagtggttcgactggatcctgagaaacatggacgtgagcgtggacctgatcgtgtacctgagaaccaaccccgagacctgctaccagagactgaagaagagatgcagagaggaggagaaggtgatccccctggagtacctggaggccatccaccacctgcacgaggagtggctgatcaagggcagcctgttccccatggccgcccccgtgctggtgatcgaggccgaccaccacatggagagaatgctggagctgttcgagcagaacagagacagaatcctgacccccgagaacagaaagcactgcccctag

SEQ ID NO: 102428 - DNA, 744 bp, Artificial Sequence
  Description of Artificial Sequence: Synthetic coding sequence
atgctgctgtggcccctgagaggctgggccgccagagccctgagatgcttcggccccggcagcagaggcagccccgccagcggccccggccccagaagagtgcagagaagagcctggccccccgacaaggagcaggagaaggagaagaagagcgtgatctgcgtggagggcaacatcgccagcggcaagaccacctgcctggagttcttcagcaacgccaccgacgtggagggcctgatgtaccacgacgccagcagatggggcctgaccctgcagacctacgtgcagctgaccatgctggacagacacaccagaccccaggtgagcagcgtgagactgatggagagaagcatccacagcgccagatacatcttcgtggagaacctgtacagaagcggcaagatgcccgaggtggactacgtggtgctgagcgagtggttcgactggatcctgagaaacatggacgtgagcgtggacctgatcgtgtacctgagaaccaaccccgagacctgctaccagagactgaagaagagatgcagagaggaggagaaggtgatccccctggagtacctggaggccatccaccacctgcacgaggagtggctgatcaagggcagcctgttccccatggccgcccccgtgctggtgatcgaggccgaccaccacatggagagaatgctggagctgttcgagcagaacagagacagaatcctgacccccgagaacagaaagcactgcccctag

SEQ ID NO: 102429 - DNA, 798 bp, Artificial Sequence
  Description of Artificial Sequence: Synthetic coding sequence
atgctgctgtggcccctgagaggctgggccgccagagccctgagatgcttcggccccggcagcagaggcagccccgccagcggccccggccccagaagagtgcagagaagagcctggccccccgacaaggagcaggagaaggagaagaagagcgtgatctgcgtggagggcaacatcgccagcggcaagaccacctgcctggagttcttcagcaacgccaccgacgtggaggtgctgaccgagcccgtgagcaagtggagaaacgtgagaggccacaaccccctgggcctgatgtaccacgacgccagcagatggggcctgaccctgcagacctacgtgcagctgaccatgctggacagacacaccagaccccaggtgagcagcgtgagactgatggagagaagcatccacagcgccagatacatcttcgtggagaacctgtacagaagcggcaagatgcccgaggtggactacgtggtgctgagcgagtggttcgactggatcctgagaaacatggacgtgagcgtggacctgatcgtgtacctgagaaccaaccccgagacctgctaccagagactgaagaagagatgcagagaggaggagaaggtgatccccctggagtacctggaggccatccaccacctgcacgaggagtggctgatcaagggcagcctgttccccatggccgcccccgtgctggtgatcgaggccgaccaccacatggagagaatgctggagctgttcgagcagaacagagacagaatcctgacccccgagaacagaaagcactgcccctag

SEQ ID NO: 102430 - DNA, 507 bp, Artificial Sequence
  Description of Artificial Sequence: Synthetic coding sequence
atgtaccacgacgccagcagatggggcctgaccctgcagacctacgtgcagctgaccatgctggacagacacaccagaccccaggtgagcagcgtgagactgatggagagaagcatccacagcgccagatacatcttcgtggagaacctgtacagaagcggcaagatgcccgaggtggactacgtggtgctgagcgagtggttcgactggatcctgagaaacatggacgtgagcgtggacctgatcgtgtacctgagaaccaaccccgagacctgctaccagagactgaagaagagatgcagagaggaggagaaggtgatccccctggagtacctggaggccatccaccacctgcacgaggagtggctgatcaagggcagcctgttccccatggccgcccccgtgctggtgatcgaggccgaccaccacatggagagaatgctggagctgttcgagcagaacagagacagaatcctgacccccgagaacagaaagcactgcccctag

SEQ ID NO: 102431 - DNA, 705 bp, Artificial Sequence
  Description of Artificial Sequence: Synthetic coding sequence
atgggcgccttctgccagagacccagcagcgacaaggagcaggagaaggagaagaagagcgtgatctgcgtggagggcaacatcgccagcggcaagaccacctgcctggagttcttcagcaacgccaccgacgtggaggtgctgaccgagcccgtgagcaagtggagaaacgtgagaggccacaaccccctgggcctgatgtaccacgacgccagcagatggggcctgaccctgcagacctacgtgcagctgaccatgctggacagacacaccagaccccaggtgagcagcgtgagactgatggagagaagcatccacagcgccagatacatcttcgtggagaacctgtacagaagcggcaagatgcccgaggtggactacgtggtgctgagcgagtggttcgactggatcctgagaaacatggacgtgagcgtggacctgatcgtgtacctgagaaccaaccccgagacctgctaccagagactgaagaagagatgcagagaggaggagaaggtgatccccctggagtacctggaggccatccaccacctgcacgaggagtggctgatcaagggcagcctgttccccatggccgcccccgtgctggtgatcgaggccgaccaccacatggagagaatgctggagctgttcgagcagaacagagacagaatcctgacccccgagaacagaaagcactgcccctag

SEQ ID NO: 102432 - DNA, 507 bp, Artificial Sequence; identical to SEQ ID NO: 102430
  Description of Artificial Sequence: Synthetic coding sequence

SEQ ID NO: 102433 - DNA, 651 bp, Artificial Sequence
  Description of Artificial Sequence: Synthetic coding sequence
atgaccagcatctgcgtggagggcaacatcgccagcggcaagaccacctgcctggagttcttcagcaacgccaccgacgtggaggtgctgaccgagcccgtgagcaagtggagaaacgtgagaggccacaaccccctgggcctgatgtaccacgacgccagcagatggggcctgaccctgcagacctacgtgcagctgaccatgctggacagacacaccagaccccaggtgagcagcgtgagactgatggagagaagcatccacagcgccagatacatcttcgtggagaacctgtacagaagcggcaagatgcccgaggtggactacgtggtgctgagcgagtggttcgactggatcctgagaaacatggacgtgagcgtggacctgatcgtgtacctgagaaccaaccccgagacctgctaccagagactgaagaagagatgcagagaggaggagaaggtgatccccctggagtacctggaggccatccaccacctgcacgaggagtggctgatcaagggcagcctgttccccatggccgcccccgtgctggtgatcgaggccgaccaccacatggagagaatgctggagctgttcgagcagaacagagacagaatcctgacccccgagaacagaaagcactgcccctag

SEQ ID NO: 102434 - DNA, 723 bp, Artificial Sequence
  Description of Artificial Sequence: Synthetic coding sequence
atgctgctgtggcccctgagaggctgggccgccagagccctgagatgcttcggccccggcagcagaggcagccccgccagcggccccggccccagaagagtgcagagaagagcctggccccccgacaaggagcaggagaaggagaagaagagcgtggtgctgaccgagcccgtgagcaagtggagaaacgtgagaggccacaaccccctgggcctgatgtaccacgacgccagcagatggggcctgaccctgcagacctacgtgcagctgaccatgctggacagacacaccagaccccaggtgagcagcgtgagactgatggagagaagcatccacagcgccagatacatcttcgtggagaacctgtacagaagcggcaagatgcccgaggtggactacgtggtgctgagcgagtggttcgactggatcctgagaaacatggacgtgagcgtggacctgatcgtgtacctgagaaccaaccccgagacctgctaccagagactgaagaagagatgcagagaggaggagaaggtgatccccctggagtacctggaggccatccaccacctgcacgaggagtggctgatcaagggcagcctgttccccatggccgcccccgtgctggtgatcgaggccgaccaccacatggagagaatgctggagctgttcgagcagaacagagacagaatcctgacccccgagaacagaaagcactgcccctag

SEQ ID NO: 102435 - DNA, 840 bp, Artificial Sequence
  Description of Artificial Sequence: Synthetic coding sequence
atgcccgtggccggcagcgagctgcccagaagacccctgccccccgccgcccaggagagagacgccgagcccagacccccccacggcgagctgcagtacctgggccagatccagcacatcctgagatgcggcgtgagaaaggacgacagaaccggcaccggcaccctgagcgtgttcggcatgcaggccagatacagcctgagagacgagttccccctgctgaccaccaagagagtgttctggaagggcgtgctggaggagctgctgtggttcatcaagggcagcaccaacgccaaggagctgagcagcaagggcgtgaagatctgggacgccaacggcagcagagacttcctggacagcctgggcttcagcaccagagaggagggcgacctgggccccgtgtacggcttccagtggagacacttcggcgccgagtacagagacatggagagcgacctgcccctgatggccctgcccccctgccacgccctgtgccagttctacgtggtgaacagcgagctgagctgccagctgtaccagagaagcggcgacatgggcctgggcgtgcccttcaacatcgccagctacgccctgctgacctacatgatcgcccacatcaccggcctgaagcccggcgacttcatccacaccctgggcgacgcccacatctacctgaaccacatcgagcccctgaagatccagctgcagagagagcccagacccttccccaagctgagaatcctgagaaaggtggagaagatcgacgacttcaaggccgaggacttccagatcgagggctacaacccccaccccaccatcaagatggagatggccgtgtag

SEQ ID NO: 102436 - DNA, 693 bp, Artificial Sequence
  Description of Artificial Sequence: Synthetic coding sequence
atgcccgtggccggcagcgagctgcccagaagacccctgccccccgccgcccaggagagagacgccgagcccagacccccccacggcgagctgcagtacctgggccagatccagcacatcctgagatgcggcgtgagaaaggacgacagaaccggcaccggcaccctgagcgtgttcggcatgcaggccagatacagcctgagagactacagcggccagggcgtggaccagctgcagagagtgatcgacaccatcaagaccaaccccgacgacagaagaatcatcatgtgcgcctggaaccccagagacctgcccctgatggccctgcccccctgccacgccctgtgccagttctacgtggtgaacagcgagctgagctgccagctgtaccagagaagcggcgacatgggcctgggcgtgcccttcaacatcgccagctacgccctgctgacctacatgatcgcccacatcaccggcctgaagcccggcgacttcatccacaccctgggcgacgcccacatctacctgaaccacatcgagcccctgaagatccagctgcagagagagcccagacccttccccaagctgagaatcctgagaaaggtggagaagatcgacgacttcaaggccgaggacttccagatcgagggctacaacccccaccccaccatcaagatggagatggccgtgtag

SEQ ID NO: 102437 - DNA, 942 bp, Artificial Sequence
  Description of Artificial Sequence: Synthetic coding sequence
atgcccgtggccggcagcgagctgcccagaagacccctgccccccgccgcccaggagagagacgccgagcccagacccccccacggcgagctgcagtacctgggccagatccagcacatcctgagatgcggcgtgagaaaggacgacagaaccggcaccggcaccctgagcgtgttcggcatgcaggccagatacagcctgagagacgagttccccctgctgaccaccaagagagtgttctggaagggcgtgctggaggagctgctgtggttcatcaagggcagcaccaacgccaaggagctgagcagcaagggcgtgaagatctgggacgccaacggcagcagagacttcctggacagcctgggcttcagcaccagagaggagggcgacctgggccccgtgtacggcttccagtggagacacttcggcgccgagtacagagacatggagagcgactacagcggccagggcgtggaccagctgcagagagtgatcgacaccatcaagaccaaccccgacgacagaagaatcatcatgtgcgcctggaaccccagagacctgcccctgatggccctgcccccctgccacgccctgtgccagttctacgtggtgaacagcgagctgagctgccagctgtaccagagaagcggcgacatgggcctgggcgtgcccttcaacatcgccagctacgccctgctgacctacatgatcgcccacatcaccggcctgaagcccggcgacttcatccacaccctgggcgacgcccacatctacctgaaccacatcgagcccctgaagatccagctgcagagagagcccagacccttccccaagctgagaatcctgagaaaggtggagaagatcgacgacttcaaggccgaggacttccagatcgagggctacaacccccaccccaccatcaagatggagatggccgtgtag

SEQ ID NO: 102438 - DNA, 678 bp, Artificial Sequence
  Description of Artificial Sequence: Synthetic coding sequence
atgagcagacccagaaagagactggccggcaccagcggcagcgacaagggcctgagcggcaagagaaccaagaccgagaacagcggcgaggccctggccaaggtggaggacagcaacccccagaagaccagcgccaccaagaactgcctgaagaacctgagcagccactggctgatgaagagcgagcccgagagcagactggagaagggcgtggacgtgaagttcagcatcgaggacctgaaggcccagcccaagcagaccacctgctgggacggcgtgagaaactaccaggccagaaacttcctgagagccatgaagctgggcgaggaggccttcttctaccacagcaactgcaaggagcccggcatcgccggcctgatgaagatcgtgaaggaggcctaccccgaccacacccagttcgagaagaacaacccccactacgaccccagcagcaaggaggacaaccccaagtggagcatggtggacgtgcagttcgtgagaatgatgaagagattcatccccctggccgagctgaagagctaccaccaggcccacaaggccaccggcggccccctgaagaacatggtgctgttcaccagacagagactgagcatccagcccctgacccaggaggagttcgacttcgtgctgagcctggaggagaaggagcccagctag

SEQ ID NO: 102439 - DNA, 501 bp, Artificial Sequence
  Description of Artificial Sequence: Synthetic coding sequence
atgagcagacccagaaagagactggccggcaccagcggcagcgacaagggcctgagcggcaagagaaccaagaccgagaacagcggcgaggccctggccaaggtggaggacagcaacccccagaagaccagcgccaccaagaactgcctgaagaacctgagcagccactggctgatgaagagcgagcccgagagcagactggagaagggcgtggacgtgaagttcagcatcgaggacctgaaggcccagcccaagcagaccacctgctgggacggcgtgagaaactaccaggccagaaacttcctgagagccatgaagctgggcgaggaggccttcttctaccacagcaactgcaaggagcccggcatcgccggcctgatgaagatcgtgaaggaggcctaccccgaccacacccagttcgagaagaacaacccccactacgaccccagcagcaaggaggacaaccccaagtggagcatgaagagcctgatcctgttctag

SEQ ID NO: 102440 - DNA, 678 bp, Artificial Sequence; identical to SEQ ID NO: 102438
  Description of Artificial Sequence: Synthetic coding sequence

SEQ ID NO: 102441 - DNA, 678 bp, Artificial Sequence; identical to SEQ ID NO: 102438
  Description of Artificial Sequence: Synthetic coding sequence

SEQ ID NO: 102442 - DNA, 1926 bp, Artificial Sequence
  Description of Artificial Sequence: Synthetic coding sequence
atggccctgagcctggaggagttcgtgcacagcctggacctgagaaccctgcccagagtgctggagatccaggccggcatctacctggagggcagcatctacgagatgttcggcaacgagtgctgcttcagcaccggcgaggtgatcaagatcaccggcctgaaggtgaagaagatcatcgccgagatctgcgagcagatcgagggctgcgagagcctgcagcccttcgagctgcccatgaacttccccggcctgttcaagatcgtggccgacaagaccccctacctgaccatggaggagatcaccagaaccatccacatcggccccagcagactgggccacccctgcttctaccaccagaaggacatcaagctggagaacctgatcatcaagcagggcgagcagatcatgctgaacagcgtggaggagatcgacggcgagatcatggtgagctgcgccgtggccagaaaccaccagacccacagcttcaacctgcccctgagccaggagggcgagttctacgagtgcgaggacgagagaatctacaccctgaaggagatcgtggagtggaagatccccaagaacagaaccagaaccgtgaacctgaccgacttcagcaacaagtgggacagcaccaaccccttccccaaggacttctacggcaccctgatcctgaagcccgtgtacgagatccagggcgtgatgaagttcagaaaggacatcatcagaatcctgcccagcctggacgtggaggtgaaggacatcaccgacagctacgacgccaactggttcctgcagctgctgagcaccgaggacctgttcgagatgaccagcaaggagttccccatcgtgaccgaggtgatcgaggcccccgagggcaaccacctgccccagagcatcctgcagcccggcaagaccatcgtgatccacaagaagtaccaggccagcagaatcctggccagcgagatcagaagcaacttccccaagagacacttcctgatccccaccagctacaagggcaagttcaagagaagacccagagagttccccaccgcctacgacctggagatcgccaagagcgagaaggagcccctgcacgtggtggccaccaaggccttccacagcccccacgacaagctgagcagcgtgagcgtgggcgaccagttcctggtgcaccagagcgagaccaccgaggtgctgtgcgagggcatcaagaaggtggtgaacgtgctggcctgcgagaagatcctgaagaagagctacgaggccgccctgctgcccctgtacatggagggcggcttcgtggaggtgatccacgacaagaagcagtaccccatcagcgagctgtgcaagcagttcagactgcccttcaacgtgaaggtgagcgtgagagacctgagcatcgaggaggacgtgctggccgccacccccggcctgcagctggaggaggacatcaccgacagctacctgctgatcagcgacttcgccaaccccaccgagtgctgggagatccccgtgggcagactgaacatgaccgtgcagctggtgagcaacttcagcagagacgccgagcccttcctggtgagaaccctggtggaggagatcaccgaggagcagtactacatgatgagaagatacgagagcagcgccagccaccccccccccagaccccccaagcaccccagcgtggaggagaccaagctgaccctgctgaccctggccgaggagagaaccgtggacctgcccaagagccccaagagacaccacgtggacatcaccaagaagctgcaccccaaccaggccggcctggacagcaaggtgctgatcggcagccagaacgacctggtggacgaggagaaggagagaagcaacagaggcgccaccgccatcgccgagaccttcaagaacgagaagcaccagaagtag

SEQ ID NO: 102443 - DNA, 1689 bp, Artificial Sequence
  Description of Artificial Sequence: Synthetic coding sequence
atgaacttccccggcctgttcaagatcgtggccgacaagaccccctacctgaccatggaggagatcaccagaaccatccacatcggccccagcagactgggccacccctgcttctaccaccagaaggacatcaagctggagaacctgatcatcaagcagggcgagcagatcatgctgaacagcgtggaggagatcgacggcgagatcatggtgagctgcgccgtggccagaaaccaccagacccacagcttcaacctgcccctgagccaggagggcgagttctacgagtgcgaggacgagagaatctacaccctgaaggagatcgtggagtggaagatccccaagaacagaaccagaaccgtgaacctgaccgacttcagcaacaagtgggacagcaccaaccccttccccaaggacttctacggcaccctgatcctgaagcccgtgtacgagatccagggcgtgatgaagttcagaaaggacatcatcagaatcctgcccagcctggacgtggaggtgaaggacatcaccgacagctacgacgccaactggttcctgcagctgctgagcaccgaggacctgttcgagatgaccagcaaggagttccccatcgtgaccgaggtgatcgaggcccccgagggcaaccacctgccccagagcatcctgcagcccggcaagaccatcgtgatccacaagaagtaccaggccagcagaatcctggccagcgagatcagaagcaacttccccaagagacacttcctgatccccaccagctacaagggcaagttcaagagaagacccagagagttccccaccgcctacgacctggagatcgccaagagcgagaaggagcccctgcacgtggtggccaccaaggccttccacagcccccacgacaagctgagcagcgtgagcgtgggcgaccagttcctggtgcaccagagcgagaccaccgaggtgctgtgcgagggcatcaagaaggtggtgaacgtgctggcctgcgagaagatcctgaagaagagctacgaggccgccctgctgcccctgtacatggagggcggcttcgtggaggtgatccacgacaagaagcagtaccccatcagcgagctgtgcaagcagttcagactgcccttcaacgtgaaggtgagcgtgagagacctgagcatcgaggaggacgtgctggccgccacccccggcctgcagctggaggaggacatcaccgacagctacctgctgatcagcgacttcgccaaccccaccgagtgctgggagatccccgtgggcagactgaacatgaccgtgcagctggtgagcaacttcagcagagacgccgagcccttcctggtgagaaccctggtggaggagatcaccgaggagcagtactacatgatgagaagatacgagagcagcgccagccaccccccccccagaccccccaagcaccccagcgtggaggagaccaagctgaccctgctgaccctggccgaggagagaaccgtggacctgcccaagagccccaagagacaccacgtggacatcaccaagaagctgcaccccaaccaggccggcctggacagcaaggtgctgatcggcagccagaacgacctggtggacgaggagaaggagagaagcaacagaggcgccaccgccatcgccgagaccttcaagaacgagaagcaccagaagtag

SEQ ID NO: 102444 - DNA, 372 bp, Artificial Sequence
  Description of Artificial Sequence: Synthetic coding sequence
atgaacttccccgtgagaaaggacatcatcagaatcctgcccagcctggacgtggaggtgaaggacatcaccgacagctacgacgccaactggttcctgcagctgctgagcaccgaggacctgttcgagatgaccagcaaggagttccccatcgtgaccgaggtgatcgaggcccccgagggcaaccacctgccccagagcatcctgcagcccggcaagaccatcgtgatccacaagaagtaccaggccagcagaatcctggccagcgagatcagaagcaacttccccaagagacacttcctgatccccaccagctacaagggcaagttcaagagaagacccagagagttccccaccgcctacgacctgtag

SEQ ID NO: 102445 - DNA, 1821 bp, Artificial Sequence
  Description of Artificial Sequence: Synthetic coding sequence
atgttcggcaacgagtgctgcttcagcaccggcgaggtgatcaagatcaccggcctgaaggtgaagaagatcatcgccgagatctgcgagcagatcgagggctgcgagagcctgcagcccttcgagctgcccatgaacttccccggcctgttcaagatcgtggccgacaagaccccctacctgaccatggaggagatcaccagaaccatccacatcggccccagcagactgggccacccctgcttctaccaccagaaggacatcaagctggagaacctgatcatcaagcagggcgagcagatcatgctgaacagcgtggaggagatcgacggcgagatcatggtgagctgcgccgtggccagaaaccaccagacccacagcttcaacctgcccctgagccaggagggcgagttctacgagtgcgaggacgagagaatctacaccctgaaggagatcgtggagtggaagatccccaagaacagaaccagaaccgtgaacctgaccgacttcagcaacaagtgggacagcaccaaccccttccccaaggacttctacggcaccctgatcctgaagcccgtgtacgagatccagggcgtgatgaagttcagaaaggacatcatcagaatcctgcccagcctggacgtggaggtgaaggacatcaccgacagctacgacgccaactggttcctgcagctgctgagcaccgaggacctgttcgagatgaccagcaaggagttccccatcgtgaccgaggtgatcgaggcccccgagggcaaccacctgccccagagcatcctgcagcccggcaagaccatcgtgatccacaagaagtaccaggccagcagaatcctggccagcgagatcagaagcaacttccccaagagacacttcctgatccccaccagctacaagggcaagttcaagagaagacccagagagttccccaccgcctacgacctggagatcgccaagagcgagaaggagcccctgcacgtggtggccaccaaggccttccacagcccccacgacaagctgagcagcgtgagcgtgggcgaccagttcctggtgcaccagagcgagaccaccgaggtgctgtgcgagggcatcaagaaggtggtgaacgtgctggcctgcgagaagatcctgaagaagagctacgaggccgccctgctgcccctgtacatggagggcggcttcgtggaggtgatccacgacaagaagcagtaccccatcagcgagctgtgcaagcagttcagactgcccttcaacgtgaaggtgagcgtgagagacctgagcatcgaggaggacgtgctggccgccacccccggcctgcagctggaggaggacatcaccgacagctacctgctgatcagcgacttcgccaaccccaccgagtgctgggagatccccgtgggcagactgaacatgaccgtgcagctggtgagcaacttcagcagagacgccgagcccttcctggtgagaaccctggtggaggagatcaccgaggagcagtactacatgatgagaagatacgagagcagcgccagccaccccccccccagaccccccaagcaccccagcgtggaggagaccaagctgaccctgctgaccctggccgaggagagaaccgtggacctgcccaagagccccaagagacaccacgtggacatcaccaagaagctgcaccccaaccaggccggcctggacagcaaggtgctgatcggcagccagaacgacctggtggacgaggagaaggagagaagcaacagaggcgccaccgccatcgccgagaccttcaagaacgagaagcaccagaagtag

SEQ ID NO: 102446 - DNA, 2043 bp, Artificial Sequence
  Description of Artificial Sequence: Synthetic coding sequence
atggccctgagcctggaggagttcgtgcacagcctggacctgagaaccctgcccagagtgctggagatccaggccggcatctacctggagggcagcatctacgagatgttcggcaacgagtgctgcttcagcaccggcgaggtgatcaagatcaccggcctgaaggtgaagaagatcatcgccgagatctgcgagcagatcgagggctgcgagagcctgcagcccttcgagctgcccatgaacttccccggcctgttcaagatcgtggccgacaagaccccctacctgaccatggaggagatcaccagaaccatccacatcggccccagcagactgggccacccctgcttctaccaccagaaggacatcaagctggagaacctgatcatcaagcagggcgagcagatcatgctgaacagcgtggaggagatcgacggcgagatcatggtgagctgcgccgtggccagaaaccaccagacccacagcttcaacctgcccctgagccaggagggcgagttctacgagtgcgaggacgagagaatctacaccctgaaggagatcgtggagtggaagatccccaagaacagaaccagaaccgtgaacctgaccgacttcagcaacaagtgggacagcaccaaccccttccccaaggacttctacggcaccctgatcctgaagcccgtgtacgagatccagggcgtgatgaagttcagaaaggacatcatcagaatcctgcccagcctggacgtggaggtgaaggacatcaccgacagctacgacgccaactggttcctgcagctgctgagcaccgaggacctgttcgagatgaccagcaaggagttccccatcgtgaccgaggtgatcgaggcccccgagggcaaccacctgccccagagcatcctgcagcccggcaagaccatcgtgatccacaagaagtaccaggccagcagaatcctggccagcgagatcagaagcaacttccccaagagacacttcctgatccccaccagctacaagggcaagttcaagagaagacccagagagttccccaccgcctacgacctggagatcgccaagagcgagaaggagcccctgcacgtggtggccaccaaggccttccacagcccccacgacaagctgagcagcgtgagcgtgggcgaccagttcctggtgcaccagagcgagaccaccgaggtgctgtgcgagggcatcaagaaggtggtgaacgtgctggcctgcgagaagatcctgaagaagagctacgaggccgccctgctgcccctgtacatggagggcggcttcgtggaggtgatccacgacaagaagcagtaccccatcagcgagctgtgcaagcagttcagactgcccttcaacgtgaaggtgagcgtgagagacctgagcatcgaggaggacgtgctggccgccacccccggcctgcagctggaggaggacatcaccgacagctacctgctgatcagcgacttcgccaaccccaccgagtgctgggagatccccgtgggcagactgaacatgaccgtgcagctggtgagcaacttcagcagagacgccgagcccttcctggtgagaaccctggtggaggagatcaccgaggagcagtactacatgatgagaagatacgagagcagcgccagccaccccccccccagaccccccaagcaccccagcgtggaggagaccaagctgaccctgctgaccctggccgaggagagaaccgtggacctgcccaagagccccaaggccggcgtgcagtggagagacctgggcagcctgcagcccctgccccccggcttcaagcagttcagcgccagcgccagccacgtggccggcatcaccggcaccccccaccacgtgcagagacaccacgtggacatcaccaagaagctgcaccccaaccaggccggcctggacagcaaggtgctgatcggcagccagaacgacctggtggacgaggagaaggagagaagcaacagaggcgccaccgccatcgccgagaccttcaagaacgagaagcaccagaagtag

SEQ ID NO: 102447 - DNA, 1581 bp, Artificial Sequence
  Description of Artificial Sequence: Synthetic coding sequence
atggacgtgagattctaccccccccccgcccagcccgccgccgcccccgacgccccctgcctgggccccagcccctgcctggacccctactactgcaacaagttcgacggcgagaacatgtacatgagcatgaccgagcccagccaggactacgtgcccgccagccagagctaccccggccccagcctggagagcgaggacttcaacatcccccccatcaccccccccagcctgcccgaccacagcctggtgcacctgaacgaggtggagagcggctaccacagcctgtgccaccccatgaaccacaacggcctgctgcccttccacccccagaacatggacctgcccgagatcaccgtgagcaacatgctgggccaggacggcaccctgctgagcaacagcatcagcgtgatgcccgacatcagaaaccccgagggcacccagtacagcagccacccccagatggccgccatgagacccagaggccagcccgccgacatcagacagcagcccggcatgatgccccacggccagctgaccaccatcaaccagagccagctgagcgcccagctgggcctgaacatgggcggcagcaacgtgccccacaacagccccagcccccccggcagcaagagcgccacccccagccccagcagcagcgtgcacgaggacgagggcgacgacaccagcaagatcaacggcggcgagaagagacccgccagcgacatgggcaagaagcccaagacccccaagaagaagaagaagaaggaccccaacgagccccagaagcccgtgagcgcctacgccctgttcttcagagacacccaggccgccatcaagggccagaaccccaacgccaccttcggcgaggtgagcaagatcgtggccagcatgtgggacggcctgggcgaggagcagaagcaggtgtacaagaagaagaccgaggccgccaagaaggagtacctgaagcagctggccgcctacagagccagcctggtgagcaagagctacagcgagcccgtggacgtgaagaccagccagcccccccagctgatcaacagcaagcccagcgtgttccacggccccagccaggcccacagcgccctgtacctgagcagccactaccaccagcagcccggcatgaacccccacctgaccgccatgcaccccagcctgcccagaaacatcgcccccaagcccaacaaccagatgcccgtgaccgtgagcatcgccaacatggccgtgagcccccccccccccctgcagatcagcccccccctgcaccagcacctgaacatgcagcagcaccagcccctgaccatgcagcagcccctgggcaaccagctgcccatgcaggtgcagagcgccctgcacagccccaccatgcagcagggcttcaccctgcagcccgactaccagaccatcatcaaccccaccagcaccgccgcccaggtggtgacccaggccatggagtacgtgagaagcggctgcagaaacccccccccccagcccgtggactggaacaacgactactgcagcagcggcggcatgcagagagacaaggccctgtacctgacctag

SEQ ID NO: 102448 - DNA, 831 bp, Artificial Sequence
  Description of Artificial Sequence: Synthetic coding sequence
atgggcaagaagcccaagacccccaagaagaagaagaagaaggaccccaacgagccccagaagcccgtgagcgcctacgccctgttcttcagagacacccaggccgccatcaagggccagaaccccaacgccaccttcggcgaggtgagcaagatcgtggccagcatgtgggacggcctgggcgaggagcagaagcaggtgtacaagaagaagaccgaggccgccaagaaggagtacctgaagcagctggccgcctacagagccagcctggtgagcaagagctacagcgagcccgtggacgtgaagaccagccagcccccccagctgatcaacagcaagcccagcgtgttccacggccccagccaggcccactaccaccagcagcccggcatgaacccccacctgaccgccatgcaccccagcctgcccagaaacatcgcccccaagcccaacaaccagatgcccgtgaccgtgagcatcgccaacatggccgtgagcccccccccccccctgcagatcagcccccccctgcaccagcacctgaacatgcagcagcaccagcccctgaccatgcagcagcccctgggcaaccagctgcccatgcaggtgcagagcgccctgcacagccccaccatgcagcagggcttcaccctgcagcccgactaccagaccatcatcaaccccaccagcaccgccgcccaggtggtgacccaggccatggagtacgtgagaagcggctgcagaaacccccccccccagcccgtggactggaacaacgactactgcagcagcggcggcatgcagagagacaaggccctgtacctgacctag

SEQ ID NO: 102449 - DNA, 747 bp, Artificial Sequence
  Description of Artificial Sequence: Synthetic coding sequence
atgcccgagttcctggaggaccccagcgtgctgaccaaggacaagctgaagagcgagctggtggccaacaacgtgaccctgcccgccggcgagcagagaaaggacgtgtacgtgcagctgtacctgcagcacctgaccgccagaaacagaccccccctgcccgccggcaccaacagcaagggcccccccgacttcagcagcgacgaggagagagagcccacccccgtgctgggcagcggcgccgccgccgccggcagaagcagagccgccgtgggcagaaaggccaccaagaagaccgacaagcccagacaggaggacaaggacgacctggacgtgaccgagctgaccaacgaggacctgctggaccagctggtgaagtacggcgtgaaccccggccccatcgtgggcaccaccagaaagctgtacgagaagaagctgctgaagctgagagagcagggcaccgagagcagaagcagcacccccctgcccaccatcagcagcagcgccgagaacaccagacagaacggcagcaacgacagcgacagatacagcgacaacgaggaggacagcaagatcgagctgaagctggagaagagagagcccctgaagggcagagccaagacccccgtgaccctgaagcagagaagagtggagcacaaccaggtgagcctggtgctgctgcccccctgcaccggcatcaacaacctgctgaccaccctgatccacgtgctggccttcaacggctag

SEQ ID NO: 102450 - DNA, 2085 bp, Artificial Sequence
  Description of Artificial Sequence: Synthetic coding sequence
atgcccgagttcctggaggaccccagcgtgctgaccaaggacaagctgaagagcgagctggtggccaacaacgtgaccctgcccgccggcgagcagagaaaggacgtgtacgtgcagctgtacctgcagcacctgaccgccagaaacagaccccccctgcccgccggcaccaacagcaagggcccccccgacttcagcagcgacgaggagagagagcccacccccgtgctgggcagcggcgccgccgccgccggcagaagcagagccgccgtgggcagaaaggccaccaagaagaccgacaagcccagacaggaggacaaggacgacctggacgtgaccgagctgaccaacgaggacctgctggaccagctggtgaagtacggcgtgaaccccggccccatcgtgggcaccaccagaaagctgtacgagaagaagctgctgaagctgagagagcagggcaccgagagcagaagcagcacccccctgcccaccatcagcagcagcgccgagaacaccagacagaacggcagcaacgacagcgacagatacagcgacaacgaggagggcaagaagaaggagcacaagaaggtgaagagcaccagagacatcgtgcccttcagcgagctgggcaccacccccagcggcggcggcttcttccagggcatcagcttccccgagatcagcaccagaccccccctgggcagcaccgagctgcaggccgccaagaaggtgcacaccagcaagggcgacctgcccagagagcccctggtggccaccaacctgcccggcagaggccagctgcagaagctggccagcgagagaaacctgttcatcagctgcaagagcagccacgacagatgcctggagaagagcagcagcagcagcagccagcccgagcacagcgccatgctggtgagcaccgccgccagccccagcctgatcaaggagaccaccaccggctactacaaggacatcgtggagaacatctgcggcagagagaagagcggcatccagcccctgtgccccgagagaagccacatcagcgaccagagccccctgagcagcaagagaaaggccctggaggagagcgagagcagccagctgatcagcccccccctggcccaggccatcagagactacgtgaacagcctgctggtgcagggcggcgtgggcagcctgcccggcaccagcaacagcatgccccccctggacgtggagaacatccagaagagaatcgaccagagcaagttccaggagaccgagttcctgagcccccccagaaaggtgcccagactgagcgagaagagcgtggaggagagagacagcggcagcttcgtggccttccagaacatccccggcagcgagctgatgagcagcttcgccaagaccgtggtgagccacagcctgaccaccctgggcctggaggtggccaagcagagccagcacgacaagatcgacgccagcgagctgagcttccccttccacgagagcatcctgaaggtgatcgaggaggagtggcagcaggtggacagacagctgcccagcctggcctgcaagtaccccgtgagcagcagagaggccacccagatcctgagcgtgcccaaggtggacgacgagatcctgggcttcatcagcgaggccacccccctgggcggcatccaggccgccagcaccgagagctgcaaccagcagctggacctggccctgtgcagagcctacgaggccgccgccagcgccctgcagatcgccacccacaccgccttcgtggccaaggccatgcaggccgacatcagccaggccgcccagatcctgagcagcgaccccagcagaacccaccaggccctgggcatcctgagcaagacctacgacgccgccagctacatctgcgaggccgccttcgacgaggtgaagatggccgcccacaccatgggcaacgccaccgtgggcagaagatacctgtggctgaaggactgcaagatcaacctggccagcaagaacaagctggccagcacccccttcaagggcggcaccctgttcggcggcgaggtgtgcaaggtgatcaagaagagaggcaacaagcactag

SEQ ID NO: 102451 - DNA, 1245 bp, Artificial Sequence
  Description of Artificial Sequence: Synthetic coding sequence
atgcccgagttcctggaggaccccagcgtgctgaccaaggacaagctgaagagcgagctggtggccaacaacgtgaccctgcccgccggcgagcagagaaaggacgtgtacgtgcagctgtacctgcagcacctgaccgccagaaacagaccccccctgcccgccggcaccaacagcaagggcccccccgacttcagcagcgacgaggagagagagcccacccccgtgctgggcagcggcgccgccgccgccggcagaagcagagccgccgtgggcagaaaggccaccaagaagaccgacaagcccagacaggaggacaaggacgacctggacgtgaccgagctgaccaacgaggacctgctggaccagctggtgaagtacggcgtgaaccccggccccatcgtgggcaccaccagaaagctgtacgagaagaagctgctgaagctgagagagcagggcaccgagagcagaagcagcacccccctgcccaccatcagcagcagcgccgagaacaccagacagaacggcagcaacgacagcgacagatacagcgacaacgaggaggacagcaagatcgagctgaagctggagaagagagagcccctgaagggcagagccaagacccccgtgaccctgaagcagagaagagtggagcacaaccaggtggagaccagcgagcacttcagaatcgacggccccgtgatcagcgagagcacccccatcgccgagaccatcatggccagcagcaacgagagcctggtggtgaacagagtgaccggcaacttcaagcacgccagccccatcctgcccatcaccgagttcagcgacatccccagaagagcccccaagaagcccctgaccagagccgaggtgggcgagaagaccgaggagagaagagtggagagagacatcctgaaggagatgttcccctacgaggccagcacccccaccggcatcagcgccagctgcagaagacccatcaagggcgccgccggcagacccctggagctgagcgacttcagaatggaggagagcttcagcagcaagtacgtgcccaagtacgtgcccctggccgacgtgaagagcgagaagaccaagaagggcagaagcatccccgtgtggatcaagatcctgctgttcgtggtggtggccgtgttcctgttcctggtgtaccaggccatggagaccaaccaggtgaaccccttcagcaacttcctgcacgtggaccccagaaagagcaactag

SEQ ID NO: 102452 - DNA, 1038 bp, Artificial Sequence
  Description of Artificial Sequence: Synthetic coding sequence
atgcccgagttcctggaggaccccagcgtgctgaccaaggacaagctgaagagcgagctggtggccaacaacgtgaccctgcccgccggcgagcagagaaaggacgtgtacgtgcagctgtacctgcagcacctgaccgccagaaacagaccccccctgcccgccggcaccaacagcaagggcccccccgacttcagcagcgacgaggagagagagcccacccccgtgctgggcagcggcgccgccgccgccggcagaagcagagccgccgtgggcagaaaggccaccaagaagaccgacaagcccagacaggaggacaaggacgacctggacgtgaccgagctgaccaacgaggacctgctggaccagctggtgaagtacggcgtgaaccccggccccatcgtgggcaccaccagaaagctgtacgagaagaagctgctgaagctgagagagcagggcaccgagagcagaagcagcacccccctgcccaccatcagcagcagcgccgagaacaccagacagaacggcagcaacgacagcgacagatacagcgacaacgaggaggacagcaagatcgagctgaagctggagaagagagagcccctgaagggcagagccaagacccccgtgaccctgaagcagagaagagtggagcacaaccaggtgggcgagaagaccgaggagagaagagtggagagagacatcctgaaggagatgttcccctacgaggccagcacccccaccggcatcagcgccagctgcagaagacccatcaagggcgccgccggcagacccctggagctgagcgacttcagaatggaggagagcttcagcagcaagtacgtgcccaagtacgtgcccctggccgacgtgaagagcgagaagaccaagaagggcagaagcatccccgtgtggatcaagatcctgctgttcgtggtggtggccgtgttcctgttcctggtgtaccaggccatggagaccaaccaggtgaaccccttcagcaacttcctgcacgtggaccccagaaagagcaactag

SEQ ID NO: 102453 - DNA, 1365 bp, Artificial Sequence
  Description of Artificial Sequence: Synthetic coding sequence
atgcccgagttcctggaggaccccagcgtgctgaccaaggacaagctgaagagcgagctggtggccaacaacgtgaccctgcccgccggcgagcagagaaaggacgtgtacgtgcagctgtacctgcagcacctgaccgccagaaacagaccccccctgcccgccggcaccaacagcaagggcccccccgacttcagcagcgacgaggagagagagcccacccccgtgctgggcagcggcgccgccgccgccggcagaagcagagccgccgtgggcagaaaggccaccaagaagaccgacaagcccagacaggaggacaaggacgacctggacgtgaccgagctgaccaacgaggacctgctggaccagctggtgaagtacggcgtgaaccccggccccatcgtgggcaccaccagaaagctgtacgagaagaagctgctgaagctgagagagcagggcaccgagagcagaagcagcacccccctgcccaccatcagcagcagcgccgagaacaccagacagaacggcagcaacgacagcgacagatacagcgacaacgaggaggacagcaagatcgagctgaagctggagaagagagagcccctgaagggcagagccaagacccccgtgaccctgaagcagagaagagtggagcacaaccagagctacagccaggccggcatcaccgagaccgagtggaccagcggcagcagcaagggcggccccctgcaggccctgaccagagagagcaccagaggcagcagaagaacccccagaaagagagtggagaccagcgagcacttcagaatcgacggccccgtgatcagcgagagcacccccatcgccgagaccatcatggccagcagcaacgagagcctggtggtgaacagagtgaccggcaacttcaagcacgccagccccatcctgcccatcaccgagttcagcgacatccccagaagagcccccaagaagcccctgaccagagccgaggtgggcgagaagaccgaggagagaagagtggagagagacatcctgaaggagatgttcccctacgaggccagcacccccaccggcatcagcgccagctgcagaagacccatcaagggcgccgccggcagacccctggagctgagcgacttcagaatggaggagagcttcagcagcaagtacgtgcccaagtacgtgcccctggccgacgtgaagagcgagaagaccaagaagggcagaagcatccccgtgtggatcaagatcctgctgttcgtggtggtggccgtgttcctgttcctggtgtaccaggccatggagaccaaccaggtgaaccccttcagcaacttcctgcacgtggaccccagaaagagcaactag

SEQ ID NO: 102454 - DNA, 135 bp, Artificial Sequence
  Description of Artificial Sequence: Synthetic coding sequence
atgagcgacaagcccgacatggccgagatcgagaagttcgacaagagcaagctgaagaagaccgagacccaggagaagaaccccctgcccagcaaggagaccatcgagcaggagaagcaggccggcgagagctag

SEQ ID NO: 102455 - DNA, 135 bp, Artificial Sequence; identical to SEQ ID NO: 102454
  Description of Artificial Sequence: Synthetic coding sequence

SEQ ID NO: 102456 - DNA, 135 bp, Artificial Sequence; identical to SEQ ID NO: 102454
  Description of Artificial Sequence: Synthetic coding sequence

SEQ ID NO: 102457 - DNA, 135 bp, Artificial Sequence; identical to SEQ ID NO: 102454
  Description of Artificial Sequence: Synthetic coding sequence

SEQ ID NO: 102458 - DNA, 135 bp, Artificial Sequence
  Description of Artificial Sequence: Synthetic coding sequence
atgagcgacaagcccggcatggccgagatcgagaagttcgacaagagcaagctgaagaagaccgagacccaggagaagaaccccctgagcagcaaggagaccatcgagcaggagagacaggccggcgagagctag

SEQ ID NO: 102459 - DNA, 1299 bp, Artificial Sequence
  Description of Artificial Sequence: Synthetic coding sequence
atgggccccgccggcagcctgctgggcagcggccagatgcagatcaccctgtggggcagcctggccgccgtggccatcttcttcgtgatcaccttcctgatcttcctgtgcagcagctgcgacagagagaagaagcccagacagcacagcggcgaccacgagaacctgatgaacgtgcccagcgacaaggagatgttcagcagaagcgtgaccagcctggccaccgacgcccccgccagcagcgagcagaacggcgccctgaccaacggcgacatcctgagcgaggacagcaccctgacctgcatgcagcactacgaggaggtgcagaccagcgccagcgacctgctggacagccaggacagcaccggcaagcccaagtgccaccagagcagagagctgcccagaatcccccccgagagcgccgtggacaccatgctgaccgccagaagcgtggacggcgaccagggcctgggcatggagggcccctacgaggtgctgaaggacagcagcagccaggagaacatggtggaggactgcctgtacgagaccgtgaaggagatcaaggaggtggccgccgccgcccacctggagaagggccacagcggcaaggccaagagcaccagcgccagcaaggagctgcccggcccccagaccgagggcaaggccgagttcgccgagtacgccagcgtggacagaaacaagaagtgcagacagagcgtgaacgtggagagcatcctgggcaacagctgcgaccccgaggaggaggcccccccccccgtgcccgtgaagctgctggacgagaacgagaacctgcaggagaaggagggcggcgaggccgaggagagcgccaccgacaccaccagcgagaccaacaagagattcagcagcctgagctacaagagcagagaggaggaccccaccctgaccgaggaggagatcagcgccatgtacagcagcgtgaacaagcccggccagctggtgaacaagagcggccagagcctgaccgtgcccgagagcacctacaccagcatccagggcgacccccagagaagccccagcagctgcaacgacctgtacgccaccgtgaaggacttcgagaagacccccaacagcaccctgccccccgccggcagacccagcgaggagcccgagcccgactacgaggccatccagaccctgaacagagaggaggagaaggccaccctgggcaccaacggccaccacggcctggtgcccaaggagaacgactacgagagcatcagcgacctgcagcagggcagagacatcaccagactgtag

SEQ ID NO: 102460 - DNA, 8136 bp, Artificial Sequence
  Description of Artificial Sequence: Synthetic coding sequence
atggccctggtgctggagatcttcaccctgctggccagcatctgctgggtgagcgccaacatcttcgagtaccaggtggacgcccagcccctgagaccctgcgagctgcagagagagaccgccttcctgaagcaggccgactacgtgccccagtgcgccgaggacggcagcttccagaccgtgcagtgccagaacgacggcagaagctgctggtgcgtgggcgccaacggcagcgaggtgctgggcagcagacagcccggcagacccgtggcctgcctgagcttctgccagctgcagaagcagcagatcctgctgagcggctacatcaacagcaccgacaccagctacctgccccagtgccaggacagcggcgactacgcccccgtgcagtgcgacgtgcagcaggtgcagtgctggtgcgtggacgccgagggcatggaggtgtacggcaccagacagctgggcagacccaagagatgccccagaagctgcgagatcagaaacagaagactgctgcacggcgtgggcgacaagagccccccccagtgcagcgccgagggcgagttcatgcccgtgcagtgcaagttcgtgaacaccaccgacatgatgatcttcgacctggtgcacagctacaacagattccccgacgccttcgtgaccttcagcagcttccagagaagattccccgaggtgagcggctactgccactgcgccgacagccagggcagagagctggccgagaccggcctggagctgctgctggacgagatctacgacaccatcttcgccggcctggacctgcccagcaccttcaccgagaccaccctgtacagaatcctgcagagaagattcctggccgtgcagagcgtgatcagcggcagattcagatgccccaccaagtgcgaggtggagagattcaccgccaccagcttcggccacccctacgtgcccagctgcagaagaaacggcgactaccaggccgtgcagtgccagaccgagggcccctgctggtgcgtggacgcccagggcaaggagatgcacggcaccagacagcagggcgagccccccagctgcgccgagggccagagctgcgccagcgagagacagcaggccctgagcagactgtacttcggcaccagcggctacttcagccagcacgacctgttcagcagccccgagaagagatgggccagccccagagtggccagattcgccaccagctgcccccccaccatcaaggagctgttcgtggacagcggcctgctgagacccatggtggagggccagagccagcagttcagcgtgagcgagaacctgctgaaggaggccatcagagccatcttccccagcagaggcctggccagactggccctgcagttcaccaccaaccccaagagactgcagcagaacctgttcggcggcaagttcctggtgaacgtgggccagttcaacctgagcggcgccctgggcaccagaggcaccttcaacttcagccagttcttccagcagctgggcctggccagcttcctgaacggcggcagacaggaggacctggccaagcccctgagcgtgggcctggacagcaacagcagcaccggcacccccgaggccgccaagaaggacggcaccatgaacaagcccaccgtgggcagcttcggcttcgagatcaacctgcaggagaaccagaacgccctgaagttcctggccagcctgctggagctgcccgagttcctgctgttcctgcagcacgccatcagcgtgcccgaggacgtggccagagacctgggcgacgtgatggagaccgtgctgagcagccagacctgcgagcagacccccgagagactgttcgtgcccagctgcaccaccgagggcagctacgaggacgtgcagtgcttcagcggcgagtgctggtgcgtgaacagctggggcaaggagctgcccggcagcagagtgagaggcggccagcccagatgccccaccgactgcgagaagcagagagccagaatgcagagcctgatgggcagccagcccgccggcagcaccctgttcgtgcccgcctgcaccagcgagggccacttcctgcccgtgcagtgcttcaacagcgagtgctactgcgtggacgccgagggccaggccatccccggcaccagaagcgccatcggcaagcccaagaagtgccccaccccctgccagctgcagagcgagcaggccttcctgagaaccgtgcaggccctgctgagcaacagcagcatgctgcccaccctgagcgacacctacatcccccagtgcagcaccgacggccagtggagacaggtgcagtgcaacggcccccccgagcaggtgttcgagctgtaccagagatgggaggcccagaacaagggccaggacctgacccccgccaagctgctggtgaagatcatgagctacagagaggccgccagcggcaacttcagcctgttcatccagagcctgtacgaggccggccagcaggacgtgttccccgtgctgagccagtaccccagcctgcaggacgtgcccctggccgccctggagggcaagagaccccagcccagagagaacatcctgctggagccctacctgttctggcagatcctgaacggccagctgagccagtaccccggcagctacagcgacttcagcacccccctggcccacttcgacctgagaaactgctggtgcgtggacgaggccggccaggagctggagggcatgagaagcgagcccagcaagctgcccacctgccccggcagctgcgaggaggccaagctgagagtgctgcagttcatcagagagaccgaggagatcgtgagcgccagcaacagcagcagattccccctgggcgagagcttcctggtggccaagggcatcagactgagaaacgaggacctgggcctgccccccctgttcccccccagagaggccttcgccgagcagttcctgagaggcagcgactacgccatcagactggccgcccagagcaccctgagcttctaccagagaagaagattcagccccgacgacagcgccggcgccagcgccctgctgagaagcggcccctacatgccccagtgcgacgccttcggcagctgggagcccgtgcagtgccacgccggcaccggccactgctggtgcgtggacgagaagggcggcttcatccccggcagcctgaccgccagaagcctgcagatcccccagtgccccaccacctgcgagaagagcagaaccagcggcctgctgagcagctggaagcaggccagaagccaggagaaccccagccccaaggacctgttcgtgcccgcctgcctggagaccggcgagtacgccagactgcaggccagcggcgccggcacctggtgcgtggaccccgccagcggcgaggagctgagacccggcagcagcagcagcgcccagtgccccagcctgtgcaacgtgctgaagagcggcgtgctgagcagaagagtgagccccggctacgtgcccgcctgcagagccgaggacggcggcttcagccccgtgcagtgcgaccaggcccagggcagctgctggtgcgtgatggacagcggcgaggaggtgcccggcaccagagtgaccggcggccagcccgcctgcgagagccccagatgccccctgcccttcaacgccagcgaggtggtgggcggcaccatcctgtgcgagaccatcagcggccccaccggcagcgccatgcagcagtgccagctgctgtgcagacagggcagctggagcgtgttcccccccggccccctgatctgcagcctggagagcggcagatgggagagccagctgccccagcccagagcctgccagagaccccagctgtggcagaccatccagacccagggccacttccagctgcagctgccccccggcaagatgtgcagcgccgactacgccgacctgctgcagaccttccaggtgttcatcctggacgagctgaccgccagaggcttctgccagatccaggtgaagaccttcggcaccctggtgagcatccccgtgtgcaacaacagcagcgtgcaggtgggctgcctgaccagagagagactgggcgtgaacgtgacctggaagagcagactggaggacatccccgtggccagcctgcccgacctgcacgacatcgagagagccctggtgggcaaggacctgctgggcagattcaccgacctgatccagagcggcagcttccagctgcacctggacagcaagaccttccccgccgagaccatcagattcctgcagggcgaccacttcggcaccagccccagaacctggttcggctgcagcgagggcttctaccaggtgctgaccagcgaggccagccaggacggcctgggctgcgtgaagtgccccgagggcagctacagccaggacgaggagtgcatcccctgccccgtgggcttctaccaggagcaggccggcagcctggcctgcgtgccctgccccgtgggcagaaccaccatcagcgccggcgccttcagccagacccacctgatgcagaagttcgagaaggtgcccgagagcaaggtgatcttcgacgccaacgcccccgtggccgtgagaagcaaggtgcccgacagcgagttccccgtgatgcagtgcctgaccgactgcaccgaggacgaggcctgcagcttcttcaccgtgagcaccaccgagcccgagatcagctgcgacttctacgcctggaccagcgacaacgtggcctgcatgaccagcgaccagaagagagacgccctgggcaacagcaaggccaccagcttcggcagcctgagatgccaggtgaaggtgagaagccacggccaggacagccccgccgtgtacctgaagaagggccagggcagcaccaccaccctgcagaagagattcgagcccaccggcttccagaacatgctgagcggcctgtacaaccccatcgtgttcagcgccagcggcgccaacctgaccgacgcccacctgttctgcctgctggcctgcgacagagacctgtgctgcgacggcttcgtgctgacccaggtgcagggcggcgccatcatctgcggcctgctgagcagccccagcgtgctgctgtgcaacgtgaaggactggatggaccccagcgaggcctgggccaacgccacctgccccggcgtgacctacgaccaggagagccaccaggtgatcctgagactgggcgaccaggagttcatcaagagcctgacccccctggagggcacccaggacaccttcaccaacttccagcaggtgtacctgtggaaggacagcgacatgggcagcagacccgagagcatgggctgcagaaaggacaccgtgcccagacccgccagccccaccgaggccggcctgaccaccgagctgttcagccccgtggacctgaaccaggtgatcgtgaacggcaaccagagcctgagcagccagaagcactggctgttcaagcacctgttcagcgcccagcaggccaacctgtggtgcctgagcagatgcgtgcaggagcacagcttctgccagctggccgagatcaccgagagcgccagcctgtacttcacctgcaccctgtaccccgaggcccaggtgtgcgacgacatcatggagagcaacgcccagggctgcagactgatcctgccccagatgcccaaggccctgttcagaaagaaggtgatcctggaggacaaggtgaagaacttctacaccagactgcccttccagaagctgatgggcatcagcatcagaaacaaggtgcccatgagcgagaagagcatcagcaacggcttcttcgagtgcgagagaagatgcgacgccgacccctgctgcaccggcttcggcttcctgaacgtgagccagctgaagggcggcgaggtgacctgcctgaccctgaacagcctgggcatccagatgtgcagcgaggagaacggcggcgcctggagaatcctggactgcggcagccccgacatcgaggtgcacacctaccccttcggctggtaccagaagcccatcgcccagaacaacgcccccagcttctgccccctggtggtgctgcccagcctgaccgagaaggtgagcctggacagctggcagagcctggccctgagcagcgtggtggtggaccccagcatcagacacttcgacgtggcccacgtgagcaccgccgccaccagcaacttcagcgccgtgagagacctgtgcctgagcgagtgcagccagcacgaggcctgcctgatcaccaccctgcagacccagcccggcgccgtgagatgcatgttctacgccgacacccagagctgcacccacagcctgcagggccagaactgcagactgctgctgagagaggaggccacccacatctacagaaagcccggcatcagcctgctgagctacgaggccagcgtgcccagcgtgcccatcagcacccacggcagactgctgggcagaagccaggccatccaggtgggcaccagctggaagcaggtggaccagttcctgggcgtgccctacgccgccccccccctggccgagagaagattccaggcccccgagcccctgaactggaccggcagctgggacgccagcaagcccagagccagctgctggcagcccggcaccagaaccagcaccagccccggcgtgagcgaggactgcctgtacctgaacgtgttcatcccccagaacgtggcccccaacgccagcgtgctggtgttcttccacaacaccatggacagagaggagagcgagggctggcccgccatcgacggcagcttcctggccgccgtgggcaacctgatcgtggtgaccgccagctacagagtgggcgtgttcggcttcctgagcagcggcagcggcgaggtgagcggcaactggggcctgctggaccaggtggccgccctgacctgggtgcagacccacatcagaggcttcggcggcgaccccagaagagtgagcctggccgccgacagaggcggcgccgacgtggccagcatccacctgctgaccgccagagccaccaacagccagctgttcagaagagccgtgctgatgggcggcagcgccctgagccccgccgccgtgatcagccacgagagagcccagcagcaggccatcgccctggccaaggaggtgagctgccccatgagcagcagccaggaggtggtgagctgcctgagacagaagcccgccaacgtgctgaacgacgcccagaccaagctgctggccgtgagcggccccttccactactggggccccgtgatcgacggccacttcctgagagagccccccgccagagccctgaagagaagcctgtgggtggaggtggacctgctgatcggcagcagccaggacgacggcctgatcaacagagccaaggccgtgaagcagttcgaggagagcagaggcagaaccagcagcaagaccgccttctaccaggccctgcagaacagcctgggcggcgaggacagcgacgccagagtggaggccgccgccacctggtactacagcctggagcacagcaccgacgactacgccagcttcagcagagccctggagaacgccaccagagactacttcatcatctgccccatcatcgacatggccagcgcctgggccaagagagccagaggcaacgtgttcatgtaccacgcccccgagaactacggccacggcagcctggagctgctggccgacgtgcagttcgccctgggcctgcccttctaccccgcctacgagggccagttcagcctggaggagaagagcctgagcctgaagatcatgcagtacttcagccacttcatcagaagcggcaaccccaactacccctacgagttcagcagaaaggtgcccaccttcgccaccccctggcccgacttcgtgcccagagccggcggcgagaactacaaggagttcagcgagctgctgcccaacagacagggcctgaagaaggccgactgcagcttctggagcaagtacatcagcagcctgaagaccagcgccgacggcgccaagggcggccagagcgccgagagcgaggaggaggagctgaccgccggcagcggcctgagagaggacctgctgagcctgcaggagcccggcagcaagacctacagcaagtag

SEQ ID NO: 102461 - DNA, 2664 bp, Artificial Sequence
  Description of Artificial Sequence: Synthetic coding sequence
atggccctggtgctggagatcttcaccctgctggccagcatctgctgggtgagcgccaacatcttcgagtaccaggtggacgcccagcccctgagaccctgcgagctgcagagagagaccgccttcctgaagcaggccgactacgtgccccagtgcgccgaggacggcagcttccagaccgtgcagtgccagaacgacggcagaagctgctggtgcgtgggcgccaacggcagcgaggtgctgggcagcagacagcccggcagacccgtggcctgcctgagcttctgccagctgcagaagcagcagatcctgctgagcggctacatcaacagcaccgacaccagctacctgccccagtgccaggacagcggcgactacgcccccgtgcagtgcgacgtgcagcaggtgcagtgctggtgcgtggacgccgagggcatggaggtgtacggcaccagacagctgggcagacccaagagatgccccagaagctgcgagatcagaaacagaagactgctgcacggcgtgggcgacaagagccccccccagtgcagcgccgagggcgagttcatgcccgtgcagtgcaagttcgtgaacaccaccgacatgatgatcttcgacctggtgcacagctacaacagattccccgacgccttcgtgaccttcagcagcttccagagaagattccccgaggtgagcggctactgccactgcgccgacagccagggcagagagctggccgagaccggcctggagctgctgctggacgagatctacgacaccatcttcgccggcctggacctgcccagcaccttcaccgagaccaccctgtacagaatcctgcagagaagattcctggccgtgcagagcgtgatcagcggcagattcagatgccccaccaagtgcgaggtggagagattcaccgccaccagcttcggccacccctacgtgcccagctgcagaagaaacggcgactaccaggccgtgcagtgccagaccgagggcccctgctggtgcgtggacgcccagggcaaggagatgcacggcaccagacagcagggcgagccccccagctgcgccgagggccagagctgcgccagcgagagacagcaggccctgagcagactgtacttcggcaccagcggctacttcagccagcacgacctgttcagcagccccgagaagagatgggccagccccagagtggccagattcgccaccagctgcccccccaccatcaaggagctgttcgtggacagcggcctgctgagacccatggtggagggccagagccagcagttcagcgtgagcgagaacctgctgaaggaggccatcagagccatcttccccagcagaggcctggccagactggccctgcagttcaccaccaaccccaagagactgcagcagaacctgttcggcggcaagttcctggtgaacgtgggccagttcaacctgagcggcgccctgggcaccagaggcaccttcaacttcagccagttcttccagcagctgggcctggccagcttcctgaacggcggcagacaggaggacctggccaagcccctgagcgtgggcctggacagcaacagcagcaccggcacccccgaggccgccaagaaggacggcaccatgaacaagcccaccgtgggcagcttcggcttcgagatcaacctgcaggagaaccagaacgccctgaagttcctggccagcctgctggagctgcccgagttcctgctgttcctgcagcacgccatcagcgtgcccgaggacgtggccagagacctgggcgacgtgatggagaccgtgctgagcagccagacctgcgagcagacccccgagagactgttcgtgcccagctgcaccaccgagggcagctacgaggacgtgcagtgcttcagcggcgagtgctggtgcgtgaacagctggggcaaggagctgcccggcagcagagtgagaggcggccagcccagatgccccaccgactgcgagaagcagagagccagaatgcagagcctgatgggcagccagcccgccggcagcaccctgttcgtgcccgcctgcaccagcgagggccacttcctgcccgtgcagtgcttcaacagcgagtgctactgcgtggacgccgagggccaggccatccccggcaccagaagcgccatcggcaagcccaagaagtgccccaccccctgccagctgcagagcgagcaggccttcctgagaaccgtgcaggccctgctgagcaacagcagcatgctgcccaccctgagcgacacctacgagggccagttcagcctggaggagaagagcctgagcctgaagatcatgcagtacttcagccacttcatcagaagcggcaaccccaactacccctacgagttcagcagaaaggtgcccaccttcgccaccccctggcccgacttcgtgcccagagccggcggcgagaactacaaggagttcagcgagctgctgcccaacagacagggcctgaagaaggccgactgcagcttctggagcaagtacatcagcagcctgaagaccagcgccgacggcgccaagggcggccagagcgccgagagcgaggaggaggagctgaccgccggcagcggcctgagagaggacctgctgagcctgcaggagcccggcagcaagacctacagcaagtag

SEQ ID NO: 102462 - DNA, 3417 bp, Artificial Sequence
  Description of Artificial Sequence: Synthetic coding sequence
atgatgcagaagttcgagaaggtgcccgagagcaaggtgatcttcgacgccaacgcccccgtggccgtgagaagcaaggtgcccgacagcgagttccccgtgatgcagtgcctgaccgactgcaccgaggacgaggcctgcagcttcttcaccgtgagcaccaccgagcccgagatcagctgcgacttctacgcctggaccagcgacaacgtggcctgcatgaccagcgaccagaagagagacgccctgggcaacagcaaggccaccagcttcggcagcctgagatgccaggtgaaggtgagaagccacggccaggacagccccgccgtgtacctgaagaagggcgccatcatctgcggcctgctgagcagccccagcgtgctgctgtgcaacgtgaaggactggatggaccccagcgaggcctgggccaacgccacctgccccggcgtgacctacgaccaggagagccaccaggtgatcctgagactgggcgaccaggagttcatcaagagcctgacccccctggagggcacccaggacaccttcaccaacttccagcaggtgtacctgtggaaggacagcgacatgggcagcagacccgagagcatgggctgcagaaaggacaccgtgcccagacccgccagccccaccgaggccggcctgaccaccgagctgttcagccccgtggacctgaaccaggtgatcgtgaacggcaaccagagcctgagcagccagaagcactggctgttcaagcacctgttcagcgcccagcaggccaacctgtggtgcctgagcagatgcgtgcaggagcacagcttctgccagctggccgagatcaccgagagcgccagcctgtacttcacctgcaccctgtaccccgaggcccaggtgtgcgacgacatcatggagagcaacgcccagggctgcagactgatcctgccccagatgcccaaggccctgttcagaaagaaggtgatcctggaggacaaggtgaagaacttctacaccagactgcccttccagaagctgatgggcatcagcatcagaaacaaggtgcccatgagcgagaagagcatcagcaacggcttcttcgagtgcgagagaagatgcgacgccgacccctgctgcaccggcttcggcttcctgaacgtgagccagctgaagggcggcgaggtgacctgcctgaccctgaacagcctgggcatccagatgtgcagcgaggagaacggcggcgcctggagaatcctggactgcggcagccccgacatcgaggtgcacacctaccccttcggctggtaccagaagcccatcgcccagaacaacgcccccagcttctgccccctggtggtgctgcccagcctgaccgagaaggtgagcctggacagctggcagagcctggccctgagcagcgtggtggtggaccccagcatcagacacttcgacgtggcccacgtgagcaccgccgccaccagcaacttcagcgccgtgagagacctgtgcctgagcgagtgcagccagcacgaggcctgcctgatcaccaccctgcagacccagcccggcgccgtgagatgcatgttctacgccgacacccagagctgcacccacagcctgcagggccagaactgcagactgctgctgagagaggaggccacccacatctacagaaagcccggcatcagcctgctgagctacgaggccagcgtgcccagcgtgcccatcagcacccacggcagactgctgggcagaagccaggccatccaggtgggcaccagctggaagcaggtggaccagttcctgggcgtgccctacgccgccccccccctggccgagagaagattccaggcccccgagcccctgaactggaccggcagctgggacgccagcaagcccagagccagctgctggcagcccggcaccagaaccagcaccagccccggcgtgagcgaggactgcctgtacctgaacgtgttcatcccccagaacgtggcccccaacgccagcgtgctggtgttcttccacaacaccatggacagagaggagagcgagggctggcccgccatcgacggcagcttcctggccgccgtgggcaacctgatcgtggtgaccgccagctacagagtgggcgtgttcggcttcctgagcagcggcagcggcgaggtgagcggcaactggggcctgctggaccaggtggccgccctgacctgggtgcagacccacatcagaggcttcggcggcgaccccagaagagtgagcctggccgccgacagaggcggcgccgacgtggccagcatccacctgctgaccgccagagccaccaacagccagctgttcagaagagccgtgctgatgggcggcagcgccctgagccccgccgccgtgatcagccacgagagagcccagcagcaggccatcgccctggccaaggaggtgagctgccccatgagcagcagccaggaggtggtgagctgcctgagacagaagcccgccaacgtgctgaacgacgcccagaccaagctgctggccgtgagcggccccttccactactggggccccgtgatcgacggccacttcctgagagagccccccgccagagccctgaagagaagcctgtgggtggaggtggacctgctgatcggcagcagccaggacgacggcctgatcaacagagccaaggccgtgaagcagttcgaggagagcagaggcagaaccagcagcaagaccgccttctaccaggccctgcagaacagcctgggcggcgaggacagcgacgccagagtggaggccgccgccacctggtactacagcctggagcacagcaccgacgactacgccagcttcagcagagccctggagaacgccaccagagactacttcatcatctgccccatcatcgacatggccagcgcctgggccaagagagccagaggcaacgtgttcatgtaccacgcccccgagaactacggccacggcagcctggagctgctggccgacgtgcagttcgccctgggcctgcccttctaccccgcctacgagggccagttcagcctggaggagaagagcctgagcctgaagatcatgcagtacttcagccacttcatcagaagcggcaaccccaactacccctacgagttcagcagaaaggtgcccaccttcgccaccccctggcccgacttcgtgcccagagccggcggcgagaactacaaggagttcagcgagctgctgcccaacagacagggcctgaagaaggccgactgcagcttctggagcaagtacatcagcagcctgaagaccagcgccgacggcgccaagggcggccagagcgccgagagcgaggaggaggagctgaccgccggcagcggcctgagagaggacctgctgagcctgcaggagcccggcagcaagacctacagcaagtag

SEQ ID NO: 102463 - DNA, 4725 bp, Artificial Sequence
  Description of Artificial Sequence: Synthetic coding sequence
atccccagaaagcccatcagcaagagacccgtgagacccagcctgcccagaagccccagatgccccctgcccttcaacgccagcgaggtggtgggcggcaccatcctgtgcgagaccatcagcggccccaccggcagcgccatgcagcagtgccagctgctgtgcagacagggcagctggagcgtgttcccccccggccccctgatctgcagcctggagagcggcagatgggagagccagctgccccagcccagagcctgccagagaccccagctgtggcagaccatccagacccagggccacttccagctgcagctgccccccggcaagatgtgcagcgccgactacgccgacctgctgcagaccttccaggtgttcatcctggacgagctgaccgccagaggcttctgccagatccaggtgaagaccttcggcaccctggtgagcatccccgtgtgcaacaacagcagcgtgcaggtgggctgcctgaccagagagagactgggcgtgaacgtgacctggaagagcagactggaggacatccccgtggccagcctgcccgacctgcacgacatcgagagagccctggtgggcaaggacctgctgggcagattcaccgacctgatccagagcggcagcttccagctgcacctggacagcaagaccttccccgccgagaccatcagattcctgcagggcgaccacttcggcaccagccccagaacctggttcggctgcagcgagggcttctaccaggtgctgaccagcgaggccagccaggacggcctgggctgcgtgaagtgccccgagggcagctacagccaggacgaggagtgcatcccctgccccgtgggcttctaccaggagcaggccggcagcctggcctgcgtgccctgccccgtgggcagaaccaccatcagcgccggcgccttcagccagacccactgcgtgaccgactgccagagaaacgaggccggcctgcagtgcgaccagaacggccagtacagagccagccagaaggacagaggcagcggcaaggccttctgcgtggacggcgagggcagaagactgccctggtgggagaccgaggcccccctggaggacagccagtgcctgatgatgcagaagttcgagaaggtgcccgagagcaaggtgatcttcgacgccaacgcccccgtggccgtgagaagcaaggtgcccgacagcgagttccccgtgatgcagtgcctgaccgactgcaccgaggacgaggcctgcagcttcttcaccgtgagcaccaccgagcccgagatcagctgcgacttctacgcctggaccagcgacaacgtggcctgcatgaccagcgaccagaagagagacgccctgggcaacagcaaggccaccagcttcggcagcctgagatgccaggtgaaggtgagaagccacggccaggacagccccgccgtgtacctgaagaagggccagggcagcaccaccaccctgcagaagagattcgagcccaccggcttccagaacatgctgagcggcctgtacaaccccatcgtgttcagcgccagcggcgccaacctgaccgacgcccacctgttctgcctgctggcctgcgacagagacctgtgctgcgacggcttcgtgctgacccaggtgcagggcggcgccatcatctgcggcctgctgagcagccccagcgtgctgctgtgcaacgtgaaggactggatggaccccagcgaggcctgggccaacgccacctgccccggcgtgacctacgaccaggagagccaccaggtgatcctgagactgggcgaccaggagttcatcaagagcctgacccccctggagggcacccaggacaccttcaccaacttccagcaggtgtacctgtggaaggacagcgacatgggcagcagacccgagagcatgggctgcagaaaggacaccgtgcccagacccgccagccccaccgaggccggcctgaccaccgagctgttcagccccgtggacctgaaccaggtgatcgtgaacggcaaccagagcctgagcagccagaagcactggctgttcaagcacctgttcagcgcccagcaggccaacctgtggtgcctgagcagatgcgtgcaggagcacagcttctgccagctggccgagatcaccgagagcgccagcctgtacttcacctgcaccctgtaccccgaggcccaggtgtgcgacgacatcatggagagcaacgcccagggctgcagactgatcctgccccagatgcccaaggccctgttcagaaagaaggtgatcctggaggacaaggtgaagaacttctacaccagactgcccttccagaagctgatgggcatcagcatcagaaacaaggtgcccatgagcgagaagagcatcagcaacggcttcttcgagtgcgagagaagatgcgacgccgacccctgctgcaccggcttcggcttcctgaacgtgagccagctgaagggcggcgaggtgacctgcctgaccctgaacagcctgggcatccagatgtgcagcgaggagaacggcggcgcctggagaatcctggactgcggcagccccgacatcgaggtgcacacctaccccttcggctggtaccagaagcccatcgcccagaacaacgcccccagcttctgccccctggtggtgctgcccagcctgaccgagaaggtgagcctggacagctggcagagcctggccctgagcagcgtggtggtggaccccagcatcagacacttcgacgtggcccacgtgagcaccgccgccaccagcaacttcagcgccgtgagagacctgtgcctgagcgagtgcagccagcacgaggcctgcctgatcaccaccctgcagacccagcccggcgccgtgagatgcatgttctacgccgacacccagagctgcacccacagcctgcagggccagaactgcagactgctgctgagagaggaggccacccacatctacagaaagcccggcatcagcctgctgagctacgaggccagcgtgcccagcgtgcccatcagcacccacggcagactgctgggcagaagccaggccatccaggtgggcaccagctggaagcaggtggaccagttcctgggcgtgccctacgccgccccccccctggccgagagaagattccaggcccccgagcccctgaactggaccggcagctgggacgccagcaagcccagagccagctgctggcagcccggcaccagaaccagcaccagccccggcgtgagcgaggactgcctgtacctgaacgtgttcatcccccagaacgtggcccccaacgccagcgtgctggtgttcttccacaacaccatggacagagaggagagcgagggctggcccgccatcgacggcagcttcctggccgccgtgggcaacctgatcgtggtgaccgccagctacagagtgggcgtgttcggcttcctgagcagcggcagcggcgaggtgagcggcaactggggcctgctggaccaggtggccgccctgacctgggtgcagacccacatcagaggcttcggcggcgaccccagaagagtgagcctggccgccgacagaggcggcgccgacgtggccagcatccacctgctgaccgccagagccaccaacagccagctgttcagaagagccgtgctgatgggcggcagcgccctgagccccgccgccgtgatcagccacgagagagcccagcagcaggccatcgccctggccaaggaggtgagctgccccatgagcagcagccaggaggtggtgagctgcctgagacagaagcccgccaacgtgctgaacgacgcccagaccaagctgctggccgtgagcggccccttccactactggggccccgtgatcgacggccacttcctgagagagccccccgccagagccctgaagagaagcctgtgggtggaggtggacctgctgatcggcagcagccaggacgacggcctgatcaacagagccaaggccgtgaagcagttcgaggagagcagaggcagaaccagcagcaagaccgccttctaccaggccctgcagaacagcctgggcggcgaggacagcgacgccagagtggaggccgccgccacctggtactacagcctggagcacagcaccgacgactacgccagcttcagcagagccctggagaacgccaccagagactacttcatcatctgccccatcatcgacatggccagcgcctgggccaagagagccagaggcaacgtgttcatgtaccacgcccccgagaactacggccacggcagcctggagctgctggccgacgtgcagttcgccctgggcctgcccttctaccccgcctacgagggccagttcagcctggaggagaagagcctgagcctgaagatcatgcagtacttcagccacttcatcagaagcggcaaccccaactacccctacgagttcagcagaaaggtgcccaccttcgccaccccctggcccgacttcgtgcccagagccggcggcgagaactacaaggagttcagcgagctgctgcccaacagacagggcctgaagaaggccgactgcagcttctggagcaagtacatcagcagcctgaagaccagcgccgacggcgccaagggcggccagagcgccgagagcgaggaggaggagctgaccgccggcagcggcctgagagaggacctgctgagcctgcaggagcccggcagcaagacctacagcaagtag

SEQ ID NO: 102464 - DNA, 1356 bp, Artificial Sequence
  Description of Artificial Sequence: Synthetic coding sequence
atggagcagaagcccagcaaggtggagtgcggcagcgaccccgaggagaacagcgccagaagccccgacggcaagagaaagagaaagaacggccagtgcagcctgaagaccagcatgagcggctacatccccagctacctggacaaggacgagcagtgcgtggtgtgcggcgacaaggccaccggctaccactacagatgcatcacctgcgagggctgcaagggcttcttcagaagaaccatccagaagaacctgcaccccacctacagctgcaagtacgacagctgctgcgtgatcgacaagatcaccagaaaccagtgccagctgtgcagattcaagaagtgcatcgccgtgggcatggccatggacctggtgctggacgacagcaagagagtggccaagagaaagctgatcgagcagaacagagagagaagaagaaaggaggagatgatcagaagcctgcagcagagacccgagcccacccccgaggagtgggacctgatccacatcgccaccgaggcccacagaagcaccaacgcccagggcagccactggaagcagagaagaaagttcctgcccgacgacatcggccagagccccatcgtgagcatgcccgacggcgacaaggtggacctggaggccttcagcgagttcaccaagatcatcacccccgccatcaccagagtggtggacttcgccaagaagctgcccatgttcagcgagctgccctgcgaggaccagatcatcctgctgaagggctgctgcatggagatcatgagcctgagagccgccgtgagatacgaccccgagagcgacaccctgaccctgagcggcgagatggccgtgaagagagagcagctgaagaacggcggcctgggcgtggtgagcgacgccatcttcgagctgggcaagagcctgagcgccttcaacctggacgacaccgaggtggccctgctgcaggccgtgctgctgatgagcaccgacagaagcggcctgctgtgcgtggacaagatcgagaagagccaggaggcctacctgctggccttcgagcactacgtgaaccacagaaagcacaacatcccccacttctggcccaagctgctgatgaagggcccccaggtgagacagctggagcagcagctgggcgaggccggcagcctgcagggccccgtgctgcagcaccagagccccaagagcccccagcagagactgctggagctgctgcacagaagcggcatcctgcacgccagagccgtgtgcggcgaggacgacagcagcgaggccgacagccccagcagcagcgaggaggagcccgaggtgtgcgaggacctggccggcaacgccgccagcccctag

SEQ ID NO: 102465 - DNA, 5940 bp, Artificial Sequence
  Description of Artificial Sequence: Synthetic coding sequence
atgagcagctggctgggcggcctgggcagcggcctgggccagagcctgggccaggtgggcggcagcctggccagcctgaccggccagatcagcaacttcaccaaggacatgctgatggagggcaccgaggaggtggaggccgagctgcccgacagcagaaccaaggagatcgaggccatccacgccatcctgagaagcgagaacgagagactgaagaagctgtgcaccgacctggaggagaagcacgaggccagcgagatccagatcaagcagcagagcaccagctacagaaaccagctgcagcagaaggaggtggagatcagccacctgaaggccagacagatcgccctgcaggaccagctgctgaagctgcagagcgccgcccagagcgtgcccagcggcgccggcgtgcccgccaccaccgccagcagcagcttcgcctacggcatcagccaccaccccagcgccttccacgacgacgacatggacttcggcgacatcatcagcagccagcaggagatcaacagactgagcaacgaggtgagcagactggagagcgaggtgggccactggagacacatcgcccagaccagcaaggcccagggcaccgacaacagcgaccagagcgagatctgcaagctgcagaacatcatcaaggagctgaagcagaacagaagccaggagatcgacgaccaccagcacgagatgagcgtgctgcagaacgcccaccagcagaagctgaccgagatcagcagaagacacagagaggagctgagcgactacgaggagagaatcgaggagctggagaacctgctgcagcagggcggcagcggcgtgatcgagaccgacctgagcaagatctacgagatgcagaagaccatccaggtgctgcagatcgagaaggtggagagcaccaagaagatggagcagctggaggacaagatcaaggacatcaacaagaagctgagcagcgccgagaacgacagagacatcctgagaagagagcaggagcagctgaacgtggagaagagacagatcatggaggagtgcgagaacctgaagctggagtgcagcaagctgcagcccagcgccgtgaagcagagcgacaccatgaccgagaaggagagaatcctggcccagagcgccagcgtggaggaggtgttcagactgcagcaggccctgagcgacgccgagaacgagatcatgagactgagcagcctgaaccaggacaacagcctggccgaggacaacctgaagctgaagatgagaatcgaggtgctggagaaggagaagagcctgctgagccaggagaaggaggagctgcagatgagcctgctgaagctgaacaacgagtacgaggtgatcaagagcaccgccaccagagacatcagcctggacagcgagctgcacgacctgagactgaacctggaggccaaggagcaggagctgaaccagagcatcagcgagaaggagaccctgatcgccgagatcgaggagctggacagacagaaccaggaggccaccaagcacatgatcctgatcaaggaccagctgagcaagcagcagaacgagggcgacagcatcatcagcaagctgaagcaggacctgaacgacgagaagaagagagtgcaccagctggaggacgacaagatggacatcaccaaggagctggacgtgcagaaggagaagctgatccagagcgaggtggccctgaacgacctgcacctgaccaagcagaagctggaggacaaggtggagaacctggtggaccagctgaacaagagccaggagagcaacgtgagcatccagaaggagaacctggagctgaaggagcacatcagacagaacgaggaggagctgagcagaatcagaaacgagctgatgcagagcctgaaccaggacagcaacagcaacttcaaggacaccctgctgaaggagagagaggccgaggtgagaaacctgaagcagaacctgagcgagctggagcagctgaacgagaacctgaagaaggtggccttcgacgtgaagatggagaacgagaagctggtgctggcctgcgaggacgtgagacaccagctggaggagtgcctggccggcaacaaccagctgagcctggagaagaacaccatcgtggagaccctgaagatggagaagggcgagatcgaggccgagctgtgctgggccaagaagagactgctggaggaggccaacaagtacgagaagaccatcgaggagctgagcaacgccagaaacctgaacaccagcgccctgcagctggagcacgagcacctgatcaagctgaaccagaagaaggacatggagatcgccgagctgaagaagaacatcgagcagatggacaccgaccacaaggagaccaaggacgtgctgagcagcagcctggaggagcagaagcagctgacccagctgatcaacaagaaggagatcttcatcgagaagctgaaggagagaagcagcaagctgcaggaggagctggacaagtacagccaggccctgagaaagaacgagatcctgagacagaccatcgaggagaaggacagaagcctgggcagcatgaaggaggagaacaaccacctgcaggaggagctggagagactgagagaggagcagagcagaaccgcccccgtggccgaccccaagaccctggacagcgtgaccgagctggccagcgaggtgagccagctgaacaccatcaaggagcacctggaggaggagatcaagcaccaccagaagatcatcgaggaccagaaccagagcaagatgcagctgctgcagagcctgcaggagcagaagaaggagatggacgagttcagataccagcacgagcagatgaacgccacccacacccagctgttcctggagaaggacgaggagatcaagagcctgcagaagaccatcgagcagatcaagacccagctgcacgaggagagacaggacatccagaccgacaacagcgacatcttccaggagaccaaggtgcagagcctgaacatcgagaacggcagcgagaagcacgacctgagcaaggccgagaccgagagactggtgaagggcatcaaggagagagagctggagatcaagctgctgaacgagaagaacatcagcctgaccaagcagatcgaccagctgagcaaggacgaggtgggcaagctgacccagatcatccagcagaaggacctggagatccaggccctgcacgccagaatcagcagcaccagccacacccaggacgtggtgtacctgcagcagcagctgcaggcctacgccatggagagagagaaggtgttcgccgtgctgaacgagaagaccagagagaacagccacctgaagaccgagtaccacaagatgatggacatcgtggccgccaaggaggccgccctgatcaagctgcaggacgagaacaagaagctgagcaccagattcgagagcagcggccaggacatgttcagagagaccatccagaacctgagcagaatcatcagagagaaggacatcgagatcgacgccctgagccagaagtgccagaccctgctggccgtgctgcagaccagcagcaccggcaacgaggccggcggcgtgaacagcaaccagttcgaggagctgctgcaggagagagacaagctgaagcagcaggtgaagaagatggaggagtggaagcagcaggtgatgaccaccgtgcagaacatgcagcacgagagcgcccagctgcaggaggagctgcaccagctgcaggcccaggtgctggtggacagcgacaacaacagcaagctgcaggtggactacaccggcctgatccagagctacgagcagaacgagaccaagctgaagaacttcggccaggagctggcccaggtgcagcacagcatcggccagctgtgcaacaccaaggacctgctgctgggcaagctggacatcatcagcccccagctgagcagcgccagcctgctgaccccccagagcgccgagtgcctgagagccagcaagagcgaggtgctgagcgagagcagcgagctgctgcagcaggagctggaggagctgagaaagagcctgcaggagaaggacgccaccatcagaaccctgcaggagaacaaccacagactgagcgacagcatcgccgccaccagcgagctggagagaaaggagcacgagcagaccgacagcgagatcaagcagctgaaggagaagcaggacgtgctgcagaagctgctgaaggagaaggacctgctgatcaaggccaagagcgaccagctgctgagcagcaacgagaacttcaccaacaaggtgaacgagaacgagctgctgagacaggccgtgaccaacctgaaggagagaatcctgatcctggagatggacatcggcaagctgaagggcgagaacgagaagatcgtggagacctacagaggcaaggagaccgagtaccaggccctgcaggagaccaacatgaagttcagcatgatgctgagagagaaggagttcgagtgccacagcatgaaggagaaggccctggccttcgagcagctgctgaaggagaaggagcagggcaagaccggcgagctgaaccagctgctgaacgccgtgaagagcatgcaggagaagaccgtggtgttccagcaggagagagaccaggtgatgctggccctgaagcagaagcagatggagaacaccgccctgcagaacgaggtgcagagactgagagacaaggagttcagaagcaaccaggagctggagagactgagaaaccacctgctggagagcgaggacagctacaccagagaggccctggccgccgaggacagagaggccaagctgagaaagaaggtgaccgtgctggaggagaagctggtgagcagcagcaacgccatggagaacgccagccaccaggccagcgtgcaggtggagagcctgcaggagcagctgaacgtggtgagcaagcagagagacgagaccgccctgcagctgagcgtgagccaggagcaggtgaagcagtacgccctgagcctggccaacctgcagatggtgctggagcacttccagcaggaggagaaggccatgtacagcgccgagctggagaagcagaagcagctgatcgccgagtggaagaagaacgccgagaacctggagggcaaggtgatcagcctgcaggagtgcctggacgaggccaacgccgccctggacagcgccagcagactgaccgagcagctggacgtgaaggaggagcagatcgaggagctgaagagacagaacgagctgagacaggagatgctggacgacgtgcagaagaagctgatgagcctggccaacagcagcgagggcaaggtggacaaggtgctgatgagaaacctgttcatcggccacttccacacccccaagaaccagagacacgaggtgctgagactgatgggcagcatcctgggcgtgagaagagaggagatggagcagctgttccacgacgaccagggcggcgtgaccagatggatgaccggctggctgggcggcggcagcaagagcgtgcccaacacccccctgagacccaaccagcagagcgtggtgaacagcagcttcagcgagctgttcgtgaagttcctggagaccgagagccaccccagcatccccccccccaagctgagcgtgcacgacatgaagcccctggacagccccggcagaagaaagagagacaccaacgcccccgagagcttcaaggacaccgccgagagcagaagcggcagaagaaccgacgtgaaccccttcctggcccccagaagcgccgccgtgcccctgatcaaccccgccggcctgggccccggcggccccggccacctgctgctgaagcccatcagcgacgtgctgcccaccttcacccccctgcccgccctgcccgacaacagcgccggcgtggtgctgaaggacctgctgaagcagtag

SEQ ID NO: 102466 - DNA, 5148 bp, Artificial Sequence
  Description of Artificial Sequence: Synthetic coding sequence
atgagcgtgctgcagaacgcccaccagcagaagctgaccgagatcagcagaagacacagagaggagctgagcgactacgaggagagaatcgaggagctggagaacctgctgcagcagggcggcagcggcgtgatcgagaccgacctgagcaagatctacgagatgcagaagaccatccaggtgctgcagatcgagaaggtggagagcaccaagaagatggagcagctggaggacaagatcaaggacatcaacaagaagctgagcagcgccgagaacgacagagacatcctgagaagagagcaggagcagctgaacgtggagaagagacagatcatggaggagtgcgagaacctgaagctggagtgcagcaagctgcagcccagcgccgtgaagcagagcgacaccatgaccgagaaggagagaatcctggcccagagcgccagcgtggaggaggtgttcagactgcagcaggccctgagcgacgccgagaacgagatcatgagactgagcagcctgaaccaggaggagctgcagatgagcctgctgaagctgaacaacgagtacgaggtgatcaagagcaccgccaccagagacatcagcctggacagcgagctgcacgacctgagactgaacctggaggccaaggagcaggagctgaaccagagcatcagcgagaaggagaccctgatcgccgagatcgaggagctggacagacagaaccaggaggccaccaagcacatgatcctgatcaaggaccagctgagcaagcagcagaacgagggcgacagcatcatcagcaagctgaagcaggacctgaacgacgagaagaagagagtgcaccagctggaggacgacaagatggacatcaccaaggagctggacgtgcagaaggagaagctgatccagagcgaggtggccctgaacgacctgcacctgaccaagcagaagctggaggacaaggtggagaacctggtggaccagctgaacaagagccaggagagcaacgtgagcatccagaaggagaacctggagctgaaggagcacatcagacagaacgaggaggagctgagcagaatcagaaacgagctgatgcagagcctgaaccaggacagcaacagcaacttcaaggacaccctgctgaaggagagagaggccgaggtgagaaacctgaagcagaacctgagcgagctggagcagctgaacgagaacctgaagaaggtggccttcgacgtgaagatggagaacgagaagctggtgctggcctgcgaggacgtgagacaccagctggaggagtgcctggccggcaacaaccagctgagcctggagaagaacaccatcgtggagaccctgaagatggagaagggcgagatcgaggccgagctgtgctgggccaagaagagactgctggaggaggccaacaagtacgagaagaccatcgaggagctgagcaacgccagaaacctgaacaccagcgccctgcagctggagcacgagcacctgatcaagctgaaccagaagaaggacatggagatcgccgagctgaagaagaacatcgagcagatggacaccgaccacaaggagaccaaggacgtgctgagcagcagcctggaggagcagaagcagctgacccagctgatcaacaagaaggagatcttcatcgagaagctgaaggagagaagcagcaagctgcaggaggagctggacaagtacagccaggccctgagaaagaacgagatcctgagacagaccatcgaggagaaggacagaagcctgggcagcatgaaggaggagaacaaccacctgcaggaggagctggagagactgagagaggagcagagcagaaccgcccccgtggccgaccccaagaccctggacagcgtgaccgagctggccagcgaggtgagccagctgaacaccatcaaggagcacctggaggaggagatcaagcaccaccagaagatcatcgaggaccagaaccagagcaagatgcagctgctgcagagcctgcaggagcagaagaaggagatggacgagttcagataccagcacgagcagatgaacgccacccacacccagctgttcctggagaaggacgaggagatcaagagcctgcagaagaccatcgagcagatcaagacccagctgcacgaggagagacaggacatccagaccgacaacagcgacatcttccaggagaccaaggtgcagagcctgaacatcgagaacggcagcgagaagcacgacctgagcaaggccgagaccgagagactggtgaagggcatcaaggagagagagctggagatcaagctgctgaacgagaagaacatcagcctgaccaagcagatcgaccagctgagcaaggacgaggtgggcaagctgacccagatcatccagcagaaggacctggagatccaggccctgcacgccagaatcagcagcaccagccacacccaggacgtggtgtacctgcagcagcagctgcaggcctacgccatggagagagagaaggtgttcgccgtgctgaacgagaagaccagagagaacagccacctgaagaccgagtaccacaagatgatggacatcgtggccgccaaggaggccgccctgatcaagctgcaggacgagaacaagaagctgagcaccagattcgagagcagcggccaggacatgttcagagagaccatccagaacctgagcagaatcatcagagagaaggacatcgagatcgacgccctgagccagaagtgccagaccctgctggccgtgctgcagaccagcagcaccggcaacgaggccggcggcgtgaacagcaaccagttcgaggagctgctgcaggagagagacaagctgaagcagcaggtgaagaagatggaggagtggaagcagcaggtgatgaccaccgtgcagaacatgcagcacgagagcgcccagctgcaggaggagctgcaccagctgcaggcccaggtgctggtggacagcgacaacaacagcaagctgcaggtggactacaccggcctgatccagagctacgagcagaacgagaccaagctgaagaacttcggccaggagctggcccaggtgcagcacagcatcggccagctgtgcaacaccaaggacctgctgctgggcaagctggacatcatcagcccccagctgagcagcgccagcctgctgaccccccagagcgccgagtgcctgagagccagcaagagcgaggtgctgagcgagagcagcgagctgctgcagcaggagctggaggagctgagaaagagcctgcaggagaaggacgccaccatcagaaccctgcaggagaacaaccacagactgagcgacagcatcgccgccaccagcgagctggagagaaaggagcacgagcagaccgacagcgagatcaagcagctgaaggagaagcaggacgtgctgcagaagctgctgaaggagaaggacctgctgatcaaggccaagagcgaccagctgctgagcagcaacgagaacttcaccaacaaggtgaacgagaacgagctgctgagacaggccgtgaccaacctgaaggagagaatcctgatcctggagatggacatcggcaagctgaagggcgagaacgagaagatcgtggagacctacagaggcaaggagaccgagtaccaggccctgcaggagaccaacatgaagttcagcatgatgctgagagagaaggagttcgagtgccacagcatgaaggagaaggccctggccttcgagcagctgctgaaggagaaggagcagggcaagaccggcgagctgaaccagctgctgaacgccgtgaagagcatgcaggagaagaccgtggtgttccagcaggagagagaccaggtgatgctggccctgaagcagaagcagatggagaacaccgccctgcagaacgaggtgcagagactgagagacaaggagttcagaagcaaccaggagctggagagactgagaaaccacctgctggagagcgaggacagctacaccagagaggccctggccgccgaggacagagaggccaagctgagaaagaaggtgaccgtgctggaggagaagctggtgagcagcagcaacgccatggagaacgccagccaccaggccagcgtgcaggtggagagcctgcaggagcagctgaacgtggtgagcaagcagagagacgagaccgccctgcagctgagcgtgagccaggagcaggtgaagcagtacgccctgagcctggccaacctgcagatggtgctggagcacttccagcaggaggagaaggccatgtacagcgccgagctggagaagcagaagcagctgatcgccgagtggaagaagaacgccgagaacctggagggcaaggtgatcagcctgcaggagtgcctggacgaggccaacgccgccctggacagcgccagcagactgaccgagcagctggacgtgaaggaggagcagatcgaggagctgaagagacagaacgagctgagacaggagatgctggacgacgtgcagaagaagctgatgagcctggccaacagcagcgagggcaaggtggacaaggtgctgatgagaaacctgttcatcggccacttccacacccccaagaaccagagacacgaggtgctgagactgatgggcagcatcctgggcgtgagaagagaggagatggagcagctgttccacgacgaccagggcggcgtgaccagatggatgaccggctggctgggcggcggcagcaagagcgtgcccaacacccccctgagacccaaccagcagagcgtggtgaacagcagcttcagcgagctgttcgtgaagttcctggagaccgagagccaccccagcatccccccccccaagctgagcgtgcacgacatgaagcccctggacagccccggcagaagaaagagagacaccaacgcccccgagagcttcaaggacaccgccgagagcagaagcggcagaagaaccgacgtgaaccccttcctggcccccagaagcgccgccgtgcccctgatcaaccccgccggcctgggccccggcggccccggccacctgctgctgaagcccatcagcgacgtgctgcccaccttcacccccctgcccgccctgcccgacaacagcgccggcgtggtgctgaaggacctgctgaagcagtag

SEQ ID NO: 102467 - DNA, 5979 bp, Artificial Sequence
  Description of Artificial Sequence: Synthetic coding sequence
atgagcaacagacccaacaacaaccccggcggcagcctgagaagaagccagagaaacaccgccggcgcccagccccaggacgacagcatcggcggcagaagctgcagcagcagcagcgccgtgatcgtgccccagcccgaggaccccgacagagccaacaccagcgagagacagaagaccggccaggtgcccaagaaggacaacagcagaggcgtgaagagaagcgccagccccgactacaacagaaccaacagccccagcagcgccaagaagcccaaggccctgcagcacaccgagagccccagcgagaccaacaagccccacagcaagagcaagaagagacacctggaccaggagcagcagctgaagagcgcccagagccccagcaccagcaaggcccacaccagaaagagcggcgccaccggcggcagcagaagccagaagagaaagagaaccgagagcagctgcgtgaagagcggcagcggcagcgagagcaccggcgccgaggagagaagcgccaagcccaccaagctggccagcaagagcgccaccagcgccaaggccggctgcagcaccatcaccgacagcagcagcgccgccagcaccagcagcagcagcagcgccgtggccagcgccagcagcaccgtgccccccggcgccagagtgaagcagggcaaggaccagaacaaggccagaagaagcagaagcgccagcagccccagccccagaagaagcagcagagagaaggagcagagcaagaccggcggcagcagcaagttcgactgggccgccagattcagccccaaggtgagcctgcccaagaccaagctgagcctgcccggcagcagcaagagcgagaccagcaagcccggccccagcggcctgcaggccaagctggccagcctgagaaagagcaccaagaagagaagcgagagcccccccgccgagctgcccagcctgagaagaagcaccagacagaagaccaccggcagctgcgccagcaccagcagaagaggcagcggcctgggcaagagaggcgccgccgaggccagaagacaggagaagatggccgaccccgagagcaaccaggaggccgtgaacagcagcgccgccagaaccgacgaggccccccagggcgccgccggcgccgtgggcatgaccaccagcggcgagagcgagagcgacgacagcgagatgggcagactgcaggccctgctggaggccagaggcctgcccccccacctgttcggccccctgggccccagaatgagccagctgttccacagaaccatcggcagcggcgccagcagcaaggcccagcagctgctgcagggcctgcaggccagcgacgagagccagcagctgcaggccgtgatcgagatgtgccagctgctggtgatgggcaacgaggagaccctgggcggcttccccgtgaagagcgtggtgcccgccctgatcaccctgctgcagatggagcacaacttcgacatcatgaaccacgcctgcagagccctgacctacatgatggaggccctgcccagaagcagcgccgtggtggtggacgccatccccgtgttcctggagaagctgcaggtgatccagtgcatcgacgtggccgagcaggccctgaccgccctggagatgctgagcagaagacacagcaaggccatcctgcaggccggcggcctggccgactgcctgctgtacctggagttcttcagcatcaacgcccagagaaacgccctggccatcgccgccaactgctgccagagcatcacccccgacgagttccacttcgtggccgacagcctgcccctgctgacccagagactgacccaccaggacaagaagagcgtggagagcacctgcctgtgcttcgccagactggtggacaacttccagcacgaggagaacctgctgcagcaggtggccagcaaggacctgctgaccaacgtgcagcagctgctggtggtgaccccccccatcctgagcagcggcatgttcatcatggtggtgagaatgttcagcctgatgtgcagcaactgccccaccctggccgtgcagctgatgaagcagaacatcgccgagaccctgcacttcctgctgtgcggcgccagcaacggcagctgccaggagcagatcgacctggtgcccagaagcccccaggagctgtacgagctgaccagcctgatctgcgagctgatgccctgcctgcccaaggagggcatcttcgccgtggacaccatgctgaagaagggcaacgcccagaacaccgacggcgccatctggcagtggagagacgacagaggcctgtggcacccctacaacagaatcgacagcagaatcatcgagcagatcaacgaggacaccggcaccgccagagccatccagagaaagcccaaccccctggccaacagcaacaccagcggctacagcgagagcaagaaggacgacgccagagcccagctgatgaaggaggaccccgagctggccaagagcttcatcaagaccctgttcggcgtgctgtacgaggtgtacagcagcagcgccggccccgccgtgagacacaagtgcctgagagccatcctgagaatcatctacttcgccgacgccgagctgctgaaggacgtgctgaagaaccacgccgtgagcagccacatcgccagcatgctgagcagccaggacctgaagatcgtggtgggcgccctgcagatggccgagatcctgatgcagaagctgcccgacatcttcagcgtgtacttcagaagagagggcgtgatgcaccaggtgaagcacctggccgagagcgagagcctgctgaccagcccccccaaggcctgcaccaacggcagcggcagcatgggcagcaccaccagcgtgagcagcggcaccgccaccgccgccacccacgccgccgccgacctgggcagccccagcctgcagcacagcagagacgacagcctggacctgagcccccagggcagactgagcgacgtgctgaagagaaagagactgcccaagagaggccccagaagacccaagtacagcccccccagagacgacgacaaggtggacaaccaggccaagagccccaccaccacccagagccccaagagcagcttcctggccagcctgaaccccaagacctggggcagactgagcacccagagcaacagcaacaacatcgagcccgccagaaccgccggcggcagcggcctggccagagccgccagcaaggacaccatcagcaacaacagagagaagatcaagggctggatcaaggagcaggcccacaagttcgtggagagatacttcagcagcgagaacatggacggcagcaaccccgccctgaacgtgctgcagagactgtgcgccgccaccgagcagctgaacctgcaggtggacggcggcgccgagtgcctggtggagatcagaagcatcgtgagcgagagcgacgtgagcagcttcgagatccagcacagcggcttcgtgaagcagctgctgctgtacctgaccagcaagagcgagaaggacgccgtgagcagagagatcagactgaagagattcctgcacgtgttcttcagcagccccctgcccggcgaggagcccatcggcagagtggagcccgtgggcaacgcccccctgctggccctggtgcacaagatgaacaactgcctgagccagatggagcagttccccgtgaaggtgcacgacttccccagcggcaacggcaccggcggcagcttcagcctgaacagaggcagccaggccctgaagttcttcaacacccaccagctgaagtgccagctgcagagacaccccgactgcgccaacgtgaagcagtggaagggcggccccgtgaagatcgaccccctggccctggtgcaggccatcgagagatacctggtggtgagaggctacggcagagtgagagaggacgacgaggacagcgacgacgacggcagcgacgaggagatcgacgagagcctggccgcccagttcctgaacagcggcaacgtgagacacagactgcagttctacatcggcgagcacctgctgccctacaacatgaccgtgtaccaggccgtgagacagttcagcatccaggccgaggacgagagagagagcaccgacgacgagagcaaccccctgggcagagccggcatctggaccaagacccacaccatctggtacaagcccgtgagagaggacgaggagagcaacaaggactgcgtgggcggcaagagaggcagagcccagaccgcccccaccaagaccagccccagaaacgccaagaagcacgacgagctgtggcacgacggcgtgtgccccagcgtgagcaaccccctggaggtgtacctgatccccaccccccccgagaacatcaccttcgaggaccccagcctggacgtgatcctgctgctgagagtgctgcacgccatcagcagatactggtactacctgtacgacaacgccatgtgcaaggagatcatccccaccagcgagttcatcaacagcaagctgaccgccaaggccaacagacagctgcaggaccccctggtgatcatgaccggcaacatccccacctggctgaccgagctgggcaagacctgccccttcttcttccccttcgacaccagacagatgctgttctacgtgaccgccttcgacagagacagagccatgcagagactgctggacaccaaccccgagatcaaccagagcgacagccaggacagcagagtggcccccagactggacagaaagaagagaaccgtgaacagagaggagctgctgaagcaggccgagagcgtgatgcaggacctgggcagcagcagagccatgctggagatccagtacgagaacgaggtgggcaccggcctgggccccaccctggagttctacgccctggtgagccaggagctgcagagagccgacctgggcctgtggagaggcgaggaggtgaccctgagcaaccccaagggcagccaggagggcaccaagtacatccagaacctgcagggcctgttcgccctgcccttcggcagaaccgccaagcccgcccacatcgccaaggtgaagatgaagttcagattcctgggcaagctgatggccaaggccatcatggacttcagactggtggacctgcccctgggcctgcccttctacaagtggatgctgagacaggagaccagcctgaccagccacgacctgttcgacatcgaccccgtggtggccagaagcgtgtaccacctggaggacatcgtgagacagaagaagagactggagcaggacaagagccagaccaaggagagcctgcagtacgccctggagaccctgaccatgaacggctgcagcgtggaggacctgggcctggacttcaccctgcccggcttccccaacatcgagctgaagaagggcggcaaggacatccccgtgaccatccacaacctggaggagtacctgagactggtgatcttctgggccctgaacgagggcgtgagcagacagttcgacagcttcagagacggcttcgagagcgtgttccccctgagccacctgcagtacttctaccccgaggagctggaccagctgctgtgcggcagcaaggccgacacctgggacgccaagaccctgatggagtgctgcagacccgaccacggctacacccacgacagcagagccgtgaagttcctgttcgagatcctgagcagcttcgacaacgagcagcagagactgttcctgcagttcgtgaccggcagccccagactgcccgtgggcggcttcagaagcctgaacccccccctgaccatcgtgagaaagaccttcgagagcaccgagaaccccgacgacttcctgcccagcgtgatgacctgcgtgaactacctgaagctgcccgactacagcagcatcgagatcatgagagagaagctgctgatcgccgccagagagggccagcagagcttccacctgagctag

SEQ ID NO: 102468 - DNA, 300 bp, Artificial Sequence
  Description of Artificial Sequence: Synthetic coding sequence
atgagcaacagacccaacaacaaccccggcggcagcctgagaagaagccagagaaacaccgccggcgcccagccccaggacgacagcatcggcggcagaagctgcagcagcagcagcgccgtgatcgtgccccagcccgaggaccccgacagagccaacaccagcgagagacagaagaccggccaggtgcccaagaaggacaacagcagaggcgtgaagagaagcgccagccccgactacaacagaaccaacagccccagcagcgccaagaagcccaaggccctgcagcacaccgagtag

SEQ ID NO: 102469 - DNA, 6123 bp, Artificial Sequence
  Description of Artificial Sequence: Synthetic coding sequence
atgagcaacagacccaacaacaaccccggcggcagcctgagaagaagccagagaaacaccgccggcgcccagccccaggacgacagcatcggcggcagaagccacctgggccaggccaagcacaagggctacagcccccccgagagcagaaagagcaacagcaaggcccccaaggtgcagagcaacaccaccagcgagctgagcagaggccacctgagcaagagaagctgcagcagcagcagcgccgtgatcgtgccccagcccgaggaccccgacagagccaacaccagcgagagacagaagaccggccaggtgcccaagaaggacaacagcagaggcgtgaagagaagcgccagccccgactacaacagaaccaacagccccagcagcgccaagaagcccaaggccctgcagcacaccgagagccccagcgagaccaacaagccccacagcaagagcaagaagagacacctggaccaggagcagcagctgaagagcgcccagagccccagcaccagcaaggcccacaccagaaagagcggcgccaccggcggcagcagaagccagaagagaaagagaaccgagagcagctgcgtgaagagcggcagcggcagcgagagcaccggcgccgaggagagaagcgccaagcccaccaagctggccagcaagagcgccaccagcgccaaggccggctgcagcaccatcaccgacagcagcagcgccgccagcaccagcagcagcagcagcgccgtggccagcgccagcagcaccgtgccccccggcgccagagtgaagcagggcaaggaccagaacaaggccagaagaagcagaagcgccagcagccccagccccagaagaagcagcagagagaaggagcagagcaagaccggcggcagcagcaagttcgactgggccgccagattcagccccaaggtgagcctgcccaagaccaagctgagcctgcccggcagcagcaagagcgagaccagcaagcccggccccagcggcctgcaggccaagctggccagcctgagaaagagcaccaagaagagaagcgagagcccccccgccgagctgcccagcctgagaagaagcaccagacagaagaccaccggcagctgcgccagcaccagcagaagaggcagcggcctgggcaagagaggcgccgccgaggccagaagacaggagaagatggccgaccccgagagcaaccaggaggccgtgaacagcagcgccgccagaaccgacgaggccccccagggcgccgccgccagcagcagcgtggccggcgccgtgggcatgaccaccagcggcgagagcgagagcgacgacagcgagatgggcagactgcaggccctgctggaggccagaggcctgcccccccacctgttcggccccctgggccccagaatgagccagctgttccacagaaccatcggcagcggcgccagcagcaaggcccagcagctgctgcagggcctgcaggccagcgacgagagccagcagctgcaggccgtgatcgagatgtgccagctgctggtgatgggcaacgaggagaccctgggcggcttccccgtgaagagcgtggtgcccgccctgatcaccctgctgcagatggagcacaacttcgacatcatgaaccacgcctgcagagccctgacctacatgatggaggccctgcccagaagcagcgccgtggtggtggacgccatccccgtgttcctggagaagctgcaggtgatccagtgcatcgacgtggccgagcaggccctgaccgccctggagatgctgagcagaagacacagcaaggccatcctgcaggccggcggcctggccgactgcctgctgtacctggagttcttcagcatcaacgcccagagaaacgccctggccatcgccgccaactgctgccagagcatcacccccgacgagttccacttcgtggccgacagcctgcccctgctgacccagagactgacccaccaggacaagaagagcgtggagagcacctgcctgtgcttcgccagactggtggacaacttccagcacgaggagaacctgctgcagcaggtggccagcaaggacctgctgaccaacgtgcagcagctgctggtggtgaccccccccatcctgagcagcggcatgttcatcatggtggtgagaatgttcagcctgatgtgcagcaactgccccaccctggccgtgcagctgatgaagcagaacatcgccgagaccctgcacttcctgctgtgcggcgccagcaacggcagctgccaggagcagatcgacctggtgcccagaagcccccaggagctgtacgagctgaccagcctgatctgcgagctgatgccctgcctgcccaaggagggcatcttcgccgtggacaccatgctgaagaagggcaacgcccagaacaccgacggcgccatctggcagtggagagacgacagaggcctgtggcacccctacaacagaatcgacagcagaatcatcgagcagatcaacgaggacaccggcaccgccagagccatccagagaaagcccaaccccctggccaacagcaacaccagcggctacagcgagagcaagaaggacgacgccagagcccagctgatgaaggaggaccccgagctggccaagagcttcatcaagaccctgttcggcgtgctgtacgaggtgtacagcagcagcgccggccccgccgtgagacacaagtgcctgagagccatcctgagaatcatctacttcgccgacgccgagctgctgaaggacgtgctgaagaaccacgccgtgagcagccacatcgccagcatgctgagcagccaggacctgaagatcgtggtgggcgccctgcagatggccgagatcctgatgcagaagctgcccgacatcttcagcgtgtacttcagaagagagggcgtgatgcaccaggtgaagcacctggccgagagcgagagcctgctgaccagcccccccaaggcctgcaccaacggcagcggcagcatgggcagcaccaccagcgtgagcagcggcaccgccaccgccgccacccacgccgccgccgacctgggcagccccagcctgcagcacagcagagacgacagcctggacctgagcccccagggcagactgagcgacgtgctgaagagaaagagactgcccaagagaggccccagaagacccaagtacagcccccccagagacgacgacaaggtggacaaccaggccaagagccccaccaccacccagagccccaagagcagcttcctggccagcctgaaccccaagacctggggcagactgagcacccagagcaacagcaacaacatcgagcccgccagaaccgccggcggcagcggcctggccagagccgccagcaaggacaccatcagcaacaacagagagaagatcaagggctggatcaaggagcaggcccacaagttcgtggagagatacttcagcagcgagaacatggacggcagcaaccccgccctgaacgtgctgcagagactgtgcgccgccaccgagcagctgaacctgcaggtggacggcggcgccgagtgcctggtggagatcagaagcatcgtgagcgagagcgacgtgagcagcttcgagatccagcacagcggcttcgtgaagcagctgctgctgtacctgaccagcaagagcgagaaggacgccgtgagcagagagatcagactgaagagattcctgcacgtgttcttcagcagccccctgcccggcgaggagcccatcggcagagtggagcccgtgggcaacgcccccctgctggccctggtgcacaagatgaacaactgcctgagccagatggagcagttccccgtgaaggtgcacgacttccccagcggcaacggcaccggcggcagcttcagcctgaacagaggcagccaggccctgaagttcttcaacacccaccagctgaagtgccagctgcagagacaccccgactgcgccaacgtgaagcagtggaagggcggccccgtgaagatcgaccccctggccctggtgcaggccatcgagagatacctggtggtgagaggctacggcagagtgagagaggacgacgaggacagcgacgacgacggcagcgacgaggagatcgacgagagcctggccgcccagttcctgaacagcggcaacgtgagacacagactgcagttctacatcggcgagcacctgctgccctacaacatgaccgtgtaccaggccgtgagacagttcagcatccaggccgaggacgagagagagagcaccgacgacgagagcaaccccctgggcagagccggcatctggaccaagacccacaccatctggtacaagcccgtgagagaggacgaggagagcaacaaggactgcgtgggcggcaagagaggcagagcccagaccgcccccaccaagaccagccccagaaacgccaagaagcacgacgagctgtggcacgacggcgtgtgccccagcgtgagcaaccccctggaggtgtacctgatccccaccccccccgagaacatcaccttcgaggaccccagcctggacgtgatcctgctgctgagagtgctgcacgccatcagcagatactggtactacctgtacgacaacgccatgtgcaaggagatcatccccaccagcgagttcatcaacagcaagctgaccgccaaggccaacagacagctgcaggaccccctggtgatcatgaccggcaacatccccacctggctgaccgagctgggcaagacctgccccttcttcttccccttcgacaccagacagatgctgttctacgtgaccgccttcgacagagacagagccatgcagagactgctggacaccaaccccgagatcaaccagagcgacagccaggacagcagagtggcccccagactggacagaaagaagagaaccgtgaacagagaggagctgctgaagcaggccgagagcgtgatgcaggacctgggcagcagcagagccatgctggagatccagtacgagaacgaggtgggcaccggcctgggccccaccctggagttctacgccctggtgagccaggagctgcagagagccgacctgggcctgtggagaggcgaggaggtgaccctgagcaaccccaagggcagccaggagggcaccaagtacatccagaacctgcagggcctgttcgccctgcccttcggcagaaccgccaagcccgcccacatcgccaaggtgaagatgaagttcagattcctgggcaagctgatggccaaggccatcatggacttcagactggtggacctgcccctgggcctgcccttctacaagtggatgctgagacaggagaccagcctgaccagccacgacctgttcgacatcgaccccgtggtggccagaagcgtgtaccacctggaggacatcgtgagacagaagaagagactggagcaggacaagagccagaccaaggagagcctgcagtacgccctggagaccctgaccatgaacggctgcagcgtggaggacctgggcctggacttcaccctgcccggcttccccaacatcgagctgaagaagggcggcaaggacatccccgtgaccatccacaacctggaggagtacctgagactggtgatcttctgggccctgaacgagggcgtgagcagacagttcgacagcttcagagacggcttcgagagcgtgttccccctgagccacctgcagtacttctaccccgaggagctggaccagctgctgtgcggcagcaaggccgacacctgggacgccaagaccctgatggagtgctgcagacccgaccacggctacacccacgacagcagagccgtgaagttcctgttcgagatcctgagcagcttcgacaacgagcagcagagactgttcctgcagttcgtgaccggcagccccagactgcccgtgggcggcttcagaagcctgaacccccccctgaccatcgtgagaaagaccttcgagagcaccgagaaccccgacgacttcctgcccagcgtgatgacctgcgtgaactacctgaagctgcccgactacagcagcatcgagatcatgagagagaagctgctgatcgccgccagagagggccagcagagcttccacctgagctag

SEQ ID NO: 102470 - DNA, 5169 bp, Artificial Sequence
  Description of Artificial Sequence: Synthetic coding sequence
atgagcaacagacccaacaacaaccccggcggcagcctgagaagaagccagagaaacaccgccggcgcccagccccaggacgacagcatcggcggcagcagaagaggcagcggcctgggcaagagaggcgccgccgaggccagaagacaggagaagatggccgaccccgagagcaaccaggaggccgtgaacagcagcgccgccagaaccgacgaggccccccagggcgccgccgccagcagcagcgtggccggcgccgtgggcatgaccaccagcggcgagagcgagagcgacgacagcgagatgggcagactgcaggccctgctggaggccagaggcctgcccccccacctgttcggccccctgggccccagaatgagccagctgttccacagaaccatcggcagcggcgccagcagcaaggcccagcagctgctgcagggcctgcaggccagcgacgagagccagcagctgcaggccgtgatcgagatgtgccagctgctggtgatgggcaacgaggagaccctgggcggcttccccgtgaagagcgtggtgcccgccctgatcaccctgctgcagatggagcacaacttcgacatcatgaaccacgcctgcagagccctgacctacatgatggaggccctgcccagaagcagcgccgtggtggtggacgccatccccgtgttcctggagaagctgcaggtgatccagtgcatcgacgtggccgagcaggccctgaccgccctggagatgctgagcagaagacacagcaaggccatcctgcaggccggcggcctggccgactgcctgctgtacctggagttcttcagcatcaacgcccagagaaacgccctggccatcgccgccaactgctgccagagcatcacccccgacgagttccacttcgtggccgacagcctgcccctgctgacccagagactgacccaccaggacaagaagagcgtggagagcacctgcctgtgcttcgccagactggtggacaacttccagcacgaggagaacctgctgcagcaggtggccagcaaggacctgctgaccaacgtgcagcagctgctggtggtgaccccccccatcctgagcagcggcatgttcatcatggtggtgagaatgttcagcctgatgtgcagcaactgccccaccctggccgtgcagctgatgaagcagaacatcgccgagaccctgcacttcctgctgtgcggcgccagcaacggcagctgccaggagcagatcgacctggtgcccagaagcccccaggagctgtacgagctgaccagcctgatctgcgagctgatgccctgcctgcccaaggagggcatcttcgccgtggacaccatgctgaagaagggcaacgcccagaacaccgacggcgccatctggcagtggagagacgacagaggcctgtggcacccctacaacagaatcgacagcagaatcatcgaggccgcccaccaggtgggcgaggacgagatcagcctgagcaccctgggcagagtgtacaccatcgacttcaacagcatgcagcagatcaacgaggacaccggcaccgccagagccatccagagaaagcccaaccccctggccaacagcaacaccagcggctacagcgagagcaagaaggacgacgccagagcccagctgatgaaggaggaccccgagctggccaagagcttcatcaagaccctgttcggcgtgctgtacgaggtgtacagcagcagcgccggccccgccgtgagacacaagtgcctgagagccatcctgagaatcatctacttcgccgacgccgagctgctgaaggacgtgctgaagaaccacgccgtgagcagccacatcgccagcatgctgagcagccaggacctgaagatcgtggtgggcgccctgcagatggccgagatcctgatgcagaagctgcccgacatcttcagcgtgtacttcagaagagagggcgtgatgcaccaggtgaagcacctggccgagagcgagagcctgctgaccagcccccccaaggcctgcaccaacggcagcggcagcatgggcagcaccaccagcgtgagcagcggcaccgccaccgccgccacccacgccgccgccgacctgggcagccccagcctgcagcacagcagagacgacagcctggacctgagcccccagggcagactgagcgacgtgctgaagagaaagagactgcccaagagaggccccagaagacccaagtacagcccccccagagacgacgacaaggtggacaaccaggccaagagccccaccaccacccagagccccaagagcagcttcctggccagcctgaaccccaagacctggggcagactgagcacccagagcaacagcaacaacatcgagcccgccagaaccgccggcggcagcggcctggccagagccgccagcaaggacaccatcagcaacaacagagagaagatcaagggctggatcaaggagcaggcccacaagttcgtggagagatacttcagcagcgagaacatggacggcagcaaccccgccctgaacgtgctgcagagactgtgcgccgccaccgagcagctgaacctgcaggtggacggcggcgccgagtgcctggtggagatcagaagcatcgtgagcgagagcgacgtgagcagcttcgagatccagcacagcggcttcgtgaagcagctgctgctgtacctgaccagcaagagcgagaaggacgccgtgagcagagagatcagactgaagagattcctgcacgtgttcttcagcagccccctgcccggcgaggagcccatcggcagagtggagcccgtgggcaacgcccccctgctggccctggtgcacaagatgaacaactgcctgagccagatggagcagttccccgtgaaggtgcacgacttccccagcggcaacggcaccggcggcagcttcagcctgaacagaggcagccaggccctgaagttcttcaacacccaccagctgaagtgccagctgcagagacaccccgactgcgccaacgtgaagcagtggaagggcggccccgtgaagatcgaccccctggccctggtgcaggccatcgagagatacctggtggtgagaggctacggcagagtgagagaggacgacgaggacagcgacgacgacggcagcgacgaggagatcgacgagagcctggccgcccagttcctgaacagcggcaacgtgagacacagactgcagttctacatcggcgagcacctgctgccctacaacatgaccgtgtaccaggccgtgagacagttcagcatccaggccgaggacgagagagagagcaccgacgacgagagcaaccccctgggcagagccggcatctggaccaagacccacaccatctggtacaagcccgtgagagaggacgaggagagcaacaaggactgcgtgggcggcaagagaggcagagcccagaccgcccccaccaagaccagccccagaaacgccaagaagcacgacgagctgtggcacgacggcgtgtgccccagcgtgagcaaccccctggaggtgtacctgatccccaccccccccgagaacatcaccttcgaggaccccagcctggacgtgatcctgctgctgagagtgctgcacgccatcagcagatactggtactacctgtacgacaacgccatgtgcaaggagatcatccccaccagcgagttcatcaacagcaagctgaccgccaaggccaacagacagctgcaggaccccctggtgatcatgaccggcaacatccccacctggctgaccgagctgggcaagacctgccccttcttcttccccttcgacaccagacagatgctgttctacgtgaccgccttcgacagagacagagccatgcagagactgctggacaccaaccccgagatcaaccagagcgacagccaggacagcagagtggcccccagactggacagaaagaagagaaccgtgaacagagaggagctgctgaagcaggccgagagcgtgatgcaggacctgggcagcagcagagccatgctggagatccagtacgagaacgaggtgggcaccggcctgggccccaccctggagttctacgccctggtgagccaggagctgcagagagccgacctgggcctgtggagaggcgaggaggtgaccctgagcaaccccaagggcagccaggagggcaccaagtacatccagaacctgcagggcctgttcgccctgcccttcggcagaaccgccaagcccgcccacatcgccaaggtgaagatgaagttcagattcctgggcaagctgatggccaaggccatcatggacttcagactggtggacctgcccctgggcctgcccttctacaagtggatgctgagacaggagaccagcctgaccagccacgacctgttcgacatcgaccccgtggtggccagaagcgtgtaccacctggaggacatcgtgagacagaagaagagactggagcaggacaagagccagaccaaggagagcctgcagtacgccctggagaccctgaccatgaacggctgcagcgtggaggacctgggcctggacttcaccctgcccggcttccccaacatcgagctgaagaagggcggcaaggacatccccgtgaccatccacaacctggaggagtacctgagactggtgatcttctgggccctgaacgagggcgtgagcagacagttcgacagcttcagagacggcttcgagagcgtgttccccctgagccacctgcagtacttctaccccgaggagctggaccagctgctgtgcggcagcaaggccgacacctgggacgccaagaccctgatggagtgctgcagacccgaccacggctacacccacgacagcagagccgtgaagttcctgttcgagatcctgagcagcttcgacaacgagcagcagagactgttcctgcagttcgtgaccggcagccccagactgcccgtgggcggcttcagaagcctgaacccccccctgaccatcgtgagaaagaccttcgagagcaccgagaaccccgacgacttcctgcccagcgtgatgacctgcgtgaactacctgaagctgcccgactacagcagcatcgagatcatgagagagaagctgctgatcgccgccagagagggccagcagagcttccacctgagctag

SEQ ID NO: 102471 - DNA, 450 bp, Artificial Sequence
  Description of Artificial Sequence: Synthetic coding sequence
atgagcaacagacccaacaacaaccccggcggcagcctgagaagaagccagagaaacaccgccggcgcccagccccaggacgacagcatcggcggcagaagctgcagcagcagcagcgccgtgatcgtgccccagcccgaggaccccgacagagccaacaccagcgagagacagaagaccggccaggtgcccaagaaggacaacagcagaggcgtgaagagaagcgccagccccgactacaacagaaccaacagccccagcagcgccaagaagcccaaggccctgcagcacaccgagagccccagcgagaccaacaagccccacagcaagagcaagaagagacacctggaccaggagcagcagctgaagagcgcccagagccccagcaccagcaaggcccacaccagaaagagcggcgccaccggcggcagcagaagccagaagagatag

SEQ ID NO: 102472 - DNA, 465 bp, Artificial Sequence
  Description of Artificial Sequence: Synthetic coding sequence
atgagcaacagacccaacaacaaccccggcggcagcctgagaagaagccagagaaacaccgccggcgcccagccccaggacgacagcatcggcggcagaagctgcagcagcagcagcgccgtgatcgtgccccagcccgaggaccccgacagagccaacaccagcgagagacagaagaccggccaggtgcccaagaaggacaacagcagaggcgtgaagagaagcgccagccccgactacaacagaaccaacagccccagcagcgccaagaagcccaaggccctgcagcacaccgagagccccagcgagaccaacaagccccacagcaagagcaagaagagacacctggaccaggagcagcagctgaagagcgcccagagccccagcaccagcaaggcccacaccagaaagagcggcgccaccggcggcagcagaagccagaagagaaagagaaccgagagctag

SEQ ID NO: 102473 - DNA, 1041 bp, Artificial Sequence
  Description of Artificial Sequence: Synthetic coding sequence
atgagcaacagacccaacaacaaccccggcggcagcctgagaagaagccagagaaacaccgccggcgcccagccccaggacgacagcatcggcggcagaagccacctgggccaggccaagcacaagggctacagcccccccgagagcagaaagagcaacagcaaggcccccaaggtgcagagcaacaccaccagcgagctgagcagaggccacctgagcaagagaagctgcagcagcagcagcgccgtgatcgtgccccagcccgaggaccccgacagagccaacaccagcgagagacagaagaccggccaggtgcccaagaaggacaacagcagaggcgtgaagagaagcgccagccccgactacaacagaaccaacagccccagcagcgccaagaagcccaaggccctgcagcacaccgagagccccagcgagaccaacaagccccacagcaagagcaagaagagacacctggaccaggagcagcagctgaagagcgcccagagccccagcaccagcaaggcccacaccagaaagagcggcgccaccggcggcagcagaagccagaagagaaagagaaccgagagcagctgcgtgaagagcggcagcggcagcgagagcaccggcgccgaggagagaagcgccaagcccaccaagctggccagcaagagcgccaccagcgccaaggccggctgcagcaccatcaccgacagcagcagcgccgccagcaccagcagcagcagcagcgccgtggccagcgccagcagcaccgtgccccccggcgccagagtgaagcagggcaaggaccagaacaaggccagaagaagcagaagcgccagcagccccagccccagaagaagcagcagagagaaggagcagagcaagaccggcggcagcagcaagttcgactgggccgccagattcagccccaaggtgagcctgcccaagaccaagctgagcctgcccggcagcagcaagagcgagaccagcaagcccggccccagcggcctgcaggccaaggtgctgaccagcaagagatag

SEQ ID NO: 102474 - DNA, 1746 bp, Artificial Sequence
  Description of Artificial Sequence: Synthetic coding sequence
atggccgtggccggcgccgtgagcggcgagcccctggtgcactggtgcacccagcagctgagaaagaccttcggcctggacgtgagcgaggagatcatccagtacgtgctgagcatcgagagcgccgaggagatcagagagtacgtgaccgacctgctgcagggcaacgagggcaagaagggccagttcatcgaggagctgatcaccaagtggcagaagaacgaccaggagctgatcagcgaccccctgcagcagtgcttcaagaaggacgagatcctggacggccagaagagcggcgaccacctgaagagaggcagaaagaagggcagaaacagacaggaggtgcccgccttcaccgagcccgacaccaccgccgaggtgaagacccccttcgacctggccaaggcccaggagaacagcaacagcgtgaagaagaagaccaagttcgtgaacctgtacaccagagagggccaggacagactggccgtgctgctgcccggcagacacccctgcgactgcctgggccagaagcacaagctgatcaacaactgcctgatctgcggcagaatcgtgtgcgagcaggagggcagcggcccctgcctgttctgcggcaccctggtgtgcacccacgaggagcaggacatcctgcagagagacagcaacaagagccagaagctgctgaagaagctgatgagcggcgtggagaacagcggcaaggtggacatcagcaccaaggacctgctgccccaccaggagctgagaatcaagagcggcctggagaaggccatcaagcacaaggacaagctgctggagttcgacagaaccagcatcagaagaacccaggtgatcgacgacgagagcgactacttcgccagcgacagcaaccagtggctgagcaagctggagagagagaccctgcagaagagagaggaggagctgagagagctgagacacgccagcagactgagcaagaaggtgaccatcgacttcgccggcagaaagatcctggaggaggagaacagcctggccgagtaccacagcagactggacgagaccatccaggccatcgccaacggcaccctgaaccagcccctgaccaagctggacagaagcagcgaggagcccctgggcgtgctggtgaaccccaacatgtaccagagccccccccagtgggtggaccacaccggcgccgccagccagaagaaggccttcagaagcagcggcttcggcctggagttcaacagcttccagcaccagctgagaatccaggaccaggagttccaggagggcttcgacggcggctggtgcctgagcgtgcaccagccctgggccagcctgctggtgagaggcatcaagagagtggagggcagaagctggtacaccccccacagaggcagactgtggatcgccgccaccgccaagaagcccagcccccaggaggtgagcgagctgcaggccacctacagactgctgagaggcaaggacgtggagttccccaacgactaccccagcggctgcctgctgggctgcgtggacctgatcgactgcctgagccagaagcagttcaaggagcagttccccgacatcagccaggagagcgacagccccttcgtgttcatctgcaagaacccccaggagatggtggtgaagttccccatcaagggcaaccccaagatctggaagctggacagcaagatccaccagggcgccaagaagggcctgatgaagcagaacaaggccgtgtag

SEQ ID NO: 102475 - DNA, 1431 bp, Artificial Sequence
  Description of Artificial Sequence: Synthetic coding sequence
atgagcggccccacctggctgccccccaagcagcccgagcccgccagagccccccagggcagagccatccccagaggcacccccggccccccccccgcccacggcgccgccctgcagccccaccccagagtgaacttctgccccctgcccagcgagcagtgctaccaggcccccggcggccccgaggacagaggccccgcctgggtgggcagccacggcgtgctgcagcacacccagggcctgcccgccgacagaggcggcctgagacccggcagcctggacgccgagatcgacctgctgagcagcaccctggccgagctgaacggcggcagaggccacgccagcagaagacccgacagacaggcctacgagcccccccccccccccgcctacagaaccggcagcctgaagcccaaccccgccagccccctgcccgccagcccctacggcggccccacccccgccagctacaccaccgccagcacccccgccggccccgccttccccgtgcaggtgaaggtggcccagcccgtgagaggctgcggcccccccagaagaggcgccagccaggccagcggccccctgcccggcccccacttccccctgcccggcagaggcgaggtgtggggccccggctacagaagccagagagagcccggccccggcgccaaggaggaggccgccggcgtgagcggccccgccggcagaggcagaggcggcgagcacggcccccaggtgcccctgagccagccccccgaggacgagctggacagactgaccaagaagctggtgcacgacatgaaccacccccccagcggcgagtacttcggccagtgcggcggctgcggcgaggacgtggtgggcgacggcgccggcgtggtggccctggacagagtgttccacgtgggctgcttcgtgtgcagcacctgcagagcccagctgagaggccagcacttctacgccgtggagagaagagcctactgcgagggctgctacgtggccaccctggagaagtgcgccacctgcagccagcccatcctggacagaatcctgagagccatgggcaaggcctaccaccccggctgcttcacctgcgtggtgtgccacagaggcctggacggcatccccttcaccgtggacgccaccagccagatccactgcatcgaggacttccacagaaagttcgcccccagatgcagcgtgtgcggcggcgccatcatgcccgagcccggccaggaggagaccgtgagaatcgtggccctggacagaagcttccacatcggctgctacaagtgcgaggagtgcggcctgctgctgagcagcgagggcgagtgccagggctgctaccccctggacggccacatcctgtgcaaggcctgcagcgcctggagaatccaggagctgagcgccaccgtgaccaccgactgctag

SEQ ID NO: 102476 - DNA, 1473 bp, Artificial Sequence
  Description of Artificial Sequence: Synthetic coding sequence
atggagcagaagcccagcaaggtggagtgcggcagcgaccccgaggagaacagcgccagaagccccgacggcaagagaaagagaaagaacggccagtgcagcctgaagaccagcatgagcggctacatccccagctacctggacaaggacgagcagtgcgtggtgtgcggcgacaaggccaccggctaccactacagatgcatcacctgcgagggctgcaagggcttcttcagaagaaccatccagaagaacctgcaccccacctacagctgcaagtacgacagctgctgcgtgatcgacaagatcaccagaaaccagtgccagctgtgcagattcaagaagtgcatcgccgtgggcatggccatggacctggtgctggacgacagcaagagagtggccaagagaaagctgatcgagcagaacagagagagaagaagaaaggaggagatgatcagaagcctgcagcagagacccgagcccacccccgaggagtgggacctgatccacatcgccaccgaggcccacagaagcaccaacgcccagggcagccactggaagcagagaagaaagttcctgcccgacgacatcggccagagccccatcgtgagcatgcccgacggcgacaaggtggacctggaggccttcagcgagttcaccaagatcatcacccccgccatcaccagagtggtggacttcgccaagaagctgcccatgttcagcgagctgccctgcgaggaccagatcatcctgctgaagggctgctgcatggagatcatgagcctgagagccgccgtgagatacgaccccgagagcgacaccctgaccctgagcggcgagatggccgtgaagagagagcagctgaagaacggcggcctgggcgtggtgagcgacgccatcttcgagctgggcaagagcctgagcgccttcaacctggacgacaccgaggtggccctgctgcaggccgtgctgctgatgagcaccgacagaagcggcctgctgtgcgtggacaagatcgagaagagccaggaggcctacctgctggccttcgagcactacgtgaaccacagaaagcacaacatcccccacttctggcccaagctgctgatgaaggagagagaggtgcagagcagcatcctgtacaagggcgccgccgccgagggcagacccggcggcagcctgggcgtgcaccccgagggccagcagctgctgggcatgcacgtggtgcagggcccccaggtgagacagctggagcagcagctgggcgaggccggcagcctgcagggccccgtgctgcagcaccagagccccaagagcccccagcagagactgctggagctgctgcacagaagcggcatcctgcacgccagagccgtgtgcggcgaggacgacagcagcgaggccgacagccccagcagcagcgaggaggagcccgaggtgtgcgaggacctggccggcaacgccgccagcccctag

SEQ ID NO: 102477 - DNA, 1473 bp, Artificial Sequence; identical to SEQ ID NO: 102476
  Description of Artificial Sequence: Synthetic coding sequence

SEQ ID NO: 102478 - DNA, 1233 bp, Artificial Sequence
  Description of Artificial Sequence: Synthetic coding sequence
atggagcagaagcccagcaaggtggagtgcggcagcgaccccgaggagaacagcgccagaagccccgacggcaagagaaagagaaagaacggccagtgcagcctgaagaccagcatgagcggctacatccccagctacctggacaaggacgagcagtgcgtggtgtgcggcgacaaggccaccggctaccactacagatgcatcacctgcgagggctgcaagggcttcttcagaagaaccatccagaagaacctgcaccccacctacagctgcaagtacgacagctgctgcgtgatcgacaagatcaccagaaaccagtgccagctgtgcagattcaagaagtgcatcgccgtgggcatggccatggacctggtgctggacgacagcaagagagtggccaagagaaagctgatcgagcagaacagagagagaagaagaaaggaggagatgatcagaagcctgcagcagagacccgagcccacccccgaggagtgggacctgatccacatcgccaccgaggcccacagaagcaccaacgcccagggcagccactggaagcagagaagaaagttcctgcccgacgacatcggccagagccccatcgtgagcatgcccgacggcgacaaggtggacctggaggccttcagcgagttcaccaagatcatcacccccgccatcaccagagtggtggacttcgccaagaagctgcccatgttcagcgagctgccctgcgaggaccagatcatcctgctgaagggctgctgcatggagatcatgagcctgagagccgccgtgagatacgaccccgagagcgacaccctgaccctgagcggcgagatggccgtgaagagagagcagctgaagaacggcggcctgggcgtggtgagcgacgccatcttcgagctgggcaagagcctgagcgccttcaacctggacgacaccgaggtggccctgctgcaggccgtgctgctgatgagcaccgacagaagcggcctgctgtgcgtggacaagatcgagaagagccaggaggcctacctgctggccttcgagcactacgtgaaccacagaaagcacaacatcccccacttctggcccaagctgctgatgaaggtgaccgacctgagaatgatcggcgcctgccacgccagcagattcctgcacatgaaggtggagtgccccaccgagctgttcccccccctgttcctggaggtgttcgaggaccaggaggtgtag

SEQ ID NO: 102479 - DNA, 1233 bp, Artificial Sequence; identical to SEQ ID NO: 102478
  Description of Artificial Sequence: Synthetic coding sequence

SEQ ID NO: 102480 - DNA, 1386 bp, Artificial Sequence
  Description of Artificial Sequence: Synthetic coding sequence
atgacccccaacagcatgaccgagaacggcctgaccgcctgggacaagcccaagcactgccccgacagagagcacgactggaagctggtgggcatgagcgaggcctgcctgcacagaaagagccacagcgagagaagaagcaccctgaagaacgagcagagcagcccccacctgatccagaccacctggaccagcagcatcttccacctggaccacgacgacgtgaacgaccagagcgtgagcagcgcccagaccttccagaccgaggagaagaagtgcaagggctacatccccagctacctggacaaggacgagctgtgcgtggtgtgcggcgacaaggccaccggctaccactacagatgcatcacctgcgagggctgcaagggcttcttcagaagaaccatccagaagaacctgcaccccagctacagctgcaagtacgagggcaagtgcgtgatcgacaaggtgaccagaaaccagtgccaggagtgcagattcaagaagtgcatctacgtgggcatggccaccgacctggtgctggacgacagcaagagactggccaagagaaagctgatcgaggagaacagagagaagagaagaagagaggagctgcagaagagcatcggccacaagcccgagcccaccgacgaggagtgggagctgatcaagaccgtgaccgaggcccacgtggccaccaacgcccagggcagccactggaagcagaagagaaagttcctgcccgaggacatcggccaggcccccatcgtgaacgcccccgagggcggcaaggtggacctggaggccttcagccacttcaccaagatcatcacccccgccatcaccagagtggtggacttcgccaagaagctgcccatgttctgcgagctgccctgcgaggaccagatcatcctgctgaagggctgctgcatggagatcatgagcctgagagccgccgtgagatacgaccccgagagcgagaccctgaccctgaacggcgagatggccgtgaccagaggccagctgaagaacggcggcctgggcgtggtgagcgacgccatcttcgacctgggcatgagcctgagcagcttcaacctggacgacaccgaggtggccctgctgcaggccgtgctgctgatgagcagcgacagacccggcctggcctgcgtggagagaatcgagaagtaccaggacagcttcctgctggccttcgagcactacatcaactacagaaagcaccacgtgacccacttctggcccaagctgctgatgaaggtgaccgacctgagaatgatcggcgcctgccacgccagcagattcctgcacatgaaggtggagtgccccaccgagctgttcccccccctgttcctggaggtgttcgaggactag

SEQ ID NO: 102481 - DNA, 1386 bp, Artificial Sequence; identical to SEQ ID NO: 102480
  Description of Artificial Sequence: Synthetic coding sequence

SEQ ID NO: 102482 - DNA, 1386 bp, Artificial Sequence; identical to SEQ ID NO: 102480
  Description of Artificial Sequence: Synthetic coding sequence

SEQ ID NO: 102483 - DNA, 87 bp, Artificial Sequence
  Description of Artificial Sequence: Synthetic coding sequence
atgacccccaacagcatgaccgagatggccctgcagcccggcaccaacagaagcaccgtgcagaccgagaacaccaccggcagctag

SEQ ID NO: 102484 - DNA, 366 bp, Artificial Sequence
  Description of Artificial Sequence: Synthetic coding sequence
atgacccccaacagcatgaccgagaacggcctgaccgcctgggacaagcccaagcactgccccgacagagagcacgactggaagctggtgggcatgagcgaggcctgcctgcacagaaagagccacagcgagagaagaagcaccctgaagaacgagcagagcagcccccacctgatccagaccacctggaccagcagcatcttccacctggaccacgacgacgtgaacgaccagagcgtgagcagcgcccagaccttccagaccgaggagaagaagtgcaagggctacatccccagctacctggacaaggacgagctgtgcgtggtgtgcggcgacaaggccaccggctaccactacagatgctag

SEQ ID NO: 102485 - DNA, 441 bp, Artificial Sequence
  Description of Artificial Sequence: Synthetic coding sequence
atgcaggtgctgaccaagagataccccaagaactgcctgctgaccgtgatggacagatacgccgccgaggtgcacaacatggagcaggtggtgatgatccccagcctgctgagagacgtgcagctgagcggccccggcggccaggcccaggccgaggcccccgacctgtacacctacttcaccatgctgaaggccatctgcgtggacgtggaccacggcctgctgcccagagaggagtggcaggccaaggtggccggcagcgaggagaacggcaccgccgagaccgaggaggtggaggacgagagcgccagcggcgagctggacctggaggcccagttccacctgcacttcagcagcctgcaccacatcctgatgcacctgaccgagaaggcccaggaggtgaccagaaagtaccaggagatgaccggccaggtgtggtag

SEQ ID NO: 102486 - DNA, 2802 bp, Artificial Sequence
  Description of Artificial Sequence: Synthetic coding sequence
atgagagccctggccgtgctgagcgtgaccctggtgatggcctgcaccgaggccttcttccccttcatcagcagaggcaaggagctgctgtggggcaagcccgaggagagcagagtgagcagcgtgctggaggagagcaagagactggtggacaccgccatgtacgccaccatgcagagaaacctgaagaagagaggcatcctgagccccgcccagctgctgagcttcagcaagctgcccgagcccaccagcggcgtgatcgccagagccgccgagatcatggagaccagcatccaggccatgaagagaaaggtgaacctgaagacccagcagagccagcaccccaccgacgccctgagcgaggacctgctgagcatcatcgccaacatgagcggctgcctgccctacatgctgccccccaagtgccccaacacctgcctggccaacaagtacagacccatcaccggcgcctgcaacaacagagaccaccccagatggggcgccagcaacaccgccctggccagatggctgccccccgtgtacgaggacggcttcagccagcccagaggctggaaccccggcttcctgtacaacggcttccccctgccccccgtgagagaggtgaccagacacgtgatccaggtgagcaacgaggtggtgaccgacgacgacagatacagcgacctgctgatggcctggggccagtacatcgaccacgacatcgccttcaccccccagagcaccagcaaggccgccttcggcggcggcgccgactgccagatgacctgcgagaaccagaacccctgcttccccatccagctgcccgaggaggccagacccgccgccggcaccgcctgcctgcccttctacagaagcagcgccgcctgcggcaccggcgaccagggcgccctgttcggcaacctgagcaccgccaaccccagacagcagatgaacggcctgaccagcttcctggacgccagcaccgtgtacggcagcagccccgccctggagagacagctgagaaactggaccagcgccgagggcctgctgagagtgcacgccagactgagagacagcggcagagcctacctgcccttcgtgccccccagagcccccgccgcctgcgcccccgagcccggcatccccggcgagaccagaggcccctgcttcctggccggcgacggcagagccagcgaggtgcccagcctgaccgccctgcacaccctgtggctgagagagcacaacagactggccgccgccctgaaggccctgaacgcccactggagcgccgacgccgtgtaccaggaggccagaaaggtggtgggcgccctgcaccagatcatcaccctgagagactacatccccagaatcctgggccccgaggccttccagcagtacgtgggcccctacgagggctacgacagcaccgccaaccccaccgtgagcaacgtgttcagcaccgccgccttcagattcggccacgccaccatccaccccctggtgagaagactggacgccagcttccaggagcaccccgacctgcccggcctgtggctgcaccaggccttcttcagcccctggaccctgctgagaggcggcggcctggaccccctgatcagaggcctgctggccagacccgccaagctgcaggtgcaggaccagctgatgaacgaggagctgaccgagagactgttcgtgctgagcaacagcagcaccctggacctggccagcatcaacctgcagagaggcagagaccacggcctgcccggctacaacgagtggagagagttctgcggcctgcccagactggagacccccgccgacctgagcaccgccatcgccagcagaagcgtggccgacaagatcctggacctgtacaagcaccccgacaacatcgacgtgtggctgggcggcctggccgagaacttcctgcccagagccagaaccggccccctgttcgcctgcctgatcggcaagcagatgaaggccctgagagacggcgactggttctggtgggagaacagccacgtgttcaccgacgcccagagaagagagctggagaagcacagcctgagcagagtgatctgcgacaacaccggcctgaccagagtgcccatggacgccttccaggtgggcaagttccccgaggacttcgagagctgcgacagcatcaccggcatgaacctggaggcctggagagagaccttcccccaggacgacaagtgcggcttccccgagagcgtggagaacggcgacttcgtgcactgcgaggagagcggcagaagagtgctggtgtacagctgcagacacggctacgagctgcagggcagagagcagctgacctgcacccaggagggctgggacttccagccccccctgtgcaaggacgtgaacgagtgcgccgacggcgcccaccccccctgccacgccagcgccagatgcagaaacaccaagggcggcttccagtgcctgtgcgccgacccctacgagctgggcgacgacggcagaacctgcgtggacagcggcagactgcccagagtgacctggatcagcatgagcctggccgccctgctgatcggcggcttcgccggcctgaccagcaccgtgatctgcagatggaccagaaccggcaccaagagcaccctgcccatcagcgagaccggcggcggcacccccgagctgagatgcggcaagcaccaggccgtgggcaccagcccccagagagccgccgcccaggacagcgagcaggagagcgccggcatggagggcagagacacccacagactgcccagagccctgtag

SEQ ID NO: 102487 - DNA, 2790 bp, Artificial Sequence
  Description of Artificial Sequence: Synthetic coding sequence
atgagagccctggccgtgctgagcgtgaccctggtgatggcctgcaccgaggccttcttccccttcatcagcagaggcaaggagctgctgtggggcaagcccgaggagagcagagtgagcagcgtgctggaggagagcaagagactggtggacaccgccatgtacgccaccatgcagagaaacctgaagaagagaggcatcctgagccccgcccagctgctgagcttcagcaagctgcccgagcccaccagcggcgtgatcgccagagccgccgagatcatggagaccagcatccaggccatgaagagaaaggtgaacctgaagacccagcagagccagcaccccaccgacgccctgagcgaggacctgctgagcatcatcgccaacatgagcggctgcctgccctacatgctgccccccaagtgccccaacacctgcctggccaacaagtacagacccatcaccggcgcctgcaacaacagagaccaccccagatggggcgccagcaacaccgccctggccagatggctgccccccgtgtacgaggacggcttcagccagcccagaggctggaaccccggcttcctgtacaacggcttccccctgccccccgtgagagaggtgaccagacacgtgatccaggtgagcaacgaggtggtgaccgacgacgacagatacagcgacctgctgatggcctggggccagtacatcgaccacgacatcgccttcaccccccagagcaccagcaaggccgccttcggcggcggcgccgactgccagatgacctgcgagaaccagaacccctgcttccccatccagctgcccgaggaggccagacccgccgccggcaccgcctgcctgcccttctacagaagcagcgccgcctgcggcaccggcgaccagggcgccctgttcggcaacctgagcaccgccaaccccagacagcagatgaacggcctgaccagcttcctggacgccagcaccgtgtacggcagcagccccgccctggagagacagctgagaaactggaccagcgccgagggcctgctgagagtgcacgccagactgagagacagcggcagagcctacctgcccttcgtgccccccagagcccccgccgcctgcgcccccgagcccggcatccccggcgagaccagaggcccctgcttcctggccggcgacggcagagccagcgaggtgcccagcctgaccgccctgcacaccctgtggctgagagagcacaacagactggccgccgccctgaaggccctgaacgcccactggagcgccgacgccgtgtaccaggaggccagaaaggtggtgggcgccctgcaccagatcatcaccctgagagactacatccccagaatcctgggccccgaggccttccagcagtacgtgggcccctacgagggctacgacagcaccgccaaccccaccgtgagcaacgtgttcagcaccgccgccttcagattcggccacgccaccatccaccccctggtgagaagactggacgccagcttccaggagcaccccgacctgcccggcctgtggctgcaccaggccttcttcagcccctggaccctgctgagaggcggcggcctggaccccctgatcagaggcctgctggccagacccgccaagctgcaggtgcaggaccagctgatgaacgaggagctgaccgagagactgttcgtgctgagcaacagcagcaccctggacctggccagcatcaacctgcagagaggcagagaccacggcctgcccggctacaacgagtggagagagttctgcggcctgcccagactggagacccccgccgacctgagcaccgccatcgccagcagaagcgtggccgacaagatcctggacctgtacaagcaccccgacaacatcgacgtgtggctgggcggcctggccgagaacttcctgcccagagccagaaccggccccctgttcgcctgcctgatcggcaagcagatgaaggccctgagagacggcgactggttctggtgggagaacagccacgtgttcaccgacgcccagagaagagagctggagaagcacagcctgagcagagtgatctgcgacaacaccggcctgaccagagtgcccatggacgccttccaggtgggcaagttccccgaggacttcgagagctgcgacagcatcaccggcatgaacctggaggcctggagagagaccttcccccaggacgacaagtgcggcttccccgagagcgtggagaacggcgacttcgtgcactgcgaggagagcggcagaagagtgctggtgtacagctgcagacacggctacgagctgcagggcagagagcagctgacctgcacccaggagggctgggacttccagccccccctgtgcaaggacgtgaacgagtgcgccgacggcgcccaccccccctgccacgccagcgccagatgcagaaacaccaagggcggcttccagtgcctgtgcgccgacccctacgagctgggcgacgacggcagaacctgcgtggacagcggcagactgcccagagtgacctggatcagcatgagcctggccgccctgctgatcggcggcttcgccggcctgaccagcaccgtgatctgcagatggagagtgctgggctggaaggccggcatcctgaccggctgcagagagcccagcgagggcaaggtggccggccactgcagaaccgccagctgcagccagaaccacagaaccaccctgttccagacccaggccaaccccaagagcgccggcagactgttcagccagcacggctag

SEQ ID NO: 102488 - DNA, 2802 bp, Artificial Sequence; identical to SEQ ID NO: 102486
  Description of Artificial Sequence: Synthetic coding sequence

SEQ ID NO: 102489 - DNA, 2670 bp, Artificial Sequence
  Description of Artificial Sequence: Synthetic coding sequence
atgagagccctggccgtgctgagcgtgaccctggtgatggcctgcaccgaggccttcttccccttcatcagcagaggcaaggagctgctgtggggcaagcccgaggagagcagagtgagcagcgtgctggaggagagcaagagactggtggacaccgccatgtacgccaccatgcagagaaacctgaagaagagaggcatcctgagccccgcccagctgctgagcttcagcaagctgcccgagcccaccagcggcgtgatcgccagagccgccgagatcatggagaccagcatccaggccatgaagagaaaggtgaacctgaagacccagcagagccagcaccccaccgacgccctgagcgaggacctgctgagcatcatcgccaacatgagcggctgcctgccctacatgctgccccccaagtgccccaacacctgcctggccaacaagtacagacccatcaccggcgcctgcaacaacagagaccaccccagatggggcgccagcaacaccgccctggccagatggctgccccccgtgtacgaggacggcttcagccagcccagaggctggaaccccggcttcctgtacaacggcttccccctgccccccgtgagagaggtgaccagacacgtgatccaggtgagcaacgaggtggtgaccgacgacgacagatacagcgacctgctgatggcctggggccagtacatcgaccacgacatcgccttcaccccccagagcaccagcaaggccgccttcggcggcggcgccgactgccagatgacctgcgagaaccagaacccctgcttccccatccagctgcccgaggaggccagacccgccgccggcaccgcctgcctgcccttctacagaagcagcgccgcctgcggcaccggcgaccagggcgccctgttcggcaacctgagcaccgccaaccccagacagcagatgaacggcctgaccagcttcctggacgccagcaccgtgtacggcagcagccccgccctggagagacagctgagaaactggaccagcgccgagggcctgctgagagtgcacgccagactgagagacagcggcagagcctacctgcccttcgtgccccccagagcccccgccgcctgcgcccccgagcccggcatccccggcgagaccagaggcccctgcttcctggccggcgacggcagagccagcgaggtgcccagcctgaccgccctgcacaccctgtggctgagagagcacaacagactggccgccgccctgaaggccctgaacgcccactggagcgccgacgccgtgtaccaggaggccagaaaggtggtgggcgccctgcaccagatcatcaccctgagagactacatccccagaatcctgggccccgaggccttccagcagtacgtgggcccctacgagggctacgacagcaccgccaaccccaccgtgagcaacgtgttcagcaccgccgccttcagattcggccacgccaccatccaccccctggtgagaagactggacgccagcttccaggagcaccccgacctgcccggcctgtggctgcaccaggccttcttcagcccctggaccctgctgagaggcggcggcctggaccccctgatcagaggcctgctggccagacccgccaagctgcaggtgcaggaccagctgatgaacgaggagctgaccgagagactgttcgtgctgagcaacagcagcaccctggacctggccagcatcaacctgcagagaggcagagaccacggcctgcccggctacaacgagtggagagagttctgcggcctgcccagactggagacccccgccgacctgagcaccgccatcgccagcagaagcgtggccgacaagatcctggacctgtacaagcaccccgacaacatcgacgtgtggctgggcggcctggccgagaacttcctgcccagagccagaaccggccccctgttcgcctgcctgatcggcaagcagatgaaggccctgagagacggcgactggttctggtgggagaacagccacgtgttcaccgacgcccagagaagagagctggagaagcacagcctgagcagagtgatctgcgacaacaccggcctgaccagagtgcccatggacgccttccaggtgggcaagttccccgaggacttcgagagctgcgacagcatcaccggcatgaacctggaggcctggagagagaccttcccccaggacgacaagtgcggcttccccgagagcgtggagaacggcgacttcgtgcactgcgaggagagcggcagaagagtgctggtgtacagctgcagacacggctacgagctgcagggcagagagcagctgacctgcacccaggagggctgggacttccagccccccctgtgcaaggacagcggcagactgcccagagtgacctggatcagcatgagcctggccgccctgctgatcggcggcttcgccggcctgaccagcaccgtgatctgcagatggaccagaaccggcaccaagagcaccctgcccatcagcgagaccggcggcggcacccccgagctgagatgcggcaagcaccaggccgtgggcaccagcccccagagagccgccgcccaggacagcgagcaggagagcgccggcatggagggcagagacacccacagactgcccagagccctgtag

SEQ ID NO: 102490 - DNA, 2283 bp, Artificial Sequence
  Description of Artificial Sequence: Synthetic coding sequence
atgagagccctggccgtgctgagcgtgaccctggtgatggcctgcaccgaggccttcttccccttcatcagcagaggcaaggagctgctgtggggcaagcccgaggagagcagagtgagcagcgtgctggaggagagcaagagactggtggacaccgccatgtacgccaccatgcagagaaacctgaagaagagaggcatcctgagccccgcccagctgctgagcttcagcaagctgcccgagcccaccagcggcgtgatcgccagagccgccgagatcatggagaccagcatccaggccatgaagagaaaggtgaacctgaagacccagcagagccagcaccccaccgacgccctgagcgaggacctgctgagcatcatcgccaacatgagcggctgcctgccctacatgctgccccccaagtgccccaacacctgcctggccaacaagtacagacccatcaccggcgcctgcaacaacagagaccaccccagatggggcgccagcaacaccgccctggccagatggctgccccccgtgtacgaggacggcttcagccagcccagaggctggaaccccggcttcctgtacaacggcttccccctgccccccgtgagagaggtgaccagacacgtgatccaggtgagcaacgaggtggtgaccgacgacgacagatacagcgacctgctgatggcctggggccagtacatcgaccacgacatcgccttcaccccccagagcaccagcaaggccgccttcggcggcggcgccgactgccagatgacctgcgagaaccagaacccctgcttccccatccagatcatcaccctgagagactacatccccagaatcctgggccccgaggccttccagcagtacgtgggcccctacgagggctacgacagcaccgccaaccccaccgtgagcaacgtgttcagcaccgccgccttcagattcggccacgccaccatccaccccctggtgagaagactggacgccagcttccaggagcaccccgacctgcccggcctgtggctgcaccaggccttcttcagcccctggaccctgctgagaggcggcggcctggaccccctgatcagaggcctgctggccagacccgccaagctgcaggtgcaggaccagctgatgaacgaggagctgaccgagagactgttcgtgctgagcaacagcagcaccctggacctggccagcatcaacctgcagagaggcagagaccacggcctgcccggctacaacgagtggagagagttctgcggcctgcccagactggagacccccgccgacctgagcaccgccatcgccagcagaagcgtggccgacaagatcctggacctgtacaagcaccccgacaacatcgacgtgtggctgggcggcctggccgagaacttcctgcccagagccagaaccggccccctgttcgcctgcctgatcggcaagcagatgaaggccctgagagacggcgactggttctggtgggagaacagccacgtgttcaccgacgcccagagaagagagctggagaagcacagcctgagcagagtgatctgcgacaacaccggcctgaccagagtgcccatggacgccttccaggtgggcaagttccccgaggacttcgagagctgcgacagcatcaccggcatgaacctggaggcctggagagagaccttcccccaggacgacaagtgcggcttccccgagagcgtggagaacggcgacttcgtgcactgcgaggagagcggcagaagagtgctggtgtacagctgcagacacggctacgagctgcagggcagagagcagctgacctgcacccaggagggctgggacttccagccccccctgtgcaaggacgtgaacgagtgcgccgacggcgcccaccccccctgccacgccagcgccagatgcagaaacaccaagggcggcttccagtgcctgtgcgccgacccctacgagctgggcgacgacggcagaacctgcgtggacagcggcagactgcccagagtgacctggatcagcatgagcctggccgccctgctgatcggcggcttcgccggcctgaccagcaccgtgatctgcagatggaccagaaccggcaccaagagcaccctgcccatcagcgagaccggcggcggcacccccgagctgagatgcggcaagcaccaggccgtgggcaccagcccccagagagccgccgcccaggacagcgagcaggagagcgccggcatggagggcagagacacccacagactgcccagagccctgtag

SEQ ID NO: 102491 - DNA, 2283 bp, Artificial Sequence; identical to SEQ ID NO: 102490
  Description of Artificial Sequence: Synthetic coding sequence

SEQ ID NO: 102492 - DNA, 2631 bp, Artificial Sequence
  Description of Artificial Sequence: Synthetic coding sequence
atgagagccctggccgtgctgagcgtgaccctggtgatggcctgcaccgaggccttcttccccttcatcagcagaggcaaggagctgctgtggggcaagcccgaggagagcagagtgagcagcgtgctggaggagagcaagagactggtggacaccgccatgtacgccaccatgcagagaaacctgaagaagagaggcatcctgagccccgcccagctgctgagcttcagcaagctgcccgagcccaccagcggcgtgatcgccagagccgccgagatcatggagaccagcatccaggccatgaagagaaaggtgaacctgaagacccagcagagccagcaccccaccgacgccctgagcgaggacctgctgagcatcatcgccaacatgagcggctgcctgccctacatgctgccccccaagtgccccaacacctgcctggccaacaagtacagacccatcaccggcgcctgcaacaacagagaccaccccagatggggcgccagcaacaccgccctggccagatggctgccccccgtgtacgaggacggcttcagccagcccagaggctggaaccccggcttcctgtacaacggcttccccctgccccccgtgagagaggtgaccagacacgtgatccaggtgagcaacgaggtggtgaccgacgacgacagatacagcgacctgctgatggcctggggccagtacatcgaccacgacatcgccttcaccccccagagcaccagcaaggccgccttcggcggcggcgccgactgccagatgacctgcgagaaccagaacccctgcttccccatccagctgcccgaggaggccagacccgccgccggcaccgcctgcctgcccttctacagaagcagcgccgcctgcggcaccggcgaccagggcgccctgttcggcaacctgagcaccgccaaccccagacagcagatgaacggcctgaccagcttcctggacgccagcaccgtgtacggcagcagccccgccctggagagacagctgagaaactggaccagcgccgagggcctgctgagagtgcacgccagactgagagacagcggcagagcctacctgcccttcgtgccccccagagcccccgccgcctgcgcccccgagcccggcatccccggcgagaccagaggcccctgcttcctggccggcgacggcagagccagcgaggtgcccagcctgaccgccctgcacaccctgtggctgagagagcacaacagactggccgccgccctgaaggccctgaacgcccactggagcgccgacgccgtgtaccaggaggccagaaaggtggtgggcgccctgcaccagatcatcaccctgagagactacatccccagaatcctgggccccgaggccttccagcagtacgtgggcccctacgagggctacgacagcaccgccaaccccaccgtgagcaacgtgttcagcaccgccgccttcagattcggccacgccaccatccaccccctggtgagaagactggacgccagcttccaggagcaccccgacctgcccggcctgtggctgcaccaggccttcttcagcccctggaccctgctgagaggcggctacaacgagtggagagagttctgcggcctgcccagactggagacccccgccgacctgagcaccgccatcgccagcagaagcgtggccgacaagatcctggacctgtacaagcaccccgacaacatcgacgtgtggctgggcggcctggccgagaacttcctgcccagagccagaaccggccccctgttcgcctgcctgatcggcaagcagatgaaggccctgagagacggcgactggttctggtgggagaacagccacgtgttcaccgacgcccagagaagagagctggagaagcacagcctgagcagagtgatctgcgacaacaccggcctgaccagagtgcccatggacgccttccaggtgggcaagttccccgaggacttcgagagctgcgacagcatcaccggcatgaacctggaggcctggagagagaccttcccccaggacgacaagtgcggcttccccgagagcgtggagaacggcgacttcgtgcactgcgaggagagcggcagaagagtgctggtgtacagctgcagacacggctacgagctgcagggcagagagcagctgacctgcacccaggagggctgggacttccagccccccctgtgcaaggacgtgaacgagtgcgccgacggcgcccaccccccctgccacgccagcgccagatgcagaaacaccaagggcggcttccagtgcctgtgcgccgacccctacgagctgggcgacgacggcagaacctgcgtggacagcggcagactgcccagagtgacctggatcagcatgagcctggccgccctgctgatcggcggcttcgccggcctgaccagcaccgtgatctgcagatggaccagaaccggcaccaagagcaccctgcccatcagcgagaccggcggcggcacccccgagctgagatgcggcaagcaccaggccgtgggcaccagcccccagagagccgccgcccaggacagcgagcaggagagcgccggcatggagggcagagacacccacagactgcccagagccctgtag

SEQ ID NO: 102493 - DNA, 519 bp, Artificial Sequence
  Description of Artificial Sequence: Synthetic coding sequence
atgagagccctggccgtgctgagcgtgaccctggtgatggcctgcaccgaggccttcttccccttcatcagcagaggcaaggagctgctgtggggcaagcccgaggagagcagagtgagcagcgtgctggaggagagcaagagactggtggacaccgccatgtacgccaccatgcagagaaacctgaagaagagaggcatcctgagccccgcccagctgctgagcttcagcaagctgcccgagcccaccagcggcgtgatcgccagagccgccgagatcatggagaccagcatccaggccatgaagagaaaggtgaacctgaagacccagcagagccagcaccccaccgacgccctgagcgaggacctgctgagcatcatcgccaacatgagcggctgcctgccctacatgctgccccccaagtgccccaacacctgcctggccaacaagtacagacccatcaccggcgcctgcaacaacagagaccaccccagatggggcgccagcaacaccgcctag

SEQ ID NO: 102494 - DNA, 462 bp, Artificial Sequence
  Description of Artificial Sequence: Synthetic coding sequence
atgaacggcctgaccagcttcctggacgccagcaccgtgtacggcagcagccccgccctggagagacagctgagaaactggaccagcgccgagggcctgctgagagtgcacgccagactgagagacagcggcagagcctacctgcccttcgtgccccccagagcccccgccgcctgcgcccccgagcccggcatccccggcgagaccagaggcccctgcttcctggccggcgaccccagacagagaggccccctgcccgacggcaccgcccacgccgtggccgccagagcccagccccccggcagaggcgcccagggcccccagtgcgccctggagagaggcagaagagtgcccggcggcgcccagggcagaggcagaagcgcccccgaccaccaccccgagggcctgcacccccaggaccccggcaccagaggcctgcccgccgtgagaggcagcctgtag

SEQ ID NO: 102495 - DNA, 525 bp, Artificial Sequence
  Description of Artificial Sequence: Synthetic coding sequence
atgagagccctggccgtgctgagcgtgaccctggtgatggcctgcaccgaggccttcttccccttcatcagcagaggcaaggagctgctgtggggcaagcccgaggagagcagagtgagcagcgtgctggaggagagcaagagactggtggacaccgccatgtacgccaccatgcagagaaacctgaagaagagaggcatcctgagccccgcccagctgctgagcttcagcaagctgcccgagcccaccagcggcgtgatcgccagagccgccgagatcatggagaccagcatccaggccatgaagagaaaggtgaacctgaagacccagcagagccagcaccccaccgacgccctgagcgaggacctgctgagcatcatcgccaacatgagcggctgcctgccctacatgctgccccccaagtgccccaacacctgcctggccaacaagtacagacccatcaccggcgcctgcaacaacagaaagatgaagtacaagcccgaccacagcgagaccgccaactag

SEQ ID NO: 102496 - DNA, 2295 bp, Artificial Sequence
  Description of Artificial Sequence: Synthetic coding sequence
atgagacccgccgacctgctgcagctggtgctgctgctggacctgcccagagacctgggcggcatgggctgcagcagccccccctgcgagtgccaccaggaggaggacttcagagtgacctgcaaggacatccagagaatccccagcctgccccccagcacccagaccctgaagctgatcgagacccacctgagaaccatccccagccacgccttcagcaacctgcccaacatcagcagaatctacgtgagcatcgacgtgaccctgcagcagctggagagccacagcttctacaacctgagcaaggtgacccacatcgagatcagaaacaccagaaacctgacctacatcgaccccgacgccctgaaggagctgcccctgctgaagttcctgggcatcttcaacaccggcctgaagatgttccccgacctgaccaaggtgtacagcaccgacatcttcttcatcctggagatcaccgacaacccctacatgaccagcatccccgtgaacgccttccagggcctgtgcaacgagaccctgaccctgaagctgtacaacaacggcttcaccagcgtgcagggctacgccttcaacggcaccaagctggacgccgtgtacctgaacaagaacaagtacctgaccgtgatcgacaaggacgccttcggcggcgtgtacagcggccccagcctgctggacgtgagccagaccagcgtgaccgccctgcccagcaagggcctggagcacctgaaggagctgatcgccagaaacacctggaccctgaagaagctgcccctgagcctgagcttcctgcacctgaccagagccgacctgagctaccccagccactgctgcgccttcaagaaccagaagaagatcagaggcatcctggagagcctgatgtgcaacgagagcagcatgcagagcctgagacagagaaagagcgtgaacgccctgaacagccccctgcaccaggagtacgaggagaacctgggcgacagcatcgtgggctacaaggagaagagcaagttccaggacacccacaacaacgcccactactacgtgttcttcgaggagcaggaggacgagatcatcggcttcggccaggagctgaagaacccccaggaggagaccctgcaggccttcgacagccactacgactacaccatctgcggcgacagcgaggacatggtgtgcacccccaagagcgacgagttcaacccctgcgaggacatcatgggctacaagttcctgagaatcgtggtgtggttcgtgagcctgctggccctgctgggcaacgtgttcgtgctgctgatcctgctgaccagccactacaagctgaacgtgcccagattcctgatgtgcaacctggccttcgccgacttctgcatgggcatgtacctgctgctgatcgccagcgtggacctgtacacccacagcgagtactacaaccacgccatcgactggcagaccggccccggctgcaacaccgccggcttcttcaccgtgttcgccagcgagctgagcgtgtacaccctgaccgtgatcaccctggagagatggtacgccatcaccttcgccatgagactggacagaaagatcagactgagacacgcctgcgccatcatggtgggcggctgggtgtgctgcttcctgctggccctgctgcccctggtgggcatcagcagctacgccaaggtgagcatctgcctgcccatggacaccgagacccccctggccctggcctacatcgtgttcgtgctgaccctgaacatcgtggccttcgtgatcgtgtgctgctgctacgtgaagatctacatcaccgtgagaaacccccagtacaaccccggcgacaaggacaccaagatcgccaagagaatggccgtgctgatcttcaccgacttcatctgcatggcccccatcagcttctacgccctgagcgccatcctgaacaagcccctgatcaccgtgagcaacagcaagatcctgctggtgctgttctaccccctgaacagctgcgccaaccccttcctgtacgccatcttcaccaaggccttccagagagacgtgttcatcctgctgagcaagttcggcatctgcaagagacaggcccaggcctacagaggccagagagtgccccccaagaacagcaccgacatccaggtgcagaaggtgacccacgagatgagacagggcctgcacaacatggaggacgtgtacgagctgatcgagaacagccacctgacccccaagaagcagggccagatcagcgaggagtacatgcagaccgtgctgtag

SEQ ID NO: 102497 - DNA, 762 bp, Artificial Sequence
  Description of Artificial Sequence: Synthetic coding sequence
atgagacccgccgacctgctgcagctggtgctgctgctggacctgcccagagacctgggcggcatgggctgcagcagccccccctgcgagtgccaccaggaggaggacttcagagtgacctgcaaggacatccagagaatccccagcctgccccccagcacccagaccctgaagctgatcgagacccacctgagaaccatccccagccacgccttcagcaacctgcccaacatcagcagaatctacgtgagcatcgacgtgaccctgcagcagctggagagccacagcttctacaacctgagcaaggtgacccacatcgagatcagaaacaccagaaacctgacctacatcgaccccgacgccctgaaggagctgcccctgctgaagttcctgggcatcttcaacaccggcctgaagatgttccccgacctgaccaaggtgtacagcaccgacatcttcttcatcctggagatcaccgacaacccctacatgaccagcatccccgtgaacgccttccagggcctgtgcaacgagaccctgaccctgaagctgtacaacaacggcttcaccagcgtgcagggctacgccttcaacggcaccaagctggacgccgtgtacctgaacaagaacaagtacctgaccgtgatcgacaaggacgccttcggcggcgtgtacagcggccccagcctgctgctgcccctgggcagaaagagcctgagcttcgagacccagaaggcccccagaagcagcatgcccagctag

SEQ ID NO: 102498 - DNA, 1236 bp, Artificial Sequence
  Description of Artificial Sequence: Synthetic coding sequence
atgagacccgccgacctgctgcagctggtgctgctgctggacctgcccagagacctgggcggcatgggctgcagcagccccccctgcgagtgccaccaggaggaggacttcagagtgacctgcaaggacatccagagaatccccagcctgccccccagcacccagaccctgaagctgatcgagacccacctgagaatcgtggtgtggttcgtgagcctgctggccctgctgggcaacgtgttcgtgctgctgatcctgctgaccagccactacaagctgaacgtgcccagattcctgatgtgcaacctggccttcgccgacttctgcatgggcatgtacctgctgctgatcgccagcgtggacctgtacacccacagcgagtactacaaccacgccatcgactggcagaccggccccggctgcaacaccgccggcttcttcaccgtgttcgccagcgagctgagcgtgtacaccctgaccgtgatcaccctggagagatggtacgccatcaccttcgccatgagactggacagaaagatcagactgagacacgcctgcgccatcatggtgggcggctgggtgtgctgcttcctgctggccctgctgcccctggtgggcatcagcagctacgccaaggtgagcatctgcctgcccatggacaccgagacccccctggccctggcctacatcgtgttcgtgctgaccctgaacatcgtggccttcgtgatcgtgtgctgctgctacgtgaagatctacatcaccgtgagaaacccccagtacaaccccggcgacaaggacaccaagatcgccaagagaatggccgtgctgatcttcaccgacttcatctgcatggcccccatcagcttctacgccctgagcgccatcctgaacaagcccctgatcaccgtgagcaacagcaagatcctgctggtgctgttctaccccctgaacagctgcgccaaccccttcctgtacgccatcttcaccaaggccttccagagagacgtgttcatcctgctgagcaagttcggcatctgcaagagacaggcccaggcctacagaggccagagagtgccccccaagaacagcaccgacatccaggtgcagaaggtgacccacgagatgagacagggcctgcacaacatggaggacgtgtacgagctgatcgagaacagccacctgacccccaagaagcagggccagatcagcgaggagtacatgcagaccgtgctgtag

SEQ ID NO: 102499 - DNA, 2295 bp, Artificial Sequence; identical to SEQ ID NO: 102496
  Description of Artificial Sequence: Synthetic coding sequence

SEQ ID NO: 102500 - DNA, 825 bp, Artificial Sequence
  Description of Artificial Sequence: Synthetic coding sequence
atgagacccgccgacctgctgcagctggtgctgctgctggacctgcccagagacctgggcggcatgggctgcagcagccccccctgcgagtgccaccaggaggaggacttcagagtgacctgcaaggacatccagagaatccccagcctgccccccagcacccagaccctgaagctgatcgagacccacctgagaaccatccccagccacgccttcagcaacctgcccaacatcagcagaatctacgtgagcatcgacgtgaccctgcagcagctggagagccacagcttctacaacctgagcaaggtgacccacatcgagatcagaaacaccagaaacctgacctacatcgaccccgacgccctgaaggagctgcccctgctgaagttcctgggcatcttcaacaccggcctgaagatgttccccgacctgaccaaggtgtacagcaccgacatcttcttcatcctggagatcaccgacaacccctacatgaccagcatccccgtgaacgccttccagggcctgtgcaacgagaccctgaccctgaagctgtacaacaacggcttcaccagcgtgcagggctacgccttcaacggcaccaagctggacgccgtgtacctgaacaagaacaagtacctgaccgtgatcgacaaggacgccttcggcggcgtgtacagcggccccagcctgctggtggagaacgtggccgtgagcggcaagggcttctgcaagagcctgttcagctggctgtacagactgcccctgggcagaaagagcctgagcttcgagacccagaaggcccccagaagcagcatgcccagctag

SEQ ID NO: 102501 - DNA, 912 bp, Artificial Sequence
  Description of Artificial Sequence: Synthetic coding sequence
atgagcgacgccggcggcggcaagaagccccccgtggacccccaggccggccccggccccggccccggcagagccgccggcgagagaggcctgagcggcagcttccccctggtgctgaagaagctgatggagaacccccccagagaggccagactggacaaggagaagggcaaggagaagctggaggaggacgaggccgccgccgccagcaccatggccgtgagcgccagcctgatgccccccatctgggacaagaccatcccctacgacggcgagagcttccacctggagtacatggacctggacgagttcctgctggagaacggcatccccgccagccccacccacctggcccacaacctgctgctgcccgtggccgagctggagggcaaggagagcgccagcagcagcaccgccagcccccccagcagcagcaccgccatcttccagcccagcgagaccgtgagcagcaccgagagcagcctggagaaggagagagagacccccagccccatcgaccccaactgcgtggaggtggacgtgaacttcaaccccgaccccgccgacctggtgctgagcagcgtgcccggcggcgagctgttcaaccccagaaagcacaagttcgccgaggaggacctgaagccccagcccatgatcaagaaggccaagaaggtgttcgtgcccgacgagcagaaggacgagaagtactggaccagaagaaagaagaacaacgtggccgccaagagaagcagagacgccagaagactgaaggagaaccagatcaccatcagagccgccttcctggagaaggagaacaccgccctgagaaccgaggtggccgagctgagaaaggaggtgggcaagtgcaagaccatcgtgagcaagtacgagaccaagtacggccccctgtag

SEQ ID NO: 102502 - DNA, 555 bp, Artificial Sequence
  Description of Artificial Sequence: Synthetic coding sequence
tgattcatcttcctgcccagacccggcaccagcctgggcagaatcagaaaggccgacaaggagaagggcaaggagaagctggaggaggacgaggccgccgccgccagcaccatggccgtgagcgccagcctgatgccccccatctgggacaagaccatcccctacgacggcgagagcttccacctggagtacatggacctggacgagttcctgctggagaacggcatccccgccagccccacccacctggcccacaacctgctgctgcccgtggccgagctggagggcaaggagagcgccagcagcagcaccgccagcccccccagcagcagcaccgccatcttccagcccagcgagaccgtgagcagcaccgagagcagcctggagaaggagagagagacccccagccccatcgaccccaactgcgtggaggtggacgtgaacttcaaccccgaccccgccgacctggtgctgagcagcgtgcccggcggcgagctgttcaaccccagaaagcacaagttcgccgaggaggacctgaagccccagcccatgtag

SEQ ID NO: 102503 - DNA, 822 bp, Artificial Sequence
  Description of Artificial Sequence: Synthetic coding sequence
atggacatgcccgaggtgctgaagagcctgctggagcacagcctgccctggcccgagaagagaaccgacaaggagaagggcaaggagaagctggaggaggacgaggccgccgccgccagcaccatggccgtgagcgccagcctgatgccccccatctgggacaagaccatcccctacgacggcgagagcttccacctggagtacatggacctggacgagttcctgctggagaacggcatccccgccagccccacccacctggcccacaacctgctgctgcccgtggccgagctggagggcaaggagagcgccagcagcagcaccgccagcccccccagcagcagcaccgccatcttccagcccagcgagaccgtgagcagcaccgagagcagcctggagaaggagagagagacccccagccccatcgaccccaactgcgtggaggtggacgtgaacttcaaccccgaccccgccgacctggtgctgagcagcgtgcccggcggcgagctgttcaaccccagaaagcacaagttcgccgaggaggacctgaagccccagcccatgatcaagaaggccaagaaggtgttcgtgcccgacgagcagaaggacgagaagtactggaccagaagaaagaagaacaacgtggccgccaagagaagcagagacgccagaagactgaaggagaaccagatcaccatcagagccgccttcctggagaaggagaacaccgccctgagaaccgaggtggccgagctgagaaaggaggtgggcaagtgcaagaccatcgtgagcaagtacgagaccaagtacggccccctgtag

SEQ ID NO: 102504 - DNA, 822 bp, Artificial Sequence; identical to SEQ ID NO: 102503
  Description of Artificial Sequence: Synthetic coding sequence

SEQ ID NO: 102505 - DNA, 729 bp, Artificial Sequence
  Description of Artificial Sequence: Synthetic coding sequence
atgcccggcccctggctgctgctggccctggccctgaccctgaacctgaccggcgtgcccggcggcagagcccagcccgaggccgcccagcaggaggccgtgaccgccgccgagcaccccggcctggacgacttcctgagacaggtggagagactgctgttcctgagagagaacatccagagactgcagggcgaccagggcgagcacagcgccagccagatcttccagagcgactggctgagcaagagacagcaccccggcaagagagaggaggaggaggaggagggcgtggaggaggaggaggaggaggagggcggcgccgtgggcccccacaagagacagcaccccggcagaagagaggacgaggccagctggagcgtggacgtgacccagcacaagagacagcaccccggcagaagaagcccctggctggcctacgccgtgcccaagagacagcaccccggcagaagactggccgaccccaaggcccagagaagctgggaggaggaggaggaggaggaggagagagaggaggacctgatgcccgagaagagacagcaccccggcaagagagccctgggcggcccctgcggcccccagggcgcctacggccaggccggcctgctgctgggcctgctggacgacctgagcagaagccagggcgccgaggagaagagacagcaccccggcagaagagccgcctgggtgagagagcccctggaggagtag

SEQ ID NO: 102506 - DNA, 3075 bp, Artificial Sequence
  Description of Artificial Sequence: Synthetic coding sequence
atgggcgaggacgacgccgccctgagagccggcagcagaggcctgagcgacccctgggccgacagcgtgggcgtgagacccagaaccaccgagagacacatcgccgtgcacaagagactggtgctggccttcgccgtgagcctggtggccctgctggccgtgaccatgctggccgtgctgctgagcctgagattcgacgagtgcggcgccagcgccacccccggcgccgacggcggccccagcggcttccccgagagaggcggcaacggcagcctgcccggcagcgccagaagaaaccaccacgccggcggcgacagctggcagcccgaggccggcggcgtggccagccccggcaccaccagcgcccagccccccagcgaggaggagagagagccctgggagccctggacccagctgagactgagcggccacctgaagcccctgcactacaacctgatgctgaccgccttcatggagaacttcaccttcagcggcgaggtgaacgtggagatcgcctgcagaaacgccaccagatacgtggtgctgcacgccagcagagtggccgtggagaaggtgcagctggccgaggacagagccttcggcgccgtgcccgtggccggcttcttcctgtacccccagacccaggtgctggtggtggtgctgaacagaaccctggacgcccagagaaactacaacctgaagatcatctacaacgccctgatcgagaacgagctgctgggcttcttcagaagcagctacgtgctgcacggcgagagaagattcctgggcgtgacccagttcagccccacccacgccagaaaggccttcccctgcttcgacgagcccatctacaaggccaccttcaagatcagcatcaagcaccaggccacctacctgagcctgagcaacatgcccgtggagaccagcgtgttcgaggaggacggctgggtgaccgaccacttcagccagacccccctgatgagcacctactacctggcctgggccatctgcaacttcacctacagagagaccaccaccaagagcggcgtggtggtgagactgtacgccagacccgacgccatcagaagaggcagcggcgactacgccctgcacatcaccaagagactgatcgagttctacgaggactacttcaaggtgccctacagcctgcccaagctggacctgctggccgtgcccaagcacccctacgccgccatggagaactggggcctgagcatcttcgtggagcagagaatcctgctggaccccagcgtgagcagcatcagctacctgctggacgtgaccatggtgatcgtgcacgagatctgccaccagtggttcggcgacctggtgacccccgtgtggtgggaggacgtgtggctgaaggagggcttcgcccactacttcgagttcgtgggcaccgactacctgtaccccggctggaacatggagaagcagagattcctgaccgacgtgctgcacgaggtgatgctgctggacggcctggccagcagccaccccgtgagccaggaggtgctgcaggccaccgacatcgacagagtgttcgactggatcgcctacaagaagggcgccgccctgatcagaatgctggccaacttcatgggccacagcgtgttccagagaggcctgcaggactacctgaccatccacaagtacggcaacgccgccagaaacgacctgtggaacaccctgagcgaggccctgaagagaaacggcaagtacgtgaacatccaggaggtgatggaccagtggaccctgcagatgggctaccccgtgatcaccatcctgggcaacaccaccgccgagaacagaatcatcatcacccagcagcacttcatctacgacatcagcgccaagaccaaggccctgaagctgcagaacaacagctacctgtggcagatccccctgaccatcgtggtgggcaacagaagccacgtgagcagcgaggccatcatctgggtgagcaacaagagcgagcaccacagaatcacctacctggacaagggcagctggctgctgggcaacatcaaccagaccggctacttcagagtgaactacgacctgagaaactggagactgctgatcgaccagctgatcagaaaccacgaggtgctgagcgtgagcaacagagccggcctgatcgacgacgccttcagcctggccagagccggctacctgccccagaacatccccctggagatcatcagatacctgagcgaggagaaggacttcctgccctggcacgccgccagcagagccctgtaccccctggacaagctgctggacagaatggagaactacaacatcttcaacgagtacatcctgaagcaggtggccaccacctacatcaagctgggctggcccaagaacaacttcaacggcagcctggtgcaggccagctaccagcacgaggagctgagaagagaggtgatcatgctggcctgcagcttcggcaacaagcactgccaccagcaggccagcaccctgatcagcgactggatcagcagcaacagaaacagaatccccctgaacgtgagagacatcgtgtactgcaccggcgtgagcctgctggacgaggacgtgtgggagttcatctggatgaagttccacagcaccaccgccgtgagcgagaagaagatcctgctggaggccctgacctgcagcgacgacagaaacctgctgaacagactgctgaacctgagcctgaacagcgaggtggtgctggaccaggacgccatcgacgtgatcatccacgtggccagaaacccccacggcagagacctggcctggaagttcttcagagacaagtggaagatcctgaacaccagatacggcgaggccctgttcatgaacagcaagctgatcagcggcgtgaccgagttcctgaacaccgagggcgagctgaaggagctgaagaacttcatgaagaactacgacggcgtggccgccgccagcttcagcagagccgtggagaccgtggaggccaacgtgagatggaagatgctgtaccaggacgagctgttccagtggctgggcaaggccctgagacactag

SEQ ID NO: 102507 - DNA, 1197 bp, Artificial Sequence
  Description of Artificial Sequence: Synthetic coding sequence
atggagaacgagaccgtgagcgagctgaaccagacccagctgcagcccagagccgtggtggccctggagtaccaggtggtgaccatcctgctggtgctgatcatctgcggcctgggcatcgtgggcaacatcatggtggtgctggtggtgatgagaaccaagcacatgagaacccccaccaactgctacctggtgagcctggccgtggccgacctgatggtgctggtggccgccggcctgcccaacatcaccgacagcatctacggcagctgggtgtacggctacgtgggctgcctgtgcatcacctacctgcagtacctgggcatcaacgccagcagctgcagcatcaccgccttcaccatcgagagatacatcgccatctgccaccccatcaaggcccagttcctgtgcaccttcagcagagccaagaagatcatcatcttcgtgtgggccttcaccagcctgtactgcatgctgtggttcttcctgctggacctgaacatcagcacctacaaggacgccatcgtgatcagctgcggctacaagatcagcagaaactactacagccccatctacctgatggacttcggcgtgttctacgtggtgcccatgatcctggccaccgtgctgtacggcttcatcgccagaatcctgttcctgaaccccatccccagcgaccccaaggagaacagcaagacctggaagaacgacagcacccaccagaacaccaacctgaacgtgaacaccagcaacagatgcttcaacagcaccgtgagcagcagaaagcaggtgaccaagatgctggccgtggtggtgatcctgttcgccctgctgtggatgccctacagaaccctggtggtggtgaacagcttcctgagcagccccttccaggagaactggttcctgctgttctgcagaatctgcatctacctgaacagcgccatcaaccccgtgatctacaacctgatgagccagaagttcagagccgccttcagaaagctgtgcaactgcaagcagaagcccaccgagaagcccgccaactacagcgtggccctgaactacagcgtgatcaaggagagcgaccacttcagcaccgagctggacgacatcaccgtgaccgacacctacctgagcgccaccaaggtgagcttcgacgacacctgcctggccagcgaggtgagcttcagccagagctag

SEQ ID NO: 102508 - DNA, 1197 bp, Artificial Sequence; identical to SEQ ID NO: 102507
  Description of Artificial Sequence: Synthetic coding sequence

SEQ ID NO: 102509 - DNA, 1128 bp, Artificial Sequence
  Description of Artificial Sequence: Synthetic coding sequence
atggaggacgagatgcccaagaccctgtacgtgggcaacctgagcagagacgtgaccgaggccctgatcctgcagctgttcagccagatcggcccctgcaagaactgcaagatgatcatggacaccgccggcaacgacccctactgcttcgtggagttccacgagcacagacacgccgccgccgccctggccgccatgaacggcagaaagatcatgggcaaggaggtgaaggtgaactgggccaccacccccagcagccagaagaaggacaccagcaaccacttccacgtgttcgtgggcgacctgagccccgagatcaccaccgaggacatcaaggccgccttcgcccccttcggcagaatcagcgacgccagagtggtgaaggacatggccaccggcaagagcaagggctacggcttcgtgagcttcttcaacaagtgggacgccgagaacgccatccagcagatgggcggccagtggctgggcggcagacagatcagaaccaactgggccaccagaaagccccccgcccccaagagcacctacgagagcaacaccaagcagctgagctacgacgaggtggtgaaccagagcagccccagcaactgcaccgtgtactgcggcggcgtgaccagcggcctgaccgagcagctgatgagacagaccttcagccccttcggccagatcatggagatcagagtgttccccgacaagggctacagcttcgtgagattcaacagccacgagagcgccgcccacgccatcgtgagcgtgaacggcaccaccatcgagggccacgtggtgaagtgctactggggcaaggagaccctggacatgatcaaccccgtgcagcagcagaaccagatcggctacccccagccctacggccagtggggccagtggtacggcaacgcccagcagatcggccagtacatgcccaacggctggcaggtgcccgcctacggcatgtacggccaggcctggaaccagcagggcttcaaccagacccagagcagcgccccctggatgggccccaactacggcgtgcagcccccccagggccagaacggcagcatgctgcccaaccagcccagcggctacagagtggccggctacgagacccagtag

SEQ ID NO: 102510 - DNA, 1161 bp, Artificial Sequence
  Description of Artificial Sequence: Synthetic coding sequence
atggaggacgagatgcccaagaccctgtacgtgggcaacctgagcagagacgtgaccgaggccctgatcctgcagctgttcagccagatcggcccctgcaagaactgcaagatgatcatggacaccgccggcaacgacccctactgcttcgtggagttccacgagcacagacacgccgccgccgccctggccgccatgaacggcagaaagatcatgggcaaggaggtgaaggtgaactgggccaccacccccagcagccagaagaaggacaccagcagcagcaccgtggtgagcacccagagaagccaggaccacttccacgtgttcgtgggcgacctgagccccgagatcaccaccgaggacatcaaggccgccttcgcccccttcggcagaatcagcgacgccagagtggtgaaggacatggccaccggcaagagcaagggctacggcttcgtgagcttcttcaacaagtgggacgccgagaacgccatccagcagatgggcggccagtggctgggcggcagacagatcagaaccaactgggccaccagaaagccccccgcccccaagagcacctacgagagcaacaccaagcagctgagctacgacgaggtggtgaaccagagcagccccagcaactgcaccgtgtactgcggcggcgtgaccagcggcctgaccgagcagctgatgagacagaccttcagccccttcggccagatcatggagatcagagtgttccccgacaagggctacagcttcgtgagattcaacagccacgagagcgccgcccacgccatcgtgagcgtgaacggcaccaccatcgagggccacgtggtgaagtgctactggggcaaggagaccctggacatgatcaaccccgtgcagcagcagaaccagatcggctacccccagccctacggccagtggggccagtggtacggcaacgcccagcagatcggccagtacatgcccaacggctggcaggtgcccgcctacggcatgtacggccaggcctggaaccagcagggcttcaaccagacccagagcagcgccccctggatgggccccaactacggcgtgcagcccccccagggccagaacggcagcatgctgcccaaccagcccagcggctacagagtggccggctacgagacccagtag

SEQ ID NO: 102511 - DNA, 1392 bp, Artificial Sequence
  Description of Artificial Sequence: Synthetic coding sequence
cccctggtgagcagagagacccccctgagctgcagccacaacagactgaacgacctgggcggcagcgagggccagggcgccggccccggcggcgccgccgccaccgccgccgccatggaggacgagatgcccaagaccctgtacgtgggcaacctgagcagagacgtgaccgaggccctgatcctgcagctgttcagccagatcggcccctgcaagaactgcaagatgatcatggacaccgccggcaacgacccctactgcttcgtggagttccacgagcacagacacgccgccgccgccctggccgccatgaacggcagaaagatcatgggcaaggaggtgaaggtgaactgggccaccacccccagcagccagaagaaggacaccagcagcagcaccgtggtgagcacccagagaagccaggaccacttccacgtgttcgtgggcgacctgagccccgagatcaccaccgaggacatcaaggccgccttcgcccccttcggcagaatcagcgacgccagagtggtgaaggacatggccaccggcaagagcaagggctacggcttcgtgagcttcttcaacaagtgggacgccgagaacgccatccagcagatgggcggccagtggctgggcggcagacagatcagaaccaactgggccaccagaaagccccccgcccccaagagcacctacgagtgcagatgcatcggcgaggagaaggagatgtggaacttcggcgagaagtacgccagattctgcagcagaagactgatcgccgagatcgacgagaagcagatcaagaccaccatccagaagagcaacaccaagcagctgagctacgacgaggtggtgaaccagagcagccccagcaactgcaccgtgtactgcggcggcgtgaccagcggcctgaccgagcagctgatgagacagaccttcagccccttcggccagatcatggagatcagagtgttccccgacaagggctacagcttcgtgagattcaacagccacgagagcgccgcccacgccatcgtgagcgtgaacggcaccaccatcgagggccacgtggtgaagtgctactggggcaaggagaccctggacatgatcaaccccgtgcagcagaaccagatcggctacccccagccctacggccagtggggccagtggtacggcaacgcccagcagatcggccagtacatgcccaacggctggcaggtgcccgcctacggcatgtacggccaggcctggaaccagcagggcttcaaccagacccagagcagcgccccctggatgggccccaactacggcgtgcagcccccccagggccagaacggcagcatgctgcccaaccagcccagcggctacagagtggccggctacgagacccagtag

SEQ ID NO: 102512 - DNA, 258 bp, Artificial Sequence
  Description of Artificial Sequence: Synthetic coding sequence
atgatcaccgagcacaccagcaacgacccctactgcttcgtggagttctacgagcacagagacgccgccgccgccctggccgccatgaacggcagaaagatcctgggcaaggaggtgaaggtgaactgggccaccacccccagcagccagaagaaggacaccagcaaccacttccacgtgttcgtgggcgacctgagccccgagatcaccaccgaggacatcaagagcgccttcgcccccttcggcaagatcagctag

SEQ ID NO: 102513 - DNA, 759 bp, Artificial Sequence
  Description of Artificial Sequence: Synthetic coding sequence
atggacgccagagtggtgaaggacatggccaccggcaagagcaagggctacggcttcgtgagcttctacaacaagctggacgccgagaacgccatcgtgcacatgggcggccagtggctgggcggcagacagatcagaaccaactgggccaccagaaagccccccgcccccaagagcacccaggagaacaacaccaagcagctgagattcgaggacgtggtgaaccagagcagccccaagaactgcaccgtgtactgcggcggcatcgccagcggcctgaccgaccagctgatgagacagaccttcagccccttcggccagatcatggagatcagagtgttccccgagaagggctacagcttcgtgagattcagcacccacgagagcgccgcccacgccatcgtgagcgtgaacggcaccaccatcgagggccacgtggtgaagtgctactggggcaaggagagccccgacatgaccaagaacttccagcaggtggactacagccagtggggccagtggagccaggtgtacggcaacccccagcagtacggccagtacatggccaacggctggcaggtgcccccctacggcgtgtacggccagccctggaaccagcagggcttcggcgtggaccagagccccagcgccgcctggatgggcggcttcggcgcccagcccccccagggccaggcccccccccccgtgatccccccccccaaccaggccggctacggcatggccagctaccagacccagtag

SEQ ID NO: 102514 - DNA, 1179 bp, Artificial Sequence
  Description of Artificial Sequence: Synthetic coding sequence
atgatggaggacgacggccagcccagaaccctgtacgtgggcaacctgagcagagacgtgaccgaggtgctgatcctgcagctgttcagccagatcggcccctgcaagagctgcaagatgatcaccgagcagcccgacagcagaagagtgaacagcagcgtgggcttcagcgtgctgcagcacaccagcaacgacccctactgcttcgtggagttctacgagcacagagacgccgccgccgccctggccgccatgaacggcagaaagatcctgggcaaggaggtgaaggtgaactgggccaccacccccagcagccagaagaaggacaccagcaaccacttccacgtgttcgtgggcgacctgagccccgagatcaccaccgaggacatcaagagcgccttcgcccccttcggcaagatcagcgacgccagagtggtgaaggacatggccaccggcaagagcaagggctacggcttcgtgagcttctacaacaagctggacgccgagaacgccatcgtgcacatgggcggccagtggctgggcggcagacagatcagaaccaactgggccaccagaaagccccccgcccccaagagcacccaggagaacaacaccaagcagctgagattcgaggacgtggtgaaccagagcagccccaagaactgcaccgtgtactgcggcggcatcgccagcggcctgaccgaccagctgatgagacagaccttcagccccttcggccagatcatggagatcagagtgttccccgagaagggctacagcttcgtgagattcagcacccacgagagcgccgcccacgccatcgtgagcgtgaacggcaccaccatcgagggccacgtggtgaagtgctactggggcaaggagagccccgacatgaccaagaacttccagcaggtggactacagccagtggggccagtggagccaggtgtacggcaacccccagcagtacggccagtacatggccaacggctggcaggtgcccccctacggcgtgtacggccagccctggaaccagcagggcttcggcgtggaccagagccccagcgccgcctggatgggcggcttcggcgcccagcccccccagggccaggcccccccccccgtgatccccccccccaaccaggccggctacggcatggccagctaccagacccagtag

SEQ ID NO: 102515 - DNA, 399 bp, Artificial Sequence
  Description of Artificial Sequence: Synthetic coding sequence
atgatcaccgagcacaccagcaacgacccctactgcttcgtggagttctacgagcacagagacgccgccgccgccctggccgccatgaacggcagaaagatcctgggcaaggaggtgaaggtgaactgggccaccacccccagcagccagaagaaggacaccagcaaccacttccacgtgttcgtgggcgacctgagccccgagatcaccaccgaggacatcaagagcgccttcgcccccttcggcaagatcagcgacgccagagtggtgaaggacatggccaccggcaagagcaagggctacggcttcgtgagcttctacaacaagctggacgccgagaacgccatcgtgcacatgggcggccagtggctgggcggcagacagatcagaaccaactag

SEQ ID NO: 102516 - DNA, 1128 bp, Artificial Sequence
  Description of Artificial Sequence: Synthetic coding sequence
atgatggaggacgacggccagcccagaaccctgtacgtgggcaacctgagcagagacgtgaccgaggtgctgatcctgcagctgttcagccagatcggcccctgcaagagctgcaagatgatcaccgagcacaccagcaacgacccctactgcttcgtggagttctacgagcacagagacgccgccgccgccctggccgccatgaacggcagaaagatcctgggcaaggaggtgaaggtgaactgggccaccacccccagcagccagaagaaggacaccagcaaccacttccacgtgttcgtgggcgacctgagccccgagatcaccaccgaggacatcaagagcgccttcgcccccttcggcaagatcagcgacgccagagtggtgaaggacatggccaccggcaagagcaagggctacggcttcgtgagcttctacaacaagctggacgccgagaacgccatcgtgcacatgggcggccagtggctgggcggcagacagatcagaaccaactgggccaccagaaagccccccgcccccaagagcacccaggagaacaacaccaagcagctgagattcgaggacgtggtgaaccagagcagccccaagaactgcaccgtgtactgcggcggcatcgccagcggcctgaccgaccagctgatgagacagaccttcagccccttcggccagatcatggagatcagagtgttccccgagaagggctacagcttcgtgagattcagcacccacgagagcgccgcccacgccatcgtgagcgtgaacggcaccaccatcgagggccacgtggtgaagtgctactggggcaaggagagccccgacatgaccaagaacttccagcaggtggactacagccagtggggccagtggagccaggtgtacggcaacccccagcagtacggccagtacatggccaacggctggcaggtgcccccctacggcgtgtacggccagccctggaaccagcagggcttcggcgtggaccagagccccagcgccgcctggatgggcggcttcggcgcccagcccccccagggccaggcccccccccccgtgatccccccccccaaccaggccggctacggcatggccagctaccagacccagtag

SEQ ID NO: 102517 - DNA, 1776 bp, Artificial Sequence
  Description of Artificial Sequence: Synthetic coding sequence
atggccagcaagtgcagcagcgagagaaagagcagaaccagcctgaccctgaaccagaagctggagatgatcaagctgagcgaggagggcatgagcaaggccgagatcggcagaagactgggcctgctgagacagaccgtgagccaggtggtgaacgccaaggagaagttcctgaaggaggtgaagagcgccacccccatgaacaccagaatgatcagaaagagaaacagcctgatcgccgacatggagaaggtgctggtggtgtggatcgaggaccagaccagcagaaacatccccctgagccagagcctgatccagaacaaggccctgaccctgttcaacagcatgaaggccgagagaggcgtggaggccgccgaggagaagttcgaggccagcagaggctggttcatgagattcaaggagagaagccacttccacaacatcaaggcccagggcgaggccgccagcgccgacgtggaggccgccgccagctaccccgaggccctggccaagatcatcgacgagggcggctacaccaagcagcagatcttcaacgtggacgagaccgccttctactggaagaagatgcccagcagaaccttcatcgccagagaggagaagagcgtgcccggcttcaaggccagcaaggacagactgaccctgctgctgggcgccaacgccgccggcgacttcaagctgaagcccatgctgatctaccacagcgagaaccccagagccctgaagaactacaccaagagcaccctgcccgtgctgtacaagtggaacagcaaggccagaatgaccgcccacctgttcaccgcctggttcaccgagtacttcaagcccaccgtggagacctactgcagcgagaagaagatccccttcaagatcctgctgctgatcgacaacgcccccagccaccccagagccctgatggagatctacgaggagatcaacgtgatcttcatgcccgccaacaccaccagcatcctgcagcccatggaccagggcgtgatcagcaccttcaagagctactacctgagaaacaccttccacaaggccctggccgccatggacagcgacgtgagcgacggcagcggccagagcaagctgaagaccttctggaagggcttcaccatcctggacgccatcaagaacatcagagacagctgggaggaggtgaagctgagcaccctgaccggcgtgtggaagaagctgatccccaccctgatcgacgactacgagggcttcaagaccagcgtggaggaggtgagcgccgacgtggtggagatcgccaaggagctggagctggaggtggagcccgaggacgtgaccgagctgctgcagagccacgacaagaccctgaccgacgaggagctgttcctgatggacgcccagagaaagtggttcctggagatggagagcacccccggcgaggacgccgtgaacatcgtggagatgaccaccaaggacctggagtactacatcaacctggtggacaaggccgccgccggcttcgagagaatcgacagcaacttcgagagaagcagcaccgtgggcaagatgctgagcaacagcatcgcctgctacagagagatcttccacgagagaaagagccagctgatgagaaaggccagccccatgagctacttcagaaagctgccccagcccccccagcccagcgccgccaccaccctgaccagccagcagcccagcaccagcagacaggaccccccccccgccaagagagtgagactgaccgagggcagcgactag

SEQ ID NO: 102518 - DNA, 1578 bp, Artificial Sequence
  Description of Artificial Sequence: Synthetic coding sequence
atgctgggcaagagaaagagagtggtgctgaccatcaaggacaagctggacatcatcaagaagctggaggagggcatcagcttcaagaagctgagcgtggtgtacggcatcggcgagagcaccgtgagagacatcaagaagaacaaggagagaatcatcaactacgccaacagcagcgaccccaccagcggcgtgagcaagagaaagagcatgaagagcagcacctacgaggagctggacagagtgatgatcgagtggttcaaccagcagaagaccgacggcatccccgtgagcggcaccatctgcgccaagcaggccaagttcttcttcgacgccctgggcatggagggcgacttcaacgccagcagcggctggctgaccagattcaagcagagacacggcatccccaaggccgccggcaagggcaccaagctgaagggcgacgagaccgccgccagagagttctgcggcagcttccaggagttcgtggagaaggagaacctgcagcccgagcagatctacggcgccgaccagaccggcctgttctggaagtgcctgcccagcagaaccctgaccctggagaccgaccagagcaccagcggctgcagaagcagcagagagagaatcatcatcatgtgctgcgccaacgccaccggcctgcacaagctgaacctgtgcgtggtgggcaaggccaagaagcccagagccttcaagggcaccgacctgagcaacctgcccgtgacctactacagccagaagggcgcctggatcgagcagagcgtgttcagacagtggttcgagaagtacttcgtgccccaggtgcagaagcacctgaagagcaagggcctgctggagaaggccgtgctgctgctggacttcccccccgccagacccaacgaggagatgctgagcagcgacgacggcagaatcatcgtgaagtacctgccccccaacgtgaccagcctgatccagcccatgagccagggcgtgctggccaccgtgaagagatactacagagccggcctgctgcagaagtacatggacgagggcaacgaccccaagatcttctggaagaacctgaccgtgctggacgccatctacgaggtgagcagagcctggaacatggtgaagagcagcaccatcaccaaggcctggaagaagctgttccccggcaacgaggagaacagcggcatgaacatcgacgagggcgccatcctggccgccaacctggccaccgtgctgcagaacaccgaggagtgcgagcacgtggacatcgagaacatcgaccagtggttcgacagcagaagcagcgacagcagctgccaggtgctgaccgacagcgagagcgccgaggaccagaccaaggccgccgagcagaagcccagcagcaagagcagaaagaccgagctgaaccccgagaagcacatcagccacaaggccgccctggagtggaccgagaacctgctggactacctggagcagcaggacgacatgctgctgagcgacaagctggtgctgagaagactgagaaccatcatcagaaagaagcagaagatccagaacaacaagaaccactag

SEQ ID NO: 102519 - DNA, 1650 bp, Artificial Sequence
  Description of Artificial Sequence: Synthetic coding sequence
atgaacaagagaggcaagtacaccaccctgaacctggaggagaagatgaaggtgctgagcagaatcgaggccggcagaagcctgaagagcgtgatggacgagttcggcatcagcaagagcaccttctacgacatcaagaagaacaagaagctgatcctggacttcgtgctgaagcaggacatgcccctggtgggcgccgagaagagaaagagaaccaccggcgccaagtacggcgacgtggacgacgccgtgtacatgtggtaccagcagaagagaagcgccggcgtgcccgtgagaggcgtggagctgcaggccgccgccgagagattcgccagatgcttcggcagaaccgacttcaaggccagcaccggctggctgttcagattcagaaacagacacgccatcggcaacagaaagggctgcggcgagcaggtgctgagcagcgtgagcgagaacgtggagcccttcagacagaagctgagcatgatcatcaaggaggagaagctgtgcctggcccagctgtacagcggcgacgagaccgacctgttctggaagagcatgcccgagaacagccaggccagcagaaaggacatctgcctgcccggcaagaagatcaacaaggagagactgagcgccttcctgtgcgccaacgccgacggcacccacaagctgaagagcatcatcatcggcaagagcaagctgcccaagagcgtgaaggaggacaccagcaccctgcccgtgatctacaagcccagcaaggacgtgtggttcaccagagagctgttcagcgagtggttcttccagaacttcgtgcccgaggtgagacacttccagctgaacgtgctgagattccacgacgaggacgtgagagccctgctgctgctggacagctgccccgcccaccccagcagcgagagcctgaccagcgaggacggcagaatcaagtgcatgttcttcccccacaacaccagcaccctgatccagcccatgaaccagggcgtgatcctgagctgcaagagactgtacagatggaagcagctggaggagagcctggtgatcttcgaggagagcgacgacgagcaggagaagggcgacaagggcgtgagcaagatcaagatctacaacatcaagagcgccatcttcaactgggccaagagctgggaggaggtgaagcagatcaccatcgccaacgcctgggagaacctgctgtacaagaaggagcccgagtacgacttccagggcctggagcacggcgactacagagagatcctggagaagtgcggcgagctggagaccaagctggacgacgacagagtgtggctgaacggcgacgaggagaagggctgcctgctgaagaccaagggcggcatcaccaaggaggtggtgcagaagggcggcgaggccgagaagcagaccgccgagttcaagctgagcgccgtgagagagagcctggactacctgctggacttcgtggacgccacccccgagttccagagattccacttcaccctgaaggagatgcagcaggagatcgtgaagaagcagttccagagcaagatccacagcagaatcggcagcttcctgaagcccagaccccacaacatcaaggacagcttcagcggccccagcaccagcggcagcaaccactag

SEQ ID NO: 102520 - DNA, 1650 bp, Artificial Sequence; identical to SEQ ID NO: 102519
  Description of Artificial Sequence: Synthetic coding sequence

SEQ ID NO: 102521 - DNA, 1536 bp, Artificial Sequence
  Description of Artificial Sequence: Synthetic coding sequence
atgaacaagagaggcaagtacaccaccctgaacctggaggagaagatgaaggtgctgagcagaatcgaggccggcagaagcctgaagagcgtgatggacgagttcggcatcagcaagagcaccttctacgacatcaagaagaacaagaagctgatcctggacttcgtgctgaagcaggacatgcccctggtgggcgccgagaagagaaagagaaccaccggcgccaagtacggcgacgtggacgacgccgtgtacatgtggtaccagcagaagagaagcgccggcgtgcccgtgagaggcgtggagctgcaggccgccgccgagagattcgccagatgcttcggcagaaccgacttcaaggccagcaccggctggctgttcagattcagaaacagacacgccatcggcaacagaaagggctgcggcgagcaggtgctgagcagcgtgagcgagaacgtggagcccttcagacagaagctgagcatgatcatcaaggaggagaagctgtgcctggcccagctgtacagcggcgacgagaccgacctgttctggaagagcatgcccgagaacagccaggccagcagaaaggacatctgcctgcccggcaagaagatcaacaaggagagactgagcgccttcctgtgcgccaacgccgacggcacccacaagctgaagagcatcatcatcggcaagagcaagctgcccaagagcgtgaaggaggacaccagcaccctgcccgtgatctacaagcccagcaaggacgtgtggttcaccagagagctgttcagcgagtggttcttccagaacttcgtgcccgaggtgagacacttccagctgaacgtgctgagattccacgacgaggacgtgagagccctgctgctgctggacagctgccccgcccaccccagcagcgagagcctgaccagcgaggacggcagaatcaagtgcatgttcttcccccacaacaccagcaccctgatccagcccatgaaccagggcgtgatcctgagctgcaagagactgtacagatggaagcagctggaggagagcctggtgatcttcgaggagagcgacgacgagcaggagaagggcgacaagggcgtgagcaagatcaagatctacaacatcaagagcgccatcttcaactgggccaagagctgggaggaggtgaagcagatcaccatcgccaacgcctgggagaacctgctgtacaagaaggagcccgagtacgacttccagggcctggagcacggcgactacagagagatcctggagaagtgcggcgagctggagaccaagctggacgacgacagagtgtggctgaacggcgacgaggagaagggctgcctgctgaagaccaagggcggcatcaccaaggaggtggtgcagaagggcggcgaggccgagaagcagaccgccgagttcaagctgagcgccgtgagagagagcctggactacctgctggacttcgtggacgccacccccgagttccagagattccacttcaccctgtgcgagttcagcgacgacagctag

SEQ ID NO: 102522 - DNA, 1644 bp, Artificial Sequence
  Description of Artificial Sequence: Synthetic coding sequence
atgaccagcgccgcccccgccaagaagccctacagaaaggccccccccgagcacagagagctgagactggagatccccggcagcagactggagcaggaggagcccctgaccgacgccgagagaatgaagctgctgcaggaggagaacgaggagctgagaagaagactggccagcgccaccagaagaaccgaggccctggagagagagctggagatcggccaggactgcctggagctggagctgggccagagcagagaggagctggacaagttcaaggacaagttcagaagactgcagaacagctacaccgccagccagagaaccaaccaggagctggaggacaagctgcacaccctgatcaagaaggccgagatggacagaaagaccctggactgggagatcgtggagctgaccaacaagctgctggacgccaagaacaccatcaacaagctggaggagctgaacgagagatacagactggactgcaacctggccgtgcagctgctgaagtgcaacaagagccacttcagaaaccacaagttcgccgacctgccctgcgagctgcaggacatggtgagaaagcacctgcacagcggccaggaggccgccagccccggccccgcccccagcctggcccccggcgccgtggtgcccaccagcgtgatcgccagagtgctggagaagcccgagagcctgctgctgaacagcgcccagagcggcagcgccggcagacccctggccgaggacgtgttcgtgcacgtggacatgagcgagggcgtgcccggcgaccccgccagcccccccgcccccggcagccccaccccccagcccaacggcgagtgccacagcctgggcaccgccagaggcagccccgaggaggagctgcccctgcccgccttcgagaagctgaacccctaccccacccccagccccccccaccccctgtaccccggcagaagagtgatcgagttcagcgaggacaaggtgagaatccccagaaacagccccctgcccaactgcacctacgccaccagacaggccatcagcctgagcctggtggaggagggcagcgagagagccagacccagccccgtgcccagcacccccgccagcgcccaggccagcccccaccaccagcccagccccgcccccctgaccctgagcgcccccgccagcagcgccagcagcgaggaggacctgctggtgagctggcagagagccttcgtggacagaacccccccccccgccgccgtggcccagagaaccgccttcggcagagacgccctgcccgagctgcagagacacttcgcccacagccccgccgacagagacgaggtggtgcaggcccccagcgccagacccgaggagagcgagctgctgctgcccaccgagcccgacagcggcttccccagagaggaggaggagctgaacctgcccatcagccccgaggaggagagacagagcctgctgcccatcaacagaggcaccgaggagggccccggcaccagccacaccgagggcagagcctggcccctgcccagcagcagcagaccccagagaagccccaagagaatgggcgtgcaccacctgcacagaaaggacagcctgacccaggcccaggagcagggcaacctgctgaactag

SEQ ID NO: 102523 - DNA, 1644 bp, Artificial Sequence; identical to SEQ ID NO: 102522
  Description of Artificial Sequence: Synthetic coding sequence

SEQ ID NO: 102524 - DNA, 1674 bp, Artificial Sequence
  Description of Artificial Sequence: Synthetic coding sequence
atgaccagcgccgcccccgccaagaagccctacagaaaggccccccccgagcacagagagctgagactggagatccccggcagcagactggagcaggaggagcccctgaccgacgccgagagaatgaagctgctgcaggaggagaacgaggagctgagaagaagactggccagcgccaccagaagaaccgaggccctggagagagagctggagatcggccaggactgcctggagctggagctgggccagagcagagaggagctggacaagttcaaggacaagttcagaagactgcagaacagctacaccgccagccagagaaccaaccaggagctggaggacaagctgcacaccctggccagcctgagccacagctggatcttcgccatcaagaaggccgagatggacagaaagaccctggactgggagatcgtggagctgaccaacaagctgctggacgccaagaacaccatcaacaagctggaggagctgaacgagagatacagactggactgcaacctggccgtgcagctgctgaagtgcaacaagagccacttcagaaaccacaagttcgccgacctgccctgcgagctgcaggacatggtgagaaagcacctgcacagcggccaggaggccgccagccccggccccgcccccagcctggcccccggcgccgtggtgcccaccagcgtgatcgccagagtgctggagaagcccgagagcctgctgctgaacagcgcccagagcggcagcgccggcagacccctggccgaggacgtgttcgtgcacgtggacatgagcgagggcgtgcccggcgaccccgccagcccccccgcccccggcagccccaccccccagcccaacggcgagtgccacagcctgggcaccgccagaggcagccccgaggaggagctgcccctgcccgccttcgagaagctgaacccctaccccacccccagccccccccaccccctgtaccccggcagaagagtgatcgagttcagcgaggacaaggtgagaatccccagaaacagccccctgcccaactgcacctacgccaccagacaggccatcagcctgagcctggtggaggagggcagcgagagagccagacccagccccgtgcccagcacccccgccagcgcccaggccagcccccaccaccagcccagccccgcccccctgaccctgagcgcccccgccagcagcgccagcagcgaggaggacctgctggtgagctggcagagagccttcgtggacagaacccccccccccgccgccgtggcccagagaaccgccttcggcagagacgccctgcccgagctgcagagacacttcgcccacagccccgccgacagagacgaggtggtgcaggcccccagcgccagacccgaggagagcgagctgctgctgcccaccgagcccgacagcggcttccccagagaggaggaggagctgaacctgcccatcagccccgaggaggagagacagagcctgctgcccatcaacagaggcaccgaggagggccccggcaccagccacaccgagggcagagcctggcccctgcccagcagcagcagaccccagagaagccccaagagaatgggcgtgcaccacctgcacagaaaggacagcctgacccaggcccaggagcagggcaacctgctgaactag

SEQ ID NO: 102525 - DNA, 1674 bp, Artificial Sequence; identical to SEQ ID NO: 102524
  Description of Artificial Sequence: Synthetic coding sequence

SEQ ID NO: 102526 - DNA, 1644 bp, Artificial Sequence; identical to SEQ ID NO: 102522
  Description of Artificial Sequence: Synthetic coding sequence

SEQ ID NO: 102527 - DNA, 1644 bp, Artificial Sequence; identical to SEQ ID NO: 102522
  Description of Artificial Sequence: Synthetic coding sequence

SEQ ID NO: 102528 - DNA, 1644 bp, Artificial Sequence; identical to SEQ ID NO: 102522
  Description of Artificial Sequence: Synthetic coding sequence

SEQ ID NO: 102529 - DNA, 1674 bp, Artificial Sequence; identical to SEQ ID NO: 102524
  Description of Artificial Sequence: Synthetic coding sequence

SEQ ID NO: 102530 - DNA, 582 bp, Artificial Sequence
  Description of Artificial Sequence: Synthetic coding sequence
atgaccagcgccgcccccgccaagaagccctacagaaaggccccccccgagcacagagagctgagactggagatccccggcagcagactggagcaggaggagcccctgaccgacgccgagagaatgaagctgctgcaggaggagaacgaggagctgagaagaagactggccagcgccaccagaagaaccgaggccctggagagagagctggagatcggccaggactgcctggagctggagctgggccagagcagagaggagctggacaagttcaaggacaagttcagaagactgcagaacagctacaccgccagccagagaaccaaccaggagctggaggacaagctgcacaccctggccagcctgagccacagctggatcttcgccatcaagaaggccgagatggacagaaagaccctggactgggagatcgtggagctgaccaacaagctgctggacgccaagaacaccatcaacaagctggaggagctgaacgagagatacagactggactgcaacctggccgtgcagctgctgaagtgcaacaagagccacttcagaaaccacaagttcgccgactag

SEQ ID NO: 102531 - DNA, 720 bp, Artificial Sequence
  Description of Artificial Sequence: Synthetic coding sequence
tgactgctgcaggaggagaacgaggagctgagaagaagactggccagcgccaccagaagaaccgaggccctggagagagagctggagatcggccaggactgcctggagctggagctgggccagagcagagaggagctggacaagttcaaggacaagttcagaagactgcagaacagctacaccgccagccagagaaccaaccaggagctggaggacaagctgcacaccctgatcaagaaggccgagatggacagaaagaccctggactgggagatcgtggagctgaccaacaagctgctggacgccaagaacaccatcaacaagctggaggagctgaacgagagatacagactggactgcaacctggccgtgcagctgctgaagtgcaacaagagccacttcagaaaccacaagttcgccgacgtgagcagaacccaccccctgcccgcccacatcgaccacagcggccactgcagaacccccctgacccccgtgagcgcccccctgagcgtgctgctgttccccctgtgcccccccctggccagcatgagccccctgaagcccgtgaacagcgccaccggctggtgccccgtgtactgccccggccccatcaccagcagcggcggccccgccctgctggtgagcgtgaccgagaccgagagagaggaccccggccaggagggcgagggcagccagagctacctgcccaaggagtactag

SEQ ID NO: 102532 - DNA, 5247 bp, Artificial Sequence
  Description of Artificial Sequence: Synthetic coding sequence
atgagcgccagagccgccgccgccaagagcaccgccatggaggagaccgccatctgggagcagcacaccgtgaccctgcacagagcccccggcttcggcttcggcatcgccatcagcggcggcagagacaacccccacttccagagcggcgagaccagcatcgtgatcagcgacgtgctgaagggcggccccgccgagggccagctgcaggagaacgacagagtggccatggtgaacggcgtgagcatggacaacgtggagcacgccttcgccgtgcagcagctgagaaagagcggcaagaacgccaagatcaccatcagaagaaagaagaaggtgcagatccccgtgagcagacccgaccccgagcccgtgagcgacaacgaggaggacagctacgacgaggagatccacgaccccagaagcggcagaagcggcgtggtgaacagaagaagcgagaagatctggcccagagacagaagcgccagcagagagagaagcctgagccccagaagcgacagaagaagcgtggccagcagccagcccgccaagcccaccaaggtgaccctggtgaagagcagaaagaacgaggagtacggcctgagactggccagccacatcttcgtgaaggagatcagccaggacagcctggccgccagagacggcaacatccaggagggcgacgtggtgctgaagatcaacggcaccgtgaccgagaacatgagcctgaccgacgccaagaccctgatcgagagaagcaagggcaagctgaagatggtggtgcagagagacgagagagccaccctgctgaacgtgcccgacctgagcgacagcatccacagcgccaacgccagcgagagagacgacatcagcgagatccagagcctggccagcgaccacagcggcagaagccacgacagaccccccagaagaagcagaagcagaagccccgaccagagaagcgagcccagcgaccacagcagacacagcccccagcagcccagcaacggcagcctgagaagcagagacgaggagagaatcagcaagcccggcgccgtgagcacccccgtgaagcacgccgacgaccacacccccaagaccgtggaggaggtgaccgtggagagaaacgagaagcagacccccagcctgcccgagcccaagcccgtgtacgcccaggtgggccagcccgacgtggacctgcccgtgagccccagcgacggcgtgctgcccaacagcacccacgaggacggcatcctgagacccagcatgaagctggtgaagttcagaaagggcgacagcgtgggcctgagactggccggcggcaacgacgtgggcatcttcgtggccggcgtgctggaggacagccccgccgccaaggagggcctggaggagggcgaccagatcctgagagtgaacaacgtggacttcaccaacatcatcagagaggaggccgtgctgttcctgctggacctgcccaagggcgaggaggtgaccatcctggcccagaagaagaaggacgtgtacagaagaatcgtggagagcgacgtgggcgacagcttctacatcagaacccacttcgagtacgagaaggagagcccctacggcctgagcttcaacaagggcgaggtgttcagagtggtggacaccctgtacaacggcaagctgggcagctggctggccatcagaatcggcaagaaccacaaggaggtggagagaggcatcatccccaacaagaacagagccgagcagctggccagcgtgcagtacaccctgcccaagaccgccggcggcgacagagccgacttctggagattcagaggcctgagaagcagcaagagaaacctgagaaagagcagagaggacctgagcgcccagcccgtgcagaccaagttccccgcctacgagagagtggtgctgagagaggccggcttcctgagacccgtgaccatcttcggccccatcgccgacgtggccagagagaagctggccagagaggagcccgacatctaccagatcgccaagagcgagcccagagacgccggcaccgaccagagaagcagcggcatcatcagactgcacaccatcaagcagatcatcgaccaggacaagcacgccctgctggacgtgacccccaacgccgtggacagactgaactacgcccagtggtaccccatcgtggtgttcctgaaccccgacagcaagcagggcgtgaagaccatgagaatgagactgtgccccgagagcagaaagagcgccagaaagctgtacgagagaagccacaagctgagaaagaacaaccaccacctgttcaccaccaccatcaacctgaacagcatgaacgacggctggtacggcgccctgaaggaggccatccagcagcagcagaaccagctggtgtgggtgagcgagggcaaggccgacggcgccaccagcgacgacctggacctgcacgacgacagactgagctacctgagcgcccccggcagcgagtacagcatgtacagcaccgacagcagacacaccagcgactacgaggacaccgacaccgagggcggcgcctacaccgaccaggagctggacgagaccctgaacgacgaggtgggcaccccccccgagagcgccatcaccagaagcagcgagcccgtgagagaggacagcagcggcatgcaccacgagaaccagacctaccccccctacagcccccaggcccagccccagcccatccacagaatcgacagccccggcttcaagcccgccagccagcagaaggccgaggccagcagccccgtgccctacctgagccccgagaccaaccccgccagcagcaccagcgccgtgaaccacaacgtgaacctgaccaacgtgagactggaggagcccacccccgcccccagcaccagctacagcccccaggccgacagcctgagaacccccagcaccgaggccgcccacatcatgctgagagaccaggagcccagcctgagcagccacgtggaccccaccaaggtgtacagaaaggacccctaccccgaggagatgatgagacagaaccacgtgctgaagcagcccgccgtgagccaccccggccacagacccgacaaggagcccaacctgacctacgagccccagctgccctacgtggagaagcaggccagcagagacctggagcagcccacctacagatacgagagcagcagctacaccgaccagttcagcagaaactacgagcacagactgagatacgaggacagagtgcccatgtacgaggagcagtggagctactacgacgacaagcagccctaccccagcagaccccccttcgacaaccagcacagccaggacctggacagcagacagcaccccgaggagagcagcgagagaggctacttccccagattcgaggagcccgcccccctgagctacgacagcagacccagatacgagcaggcccccagagccagcgccctgagacacgaggagcagcccgcccccggctacgacacccacggcagactgagacccgaggcccagccccaccccagcgccggccccaagcccgccgagagcaagcagtacttcgagcagtacagcagaagctacgagcaggtgcccccccagggcttcaccagcagagccggccacttcgagcccctgcacggcgccgccgccgtgccccccctgatccccagcagccagcacaagcccgaggccctgcccagcaacaccaagcccctgccccccccccccacccagaccgaggaggaggaggaccccgccatgaagccccagagcgtgctgaccagagtgaagatgttcgagaacaagagaagcgccagcctggagaccaagaaggacgtgaacgacaccggcagcttcaagccccccgaggtggccagcaagcccagcggcgcccccatcatcggccccaagcccaccagccagaaccagttcagcgagcacgacaagaccctgtacagaatccccgagccccagaagccccagctgaagccccccgaggacatcgtgagaagcaaccactacgaccccgaggaggacgaggagtactacagaaagcagctgagctacttcgacagaagaagcttcgagaacaagccccccgcccacatcgccgccagccacctgagcgagcccgccaagcccgcccacagccagaaccagagcaacttcagcagctacagcagcaagggcaagccccccgaggccgacggcgtggacagaagcttcggcgagaagagatacgagcccatccaggccacccccccccccccccccctgcccagccagtacgcccagcccagccagcccgtgaccagcgccagcctgcacatccacagcaagggcgcccacggcgagggcaacagcgtgagcctggacttccagaacagcctggtgagcaagcccgaccccccccccagccagaacaagcccgccaccttcagaccccccaacagagaggacaccgcccaggccgccttctacccccagaagagcttccccgacaaggcccccgtgaacggcaccgagcagacccagaagaccgtgacccccgcctacaacagattcacccccaagccctacaccagcagcgccagacccttcgagagaaagttcgagagccccaagttcaaccacaacctgctgcccagcgagaccgcccacaagcccgacctgagcagcaagacccccaccagccccaagaccctggtgaagagccacagcctggcccagccccccgagttcgacagcggcgtggagaccttcagcatccacgccgagaagcccaagtaccagatcaacaacatcagcaccgtgcccaaggccatccccgtgagccccagcgccgtggaggaggacgaggacgaggacggccacaccgtggtggccaccgccagaggcatcttcaacagcaacggcggcgtgctgagcagcatcgagaccggcgtgagcatcatcatcccccagggcgccatccccgagggcgtggagcaggagatctacttcaaggtgtgcagagacaacagcatcctgccccccctggacaaggagaagggcgagaccctgctgagccccctggtgatgtgcggcccccacggcctgaagttcctgaagcccgtggagctgagactgccccactgcgaccccaagacctggcagaacaagtgcctgcccggcgaccccaactacctggtgggcgccaactgcgtgagcgtgctgatcgaccacttctag

SEQ ID NO: 102533 - DNA, 5007 bp, Artificial Sequence
  Description of Artificial Sequence: Synthetic coding sequence
atgagcgccagagccgccgccgccaagagcaccgccatggaggagaccgccatctgggagcagcacaccgtgaccctgcacagagcccccggcttcggcttcggcatcgccatcagcggcggcagagacaacccccacttccagagcggcgagaccagcatcgtgatcagcgacgtgctgaagggcggccccgccgagggccagctgcaggagaacgacagagtggccatggtgaacggcgtgagcatggacaacgtggagcacgccttcgccgtgcagcagctgagaaagagcggcaagaacgccaagatcaccatcagaagaaagaagaaggtgcagatccccgtgagcagacccgaccccgagcccgtgagcgacaacgaggaggacagctacgacgaggagatccacgaccccagaagcggcagaagcggcgtggtgaacagaagaagcgagaagatctggcccagagacagaagcgccagcagagagagaagcctgagccccagaagcgacagaagaagcgtggccagcagccagcccgccaagcccaccaaggtgaccctggtgaagagcagaaagaacgaggagtacggcctgagactggccagccacatcttcgtgaaggagatcagccaggacagcctggccgccagagacggcaacatccaggagggcgacgtggtgctgaagatcaacggcaccgtgaccgagaacatgagcctgaccgacgccaagaccctgatcgagagaagcaagggcaagctgaagatggtggtgcagagagacgagagagccaccctgctgaacgtgcccgacctgagcgacagcatccacagcgccaacgccagcgagagagacgacatcagcgagatccagagcctggccagcgaccacagcggcagaagccacgacagaccccccagaagaagcagaagcagaagccccgaccagagaagcgagcccagcgaccacagcagacacagcccccagcagcccagcaacggcagcctgagaagcagagacgaggagagaatcagcaagcccggcgccgtgagcacccccgtgaagcacgccgacgaccacacccccaagaccgtggaggaggtgaccgtggagagaaacgagaagcagacccccagcctgcccgagcccaagcccgtgtacgcccaggtgggccagcccgacgtggacctgcccgtgagccccagcgacggcgtgctgcccaacagcacccacgaggacggcatcctgagacccagcatgaagctggtgaagttcagaaagggcgacagcgtgggcctgagactggccggcggcaacgacgtgggcatcttcgtggccggcgtgctggaggacagccccgccgccaaggagggcctggaggagggcgaccagatcctgagagtgaacaacgtggacttcaccaacatcatcagagaggaggccgtgctgttcctgctggacctgcccaagggcgaggaggtgaccatcctggcccagaagaagaaggacgtgtacagaagaatcgtggagagcgacgtgggcgacagcttctacatcagaacccacttcgagtacgagaaggagagcccctacggcctgagcttcaacaagggcgaggtgttcagagtggtggacaccctgtacaacggcaagctgggcagctggctggccatcagaatcggcaagaaccacaaggaggtggagagaggcatcatccccaacaagaacagagccgagcagctggccagcgtgcagtacaccctgcccaagaccgccggcggcgacagagccgacttctggagattcagaggcctgagaagcagcaagagaaacctgagaaagagcagagaggacctgagcgcccagcccgtgcagaccaagttccccgcctacgagagagtggtgctgagagaggccggcttcctgagacccgtgaccatcttcggccccatcgccgacgtggccagagagaagctggccagagaggagcccgacatctaccagatcgccaagagcgagcccagagacgccggcaccgaccagagaagcagcggcatcatcagactgcacaccatcaagcagatcatcgaccaggacaagcacgccctgctggacgtgacccccaacgccgtggacagactgaactacgcccagtggtaccccatcgtggtgttcctgaaccccgacagcaagcagggcgtgaagaccatgagaatgagactgtgccccgagagcagaaagagcgccagaaagctgtacgagagaagccacaagctgagaaagaacaaccaccacctgttcaccaccaccatcaacctgaacagcatgaacgacggctggtacggcgccctgaaggaggccatccagcagcagcagaaccagctggtgtgggtgagcgagggcaaggccgacggcgccaccagcgacgacctggacctgcacgacgacagactgagctacctgagcgcccccggcagcgagtacagcatgtacagcaccgacagcagacacaccagcgactacgaggacaccgacaccgagggcggcgcctacaccgaccaggagctggacgagaccctgaacgacgaggtgggcaccccccccgagagcgccatcaccagaagcagcgagcccgtgagagaggacagcagcggcatgcaccacgagaaccagacctaccccccctacagcccccaggcccagccccagcccatccacagaatcgacagccccggcttcaagcccgccagccagcaggtgtacagaaaggacccctaccccgaggagatgatgagacagaaccacgtgctgaagcagcccgccgtgagccaccccggccacagacccgacaaggagcccaacctgacctacgagccccagctgccctacgtggagaagcaggccagcagagacctggagcagcccacctacagatacgagagcagcagctacaccgaccagttcagcagaaactacgagcacagactgagatacgaggacagagtgcccatgtacgaggagcagtggagctactacgacgacaagcagccctaccccagcagaccccccttcgacaaccagcacagccaggacctggacagcagacagcaccccgaggagagcagcgagagaggctacttccccagattcgaggagcccgcccccctgagctacgacagcagacccagatacgagcaggcccccagagccagcgccctgagacacgaggagcagcccgcccccggctacgacacccacggcagactgagacccgaggcccagccccaccccagcgccggccccaagcccgccgagagcaagcagtacttcgagcagtacagcagaagctacgagcaggtgcccccccagggcttcaccagcagagccggccacttcgagcccctgcacggcgccgccgccgtgccccccctgatccccagcagccagcacaagcccgaggccctgcccagcaacaccaagcccctgccccccccccccacccagaccgaggaggaggaggaccccgccatgaagccccagagcgtgctgaccagagtgaagatgttcgagaacaagagaagcgccagcctggagaccaagaaggacgtgaacgacaccggcagcttcaagccccccgaggtggccagcaagcccagcggcgcccccatcatcggccccaagcccaccagccagaaccagttcagcgagcacgacaagaccctgtacagaatccccgagccccagaagccccagctgaagccccccgaggacatcgtgagaagcaaccactacgaccccgaggaggacgaggagtactacagaaagcagctgagctacttcgacagaagaagcttcgagaacaagccccccgcccacatcgccgccagccacctgagcgagcccgccaagcccgcccacagccagaaccagagcaacttcagcagctacagcagcaagggcaagccccccgaggccgacggcgtggacagaagcttcggcgagaagagatacgagcccatccaggccacccccccccccccccccctgcccagccagtacgcccagcccagccagcccgtgaccagcgccagcctgcacatccacagcaagggcgcccacggcgagggcaacagcgtgagcctggacttccagaacagcctggtgagcaagcccgaccccccccccagccagaacaagcccgccaccttcagaccccccaacagagaggacaccgcccaggccgccttctacccccagaagagcttccccgacaaggcccccgtgaacggcaccgagcagacccagaagaccgtgacccccgcctacaacagattcacccccaagccctacaccagcagcgccagacccttcgagagaaagttcgagagccccaagttcaaccacaacctgctgcccagcgagaccgcccacaagcccgacctgagcagcaagacccccaccagccccaagaccctggtgaagagccacagcctggcccagccccccgagttcgacagcggcgtggagaccttcagcatccacgccgagaagcccaagtaccagatcaacaacatcagcaccgtgcccaaggccatccccgtgagccccagcgccgtggaggaggacgaggacgaggacggccacaccgtggtggccaccgccagaggcatcttcaacagcaacggcggcgtgctgagcagcatcgagaccggcgtgagcatcatcatcccccagggcgccatccccgagggcgtggagcaggagatctacttcaaggtgtgcagagacaacagcatcctgccccccctggacaaggagaagggcgagaccctgctgagccccctggtgatgtgcggcccccacggcctgaagttcctgaagcccgtggagctgagactgccccactgcgaccccaagacctggcagaacaagtgcctgcccggcgaccccaactacctggtgggcgccaactgcgtgagcgtgctgatcgaccacttctag

SEQ ID NO: 102534 - DNA, 2982 bp, Artificial Sequence
  Description of Artificial Sequence: Synthetic coding sequence
atgcccgtgagaggcgacagaggcttcccccccagaagagagctgagcggctggctgagagcccccggcatggaggagctgatctgggagcagtacaccgtgaccctgcagaaggacagcaagagaggcttcggcatcgccgtgagcggcggcagagacaacccccacttcgagaacggcgagaccagcatcgtgatcagcgacgtgctgcccggcggccccgccgacggcctgctgcaggagaacgacagagtggtgatggtgaacggcacccccatggaggacgtgctgcacagcttcgccgtgcagcagctgagaaagagcggcaaggtggccgccatcgtggtgaagagacccagaaaggtgcaggtggccgccctgcaggccagcccccccctggaccaggacgacagagccttcgaggtgatggacgagttcgacggcagaagcttcagaagcggctacagcgagagaagcagactgaacagccacggcggcagaagcagaagctgggaggacagccccgagagaggcagaccccacgagagagccagaagcagagagagagacctgagcagagacagaagcagaggcagaagcctggagagaggcctggaccaggaccacgccagaaccagagacagaagcagaggcagaagcctggagagaggcctggaccacgacttcggccccagcagagacagagacagagacagaagcagaggcagaagcatcgaccaggactacgagagagcctaccacagagcctacgaccccgactacgagagagcctacagccccgagtacagaagaggcgccagacacgacgccagaagcagaggccccagaagcagaagcagagagcacccccacagcagaagccccagccccgagcccagaggcagacccggccccatcggcgtgctgctgatgaagagcagagccaacgaggagtacggcctgagactgggcagccagatcttcgtgaaggagatgaccagaaccggcctggccaccaaggacggcaacctgcacgagggcgacatcatcctgaagatcaacggcaccgtgaccgagaacatgagcctgaccgacgccagaaagctgatcgagaagagcagaggcaagctgcagctggtggtgctgagagacagccagcagaccctgatcaacatccccagcctgaacgacagcgacagcgagatcgaggacatcagcgagatcgagagcaacagaagcttcagccccgaggagagaagacaccagtacagcgactacgactaccacagcagcagcgagaagctgaaggagagacccagcagcagagaggacacccccagcagactgagcagaatgggcgccacccccacccccttcaagagcaccggcgacatcgccggcaccgtggtgcccgagaccaacaaggagcccagataccaggaggacccccccgccccccagcccaaggccgcccccagaaccttcctgagacccagccccgaggacgaggccatctacggccccaacaccaagatggtgagattcaagaagggcgacagcgtgggcctgagactggccggcggcaacgacgtgggcatcttcgtggccggcatccaggagggcaccagcgccgagcaggagggcctgcaggagggcgaccagatcctgaaggtgaacacccaggacttcagaggcctggtgagagaggacgccgtgctgtacctgctggagatccccaagggcgagatggtgaccatcctggcccagagcagagccgacgtgtacagagacatcctggcctgcggcagaggcgacagcttcttcatcagaagccacttcgagtgcgagaaggagaccccccagagcctggccttcaccagaggcgaggtgttcagagtggtggacaccctgtacgacggcaagctgggcaactggctggccgtgagaatcggcaacgagctggagaagggcctgatccccaacaagagcagagccgagcagatggccagcgtgcagaacgcccagagagacaacgccggcgacagagccgacttctggagaatgagaggccagagaagcggcgtgaagaagaacctgagaaagagcagagaggacctgaccgccgtggtgagcgtgagcaccaagttccccgcctacgagagagtgctgctgagagaggccggcttcaagagacccgtggtgctgttcggccccatcgccgacatcgccatggagaagctggccaacgagctgcccgactggttccagaccgccaagaccgagcccaaggacgccggcagcgagaagagcaccggcgtggtgagactgaacaccgtgagacagatcatcgagcaggacaagcacgccctgctggacgtgacccccaaggccgtggacctgctgaactacacccagtggttccccatcgtgatcttcttcaaccccgacagcagacagggcgtgaagaccatgagacagagactgaaccccaccagcaacaagagcagcagaaagctgttcgaccaggccaacaagctgaagaagacctgcgcccacctgttcaccgccaccatcaacctgaacagcgccaacgacagctggttcggcagcctgaaggacaccatccagcaccagcagggcgaggccgtgtgggtgagcgagggcaagatggagggcatggacgacgaccccgaggacagaatgagctacctgaccgccatgggcgccgactacctgagctgcgacagcagactgatcagcgacttcgaggacaccgacggcgagggcggcgcctacaccgacaacgagctggacgagcccgccgaggagcccctggtgagcagcatcaccagaagcagcgagcccgtgcagcacgaggaggtgagaagaggcagacccagagccggcaccggcgagcccggcgtgttcctggccctgagctggaccgccgtgtgcagcggctgctgcggcagacacagctag

SEQ ID NO: 102535 - DNA, 3132 bp, Artificial Sequence
  Description of Artificial Sequence: Synthetic coding sequence
atgcccgtgagaggcgacagaggcttcccccccagaagagagctgagcggctggctgagagcccccggcatggaggagctgatctgggagcagtacaccgtgaccctgcagaaggacagcaagagaggcttcggcatcgccgtgagcggcggcagagacaacccccacttcgagaacggcgagaccagcatcgtgatcagcgacgtgctgcccggcggccccgccgacggcctgctgcaggagaacgacagagtggtgatggtgaacggcacccccatggaggacgtgctgcacagcttcgccgtgcagcagctgagaaagagcggcaaggtggccgccatcgtggtgaagagacccagaaaggtgcaggtggccgccctgcaggccagcccccccctggaccaggacgacagagccttcgaggtgatggacgagttcgacggcagaagcttcagaagcggctacagcgagagaagcagactgaacagccacggcggcagaagcagaagctgggaggacagccccgagagaggcagaccccacgagagagccagaagcagagagagagacctgagcagagacagaagcagaggcagaagcctggagagaggcctggaccaggaccacgccagaaccagagacagaagcagaggcagaagcctggagagaggcctggaccacgacttcggccccagcagagacagagacagagacagaagcagaggcagaagcatcgaccaggactacgagagagcctaccacagagcctacgaccccgactacgagagagcctacagccccgagtacagaagaggcgccagacacgacgccagaagcagaggccccagaagcagaagcagagagcacccccacagcagaagccccagccccgagcccagaggcagacccggccccatcggcgtgctgctgatgaagagcagagccaacgaggagtacggcctgagactgggcagccagatcttcgtgaaggagatgaccagaaccggcctggccaccaaggacggcaacctgcacgagggcgacatcatcctgaagatcaacggcaccgtgaccgagaacatgagcctgaccgacgccagaaagctgatcgagaagagcagaggcaagctgcagctggtggtgctgagagacagccagcagaccctgatcaacatccccagcctgaacgacagcgacagcgagatcgaggacatcagcgagatcgagagcaacagaagcttcagccccgaggagagaagacaccagtacagcgactacgactaccacagcagcagcgagaagctgaaggagagacccagcagcagagaggacacccccagcagactgagcagaatgggcgccacccccacccccttcaagagcaccggcgacatcgccggcaccgtggtgcccgagaccaacaaggagcccagataccaggaggacccccccgccccccagcccaaggccgcccccagaaccttcctgagacccagccccgaggacgaggccatctacggccccaacaccaagatggtgagattcaagaagggcgacagcgtgggcctgagactggccggcggcaacgacgtgggcatcttcgtggccggcatccaggagggcaccagcgccgagcaggagggcctgcaggagggcgaccagatcctgaaggtgaacacccaggacttcagaggcctggtgagagaggacgccgtgctgtacctgctggagatccccaagggcgagatggtgaccatcctggcccagagcagagccgacgtgtacagagacatcctggcctgcggcagaggcgacagcttcttcatcagaagccacttcgagtgcgagaaggagaccccccagagcctggccttcaccagaggcgaggtgttcagagtggtggacaccctgtacgacggcaagctgggcaactggctggccgtgagaatcggcaacgagctggagaagggcctgatccccaacaagagcagagccgagcagatggccagcgtgcagaacgcccagagagacaacgccggcgacagagccgacttctggagaatgagaggccagagaagcggcgtgaagaagaacctgagaaagagcagagaggacctgaccgccgtggtgagcgtgagcaccaagttccccgcctacgagagagtgctgctgagagaggccggcttcaagagacccgtggtgctgttcggccccatcgccgacatcgccatggagaagctggccaacgagctgcccgactggttccagaccgccaagaccgagcccaaggacgccggcagcgagaagagcaccggcgtggtgagactgaacaccgtgagacagatcatcgagcaggacaagcacgccctgctggacgtgacccccaaggccgtggacctgctgaactacacccagtggttccccatcgtgatcttcttcaaccccgacagcagacagggcgtgaagaccatgagacagagactgaaccccaccagcaacaagagcagcagaaagctgttcgaccaggccaacaagctgaagaagacctgcgcccacctgttcaccgccaccatcaacctgaacagcgccaacgacagctggttcggcagcctgaaggacaccatccagcaccagcagggcgaggccgtgtgggtgagcgagggcaagatggagggcatggacgacgaccccgaggacagaatgagctacctgaccgccatgggcgccgactacctgagctgcgacagcagactgatcagcgacttcgaggacaccgacggcgagggcggcgcctacaccgacaacgagctggacgagcccgccgaggagcccctggtgagcagcatcaccagaagcagcgagcccgtgcagcacgaggagatcgagatcgcccagaagcaccccgacatctacgccgtgcccatcaagacccacaagcccgaccccggcaccccccagcacaccagcagcagaccccccgagccccagaaggcccccagcagaccctaccaggacaccagaggcagctacggcagcgacgccgaggaggaggagtacagacagcagctgagcgagcacagcaagagaggctactacggccagagcgccagatacagagacaccgagctgtag

SEQ ID NO: 102536 - DNA, 3573 bp, Artificial Sequence
  Description of Artificial Sequence: Synthetic coding sequence
atgcccgtgagaggcgacagaggcttcccccccagaagagagctgagcggctggctgagagcccccggcatggaggagctgatctgggagcagtacaccgtgaccctgcagaaggacagcaagagaggcttcggcatcgccgtgagcggcggcagagacaacccccacttcgagaacggcgagaccagcatcgtgatcagcgacgtgctgcccggcggccccgccgacggcctgctgcaggagaacgacagagtggtgatggtgaacggcacccccatggaggacgtgctgcacagcttcgccgtgcagcagctgagaaagagcggcaaggtggccgccatcgtggtgaagagacccagaaaggtgcaggtggccgccctgcaggccagcccccccctggaccaggacgacagagccttcgaggtgatggacgagttcgacggcagaagcttcagaagcggctacagcgagagaagcagactgaacagccacggcggcagaagcagaagctgggaggacagccccgagagaggcagaccccacgagagagccagaagcagagagagagacctgagcagagacagaagcagaggcagaagcctggagagaggcctggaccaggaccacgccagaaccagagacagaagcagaggcagaagcctggagagaggcctggaccacgacttcggccccagcagagacagagacagagacagaagcagaggcagaagcatcgaccaggactacgagagagcctaccacagagcctacgaccccgactacgagagagcctacagccccgagtacagaagaggcgccagacacgacgccagaagcagaggccccagaagcagaagcagagagcacccccacagcagaagccccagccccgagcccagaggcagacccggccccatcggcgtgctgctgatgaagagcagagccaacgaggagtacggcctgagactgggcagccagatcttcgtgaaggagatgaccagaaccggcctggccaccaaggacggcaacctgcacgagggcgacatcatcctgaagatcaacggcaccgtgaccgagaacatgagcctgaccgacgccagaaagctgatcgagaagagcagaggcaagctgcagctggtggtgctgagagacagccagcagaccctgatcaacatccccagcctgaacgacagcgacagcgagatcgaggacatcagcgagatcgagagcaacagaagcttcagccccgaggagagaagacaccagtacagcgactacgactaccacagcagcagcgagaagctgaaggagagacccagcagcagagaggacacccccagcagactgagcagaatgggcgccacccccacccccttcaagagcaccggcgacatcgccggcaccgtggtgcccgagaccaacaaggagcccagataccaggaggacccccccgccccccagcccaaggccgcccccagaaccttcctgagacccagccccgaggacgaggccatctacggccccaacaccaagatggtgagattcaagaagggcgacagcgtgggcctgagactggccggcggcaacgacgtgggcatcttcgtggccggcatccaggagggcaccagcgccgagcaggagggcctgcaggagggcgaccagatcctgaaggtgaacacccaggacttcagaggcctggtgagagaggacgccgtgctgtacctgctggagatccccaagggcgagatggtgaccatcctggcccagagcagagccgacgtgtacagagacatcctggcctgcggcagaggcgacagcttcttcatcagaagccacttcgagtgcgagaaggagaccccccagagcctggccttcaccagaggcgaggtgttcagagtggtggacaccctgtacgacggcaagctgggcaactggctggccgtgagaatcggcaacgagctggagaagggcctgatccccaacaagagcagagccgagcagatggccagcgtgcagaacgcccagagagacaacgccggcgacagagccgacttctggagaatgagaggccagagaagcggcgtgaagaagaacctgagaaagagcagagaggacctgaccgccgtggtgagcgtgagcaccaagttccccgcctacgagagagtgctgctgagagaggccggcttcaagagacccgtggtgctgttcggccccatcgccgacatcgccatggagaagctggccaacgagctgcccgactggttccagaccgccaagaccgagcccaaggacgccggcagcgagaagagcaccggcgtggtgagactgaacaccgtgagacagatcatcgagcaggacaagcacgccctgctggacgtgacccccaaggccgtggacctgctgaactacacccagtggttccccatcgtgatcttcttcaaccccgacagcagacagggcgtgaagaccatgagacagagactgaaccccaccagcaacaagagcagcagaaagctgttcgaccaggccaacaagctgaagaagacctgcgcccacctgttcaccgccaccatcaacctgaacagcgccaacgacagctggttcggcagcctgaaggacaccatccagcaccagcagggcgaggccgtgtgggtgagcgagggcaagatggagggcatggacgacgaccccgaggacagaatgagctacctgaccgccatgggcgccgactacctgagctgcgacagcagactgatcagcgacttcgaggacaccgacggcgagggcggcgcctacaccgacaacgagctggacgagcccgccgaggagcccctggtgagcagcatcaccagaagcagcgagcccgtgcagcacgaggagagcatcagaaagcccagccccgagcccagagcccagatgagaagagccgccagcagcgaccagctgagagacaacagccccccccccgccttcaagcccgagccccccaaggccaagacccagaacaaggaggagagctacgacttcagcaagagctacgagtacaagagcaaccccagcgccgtggccggcaacgagacccccggcgccagcaccaagggctaccccccccccgtggccgccaagcccaccttcggcagaagcatcctgaagcccagcacccccatccccccccaggagggcgaggaggtgggcgagagcagcgaggagcaggacaacgcccccaagagcgtgctgggcaaggtgaagatcttcgagaagatggaccacaaggccagactgcagagaatgcaggagctgcaggaggcccagaacgccagaatcgagatcgcccagaagcaccccgacatctacgccgtgcccatcaagacccacaagcccgaccccggcaccccccagcacaccagcagcagaccccccgagccccagaaggcccccagcagaccctaccaggacaccagaggcagctacggcagcgacgccgaggaggaggagtacagacagcagctgagcgagcacagcaagagaggctactacggccagagcgccagatacagagacaccgagctgtag

SEQ ID NO: 102537 - DNA, 306 bp, Artificial Sequence
  Description of Artificial Sequence: Synthetic coding sequence
atggaggagctgatctgggagcagtacaccgtgaccctgcagaaggacagcaagagaggcttcggcatcgccgtgagcggcggcagagacaacccccacttcgagaacggcgagaccagcatcgtgatcagcgacgtgctgcccggcggccccgccgacggcctgctgcaggagaacgacagagtggtgatggtgaacggcacccccatggaggacgtgctgcacagcttcgccgtgcagcagctgagaaagagcggcaaggtggccgccatcgtgagcaccggcttcgccttcagcctgccctag

SEQ ID NO: 102538 - DNA, 486 bp, Artificial Sequence
  Description of Artificial Sequence: Synthetic coding sequence
atggaggagctgatctgggagcagtacaccgtgaccctgcagaaggacagcaagagaggcttcggcatcgccgtgagcggcggcagagacaacccccacttcgagaacggcgagaccagcatcgtgatcagcgacgtgctgcccggcggccccgccgacggcctgctgcaggagaacgacagagtggtgatggtgaacggcacccccatggaggacgtgctgcacagcttcgccgtgcagcagctgagaaagagcggcaaggtggccgccatcgtggtgaagagacccagaaaggtgcaggtggccgccctgcaggccagcccccccctggaccaggacgacagagccttcgaggtgatggacgagttcgacggcagaagcttcagaagcggctacagcgagagaagcagactgaacagccacggcggcagaagcagaagctgggaggacagccccgagagaggcagaccccacgagagagcctag

SEQ ID NO: 102539 - DNA, 3063 bp, Artificial Sequence
  Description of Artificial Sequence: Synthetic coding sequence
atggaggagctgatctgggagcagtacaccgtgaccctgcagaaggacagcaagagaggcttcggcatcgccgtgagcggcggcagagacaacccccacttcgagaacggcgagaccagcatcgtgatcagcgacgtgctgcccggcggccccgccgacggcctgctgcaggagaacgacagagtggtgatggtgaacggcacccccatggaggacgtgctgcacagcttcgccgtgcagcagctgagaaagagcggcaaggtggccgccatcgtggtgaagagacccagaaaggtgcaggtggccgccctgcaggccagcccccccctggaccaggacgacagagccttcgaggtgatggacgagttcgacggcagaagcttcagaagcggctacagcgagagaagcagactgaacagccacggcggcagaagcagaagctgggaggacagccccgagagaggcagaccccacgagagagccagaagcagagagagagacctgagcagagacagaagcagaggcagaagcctggagagaggcctggaccaggaccacgccagaaccagagacagaagcagaggcagaagcctggagagaggcctggaccacgacttcggccccagcagagacagagacagagacagaagcagaggcagaagcatcgaccaggactacgagagagcctaccacagagcctacgaccccgactacgagagagcctacagccccgagtacagaagaggcgccagacacgacgccagaagcagaggccccagaagcagaagcagagagcacccccacagcagaagccccagccccgagcccagaggcagacccggccccatcggcgtgctgctgatgaagagcagagccaacgaggagtacggcctgagactgggcagccagatcttcgtgaaggagatgaccagaaccggcctggccaccaaggacggcaacctgcacgagggcgacatcatcctgaagatcaacggcaccgtgaccgagaacatgagcctgaccgacgccagaaagctgatcgagaagagcagaggcaagctgcagctggtggtgctgagagacagccagcagaccctgatcaacatccccagcctgaacgacagcgacagcgagatcgaggacatcagcgagatcgagagcaacagaagcttcagccccgaggagagaagacaccagtacagcgactacgactaccacagcagcagcgagaagctgaaggagagacccagcagcagagaggacacccccagcagactgagcagaatgggcgccacccccacccccttcaagagcaccggcgacatcgccggcaccgtggtgcccgagaccaacaaggagcccagataccaggaggacccccccgccccccagcccaaggccgcccccagaaccttcctgagacccagccccgaggacgaggccatctacggccccaacaccaagatggtgagattcaagaagggcgacagcgtgggcctgagactggccggcggcaacgacgtgggcatcttcgtggccggcatccaggagggcaccagcgccgagcaggagggcctgcaggagggcgaccagatcctgaaggtgaacacccaggacttcagaggcctggtgagagaggacgccgtgctgtacctgctggagatccccaagggcgagatggtgaccatcctggcccagagcagagccgacgtgtacagagacatcctggcctgcggcagaggcgacagcttcttcatcagaagccacttcgagtgcgagaaggagaccccccagagcctggccttcaccagaggcgaggtgttcagagtggtggacaccctgtacgacggcaagctgggcaactggctggccgtgagaatcggcaacgagctggagaagggcctgatccccaacaagagcagagccgagcagatggccagcgtgcagaacgcccagagagacaacgccggcgacagagccgacttctggagaatgagaggccagagaagcggcgtgaagaagaacctgagaaagagcagagaggacctgaccgccgtggtgagcgtgagcaccaagttccccgcctacgagagagtgctgctgagagaggccggcttcaagagacccgtggtgctgttcggccccatcgccgacatcgccatggagaagctggccaacgagctgcccgactggttccagaccgccaagaccgagcccaaggacgccggcagcgagaagagcaccggcgtggtgagactgaacaccgtgagacagatcatcgagcaggacaagcacgccctgctggacgtgacccccaaggccgtggacctgctgaactacacccagtggttccccatcgtgatcttcttcaaccccgacagcagacagggcgtgaagaccatgagacagagactgaaccccaccagcaacaagagcagcagaaagctgttcgaccaggccaacaagctgaagaagacctgcgcccacctgttcaccgccaccatcaacctgaacagcgccaacgacagctggttcggcagcctgaaggacaccatccagcaccagcagggcgaggccgtgtgggtgagcgagggcaagatggagggcatggacgacgaccccgaggacagaatgagctacctgaccgccatgggcgccgactacctgagctgcgacagcagactgatcagcgacttcgaggacaccgacggcgagggcggcgcctacaccgacaacgagctggacgagcccgccgaggagcccctggtgagcagcatcaccagaagcagcgagcccgtgcagcacgaggagatcgagatcgcccagaagcaccccgacatctacgccgtgcccatcaagacccacaagcccgaccccggcaccccccagcacaccagcagcagaccccccgagccccagaaggcccccagcagaccctaccaggacaccagaggcagctacggcagcgacgccgaggaggaggagtacagacagcagctgagcgagcacagcaagagaggctactacggccagagcgccagatacagagacaccgagctgtag

SEQ ID NO: 102540 - DNA, 3474 bp, Artificial Sequence
  Description of Artificial Sequence: Synthetic coding sequence
atgaagaccgcccaggccctgcacagaatgtggatccaggccgtgaagaagctgagaagatggaagggcagagcccccggcatggaggagctgatctgggagcagtacaccgtgaccctgcagaaggacagcaagagaggcttcggcatcgccgtgagcggcggcagagacaacccccacttcgagaacggcgagaccagcatcgtgatcagcgacgtgctgcccggcggccccgccgacggcctgctgcaggagaacgacagagtggtgatggtgaacggcacccccatggaggacgtgctgcacagcttcgccgtgcagcagctgagaaagagcggcaaggtggccgccatcgtggtgaagagacccagaaaggtgcaggtggccgccctgcaggccagcccccccctggaccaggacgacagagccttcgaggtgatggacgagttcgacggcagaagcttcagaagcggctacagcgagagaagcagactgaacagccacggcggcagaagcagaagctgggaggacagccccgagagaggcagaccccacgagagagccagaagcagagagagagacctgagcagagacagaagcagaggcagaagcctggagagaggcctggaccaggaccacgccagaaccagagacagaagcagaggcagaagcctggagagaggcctggaccacgacttcggccccagcagagacagagacagagacagaagcagaggcagaagcatcgaccaggactacgagagagcctaccacagagcctacgaccccgactacgagagagcctacagccccgagtacagaagaggcgccagacacgacgccagaagcagaggccccagaagcagaagcagagagcacccccacagcagaagccccagccccgagcccagaggcagacccggccccatcggcgtgctgctgatgaagagcagagccaacgaggagtacggcctgagactgggcagccagatcttcgtgaaggagatgaccagaaccggcctggccaccaaggacggcaacctgcacgagggcgacatcatcctgaagatcaacggcaccgtgaccgagaacatgagcctgaccgacgccagaaagctgatcgagaagagcagaggcaagctgcagctggtggtgctgagagacagccagcagaccctgatcaacatccccagcctgaacgacagcgacagcgagatcgaggacatcagcgagatcgagagcaacagaagcttcagccccgaggagagaagacaccagtacagcgactacgactaccacagcagcagcgagaagctgaaggagagacccagcagcagagaggacacccccagcagactgagcagaatgggcgccacccccacccccttcaagagcaccggcgacatcgccggcaccgtggtgcccgagaccaacaaggagcccagataccaggaggacccccccgccccccagcccaaggccgcccccagaaccttcctgagacccagccccgaggacgaggccatctacggccccaacaccaagatggtgagattcaagaagggcgacagcgtgggcctgagactggccggcggcaacgacgtgggcatcttcgtggccggcatccaggagggcaccagcgccgagcaggagggcctgcaggagggcgaccagatcctgaaggtgaacacccaggacttcagaggcctggtgagagaggacgccgtgctgtacctgctggagatccccaagggcgagatggtgaccatcctggcccagagcagagccgacgtgtacagagacatcctggcctgcggcagaggcgacagcttcttcatcagaagccacttcgagtgcgagaaggagaccccccagagcctggccttcaccagaggcgaggtgttcagagtggtggacaccctgtacgacggcaagctgggcaactggctggccgtgagaatcggcaacgagctggagaagggcctgatccccaacaagagcagagccgagcagatggccagcgtgcagaacgcccagagagacaacgccggcgacagagccgacttctggagaatgagaggccagagaagcggcgtgaagaagaacctgagaaagagcagagaggacctgaccgccgtggtgagcgtgagcaccaagttccccgcctacgagagagtgctgctgagagaggccggcttcaagagacccgtggtgctgttcggccccatcgccgacatcgccatggagaagctggccaacgagctgcccgactggttccagaccgccaagaccgagcccaaggacgccggcagcgagaagagcaccggcgtggtgagactgaacaccgtgagacagatcatcgagcaggacaagcacgccctgctggacgtgacccccaaggccgtggacctgctgaactacacccagtggttccccatcgtgatcttcttcaaccccgacagcagacagggcgtgaagaccatgagacagagactgaaccccaccagcaacaagagcagcagaaagctgttcgaccaggccaacaagctgaagaagacctgcgcccacctgttcaccgccaccatcaacctgaacagcgccaacgacagctggttcggcagcctgaaggacaccatccagcaccagcagggcgaggccgtgtgggtgagcgagggcaagatggagggcatggacgacgaccccgaggacagaatgagctacctgaccgccatgggcgccgactacctgagctgcgacagcagactgatcagcgacttcgaggacaccgacggcgagggcggcgcctacaccgacaacgagctggacgagcccgccgaggagcccctggtgagcagcatcaccagaagcagcgagcccgtgcagcacgaggaggccaagacccagaacaaggaggagagctacgacttcagcaagagctacgagtacaagagcaaccccagcgccgtggccggcaacgagacccccggcgccagcaccaagggctaccccccccccgtggccgccaagcccaccttcggcagaagcatcctgaagcccagcacccccatccccccccaggagggcgaggaggtgggcgagagcagcgaggagcaggacaacgcccccaagagcgtgctgggcaaggtgaagatcttcgagaagatggaccacaaggccagactgcagagaatgcaggagctgcaggaggcccagaacgccagaatcgagatcgcccagaagcaccccgacatctacgccgtgcccatcaagacccacaagcccgaccccggcaccccccagcacaccagcagcagaccccccgagccccagaaggcccccagcagaccctaccaggacaccagaggcagctacggcagcgacgccgaggaggaggagtacagacagcagctgagcgagcacagcaagagaggctactacggccagagcgccagatacagagacaccgagctgtag

SEQ ID NO: 102541 - DNA, 3666 bp, Artificial Sequence
  Description of Artificial Sequence: Synthetic coding sequence
atgaagaccgcccaggccctgcacagaatgtggatccaggccgtgaagaagctgagaagatggaagggcagagtgagccccagcgccagcagccccctggtgttccccaacctgagcagctgggagggcgagggcagcaagaccatcctgaccgcccccggcatggaggagctgatctgggagcagtacaccgtgaccctgcagaaggacagcaagagaggcttcggcatcgccgtgagcggcggcagagacaacccccacttcgagaacggcgagaccagcatcgtgatcagcgacgtgctgcccggcggccccgccgacggcctgctgcaggagaacgacagagtggtgatggtgaacggcacccccatggaggacgtgctgcacagcttcgccgtgcagcagctgagaaagagcggcaaggtggccgccatcgtggtgaagagacccagaaaggtgcaggtggccgccctgcaggccagcccccccctggaccaggacgacagagccttcgaggtgatggacgagttcgacggcagaagcttcagaagcggctacagcgagagaagcagactgaacagccacggcggcagaagcagaagctgggaggacagccccgagagaggcagaccccacgagagagccagaagcagagagagagacctgagcagagacagaagcagaggcagaagcctggagagaggcctggaccaggaccacgccagaaccagagacagaagcagaggcagaagcctggagagaggcctggaccacgacttcggccccagcagagacagagacagagacagaagcagaggcagaagcatcgaccaggactacgagagagcctaccacagagcctacgaccccgactacgagagagcctacagccccgagtacagaagaggcgccagacacgacgccagaagcagaggccccagaagcagaagcagagagcacccccacagcagaagccccagccccgagcccagaggcagacccggccccatcggcgtgctgctgatgaagagcagagccaacgaggagtacggcctgagactgggcagccagatcttcgtgaaggagatgaccagaaccggcctggccaccaaggacggcaacctgcacgagggcgacatcatcctgaagatcaacggcaccgtgaccgagaacatgagcctgaccgacgccagaaagctgatcgagaagagcagaggcaagctgcagctggtggtgctgagagacagccagcagaccctgatcaacatccccagcctgaacgacagcgacagcgagatcgaggacatcagcgagatcgagagcaacagaagcttcagccccgaggagagaagacaccagtacagcgactacgactaccacagcagcagcgagaagctgaaggagagacccagcagcagagaggacacccccagcagactgagcagaatgggcgccacccccacccccttcaagagcaccggcgacatcgccggcaccgtggtgcccgagaccaacaaggagcccagataccaggaggacccccccgccccccagcccaaggccgcccccagaaccttcctgagacccagccccgaggacgaggccatctacggccccaacaccaagatggtgagattcaagaagggcgacagcgtgggcctgagactggccggcggcaacgacgtgggcatcttcgtggccggcatccaggagggcaccagcgccgagcaggagggcctgcaggagggcgaccagatcctgaaggtgaacacccaggacttcagaggcctggtgagagaggacgccgtgctgtacctgctggagatccccaagggcgagatggtgaccatcctggcccagagcagagccgacgtgtacagagacatcctggcctgcggcagaggcgacagcttcttcatcagaagccacttcgagtgcgagaaggagaccccccagagcctggccttcaccagaggcgaggtgttcagagtggtggacaccctgtacgacggcaagctgggcaactggctggccgtgagaatcggcaacgagctggagaagggcctgatccccaacaagagcagagccgagcagatggccagcgtgcagaacgcccagagagacaacgccggcgacagagccgacttctggagaatgagaggccagagaagcggcgtgaagaagaacctgagaaagagcagagaggacctgaccgccgtggtgagcgtgagcaccaagttccccgcctacgagagagtgctgctgagagaggccggcttcaagagacccgtggtgctgttcggccccatcgccgacatcgccatggagaagctggccaacgagctgcccgactggttccagaccgccaagaccgagcccaaggacgccggcagcgagaagagcaccggcgtggtgagactgaacaccgtgagacagatcatcgagcaggacaagcacgccctgctggacgtgacccccaaggccgtggacctgctgaactacacccagtggttccccatcgtgatcttcttcaaccccgacagcagacagggcgtgaagaccatgagacagagactgaaccccaccagcaacaagagcagcagaaagctgttcgaccaggccaacaagctgaagaagacctgcgcccacctgttcaccgccaccatcaacctgaacagcgccaacgacagctggttcggcagcctgaaggacaccatccagcaccagcagggcgaggccgtgtgggtgagcgagggcaagatggagggcatggacgacgaccccgaggacagaatgagctacctgaccgccatgggcgccgactacctgagctgcgacagcagactgatcagcgacttcgaggacaccgacggcgagggcggcgcctacaccgacaacgagctggacgagcccgccgaggagcccctggtgagcagcatcaccagaagcagcgagcccgtgcagcacgaggagagcatcagaaagcccagccccgagcccagagcccagatgagaagagccgccagcagcgaccagctgagagacaacagccccccccccgccttcaagcccgagccccccaaggccaagacccagaacaaggaggagagctacgacttcagcaagagctacgagtacaagagcaaccccagcgccgtggccggcaacgagacccccggcgccagcaccaagggctaccccccccccgtggccgccaagcccaccttcggcagaagcatcctgaagcccagcacccccatccccccccaggagggcgaggaggtgggcgagagcagcgaggagcaggacaacgcccccaagagcgtgctgggcaaggtgaagatcttcgagaagatggaccacaaggccagactgcagagaatgcaggagctgcaggaggcccagaacgccagaatcgagatcgcccagaagcaccccgacatctacgccgtgcccatcaagacccacaagcccgaccccggcaccccccagcacaccagcagcagaccccccgagccccagaaggcccccagcagaccctaccaggacaccagaggcagctacggcagcgacgccgaggaggaggagtacagacagcagctgagcgagcacagcaagagaggctactacggccagagcgccagatacagagacaccgagctgtag

SEQ ID NO: 102542 - DNA, 2787 bp, Artificial Sequence
  Description of Artificial Sequence: Synthetic coding sequence
atggccgtgagattccaggtggccgacatggaggagctgaccatctgggagcagcacaccgccaccctgagcaaggaccccagaagaggcttcggcatcgccatcagcggcggcagagacagacccggcggcagcatggtggtgagcgacgtggtgcccggcggccccgccgagggcagactgcagaccggcgaccacatcgtgatggtgaacggcgtgagcatggagaacgccaccagcgccttcgccatccagatcctgaagacctgcaccaagatggccaacatcaccgtgaagagacccagaagaatccacctgcccgccaccaaggccagccccagcagccccggcagacaggacagcgacgaggacgacggcccccagagagtggaggaggtggaccagggcagaggctacgacggcgacagcagcagcggcagcggcagaagctgggacgagagaagcagaagacccagacccggcagaagaggcagagccggcagccacggcagaagaagccccggcggcggcagcgaggccaacggcctggccctggtgagcggcttcaagagactgcccagacaggacgtgcagatgaagcccgtgaagagcgtgctggtgaagagaagagacagcgaggagttcggcgtgaagctgggcagccagatcttcatcaagcacatcaccgacagcggcctggccgccagacacagaggcctgcaggagggcgacctgatcctgcagatcaacggcgtgagcagccagaacctgagcctgaacgacaccagaagactgatcgagaagagcgagggcaagctgagcctgctggtgctgagagacagaggccagttcctggtgaacatcccccccgccgtgagcgacagcgacagcagccccctggaggacatcagcgacctggccagcgagctgagccaggccccccccagccacatcccccccccccccagacacgcccagagaagccccgaggccagccagaccgacagccccgtggagagccccagactgagaagagagagcagcgtggacagcagaaccatcagcgagcccgacgagcagagaagcgagctgcccagagagagcagctacgacatctacagagtgcccagcagccagagcatggaggacagaggctacagccccgacaccagagtggtgagattcctgaagggcaagagcatcggcctgagactggccggcggcaacgacgtgggcatcttcgtgagcggcgtgcaggccggcagccccgccgacggccagggcatccaggagggcgaccagatcctgcaggtgaacgacgtgcccttccagaacctgaccagagaggaggccgtgcagttcctgctgggcctgccccccggcgaggagatggagctggtgacccagagaaagcaggacatcttctggaagatggtgcagagcagagtgggcgacagcttctacatcagaacccacttcgagctggagcccagcccccccagcggcctgggcttcaccagaggcgacgtgttccacgtgctggacaccctgcaccccggccccggccagagccacgccagaggcggccactggctggccgtgagaatgggcagagacctgagagagcaggagagaggcatcatccccaaccagagcagagccgagcagctggccagcctggaggccgcccagagagccgtgggcgtgggccccggcagcagcgccggcagcaacgccagagccgagttctggagactgagaggcctgagaagaggcgccaagaagaccacccagagaagcagagaggacctgagcgccctgaccagacagggcagataccccccctacgagagagtggtgctgagagaggccagcttcaagagacccgtggtgatcctgggccccgtggccgacatcgccatgcagaagctgaccgccgagatgcccgaccagttcgagatcgccgagaccgtgagcagaaccgacagccccagcaagatcatcaagctggacaccgtgagagtgatcgccgagaaggacaagcacgccctgctggacgtgacccccagcgccatcgagagactgaactacgtgcagtactaccccatcgtggtgttcttcatccccgagagcagacccgccctgaaggccctgagacagtggctggcccccgccagcagaagaagcaccagaagactgtacgcccaggcccagaagctgagaaagcacagcagccacctgttcaccgccaccatccccctgaacggcaccagcgacacctggtaccaggagctgaaggccatcatcagagagcagcagaccagacccatctggaccgccgaggaccagctggacggcagcctggaggacaacctggacctgccccaccacggcctggccgacagcagcgccgacctgagctgcgacagcagagtgaacagcgactacgagaccgacggcgagggcggcgcctacaccgacggcgagggctacaccgacggcgagggcggcccctacaccgacgtggacgacgagccccccgcccccgccctggccagaagcagcgagcccgtgcaggccgacgagagccagagccccagagacagaggcagaatcagcgcccaccagggcgcccaggtggacagcagacacccccagggccagtggagacaggacagcatgagaacctacgagagagaggccctgaagaagaagttcatgagagtgcacgacgccgagagcagcgacgaggacggctacgactggggccccgccaccgacctgtag

SEQ ID NO: 102543 - DNA, 2859 bp, Artificial Sequence
  Description of Artificial Sequence: Synthetic coding sequence
atgaacctgtgcggcctgatgcccatcttccccgcccccctggaccaggtggccgacatggaggagctgaccatctgggagcagcacaccgccaccctgagcaaggaccccagaagaggcttcggcatcgccatcagcggcggcagagacagacccggcggcagcatggtggtgagcgacgtggtgcccggcggccccgccgagggcagactgcagaccggcgaccacatcgtgatggtgaacggcgtgagcatggagaacgccaccagcgccttcgccatccagatcctgaagacctgcaccaagatggccaacatcaccgtgaagagacccagaagaatccacctgcccgccaccaaggccagccccagcagccccggcagacaggacagcgacgaggacgacggcccccagagagtggaggaggtggaccagggcagaggctacgacggcgacagcagcagcggcagcggcagaagctgggacgagagaagcagaagacccagacccggcagaagaggcagagccggcagccacggcagaagaagccccggcggcggcagcgaggccaacggcctggccctggtgagcggcttcaagagactgcccagacaggacgtgcagatgaagcccgtgaagagcgtgctggtgaagagaagagacagcgaggagttcggcgtgaagctgggcagccagatcttcatcaagcacatcaccgacagcggcctggccgccagacacagaggcctgcaggagggcgacctgatcctgcagatcaacggcgtgagcagccagaacctgagcctgaacgacaccagaagactgatcgagaagagcgagggcaagctgagcctgctggtgctgagagacagaggccagttcctggtgaacatcccccccgccgtgagcgacagcgacagcagccccctggaggagggcgtgaccatggccgacgagatgagcagcccccccgccgacatcagcgacctggccagcgagctgagccaggccccccccagccacatcccccccccccccagacacgcccagagaagccccgaggccagccagaccgacagccccgtggagagccccagactgagaagagagagcagcgtggacagcagaaccatcagcgagcccgacgagcagagaagcgagctgcccagagagagcagctacgacatctacagagtgcccagcagccagagcatggaggacagaggctacagccccgacaccagagtggtgagattcctgaagggcaagagcatcggcctgagactggccggcggcaacgacgtgggcatcttcgtgagcggcgtgcaggccggcagccccgccgacggccagggcatccaggagggcgaccagatcctgcaggtgaacgacgtgcccttccagaacctgaccagagaggaggccgtgcagttcctgctgggcctgccccccggcgaggagatggagctggtgacccagagaaagcaggacatcttctggaagatggtgcagagcagagtgggcgacagcttctacatcagaacccacttcgagctggagcccagcccccccagcggcctgggcttcaccagaggcgacgtgttccacgtgctggacaccctgcaccccggccccggccagagccacgccagaggcggccactggctggccgtgagaatgggcagagacctgagagagcaggagagaggcatcatccccaaccagagcagagccgagcagctggccagcctggaggccgcccagagagccgtgggcgtgggccccggcagcagcgccggcagcaacgccagagccgagttctggagactgagaggcctgagaagaggcgccaagaagaccacccagagaagcagagaggacctgagcgccctgaccagacagggcagataccccccctacgagagagtggtgctgagagaggccagcttcaagagacccgtggtgatcctgggccccgtggccgacatcgccatgcagaagctgaccgccgagatgcccgaccagttcgagatcgccgagaccgtgagcagaaccgacagccccagcaagatcatcaagctggacaccgtgagagtgatcgccgagaaggacaagcacgccctgctggacgtgacccccagcgccatcgagagactgaactacgtgcagtactaccccatcgtggtgttcttcatccccgagagcagacccgccctgaaggccctgagacagtggctggcccccgccagcagaagaagcaccagaagactgtacgcccaggcccagaagctgagaaagcacagcagccacctgttcaccgccaccatccccctgaacggcaccagcgacacctggtaccaggagctgaaggccatcatcagagagcagcagaccagacccatctggaccgccgaggaccagctggacggcagcctggaggacaacctggacctgccccaccacggcctggccgacagcagcgccgacctgagctgcgacagcagagtgaacagcgactacgagaccgacggcgagggcggcgcctacaccgacggcgagggctacaccgacggcgagggcggcccctacaccgacgtggacgacgagccccccgcccccgccctggccagaagcagcgagcccgtgcaggccgacgagagccagagccccagagacagaggcagaatcagcgcccaccagggcgcccaggtggacagcagacacccccagggccagtggagacaggacagcatgagaacctacgagagagaggccctgaagaagaagttcatgagagtgcacgacgccgagagcagcgacgaggacggctacgactggggccccgccaccgacctgtag

SEQ ID NO: 102544 - DNA, 2802 bp, Artificial Sequence
  Description of Artificial Sequence: Synthetic coding sequence
atggaggagctgaccatctgggagcagcacaccgccaccctgagcaaggaccccagaagaggcttcggcatcgccatcagcggcggcagagacagacccggcggcagcatggtggtgagcgacgtggtgcccggcggccccgccgagggcagactgcagaccggcgaccacatcgtgatggtgaacggcgtgagcatggagaacgccaccagcgccttcgccatccagatcctgaagacctgcaccaagatggccaacatcaccgtgaagagacccagaagaatccacctgcccgccaccaaggccagccccagcagccccggcagacaggacagcgacgaggacgacggcccccagagagtggaggaggtggaccagggcagaggctacgacggcgacagcagcagcggcagcggcagaagctgggacgagagaagcagaagacccagacccggcagaagaggcagagccggcagccacggcagaagaagccccggcggcggcagcgaggccaacggcctggccctggtgagcggcttcaagagactgcccagacaggacgtgcagatgaagcccgtgaagagcgtgctggtgaagagaagagacagcgaggagttcggcgtgaagctgggcagccagatcttcatcaagcacatcaccgacagcggcctggccgccagacacagaggcctgcaggagggcgacctgatcctgcagatcaacggcgtgagcagccagaacctgagcctgaacgacaccagaagactgatcgagaagagcgagggcaagctgagcctgctggtgctgagagacagaggccagttcctggtgaacatcccccccgccgtgagcgacagcgacagcagccccctggaggagggcgtgaccatggccgacgagatgagcagcccccccgccgacatcagcgacctggccagcgagctgagccaggccccccccagccacatcccccccccccccagacacgcccagagaagccccgaggccagccagaccgacagccccgtggagagccccagactgagaagagagagcagcgtggacagcagaaccatcagcgagcccgacgagcagagaagcgagctgcccagagagagcagctacgacatctacagagtgcccagcagccagagcatggaggacagaggctacagccccgacaccagagtggtgagattcctgaagggcaagagcatcggcctgagactggccggcggcaacgacgtgggcatcttcgtgagcggcgtgcaggccggcagccccgccgacggccagggcatccaggagggcgaccagatcctgcaggtgaacgacgtgcccttccagaacctgaccagagaggaggccgtgcagttcctgctgggcctgccccccggcgaggagatggagctggtgacccagagaaagcaggacatcttctggaagatggtgcagagcagagtgggcgacagcttctacatcagaacccacttcgagctggagcccagcccccccagcggcctgggcttcaccagaggcgacgtgttccacgtgctggacaccctgcaccccggccccggccagagccacgccagaggcggccactggctggccgtgagaatgggcagagacctgagagagcaggagagaggcatcatccccaaccagagcagagccgagcagctggccagcctggaggccgcccagagagccgtgggcgtgggccccggcagcagcgccggcagcaacgccagagccgagttctggagactgagaggcctgagaagaggcgccaagaagaccacccagagaagcagagaggacctgagcgccctgaccagacagggcagataccccccctacgagagagtggtgctgagagaggccagcttcaagagacccgtggtgatcctgggccccgtggccgacatcgccatgcagaagctgaccgccgagatgcccgaccagttcgagatcgccgagaccgtgagcagaaccgacagccccagcaagatcatcaagctggacaccgtgagagtgatcgccgagaaggacaagcacgccctgctggacgtgacccccagcgccatcgagagactgaactacgtgcagtactaccccatcgtggtgttcttcatccccgagagcagacccgccctgaaggccctgagacagtggctggcccccgccagcagaagaagcaccagaagactgtacgcccaggcccagaagctgagaaagcacagcagccacctgttcaccgccaccatccccctgaacggcaccagcgacacctggtaccaggagctgaaggccatcatcagagagcagcagaccagacccatctggaccgccgaggaccagctggacggcagcctggaggacaacctggacctgccccaccacggcctggccgacagcagcgccgacctgagctgcgacagcagagtgaacagcgactacgagaccgacggcgagggcggcgcctacaccgacggcgagggctacaccgacggcgagggcggcccctacaccgacgtggacgacgagccccccgcccccgccctggccagaagcagcgagcccgtgcaggccgacgagagccagagccccagagacagaggcagaatcagcgcccaccagggcgcccaggtggacagcagacacccccagggccagtggagacaggacagcatgagaacctacgagagagaggccctgaagaagaagttcatgagagtgcacgacgccgagagcagcgacgaggacggctacgactggggccccgccaccgacctgtag

SEQ ID NO: 102545 - DNA, 2652 bp, Artificial Sequence
  Description of Artificial Sequence: Synthetic coding sequence
atggtggtgagcgacgtggtgcccggcggccccgccgagggcagactgcagaccggcgaccacatcgtgatggtgaacggcgtgagcatggagaacgccaccagcgccttcgccatccagatcctgaagacctgcaccaagatggccaacatcaccgtgaagagacccagaagaatccacctgcccgccaccaaggccagccccagcagccccggcagacaggacagcgacgaggacgacggcccccagagagtggaggaggtggaccagggcagaggctacgacggcgacagcagcagcggcagcggcagaagctgggacgagagaagcagaagacccagacccggcagaagaggcagagccggcagccacggcagaagaagccccggcggcggcagcgaggccaacggcctggccctggtgagcggcttcaagagactgcccagacaggacgtgcagatgaagcccgtgaagagcgtgctggtgaagagaagagacagcgaggagttcggcgtgaagctgggcagccagatcttcatcaagcacatcaccgacagcggcctggccgccagacacagaggcctgcaggagggcgacctgatcctgcagatcaacggcgtgagcagccagaacctgagcctgaacgacaccagaagactgatcgagaagagcgagggcaagctgagcctgctggtgctgagagacagaggccagttcctggtgaacatcccccccgccgtgagcgacagcgacagcagccccctggaggacatcagcgacctggccagcgagctgagccaggccccccccagccacatcccccccccccccagacacgcccagagaagccccgaggccagccagaccgacagccccgtggagagccccagactgagaagagagagcagcgtggacagcagaaccatcagcgagcccgacgagcagagaagcgagctgcccagagagagcagctacgacatctacagagtgcccagcagccagagcatggaggacagaggctacagccccgacaccagagtggtgagattcctgaagggcaagagcatcggcctgagactggccggcggcaacgacgtgggcatcttcgtgagcggcgtgcaggccggcagccccgccgacggccagggcatccaggagggcgaccagatcctgcaggtgaacgacgtgcccttccagaacctgaccagagaggaggccgtgcagttcctgctgggcctgccccccggcgaggagatggagctggtgacccagagaaagcaggacatcttctggaagatggtgcagagcagagtgggcgacagcttctacatcagaacccacttcgagctggagcccagcccccccagcggcctgggcttcaccagaggcgacgtgttccacgtgctggacaccctgcaccccggccccggccagagccacgccagaggcggccactggctggccgtgagaatgggcagagacctgagagagcaggagagaggcatcatccccaaccagagcagagccgagcagctggccagcctggaggccgcccagagagccgtgggcgtgggccccggcagcagcgccggcagcaacgccagagccgagttctggagactgagaggcctgagaagaggcgccaagaagaccacccagagaagcagagaggacctgagcgccctgaccagacagggcagataccccccctacgagagagtggtgctgagagaggccagcttcaagagacccgtggtgatcctgggccccgtggccgacatcgccatgcagaagctgaccgccgagatgcccgaccagttcgagatcgccgagaccgtgagcagaaccgacagccccagcaagatcatcaagctggacaccgtgagagtgatcgccgagaaggacaagcacgccctgctggacgtgacccccagcgccatcgagagactgaactacgtgcagtactaccccatcgtggtgttcttcatccccgagagcagacccgccctgaaggccctgagacagtggctggcccccgccagcagaagaagcaccagaagactgtacgcccaggcccagaagctgagaaagcacagcagccacctgttcaccgccaccatccccctgaacggcaccagcgacacctggtaccaggagctgaaggccatcatcagagagcagcagaccagacccatctggaccgccgaggaccagctggacggcagcctggaggacaacctggacctgccccaccacggcctggccgacagcagcgccgacctgagctgcgacagcagagtgaacagcgactacgagaccgacggcgagggcggcgcctacaccgacggcgagggctacaccgacggcgagggcggcccctacaccgacgtggacgacgagccccccgcccccgccctggccagaagcagcgagcccgtgcaggccgacgagagccagagccccagagacagaggcagaatcagcgcccaccagggcgcccaggtggacagcagacacccccagggccagtggagacaggacagcatgagaacctacgagagagaggccctgaagaagaagttcatgagagtgcacgacgccgagagcagcgacgaggacggctacgactggggccccgccaccgacctgtag

SEQ ID NO: 102546 - DNA, 2760 bp, Artificial Sequence
  Description of Artificial Sequence: Synthetic coding sequence
atggaggagctgaccatctgggagcagcacaccgccaccctgagcaaggaccccagaagaggcttcggcatcgccatcagcggcggcagagacagacccggcggcagcatggtggtgagcgacgtggtgcccggcggccccgccgagggcagactgcagaccggcgaccacatcgtgatggtgaacggcgtgagcatggagaacgccaccagcgccttcgccatccagatcctgaagacctgcaccaagatggccaacatcaccgtgaagagacccagaagaatccacctgcccgccaccaaggccagccccagcagccccggcagacaggacagcgacgaggacgacggcccccagagagtggaggaggtggaccagggcagaggctacgacggcgacagcagcagcggcagcggcagaagctgggacgagagaagcagaagacccagacccggcagaagaggcagagccggcagccacggcagaagaagccccggcggcggcagcgaggccaacggcctggccctggtgagcggcttcaagagactgcccagacaggacgtgcagatgaagcccgtgaagagcgtgctggtgaagagaagagacagcgaggagttcggcgtgaagctgggcagccagatcttcatcaagcacatcaccgacagcggcctggccgccagacacagaggcctgcaggagggcgacctgatcctgcagatcaacggcgtgagcagccagaacctgagcctgaacgacaccagaagactgatcgagaagagcgagggcaagctgagcctgctggtgctgagagacagaggccagttcctggtgaacatcccccccgccgtgagcgacagcgacagcagccccctggaggacatcagcgacctggccagcgagctgagccaggccccccccagccacatcccccccccccccagacacgcccagagaagccccgaggccagccagaccgacagccccgtggagagccccagactgagaagagagagcagcgtggacagcagaaccatcagcgagcccgacgagcagagaagcgagctgcccagagagagcagctacgacatctacagagtgcccagcagccagagcatggaggacagaggctacagccccgacaccagagtggtgagattcctgaagggcaagagcatcggcctgagactggccggcggcaacgacgtgggcatcttcgtgagcggcgtgcaggccggcagccccgccgacggccagggcatccaggagggcgaccagatcctgcaggtgaacgacgtgcccttccagaacctgaccagagaggaggccgtgcagttcctgctgggcctgccccccggcgaggagatggagctggtgacccagagaaagcaggacatcttctggaagatggtgcagagcagagtgggcgacagcttctacatcagaacccacttcgagctggagcccagcccccccagcggcctgggcttcaccagaggcgacgtgttccacgtgctggacaccctgcaccccggccccggccagagccacgccagaggcggccactggctggccgtgagaatgggcagagacctgagagagcaggagagaggcatcatccccaaccagagcagagccgagcagctggccagcctggaggccgcccagagagccgtgggcgtgggccccggcagcagcgccggcagcaacgccagagccgagttctggagactgagaggcctgagaagaggcgccaagaagaccacccagagaagcagagaggacctgagcgccctgaccagacagggcagataccccccctacgagagagtggtgctgagagaggccagcttcaagagacccgtggtgatcctgggccccgtggccgacatcgccatgcagaagctgaccgccgagatgcccgaccagttcgagatcgccgagaccgtgagcagaaccgacagccccagcaagatcatcaagctggacaccgtgagagtgatcgccgagaaggacaagcacgccctgctggacgtgacccccagcgccatcgagagactgaactacgtgcagtactaccccatcgtggtgttcttcatccccgagagcagacccgccctgaaggccctgagacagtggctggcccccgccagcagaagaagcaccagaagactgtacgcccaggcccagaagctgagaaagcacagcagccacctgttcaccgccaccatccccctgaacggcaccagcgacacctggtaccaggagctgaaggccatcatcagagagcagcagaccagacccatctggaccgccgaggaccagctggacggcagcctggaggacaacctggacctgccccaccacggcctggccgacagcagcgccgacctgagctgcgacagcagagtgaacagcgactacgagaccgacggcgagggcggcgcctacaccgacggcgagggctacaccgacggcgagggcggcccctacaccgacgtggacgacgagccccccgcccccgccctggccagaagcagcgagcccgtgcaggccgacgagagccagagccccagagacagaggcagaatcagcgcccaccagggcgcccaggtggacagcagacacccccagggccagtggagacaggacagcatgagaacctacgagagagaggccctgaagaagaagttcatgagagtgcacgacgccgagagcagcgacgaggacggctacgactggggccccgccaccgacctgtag

SEQ ID NO: 102547 - DNA, 1623 bp, Artificial Sequence; identical to SEQ ID NO: 75790
  Description of Artificial Sequence: Synthetic coding sequence

SEQ ID NO: 102548 - DNA, 3627 bp, Artificial Sequence
  Description of Artificial Sequence: Synthetic coding sequence
atggacctgcacatgatgaactgcgagctgctggccacctgcagcgccctgggctacctggagggcgacacctaccacaaggagcccgactgcctggagagcgtgaaggacctgatcagatacctgagacacgaggacgagaccagagacgtgagacagcagctgggcgccgcccagatcctgcagagcgacctgctgcccatcctgacccagcaccaccaggacaagcccctgttcgacgccgtgatcagactgatggtgaacctgacccagcccgccctgctgtgcttcggcaacctgcccaaggagcccagcttcagacaccacttcctgcaggtgctgacctacctgcaggcctacaaggaggccttcgccagcgagaaggccttcggcgtgctgagcgagaccctgtacgagctgctgcagctgggctgggaggagagacaggaggaggacaacctgctgatcgagagaatcctgctgctggtgagaaacatcctgcacgtgcccgccgacctggaccaggagaagaagatcgacgacgacgccagcgcccacgaccagctgctgtgggccatccacctgagcggcctggacgacctgctgctgttcctggccagcagcagcgccgaggagcagtggagcctgcacgtgctggagatcgtgagcctgatgttcagagaccagaaccccgagcagctggccggcgtgggccagggcagactggcccaggagagaagcgccgacttcgccgagctggaggtgctgagacagagagagatggccgagaagaagaccagagccctgcagagaggcaacagacacagcagattcggcggcagctacatcgtgcagggcctgaagagcatcggcgagagagacctgatcttccacaagggcctgcacaacctgagaaactacagcagcgacctgggcaagcagcccaagaaggtgcccaagagaagacaggccgccagagagctgagcatccagagaagaagcgccctgaacgtgagactgttcctgagagacttctgcagcgagttcctggagaactgctacaacagactgatgggcagcgtgaaggaccacctgctgagagagaaggcccagcagcacgacgagacctactacatgtgggccctggccttcttcatggccttcaacagagccgccagcttcagacccggcctggtgagcgagaccctgagcgtgagaaccttccacttcatcgagcagaacctgaccaactactacgagatgatgctgaccgacagaaaggaggccgccagctgggccagaagaatgcacctggccctgaaggcctaccaggagctgctggccaccgtgaacgagatggacatcagccccgacgaggccgtgagagagagcagcagaatcatcaagaacaacatcttctacgtgatggagtacagagagctgttcctggccctgttcagaaagttcgacgagagatgccagcccagaagcttcctgagagacctggtggagaccacccacctgttcctgaagatgctggagagattctgcagaagcagaggcaacctggtggtgcagaacaagcagaagaagagaagaaagaagaagaagaaggtgctggaccaggccatcgtgagcggcaacgtgcccagcagccccgaggaggtggaggccgtgtggcccgccctggccgagcagctgcagtgctgcgcccagaacagcgagctgagcatggacagcgtggtgcccttcgacgccgccagcgaggtgcccgtggaggagcagagagccgaggccatggtgagaatccaggactgcctgctggccggccaggccccccaggccctgaccctgctgagaagcgccagagaggtgtggcccgagggcgacgtgttcggcagccaggacatcagccccgaggaggagatccagctgctgaagcagatcctgagcgcccccctgcccagacagcagggccccgaggagagaggcgccgaggaggaggaggaggaggaggaggaggaggaggaggagctgcaggtggtgcaggtgagcgagaaggagttcaacttcctggactacctgaagagattcgcctgcagcaccgtggtgagagcctacgtgctgctgctgagaagctaccagcagaacagcgcccacaccaaccactgcatcgtgaagatgctgcacagactggcccacgacctgaagatggaggccctgctgttccagctgagcgtgttctgcctgttcaacagactgctgagcgaccccgccgccggcgcctacaaggagctggtgaccttcgccaagtacatcctgggcaagttcttcgccctggccgccgtgaaccagaaggccttcgtggagctgctgttctggaagaacaccgccgtggtgagagagatgaccgagggctacggcagcctggacgacagaagcagcagcagaagagcccccacctggagccccgaggaggaggcccacctgagagagctgtacctggccaacaaggacgtggagggccaggacgtggtggaggccatcctggcccacctgaacaccgtgcccagaaccagaaagcagatcatccaccacctggtgcagatgggcctggccgacagcgtgaaggacttccagagaaagggcacccacatcgtgctgtggaccggcgaccaggagctggagctgcagagactgttcgaggagttcagagacagcgacgacgtgctgggccacatcatgaagaacatcaccgccaagagaagcagagccagaatcgtggacaagctgctggccctgggcctggtggccgagagaagagagctgtacaagaagagacagaagaagctggccagcagcatcctgcccaacggcgccgagagcctgaaggacttctgccaggaggacctggaggaggaggagaacctgcccgaggaggacagcgaggaggaggaggagggcggcagcgaggccgagcaggtgcagggcagcctggtgctgagcaacgagaacctgggccagagcctgcaccaggagggcttcagcatccccctgctgtggctgcagaactgcctgatcagagccgccgacgacagagaggaggacggctgcagccaggccgtgcccctggtgcccctgaccgaggagaacgaggaggccatggagaacgagcagttccagcagctgctgagaaagctgggcgtgagaccccccgccagcggccaggagaccttctggagaatccccgccaagctgagccccacccagctgagaagagccgccgccagcctgagccagcccgaggaggagcagaagctgcagcccgagctgcagcccaaggtgcccggcgagcagggcagcgacgaggagcactgcaaggagcacagagcccaggccctgagagccctgctgctggcccacaagaagaaggccggcctggccagccccgaggaggaggacgccgtgggcaaggagcccctgaaggccgcccccaagaagagacagctgctggacagcgacgaggagcaggaggaggacgagggcagaaacagagcccccgagctgggcgcccccggcatccagaagaagaagagataccagatcgaggacgacgaggacgactag

SEQ ID NO: 102549 - DNA, 906 bp, Artificial Sequence
  Description of Artificial Sequence: Synthetic coding sequence
atgctggagccccaggagaacggcgtgatcgacctgcccgactacgagcacgtggaggacgagaccttcccccccttccccccccccgccagccccgagagacaggacggcgagggcaccgagcccgacgaggagagcggcaacggcgcccccgtgagagtgccccccaagagaaccgtgaagagaaacatccccaagctggacgcccagagactgatcagcgagagaggcctgcccgccctgagacacgtgttcgacaaggccaagttcaagggcaagggccacgaggccgaggacctgaagatgctgatcagacacatggagcactgggcccacagactgttccccaagctgcagttcgaggacttcatcgacagagtggagtacctgggcagcaagaaggaggtgcagacctgcctgaagagaatcagactggacctgcccatcctgcacgaggacttcgtgagcaacaacgacgaggtggccgagaacaacgagcacgacgtgaccagcaccgagctggaccccttcctgaccaacctgagcgagagcgagatgttcgccagcgagctgagcagaagcctgaccgaggagcagcagcagagaatcgagagaaacaagcagctggccctggagagaagacaggccaagctgctgagcaacagccagaccctgggcaacgacatgctgatgaacacccccagagcccacaccgtggaggaggtgaacaccgacgaggaccagaaggaggagagcaacggcctgaacgaggacatcctggacaacccctgcaacgacgccatcgccaacaccctgaacgaggaggagaccctgctggaccagagcttcaagaacgtgcagcagcagctggacgccaccagcagaaacatcaccgaggccagatag

SEQ ID NO: 102550 - DNA, 603 bp, Artificial Sequence
  Description of Artificial Sequence: Synthetic coding sequence
atgctgatcagacacatggagcactgggcccacagactgttccccaagctgcagttcgaggacttcatcgacagagtggagtacctgggcagcaagaaggaggtgcagacctgcctgaagagaatcagactggacctgcccatcctgcacgaggacttcgtgagcaacaacgacgaggtggccgagaacaacgagcacgacgtgaccagcaccgagctggaccccttcctgaccaacctgagcgagagcgagatgttcgccagcgagctgagcagaagcctgaccgaggagcagcagcagagaatcgagagaaacaagcagctggccctggagagaagacaggccaagctgctgagcaacagccagaccctgggcaacgacatgctgatgaacacccccagagcccacaccgtggaggaggtgaacaccgacgaggaccagaaggaggagagcaacggcctgaacgaggacatcctggacaacccctgcaacgacgccatcgccaacaccctgaacgaggaggagaccctgctggaccagagcttcaagaacgtgcagcagcagctggacgccaccagcagaaacatcaccgaggccagatag

SEQ ID NO: 102551 - DNA, 537 bp, Artificial Sequence
  Description of Artificial Sequence: Synthetic coding sequence
atgatgatccacggcttccagagcagccacagagacttctgcttcggcccctggaagctgaccgccagcaagacccacatcatgaagagcgccgacgtggagaagctggccgacgagctgcacatgcccagcctgcccgagatgatgttcggcgacaacgtgctgagaatccagcacggcagcggcttcggcatcgagttcaacgccaccgacgccctgagatgcgtgaacaactaccagggcatgctgaaggtggcctgcgccgaggagtggcaggagagcagaaccgagggcgagcacagcaaggaggtgatcaagccctacgactggacctacaccaccgactacaagggcaccctgctgggcgagagcctgaagctgaaggtggtgcccaccaccgaccacatcgacaccgagaagctgaaggccagagagcagatcaagttcttcgaggaggtgctgctgttcgaggacgagctgcacgaccacggcgtgagcagcctgagcgtgaagatccccggcggcggccacctgtag

SEQ ID NO: 102552 - DNA, 819 bp, Artificial Sequence
  Description of Artificial Sequence: Synthetic coding sequence
atgatgatccacggcttccagagcagccacagagacttctgcttcggcccctggaagctgaccgccagcaagacccacatcatgaagagcgccgacgtggagaagctggccgacgagctgcacatgcccagcctgcccgagatgatgttcggcgacaacgtgctgagaatccagcacggcagcggcttcggcatcgagttcaacgccaccgacgccctgagatgcgtgaacaactaccagggcatgctgaaggtggcctgcgccgaggagtggcaggagagcagaaccgagggcgagcacagcaaggaggtgatcaagccctacgactggacctacaccaccgactacaagggcaccctgctgggcgagagcctgaagctgaaggtggtgcccaccaccgaccacatcgacaccgagaagctgaaggccagagagcagatcaagttcttcgaggaggtgctgctgttcgaggacgagctgcacgaccacggcgtgagcagcctgagcgtgaagatcagagtgatgcccagcagcttcttcctgctgctgagattcttcctgagaatcgacggcgtgctgatcagaatgaacgacaccagactgtaccacgaggccgacaagacctacatgctgagagagtacaccagcagagagagcaagatcagcagcctgatgcacgtgccccccagcctgttcaccgagcccaacgagatcagccagtacctgcccatcaaggaggccgtgtgcgagaagctgatcttccccgagagaatcgaccccaaccccgccgacagccagaagagcacccaggtggagtag

SEQ ID NO: 102553 - DNA, 1143 bp, Artificial Sequence; identical to SEQ ID NO: 90505
  Description of Artificial Sequence: Synthetic coding sequence

SEQ ID NO: 102554 - DNA, 756 bp, Artificial Sequence
  Description of Artificial Sequence: Synthetic coding sequence
atgatctacaccatgaagaaggtgcacgccctgtgggccagcgtgtgcctgctgctgaacctggcccccgcccccctgaacgccgacagcgaggaggacgaggagcacaccatcatcaccgacaccgagctgccccccctgaagctgatgcacagcttctgcgccttcaaggccgacgacggcccctgcaaggccatcatgaagagattcttcttcaacatcttcaccagacagtgcgaggagttcatctacggcggctgcgagggcaaccagaacagattcgagagcctggaggagtgcaagaagatgtgcaccagagacaacgccaacagaatcatcaagaccaccctgcagcaggagaagcccgacttctgcttcctggaggaggaccccggcatctgcagaggctacatcaccagatacttctacaacaaccagaccaagcagtgcgagagattcaagtacggcggctgcctgggcaacatgaacaacttcgagaccctggaggagtgcaagaacatctgcgaggacggccccaacggcttccaggtggacaactacggcacccagctgaacgccgtgaacaacagcctgaccccccagagcaccaaggtgcccagcctgttcgtgaccaaggagggcaccaacgacggctggaagaacgccgcccacatctaccaggtgttcctgaacgccttctgcatccacgccagcatgttcttcctgggcctggacagcatcagctgcctgtgctag

SEQ ID NO: 102555 - DNA, 915 bp, Artificial Sequence; identical to SEQ ID NO: 90362
  Description of Artificial Sequence: Synthetic coding sequence

SEQ ID NO: 102556 - DNA, 756 bp, Artificial Sequence; identical to SEQ ID NO: 102554
  Description of Artificial Sequence: Synthetic coding sequence

SEQ ID NO: 102557 - DNA, 231 bp, Artificial Sequence
  Description of Artificial Sequence: Synthetic coding sequence
atgatctacaccatgaagaaggtgcacgccctgtgggccagcgtgtgcctgctgctgaacctggcccccgcccccctgaacgccgacagcgaggaggacgaggagcacaccatcatcaccgacaccgagctgccccccctgaagctgatgcacagcttctgcgccttcaaggccgacgacggcccctgcaaggccatcatgaagagattcttcttcaacatcttcacctag

SEQ ID NO: 102558 - DNA, 186 bp, Artificial Sequence
  Description of Artificial Sequence: Synthetic coding sequence
atgatctacaccatgaagaaggtgcacgccctgtgggccagcgtgtgcctgctgctgaacctggcccccgcccccctgaacgccgacagcgaggaggacgaggagcacaccatcatcaccgacaccgagctgccccccctgaagctgatgcacagcttctgcgccttcaaggccgacgacggctag

SEQ ID NO: 102559 - DNA, 321 bp, Artificial Sequence
  Description of Artificial Sequence: Synthetic coding sequence
atgatctacaccatgaagaaggtgcacgccctgtgggccagcgtgtgcctgctgctgaacctggcccccgcccccctgaacgccgacagcgaggaggacgaggagcacaccatcatcaccgacaccgagctgccccccctgaagctgatgcacagcttctgcgccttcaaggccgacgacggcccctgcaaggccatcatgaagagattcttcttcaacatcttcaccagacagtgcgaggagttcatctacggcggctgcgagggcaaccagaacagattcgagagcctggaggagtgcaagaagatgtgcaccagatag

SEQ ID NO: 102560 - DNA, 867 bp, Artificial Sequence
  Description of Artificial Sequence: Synthetic coding sequence
atgatctacaccatgaagaaggtgcacgccctgtgggccagcgtgtgcctgctgctgaacctggcccccgcccccctgaacgccgacagcgaggaggacgaggagcacaccatcatcaccgacaccgagctgccccccctgaagctgatgcacagcttctgcgccttcaaggccgacgacggcccctgcaaggccatcatgaagagattcttcttcaacatcttcaccagacagtgcgaggagttcatctacggcggctgcgagggcaaccagaacagattcgagagcctggaggagtgcaagaagatgtgcaccagagacaacgccaacagaatcatcaagaccaccctgcagcaggagaagcccgacttctgcttcctggaggaggaccccggcatctgcagaggctacatcaccagatacttctacaacaaccagaccaagcagtgcgagagattcaagtacggcggctgcctgggcaacatgaacaacttcgagaccctggaggagtgcaagaacatctgcgaggacggccccaacggcttccaggtggacaactacggcacccagctgaacgccgtgaacaacagcctgaccccccagagcaccaaggtgcccagcctgttcgagttccacggccccagctggtgcctgacccccgccgacagaggcctgtgcagagccaacgagaacagattctactacaacagcgtgatcggcaagtgcagacccttcaagtacagcggctgcggcggcaacgagaacaacttcaccagcaagcaggagtgcctgagagcctgcaagaagggcttcatccagagaatcagcaagggcggcctgatcaagaccaagagaaagagaaagtag

SEQ ID NO: 102561 - DNA, 321 bp, Artificial Sequence; identical to SEQ ID NO: 102559
  Description of Artificial Sequence: Synthetic coding sequence

SEQ ID NO: 102562 - DNA, 318 bp, Artificial Sequence
  Description of Artificial Sequence: Synthetic coding sequence
atgatctacaccatgaagaaggtgcacgccctgtgggccagcgtgtgcctgctgctgaacctggcccccgcccccctgaacgccgacagcgaggaggacgaggagcacaccatcatcaccgacaccgagctgccccccctgaagctgatgcacagcttctgcgccttcaaggccgacgacggcccctgcaaggccatcatgaagagattcttcttcaacatcttcaccagacagtgcgaggagttcatctacggcggctgcgagggcaaccagaacagattcgagagcctggaggagtgcaagaagatgtgcacctag

SEQ ID NO: 102563 - DNA, 966 bp, Artificial Sequence
  Description of Artificial Sequence: Synthetic coding sequence
atgggcgagccccagggcagcatgagaatcctggtgaccggcggcagcggcctggtgggcaaggccatccagaaggtggtggccgacggcgccggcctgcccggcgaggactgggtgttcgtgagcagcaaggacgccgacctgaccgacaccgcccagaccagagccctgttcgagaaggtgcagcccacccacgtgatccacctggccgccatggtgggcggcctgttcagaaacatcaagtacaacctggacttctggagaaagaacgtgcacatgaacgacaacgtgctgcacagcgccttcgaggtgggcgccagaaaggtggtgagctgcctgagcacctgcatcttccccgacaagaccacctaccccatcgacgagaccatgatccacaacggccccccccacaacagcaacttcggctacagctacgccaagagaatgatcgacgtgcagaacagagcctacttccagcagtacggctgcaccttcaccgccgtgatccccaccaacgtgttcggcccccacgacaacttcaacatcgaggacggccacgtgctgcccggcctgatccacaaggtgcacctggccaagagcagcggcagcgccctgaccgtgtggggcaccggcaaccccagaagacagttcatctacagcctggacctggcccagctgttcatctgggtgctgagagagtacaacgaggtggagcccatcatcctgagcgtgggcgaggaggacgaggtgagcatcaaggaggccgccgaggccgtggtggaggccatggacttccacggcgaggtgaccttcgacaccaccaagagcgacggccagttcaagaagaccgccagcaacagcaagctgagaacctacctgcccgacttcagattcacccccttcaagcaggccgtgaaggagacctgcgcctggttcaccgacaactacgagcaggccagaaagtag

SEQ ID NO: 102564 - DNA, 360 bp, Artificial Sequence
  Description of Artificial Sequence: Synthetic coding sequence
atgggcgagccccagggcagcatgagaatcctggtgaccggcggcagcggcctggtgggcaaggccatccagaaggtggtggccgacggcgccggcctgcccggcgaggactgggtgttcgtgagcagcaaggacgccgacctgaccgacaccgcccagaccagagccctgttcgagaaggtgcagcccacccacgtgatccacctggccgccatggtgggcggcctgttcagaaacatcaagtacaacctggacttctggagaaagaacgtgcacatgaacgacaacgtgctgcacagcgccttcgaggtgggcgccagaaaggtggtgagctgcctgagcacctgcatcttcccctag

SEQ ID NO: 102565 - DNA, 807 bp, Artificial Sequence
  Description of Artificial Sequence: Synthetic coding sequence
atgggcgagccccagggcagcatgagaatcctggtgaccggcggcagcggcctggtgggcaaggccatccagaaggtggtggccgacggcgccggcctgcccggcgaggactgggtgttcgtgagcagcaaggacgccgacctgaccgacaccgcccagaccagagccctgttcgagaaggtgcagcccacccacgtgatccacctggccgccatggtgggcggcctgttcagaaacatcaagtacaacctggacttctggagaaagaacgtgcacatgaacgacaacgtgctgcacagcgccttcgaggtgggcgccagaaaggtggtgagctgcctgagcacctgcatcttccccgacaagaccacctaccccatcgacgagaccatgatccacaacggccccccccacaacagcaacttcggctacagctacgccaagagaatgatcgacgtgcagaacagagcctacttccagcagtacggctgcaccttcaccgccgtgatccccaccaacgtgttcggcccccacgacaacttcaacatcgaggacggccacgtgctgcccggcctgatccacaaggtgcacctggccaagagcagcggcagcgccctgaccgtgtggggcaccggcaaccccagaagacagttcatctacagcctggacctggcccagctgttcatctgggtgctgagagagtacaacgaggtggagcccatcatcctgagcgtgggcgaggaggacgaggtgagcatcaaggaggccgccgaggccgtggtggaggccatggacttccacggcgagtag

SEQ ID NO: 102566 - DNA, 966 bp, Artificial Sequence; identical to SEQ ID NO: 102563
  Description of Artificial Sequence: Synthetic coding sequence

SEQ ID NO: 102567 - DNA, 597 bp, Artificial Sequence
  Description of Artificial Sequence: Synthetic coding sequence
atgggcgagccccagggcagcatgagaatcctggtgaccggcggcagcggcctggtgggcaaggccatccagaaggtggtggccgacggcgccggcctgcccggcgaggactgggtgttcgtgagcagcaaggacgccgacctgaccgacaccgcccagaccagagccctgttcgagaaggtgcagcccacccacgtgatccacctggccgccatggtgggcggcctgttcagaaacatcaagtacaacctggacttctggagaaagaacgtgcacatgaacgacaacgtgctgcacagcgccttcgaggtgggcgccagaaaggtggtgagctgcctgagcacctgcatcttccccgacaagaccacctaccccatcgacgagaccatgatccacaacggccccccccacaacagcaacttcggctacagctacgccaagagaatgatcgacgtgcagaacagagcctacttccagcagtacggctgcaccttcaccgccgtgatccccaccaacgtgttcggcccccacgacaacttcaacatcgaggacggccacgtgctgcccggcctgatccacaaggtgcacctggcctag

SEQ ID NO: 102568 - DNA, 2658 bp, Artificial Sequence
  Description of Artificial Sequence: Synthetic coding sequence
atggtggagaagagcagcatcgacgagaacagcatcagcctggagaaggaggtgagacacgtgcaggagcagaacctggacatcctgaagaccgacctgagcctgaagagcttcagcgaggagatctacagcgagagctgcgccctgctgcccaccagcagcgccgacatcgaggagaccgacctgagcgagaagagctgccccctggagaacggcggcagaagcagcatcagccacctgaagaaggccgccagcgaggagaagcccctgggcgtgggcgagatggaggaggagtgcaccctggagcccgagctggccgccttccccaagcaggacggcggcacccaggagtacaccgacgccaccctggaggaccacagaggcgacgtgcaggaggccgacaccctgcacagacagctgagcctgagccagtgcttccccctgctgatgaccgaggagcagcagaaccccggcgagcagatcagcaccaacatccacgccagcggcgaggagaagtgctacgaggaggtgcaggtgcagaacgaggccagcttcagcaccctggagggcgagatgatcgagaccagcttcagccagaacatccccaagctggacgaggcccacaccaccgaggccgccgagagcgagaccagcctgacccagtacctgctggccgccggcaagagagaggtgcccgagaccaaggacaccagagaccaggccaagctggtgcagagcgagagcatcaccagcatggaggtggaggaggtgaccttcaacaccgtgtacgagtactacaaccagaagcaggagagcctgggcagacccctgagccccgagagcgacatcagcatcggcgtgggcagcaccaccagcgaggagatcagcgagctggaccagttctacaccccccccagcagcgtggagtacttcgagagccccaagagccccgacctgtacttcaaccccagcgacatcaccaagcagagcagcatccacagcggcggcgagaccgtggagagatacagcacccccctgggcgaggtggccgagagatacagcacccccagcgagggcgaggtgggcgagagatacagcaccccccccggcgagaccctggagagatacagcaccccccccggcgagaccctggagagatacagcaccccccccggcgaggccctggagagatacagcatccccaccggcggccccaaccccaccggcaccttcaagacctaccccagcaagatcgagagagaggacggcacccccaacgagcacttctacacccccaccgaggagagaggcagcgcctacgagatctggagaagcgacagcttcggcacccccaacgaggccatcgagcccaaggacaacgagatgccccccagcttcatcgagcccctgaccaagagaaaggtgtacgagaacaccaccctgggcttcatcgtggaggtggagggcctgcccgtgcccggcgtgaagtggtacagaaacaagagcctgctggagcccgacgagagaatcaagatggagagagtgggcaacgtgtgcagcctggagatcagcaacatccagaagggcgagggcggcgagtacatgtgccacgccgtgaacatcatcggcgaggccaagagcttcgccaacgtggacatcatgccccaggaggagagagtggtggccctgcccccccccgtgacccaccagcacgtgatggagttcgacctggagcacaccaccagcagcagaacccccagcccccaggagatcgtgctggaggtggagctgagcgagaaggacgtgaaggagttcgagaagcaggtgaagatcgtgaccgtgcccgagttcacccccgaccacaagagcatgatcgtgagcctggacgtgctgcccttcaacttcgtggaccccaacatggacagcagagagggcgaggacaaggagctgaagatcgacctggaggtgttcgagatgccccccagattcatcatgcccatctgcgacttcaagatccccgagaacagcgacgccgtgttcaagtgcagcgtgatcggcatccccacccccgaggtgaagtggtacaaggagtacatgtgcatcgagcccgacaacatcaagtacgtgatcagcgaggagaagggcagccacaccctgaagatcagaaacgtgtgcctgagcgacagcgccacctacagatgcagagccgtgaactgcgtgggcgaggccatctgcagaggcttcctgaccatgggcgacagcgagatcttcgccgtgatcgccaagaagagcaaggtgaccctgagcagcctgatggaggagctggtgctgaagagcaactacaccgacagcttcttcgagttccaggtggtggagggcccccccagattcatcaagggcatcagcgactgctacgcccccatcggcaccgccgcctacttccagtgcctggtgagaggcagccccagacccaccgtgtactggtacaaggacggcaagctggtgcagggcagaagattcaccgtggaggagagcggcaccggcttccacaacctgttcatcaccagcctggtgaagagcgacgagggcgagtacagatgcgtggccaccaacaagagcggcatggccgagagcttcgccgccctgaccctgacctag

SEQ ID NO: 102569 - DNA, 16815 bp, Artificial Sequence
  Description of Artificial Sequence: Synthetic coding sequence
atgaccacccaggcccccaccttcacccagcccctgcagagcgtggtggtgctggagggcagcaccgccaccttcgaggcccacatcagcggcttccccgtgcccgaggtgagctggttcagagacggccaggtgatcagcaccagcaccctgcccggcgtgcagatcagcttcagcgacggcagagccaagctgaccatccccgccgtgaccaaggccaacagcggcagatacagcctgaaggccaccaacggcagcggccaggccaccagcaccgccgagctgctggtgaaggccgagaccgccccccccaacttcgtgcagagactgcagagcatgaccgtgagacagggcagccaggtgagactgcaggtgagagtgaccggcatccccacccccgtggtgaagttctacagagacggcgccgagatccagagcagcctggacttccagatcagccaggagggcgacctgtacagcctgctgatcgccgaggcctaccccgaggacagcggcacctacagcgtgaacgccaccaacagcgtgggcagagccaccagcaccgccgagctgctggtgcagggcgaggaggaggtgcccgccaagaagaccaagaccatcgtgagcaccgcccagatcagcgagagcagacagaccagaatcgagaagaagatcgaggcccacttcgacgccagaagcatcgccaccgtggagatggtgatcgacggcgccgccggccagcagctgccccacaagaccccccccagaatcccccccaagcccaagagcagaagccccaccccccccagcatcgccgccaaggcccagctggccagacagcagagccccagccccatcagacacagccccagccccgtgagacacgtgagagcccccacccccagccccgtgagaagcgtgagccccgccgccagaatcagcaccagccccatcagaagcgtgagaagccccctgctgatgagaaagacccaggccagcaccgtggccaccggccccgaggtgccccccccctggaagcaggagggctacgtggccagcagcagcgaggccgagatgagagagaccaccctgaccaccagcacccagatcagaaccgaggagagatgggagggcagatacggcgtgcaggagcaggtgaccatcagcggcgccgccggcgccgccgccagcgtgagcgccagcgccagctacgccgccgaggccgtggccaccggcgccaaggaggtgaagcaggacgccgacaagagcgccgccgtggccaccgtggtggccgccgtggacatggccagagtgagagagcccgtgatcagcgccgtggagcagaccgcccagagaaccaccaccaccgccgtgcacatccagcccgcccaggagcaggtgagaaaggaggccgagaagaccgccgtgaccaaggtggtggtggccgccgacaaggccaaggagcaggagctgaagagcagaaccaaggaggtgatcaccaccaagcaggagcagatgcacgtgacccacgagcagatcagaaaggagaccgagaagaccttcgtgcccaaggtggtgatcagcgccgccaaggccaaggagcaggagaccagaatcagcgaggagatcaccaagaagcagaagcaggtgacccaggaggccatcagacaggagaccgagatcaccgccgccagcatggtggtggtggccaccgccaagagcaccaagctggagaccgtgcccggcgcccaggaggagaccaccacccagcaggaccagatgcacctgagctacgagaagatcatgaaggagaccagaaagaccgtggtgcccaaggtgatcgtggccacccccaaggtgaaggagcaggacctggtgagcagaggcagagagggcatcaccaccaagagagagcaggtgcagatcacccaggagaagatgagaaaggaggccgagaagaccgccctgagcaccatcgccgtggccaccgccaaggccaaggagcaggagaccatcctgagaaccagagagaccatggccaccagacaggagcagatccaggtgacccacggcaaggtggacgtgggcaagaaggccgaggccgtggccaccgtggtggccgccgtggaccaggccagagtgagagagcccagagagcccggccacctggaggagagctacgcccagcagaccaccctggagtacggctacaaggagagaatcagcgccgccaaggtggccgagcccccccagagacccgccagcgagccccacgtggtgcccaaggccgtgaagcccagagtgatccaggcccccagcgagacccacatcaagaccaccgaccagaagggcatgcacatcagcagccagatcaagaagaccaccgacctgaccaccgagagactggtgcacgtggacaagagacccagaaccgccagcccccacttcaccgtgagcaagatcagcgtgcccaagaccgagcacggctacgaggccagcatcgccggcagcgccatcgccaccctgcagaaggagctgagcgccaccagcagcgcccagaagatcaccaagagcgtgaaggcccccaccgtgaagcccagcgagaccagagtgagagccgagcccacccccctgccccagttccccttcgccgacacccccgacacctacaagagcgaggccggcgtggaggtgaagaaggaggtgggcgtgagcatcaccggcaccaccgtgagagaggagagattcgaggtgctgcacggcagagaggccaaggtgaccgagaccgccagagtgcccgcccccgtggagatccccgtgaccccccccaccctggtgagcggcctgaagaacgtgaccgtgatcgagggcgagagcgtgaccctggagtgccacatcagcggctaccccagccccaccgtgacctggtacagagaggactaccagatcgagagcagcatcgacttccagatcaccttccagagcggcatcgccagactgatgatcagagaggccttcgccgaggacagcggcagattcacctgcagcgccgtgaacgaggccggcaccgtgagcaccagctgctacctggccgtgcaggtgagcgaggagttcgagaaggagaccaccgccgtgaccgagaagttcaccaccgaggagaagagattcgtggagagcagagacgtggtgatgaccgacaccagcctgaccgaggagcaggccggccccggcgagcccgccgccccctacttcatcaccaagcccgtggtgcagaagctggtggagggcggcagcgtggtgttcggctgccaggtgggcggcaaccccaagccccacgtgtactggaagaagagcggcgtgcccctgaccaccggctacagatacaaggtgagctacaacaagcagaccggcgagtgcaagctggtgatcagcatgaccttcgccgacgacgccggcgagtacaccatcgtggtgagaaacaagcacggcgagaccagcgccagcgccagcctgctggaggaggccgactacgagctgctgatgaagagccagcaggagatgctgtaccagacccaggtgaccgccttcgtgcaggagcccaaggtgggcgagaccgcccccggcttcgtgtacagcgagtacgagaaggagtacgagaaggagcaggccctgatcagaaagaagatggccaaggacaccgtggtggtgagaacctacgtggaggaccaggagttccacatcagcagcttcgaggagagactgatcaaggagatcgagtacagaatcatcaagaccaccctggaggagctgctggaggaggacggcgaggagaagatggccgtggacatcagcgagagcgaggccgtggagagcggcttcgacagcagaatcaagaactacagaatcctggagggcatgggcgtgaccttccactgcaagatgagcggctaccccctgcccaagatcgcctggtacaaggacggcaagagaatcaagcacggcgagagataccagatggacttcctgcaggacggcagagccagcctgagaatccccgtggtgctgcccgaggacgagggcatctacaccgccttcgccagcaacatcaagggcaacgccatctgcagcggcaagctgtacgtggagcccgccgcccccctgggcgcccccacctacatccccaccctggagcccgtgagcagaatcagaagcctgagccccagaagcgtgagcagaagccccatcagaatgagccccgccagaatgagccccgccagaatgagccccgccagaatgagccccgccagaatgagccccggcagaagactggaggagaccgacgagagccagctggagagactgtacaagcccgtgttcgtgctgaagcccgtgagcttcaagtgcctggagggccagaccgccagattcgacctgaaggtggtgggcagacccatgcccgagaccttctggttccacgacggccagcagatcgtgaacgactacacccacaaggtggtgatcaaggaggacggcacccagagcctgatcatcgtgcccgccacccccagcgacagcggcgagtggaccgtggtggcccagaacagagccggcagaagcagcatcagcgtgatcctgaccgtggaggccgtggagcaccaggtgaagcccatgttcgtggagaagctgaagaacgtgaacatcaaggagggcagcagactggagatgaaggtgagagccaccggcaaccccaaccccgacatcgtgtggctgaagaacagcgacatcatcgtgccccacaagtaccccaagatcagaatcgagggcaccaagggcgaggccgccctgaagatcgacagcaccgtgagccaggacagcgcctggtacaccgccaccgccatcaacaaggccggcagagacaccaccagatgcaaggtgaacgtggaggtggagttcgccgagcccgagcccgagagaaagctgatcatccccagaggcacctacagagccaaggagatcgccgcccccgagctggagcccctgcacctgagatacggccaggagcagtgggaggagggcgacctgtacgacaaggagaagcagcagaagcccttcttcaagaagaagctgaccagcctgagactgaagagattcggccccgcccacttcgagtgcagactgacccccatcggcgaccccaccatggtggtggagtggctgcacgacggcaagcccctggaggccgccaacagactgagaatgatcaacgagttcggctactgcagcctggactacggcgtggcctacagcagagacagcggcatcatcacctgcagagccaccaacaagtacggcaccgaccacaccagcgccaccctgatcgtgaaggacgagaagagcctggtggaggagagccagctgcccgagggcagaaagggcctgcagagaatcgaggagctggagagaatggcccacgagggcgccctgaccggcgtgaccaccgaccagaaggagaagcagaagcccgacatcgtgctgtaccccgagcccgtgagagtgctggagggcgagaccgccagattcagatgcagagtgaccggctacccccagcccaaggtgaactggtacctgaacggccagctgatcagaaagagcaagagattcagagtgagatacgacggcatccactacctggacatcgtggactgcaagagctacgacaccggcgaggtgaaggtgaccgccgagaaccccgagggcgtgatcgagcacaaggtgaagctggagatccagcagagagaggacttcagaagcgtgctgagaagagcccccgagcccagacccgagttccacgtgcacgagcccggcaagctgcagttcgaggtgcagaaggtggacagacccgtggacaccaccgagaccaaggaggtggtgaagctgaagagagccgagagaatcacccacgagaaggtgcccgaggagagcgaggagctgagaagcaagttcaagagaagaaccgaggagggctactacgaggccatcaccgccgtggagctgaagagcagaaagaaggacgagagctacgaggagctgctgagaaagaccaaggacgagctgctgcactggaccaaggagctgaccgaggaggagaagaaggccctggccgaggagggcaagatcaccatccccaccttcaagcccgacaagatcgagctgagccccagcatggaggcccccaagatcttcgagagaatccagagccagaccgtgggccagggcagcgacgcccacttcagagtgagagtggtgggcaagcccgaccccgagtgcgagtggtacaagaacggcgtgaagatcgagagaagcgacagaatctactggtactggcccgaggacaacgtgtgcgagctggtgatcagagacgtgaccgccgaggacagcgccagcatcatggtgaaggccatcaacatcgccggcgagaccagcagccacgccttcctgctggtgcaggccaagcagctgatcaccttcacccaggagctgcaggacgtggtggccaaggagaaggacaccatggccaccttcgagtgcgagaccagcgagcccttcgtgaaggtgaagtggtacaaggacggcatggaggtgcacgagggcgacaagtacagaatgcacagcgacagaaaggtgcacttcctgagcatcctgaccatcgacaccagcgacgccgaggactacagctgcgtgctggtggaggacgagaacgtgaagaccaccgccaagctgatcgtggagggcgccgtggtggagttcgtgaaggagctgcaggacatcgaggtgcccgagagctacagcggcgagctggagtgcatcgtgagccccgagaacatcgagggcaagtggtaccacaacgacgtggagctgaagagcaacggcaagtacaccatcaccagcagaagaggcagacagaacctgaccgtgaaggacgtgaccaaggaggaccagggcgagtacagcttcgtgatcgacggcaagaagaccacctgcaagctgaagatgaagcccagacccatcgccatcctgcagggcctgagcgaccagaaggtgtgcgagggcgacatcgtgcagctggaggtgaaggtgagcctggagagcgtggagggcgtgtggatgaaggacggccaggaggtgcagcccagcgacagagtgcacatcgtgatcgacaagcagagccacatgctgctgatcgaggacatgaccaaggaggacgccggcaactacagcttcaccatccccgccctgggcctgagcaccagcggcagagtgagcgtgtacagcgtggacgtgatcacccccctgaaggacgtgaacgtgatcgagggcaccaaggccgtgctggagtgcaaggtgagcgtgcccgacgtgaccagcgtgaagtggtacctgaacgacgagcagatcaagcccgacgacagagtgcaggccatcgtgaagggcaccaagcagagactggtgatcaacagaacccacgccagcgacgagggcccctacaagctgatcgtgggcagagtggagaccaactgcaacctgagcgtggagaagatcaagatcatcagaggcctgagagacctgacctgcaccgagacccagaacgtggtgttcgaggtggagctgagccacagcggcatcgacgtgctgtggaacttcaaggacaaggagatcaagcccagcagcaagtacaagatcgaggcccacggcaagatctacaagctgaccgtgctgaacatgatgaaggacgacgagggcaagtacaccttctacgccggcgagaacatgaccagcggcaagctgaccgtggccggcggcgccatcagcaagcccctgaccgaccagaccgtggccgagagccaggaggccgtgttcgagtgcgaggtggccaaccccgacagcaagggcgagtggctgagagacggcaagcacctgcccctgaccaacaacatcagaagcgagagcgacggccacaagagaagactgatcatcgccgccaccaagctggacgacatcggcgagtacacctacaaggtggccaccagcaagaccagcgccaagctgaaggtggaggccgtgaagatcaagaagaccctgaagaacctgaccgtgaccgagacccaggacgccgtgttcaccgtggagctgacccaccccaacgtgaagggcgtgcagtggatcaagaacggcgtggtgctggagagcaacgagaagtacgccatcagcgtgaagggcaccatctacagcctgagaatcaagaactgcgccatcgtggacgagagcgtgtacggcttcagactgggcagactgggcgccagcgccagactgcacgtggagaccgtgaagatcatcaagaagcccaaggacgtgaccgccctggagaacgccaccgtggccttcgaggtgagcgtgagccacgacaccgtgcccgtgaagtggttccacaagagcgtggagatcaagcccagcgacaagcacagactggtgagcgagagaaaggtgcacaagctgatgctgcagaacatcagccccagcgacgccggcgagtacaccgccgtggtgggccagctggagtgcaaggccaagctgttcgtggagaccctgcacatcaccaagaccatgaagaacatcgaggtgcccgagaccaagaccgccagcttcgagtgcgaggtgagccacttcaacgtgcccagcatgtggctgaagaacggcgtggagatcgagatgagcgagaagttcaagatcgtggtgcagggcaagctgcaccagctgatcatcatgaacaccagcaccgaggacagcgccgagtacaccttcgtgtgcggcaacgaccaggtgagcgccaccctgaccgtgacccccatcatgatcaccagcatgctgaaggacatcaacgccgaggagaaggacaccatcaccttcgaggtgaccgtgaactacgagggcatcagctacaagtggctgaagaacggcgtggagatcaagagcaccgacaagtgccagatgagaaccaagaagctgacccacagcctgaacatcagaaacgtgcacttcggcgacgccgccgactacaccttcgtggccggcaaggccaccagcaccgccaccctgtacgtggaggccagacacatcgagttcagaaagcacatcaaggacatcaaggtgctggagaagaagagagccatgttcgagtgcgaggtgagcgagcccgacatcaccgtgcagtggatgaaggacgaccaggagctgcagatcaccgacagaatcaagatccagaaggagaagtacgtgcacagactgctgatccccagcaccagaatgagcgacgccggcaagtacaccgtggtggccggcggcaacgtgagcaccgccaagctgttcgtggagggcagagacgtgagaatcagaagcatcaagaaggaggtgcaggtgatcgagaagcagagagccgtggtggagttcgaggtgaacgaggacgacgtggacgcccactggtacaaggacggcatcgagatcaacttccaggtgcaggagagacacaagtacgtggtggagagaagaatccacagaatgttcatcagcgagaccagacagagcgacgccggcgagtacaccttcgtggccggcagaaacagaagcagcgtgaccctgtacgtgaacgcccccgagcccccccaggtgctgcaggagctgcagcccgtgaccgtgcagagcggcaagcccgccagattctgcgccgtgatcagcggcagaccccagcccaagatcagctggtacaaggaggagcagctgctgagcaccggcttcaagtgcaagttcctgcacgacggccaggagtacaccctgctgctgatcgaggccttccccgaggacgccgccgtgtacacctgcgaggccaagaacgactacggcgtggccaccaccagcgccagcctgagcgtggaggtgcccgaggtggtgagccccgaccaggagatgcccgtgtacccccccgccatcatcacccccctgcaggacaccgtgaccagcgagggccagcccgccagattccagtgcagagtgagcggcaccgacctgaaggtgagctggtacagcaaggacaagaagatcaagcccagcagattcttcagaatgacccagttcgaggacacctaccagctggagatcgccgaggcctaccccgaggacgagggcacctacaccttcgtggccagcaacgccgtgggccaggtgagcagcaccgccaacctgagcctggaggcccccgagagcatcctgcacgagagaatcgagcaggagatcgagatggagatgaaggagctgttcagcgagggcgagagcgagcacagcgagagagacaccagagacgccttcagcgacagcgaggacatcgaccacaagagcatggccgccaagagatacgccagcagaatcagcagcaccagcagctggcccgagtacttcaagcccagcttcacccagaagctgaccttcaagtacgtgctggagggcgagcccgtggtgttcacctgcagactgatcgcctgccccacccccgagatgacctggttccacaacaacagacccatccccaccggcctgagaagaatcatcaaggccgagagcgacctgcaccaccacagcagcagcctggagatcaagagagtgcaggacagagacagcggcagctacagactgctggccatcaacagcgagggcagcgccgagagcaccgccagcctgctggtgatccagaagggccaggacgagaagtacctggagttcctgaagagagccgagagaacccacgagaacgtggaggccctggtggagagaggcgaggacagaatcaaggtggacctgagattcaccggcagccccttcaacaagaagcaggacgtggagcagaagggcatgatgagaaccatccacttcaagaccatgagcagcgccaagaagaccgactacatgtacgacgaggagtacctggagagcaagagcgacatcagaggctggctgaacgtgggcgagagcttcctggacaaggagaccaaggtgaagctgcagagactgagagaggccagaaagaccctgatggagaagaagaagctgagcctgctggacaccagcagcgagatcagcagcagaaccctgagaagcgaggccagcgacaaggacatcctgttcagcagagaggacatgaagatcagaagcatgagcgacctggccgagagctacaaggtggaccacagcgccgagagcatcgtgcagaacccccacgccctgagcaaccagatggaccagaacatcgagagcgaggagctgcccaccagcttccagaccatcgtggacgaggagatcttccagaccgagatcagaatgagccaggaggccctggtgaaggagagcctgcccaaggaccacctgtacggcgagatcctggtgaacgagaacacccaggccagaggccagctggaggagatcatggccaacaccaccatcggcgagagcagcacctacatcaccaacgtgtgcgagaaggaggaggtgtacgagacccccgagaacgtgagccaggccatcaccccccacgccagcgagagcttcggcaccctggtgaacgtggaggagagcgaggagatcgccagcgagagaatcaagaaggacgacctgagagagctgcagctgagcgccagcaccagaatcgacgagttcaagaccgagcagaaggaggagaacatgagattcttcgagaacagcttcagaaagagaccccagagatgcccccccagcttcctgcaggagatcgagagccaggaggtgtacgagggcgacagctgcaacttcgtgtgccacttccagggctacccccagcccatcgtgacctggtacaacaacgacatgcccatccccagaaaccagaacttcatcatccacagcctggagaactacagcatcctgaccctgagcagcgtgcaccaccagaacgagggcagcatcacctgcgtgctgttcaaccagtacggcaccgtgaagaccaccagcatgctgaaggtgaaggccaagcagaagcacgacgtgaaggcccacaaggtgcccgtgttccacgactacctggacgaggaggaggagctggccctggtgttcgaccaggccaagggcgcccaccccagcatgagccaggagggccagaccaacctgcacctgctgaagaccaacccccccgtgccccccagcggcgacaccgagctgctgagcttccccgtggagatccaggtgaccgccgccacccccatccccgagcaggacaaggagagcaaggaggtgttccagaccgaggagctggagcccaaggccatgccccaggaccaggtgacccagagccccaagcacagattcgtgttcctgagcgacatcaccaacgagccccccaagatgctgcaggagatgcccaagcacgccagatgcagagagggcgacagcatcatcctggagtgcctgatcagcggcgagccccagcccgtggtgacctggttccagaacggcgtgctgctgaagcagaaccagaagttccagttcgaggaggtgaactgcagccaccagctgtacatcaaggacgtgaacagccaggacagcggcaagtacaagtgcgtggccgagaacaacagcggcgccgtggagagcgtgagcgacctgaccgtggagcccgtgacctacagagagaacagccagttcgagaacatcggcgagatctacggcaagtacagcagagaccagcagctgcaggaccagggcgagagcgtgagagcccacttctacgactaccccgccggccccttcaccccctggaccaacgtgaaggagtacagcgtgagagactacttccagagcctggagaccatcgagcagatcgaccagaaggagcaggtgagatgcatccccagcagagagaagatccccagattcgtgcacggcgccagcagaaccatcaagatcagcaagcccatcagagccgagttcatccagtgccaggccgagggcaaggagagacacgtgagcgagaagagcaagctgcaccaggccgagggcaccgtgtaccccttcgtggacgacttcagcgacgtgaccatcaagaaggagatcagaaacaacttcggcaagctgggcagaagcgagaaggagaacgtgcaggagtgcgcccagagcgactacctgcccaacatccacagcgagagaatcagcgacagctacaacaccaaggacagcagcgccatcgtgtacgaggagagcctgggcgaggagatccactaccccggcaagaaggtgaagcacagaatcatcgagttcgagaagctgcacgtggagaagggcgtgctggagaagagacccaccagaaccagcatcgtgaaccccccccagaagaagatcgacgacaaggccttcagcctgaagcagagagagagcagaagcagcaacctgaacgccaacatgtaccaggccgagaagatgagccccaacaccgagagcgacagcagcaacatcgccatcaacctgaagctgctgagcagccagacccacaaggagttcgacgcccaggagagagagcagcaggagaagatcagcctgatcgacaagcccgccatcagcaagagagccgagcacgagagccccatcaccttcgacctgaagcagttccacacccagatcaagcacaccgacgtgaagttccaggagctggacagcggccagcccgaggaggcctacttcaagatccagcaccccgccgacaccgagaacatcgtgttcgacctgaagcagatgtacagccacatcggcgaccccgccctggagttccagggccaggagaccagagagcagcaggagatccactacaaggagaagatccccagccccgagaccctgcagcccgacacccacaacatcagcaagagcgtgcagaacaacgtgttcgccagccaggagatcagcagcagccaggagctgagcaacagaaccatggtggagaagagcagcatcgacgagaacagcatcagcctggagaaggaggtgagacacgtgcaggagcagaacctggacatcctgaagaccgacctgagcctgaagagcttcagcgaggagatctacagcgagagctgcgccctgctgcccaccagcagcgccgacatcgaggagaccgacctgagcgagaagagctgccccctggagaacggcggcagaagcagcatcagccacctgaagaaggccgccagcgaggagaagcccctgggcgtgggcgagatggaggaggagtgcaccctggagcccgagctggccgccttccccaagcaggacggcggcacccaggagtacaccgacgccaccctggaggaccacagaggcgacgtgcaggaggccgacaccctgcacagacagctgagcctgagccagtgcttccccctgctgatgaccgaggagcagcagaaccccggcgagcagatcagcaccaacatccacgccagcggcgaggagaagtgctacgaggaggtgcaggtgcagaacgaggccagcttcagcaccctggagggcgagatgatcgagaccagcttcagccagaacatccccaagctggacgaggcccacaccaccgaggccgccgagagcgagaccagcctgacccagtacctgctggccgccggcaagagagaggtgcccgagaccaaggacaccagagaccaggccaagctggtgcagagcgagagcatcaccagcatggaggtggaggaggtgaccttcaacaccgtgtacgagtactacaaccagaagcaggagagcctgggcagacccctgagccccgagagcgacatcagcatcggcgtgggcagcaccaccagcgaggagatcagcgagctggaccagttctacaccccccccagcagcgtggagtacttcgagagccccaagagccccgacctgtacttcaaccccagcgacatcaccaagcagagcagcatccacagcggcggcgagaccgtggagagatacagcacccccctgggcgaggtggccgagagatacagcacccccagcgagggcgaggtgggcgagagatacagcaccccccccggcgagaccctggagagatacagcaccccccccggcgagaccctggagagatacagcaccccccccggcgagaccctggagagatacagcaccccccccggcgagaccctggagagatacagcaccccccccggcgagaccctggagagatacagcaccccccccggcgaggccctggagagatacagcatccccaccggcggccccaaccccaccggcaccttcaagacctaccccagcaagatcgagagagaggacggcacccccaacgagcacttctacacccccaccgaggagagaggcagcgcctacgagatctggagaagcgacagcttcggcacccccaacgaggccatcgagcccaaggacaacgagatgccccccagcttcatcgagcccctgaccaagagaaaggtgtacgagaacaccaccctgggcttcatcgtggaggtggagggcctgcccgtgcccggcgtgaagtggtacagaaacaagagcctgctggagcccgacgagagaatcaagatggagagagtgggcaacgtgtgcagcctggagatcagcaacatccagaagggcgagggcggcgagtacatgtgccacgccgtgaacatcatcggcgaggccaagagcttcgccaacgtggacatcatgccccaggaggagagagtggtggccctgcccccccccgtgacccaccagcacgtgatggagttcgacctggagcacaccaccagcagcagaacccccagcccccaggagatcgtgctggaggtggagctgagcgagaaggacgtgaaggagttcgagaagcaggtgaagatcgtgaccgtgcccgagttcacccccgaccacaagagcatgatcgtgagcctggacgtgctgcccttcaacttcgtggaccccaacatggacagcagagagggcgaggacaaggagctgaagatcgacctggaggtgttcgagatgccccccagattcatcatgcccatctgcgacttcaagatccccgagaacagcgacgccgtgttcaagtgcagcgtgatcggcatccccacccccgaggtgaagtggtacaaggagtacatgtgcatcgagcccgacaacatcaagtacgtgatcagcgaggagaagggcagccacaccctgaagatcagaaacgtgtgcctgagcgacagcgccacctacagatgcagagccgtgaactgcgtgggcgaggccatctgcagaggcttcctgaccatgggcgacagcgagatcttcgccgtgatcgccaagaagagcaaggtgaccctgagcagcctgatggaggagctggtgctgaagagcaactacaccgacagcttcttcgagttccaggtggtggagggcccccccagattcatcaagggcatcagcgactgctacgcccccatcggcaccgccgcctacttccagtgcctggtgagaggcagccccagacccaccgtgtactggtacaaggacggcaagctggtgcagggcagaagattcaccgtggaggagagcggcaccggcttccacaacctgttcatcaccagcctggtgaagagcgacgagggcgagtacagatgcgtggccaccaacaagagcggcatggccgagagcttcgccgccctgaccctgacctag

SEQ ID NO: 102570 - DNA, 1419 bp, Artificial Sequence
  Description of Artificial Sequence: Synthetic coding sequence
atgtacatctacgaggccagcgaggaggccgtgctggaggagaaggtgctggtgacccagccccagaagaccaagcccaagctggccaaggtgcccgagccccccaagaaggtggtgcccgaggacaagatctacgtgaccatccccaagaagagagagacccccgccaccaaggagcccgacaccaccagaggcatcttccccgaggtggagccccccgaggccatccccgagatccccgagcacccccccaccgaggagttcgaggtgttcaaggaggtgatccccgagggcgagacccccatcgtgaagagaagaaagacccccagccccaccgcccccgaggccatgaaggaggtggtgcccgagatgaagatcttcgaggacgtgcccgaggagcccgagacccccagaatgaagacccccgaggccccccaggagatcatccccgccaagaccgtgcccagcaagaagagagagccccccagcgtgaaggtgcccgaggccctgcaggagatcgtgcccgagaagaagaccctggtggtgcccctgagaaagcccgaggtgctgcccgacgaggtgcccgaggccctgagagaggtggtgcccgagaagaaggtgcaccccccccagagagccgaggtggtgcccgtgaaggtgcacgaggcccccaaggagatcatccccgagaagaaggtgagcgtggtgccccccaagaagcccgaggtgccccccgtgaaggtgcccgaggccagcaaggaggtgatcagagaggagaaggtgcccctggccccccccaaggagcccgaggtgccccccgtgaaggtgcccgagccccccaaggaggtggtgcccgagaagaaggcccccgtggccccccccaaggagcccgaggtgccccccgtgaaggtgcccgaggcccccaaggaggtggtgcccgagaagaaggtgcccgtgcccccccccaagaagcccgaggtgccccccaccaaggtgcccgaggtgcccaaggccgccgtgcccgagaagaagctgcccgaggccatcccccccaagcccgagagccccccccccgaggtgcccgaggtgctgccccccaaggaggtggtgcccgagaagaaggtgcccgtgccccccgccaagaagcccgaggcccccccccccaaggtgcccgaggcccccaaggaggtggtgctggagaagaaggccagcgtggccgtgcccaagaagcccgaggcccccagagccaaggtgcccgaggccgcccaggaggtggtgcccgagaagaagatccccaaggcccccatcaagaagcccgaggcccccgccgtgaccgtgcccgaggtgccccaggagatcgtgcccgagaagaagaccctggtgctgcccaagaagcccgaggtgccccccgtgacctag

SEQ ID NO: 102571 - DNA, 1122 bp, Artificial Sequence
  Description of Artificial Sequence: Synthetic coding sequence
gtggtgcccgagaagaaggtgcccctggtggtgcccaagaagcccgaggccccccccgccaaggtgcccgaggtgcccaaggaggtggtgcccgagaagaaggtggccgtgcccaagaagcccgaggtgccccccgccaaggtgcccgaggtgcccaagaagcccgtgctggaggagaagcccgccgtgcccgtgcccgagagagccgagagccccccccccgaggtgtacgaggagcccgaggagatcgcccccgaggaggagatcgcccccgaggaggagaagcccgtgcccgtggccgaggaggaggagcccgaggtgcccccccccgccgtgcccgaggagcccaagaagatcatccccgagaagaaggtgcccgtgatcaagaagcccgaggcccccccccccaaggagcccgagatgcccaagaaggtggtgcccgtgaagaaggtgcccaccgtgaagaagcccgagacccccgccgccaaggtgcccgaggtgcccaagaagctggtgcccgtgaagaaggagcccgtgcccgtgaccaagaagcccgaggtgctgcccgagaaggtgcccaaggtgcccgagaagatcatccccgagaaggaggtgagcgtgcccatccccgccgagcccgaggtgccccccgccgaggtggaggagacccccgaggagatcatctacgaggagaaggccagcatcaccatcggcagaaaggagaccccccccgtggaggagagagagatcgagaagtacatcaagcccgaggagcccgagcccgagccccagcccgaggagatccccgtgaaggagcccgagcccgagaaggtgatcgagaagcccaagctgaagcccagaccccccccccccccccccgccccccccaaggaggacgtgaaggagaagatcttccagctgaaggccatccccaagaagaaggtgcccgagaagccccaggtgcccgagaaggtggagctgacccccctgaaggtgcccgagccccccccccccaagcccgtggaggaggtggaggtgcccaccgtgaccaagagagagagaaagatccccgagcccaccaaggtgcccgagatcaagcccgccatccccctgcccgcctag

SEQ ID NO: 102572 - DNA, 543 bp, Artificial Sequence
  Description of Artificial Sequence: Synthetic coding sequence
aaggtgcccgaggtgcccaagaagcccgtgctggaggagaagcccgccgtgcccgtgcccgagagagccgagagccccccccccgaggtgtacgaggagcccgaggagatcgcccccgaggaggagatcgcccccgaggaggagaagcccgtgcccgtggccgaggaggaggagcccgaggtgcccccccccgccgtgcccgaggagcccaagaagatcatccccgagaagaaggtgcccgtgatcaagaagcccgaggcccccccccccaaggagcccgagcccgagaaggtgatcgagaagcccaagctgaagcccagaccccccccccccccccccgccccccccaaggaggacgtgaaggagaagatcttccagctgaaggccatccccaagaagaaggtgcccgagaagccccaggtgcccgagaaggtggagctgacccccctgaaggtgcccggcggcgagaagaaggtgagaaagctgctgcccgagagaaagcccgagcccaaggaggaggtggtgctgaagagcggcatctag

SEQ ID NO: 102573 - DNA, 438 bp, Artificial Sequence
  Description of Artificial Sequence: Synthetic coding sequence
gaggacacctaccagctggagatcgccgaggcctaccccgaggacgagggcacctacaccttcgtggccagcaacgccgtgggccaggtgagcagcaccgccaacctgagcctggaggcccccgagagcatcctgcacgagagaatcgagcaggagatcgagatggagatgaaggagctgttcagcgagggcgagagcgagcacagcgagagagacaccagagacgccttcagcgacagcgaggacatcgaccacaagagcatggccgccaagagatacgccagcagaatcagcagcaccagcagctggcccgagtacttcaagcccagcttcacccagaagctgaccttcaagtacgtgctggagggcgagcccgtggtgttcacctgcagactgatcgcctgccccacccccgagatgacctggttccacaactag

SEQ ID NO: 102574 - DNA, 546 bp, Artificial Sequence
  Description of Artificial Sequence: Synthetic coding sequence
atgttcttcgccagccacaccgaggaggaggtgagcgtgaccgtgcccgaggtgcagaaggagatcgtgaccgaggagaagatccacgtggccatcagcaagagagtggagcccccccccaaggtgcccgagctgcccgagaagcccgcccccgaggaggtggcccccgtgcccatccccaagaaggtggagccccccgcccccaaggtgcccgaggtgcccaagaagcccgtgcccgaggagaagaagcccgtgcccgtgcccaagaaggagcccgccgccccccccaaggtgcccgaggtgcccaagaagcccgtgcccgaggagaagatccccgtgcccgtggccaagaagaaggaggccccccccgccaaggtgcccgagatccccaagaagaaggtgcccgaggagagaaagcccgtgcccagaaaggaggaggaggtgccccccccccccaaggtgcccgccctgcccaagaagcccgtgcccgaggagaaggtggccgtgcccgtgcccgtggccaagaaggcccccccccccagatag

SEQ ID NO: 102575 - DNA, 2490 bp, Artificial Sequence
  Description of Artificial Sequence: Synthetic coding sequence
gtggaggagttcatcaagctggagcagcacagagtggaggaggagcacagagtggagaaggtgcacagagtgatcgaggtgttcgaggccgaggaggtggaggtgttcgagaagcccaaggccccccccaagggccccgagatcagcgagaagatcatcccccccaagaagccccccaccaaggtggtgcccagaaaggagccccccgccaaggtgcccgaggtgcccaagaagatcgtggtggaggagaaggtgagagtgcccgaggagcccagagtgccccccaccaaggcccccgaggtgcccaagaagatcgtgcccgaggagaaggtgagagaggccgtgctgaagaagcccgaggtgccccccgccaaggtgcccggcatgcccaagaagagcgtgcaggaggagaagagccccatcgtgatcagcgaggacaccgagatgtacatctacgaggccagcgaggaggccgtgctggaggagaaggtgctggtgacccagccccagaagaccaagcccaagctggccaaggtgcccgagccccccaagaaggtggtgcccgaggacaagatctacgtgaccatccccaagaagagagagacccccgccaccaaggagcccgacaccaccagaggcatcttccccgaggtggagccccccgaggccatccccgagatccccgagcacccccccaccgaggagttcgaggtgttcaaggaggtgatccccgagggcgagacccccatcgtgaagagaagaaagacccccagccccaccgcccccgaggccatgaaggaggtggtgcccgagatgaagatcttcgaggacgtgcccgaggagcccgagacccccagaatgaagacccccgaggccccccaggagatcatccccgccaagaccgtgcccagcaagaagagagagccccccagcgtgaaggtgcccgaggccctgcaggagatcgtgcccgagaagaagaccctggtggtgcccctgagaaagcccgaggtgctgcccgacgaggtgcccgaggccctgagagaggtggtgcccgagaagaaggtgcaccccccccagagagccgaggtggtgcccgtgaaggtgcacgaggcccccaaggagatcatccccgagaagaaggtgagcgtggtgccccccaagaagcccgaggtgccccccgtgaaggtgcccgaggccagcaaggaggtgatcagagaggagaaggtgcccctggccccccccaaggagcccgaggtgccccccgtgaaggtgcccgagccccccaaggaggtggtgcccgagaagaaggcccccgtggccccccccaaggagcccgaggtgccccccgtgaaggtgcccgaggcccccaaggaggtggtgcccgagaagaaggtgcccgtgcccccccccaagaagcccgaggtgccccccaccaaggtgcccgaggtgcccaaggccgccgtgcccgagaagaagctgcccgaggccatcccccccaagcccgagagccccccccccgaggtgcccgaggtgctgccccccaaggaggtggtgcccgagaagaaggtgcccgtgccccccgccaagaagcccgaggcccccccccccaaggtgcccgaggcccccaaggaggtggtgctggagaagaaggccagcgtggccgtgcccaagaagcccgaggcccccagagccaaggtgcccgaggccgcccaggaggtggtgcccgagaagaagatccccaaggcccccatcaagaagcccgaggcccccgccgtgaccgtgcccgaggtgccccaggagatcgtgcccgagaagaagaccctggtgctgcccaagaagcccgaggtgccccccgtgaccgtgcccgaggcccccaaggaggtggtgctggagaagaaggtgcccagcgccccccccaagaagcccgaggtgccccccgtgaaggtgcccgaggcccccaaggaggtggtgcccgagaagaaggtgcccgtgcccccccccaagaagcccgaggtgccccccaccaaggtgcccgaggtgcccaaggccgccgtgcccgagaagaaggtgcccgaggccatcccccccaagcccgagagccccccccccgaggtgcccgaggtgctgccccccaaggaggtggtgcccgagaagaaggtgcccgtgccccccgccaagaagcccgaggcccccccccccaaggtgcccgaggcccccaaggaggtggtgctggagaagaaggccagcgtggccgtgcccaagaagcccgaggcccccagagccaaggtgcccgaggccgcccaggaggtggtgcccgagaagaagatccccaaggcccccatcaagaagcccgaggcccccgccgtgaccgtgcccgaggtgccccaggaggccgccgagaaggagatccccgtggccccccccaagaagcccgaggcccccatcgtgcccgtgcccgaggcccaggaggtggtgcccgagaagaagtag

SEQ ID NO: 102576 - DNA, 504 bp, Artificial Sequence
  Description of Artificial Sequence: Synthetic coding sequence
atggccaccagcgagctgagctgcgaggtgagcgaggagaactgcgagagaagagaggccttctgggccgagtggaaggacctgaccctgagcaccagacccgaggagggctgcagcctgcacgaggaggacacccagagacacgagacctaccaccagcagggccagtgccaggtgctggtgcagagaagcccctggctgatgatgagaatgggcatcctgggcagaggcctgcaggagtaccagctgccctaccagagagtgctgcccctgcccatcttcacccccgccaagatgggcgccaccaaggaggagagagaggacacccccatccagctgcaggagctgctggccctggagaccgccctgggcggccagtgcgtggacagacaggaggtggccgagatcaccaagcagctgccccccgtggtgcccgtgagcaagcccggcgccctgagaagaagcctgagcagaagcatgagccaggaggcccagagaggctag

SEQ ID NO: 102577 - DNA, 744 bp, Artificial Sequence
  Description of Artificial Sequence: Synthetic coding sequence
atggccggcggcgtgctgcccctgagaggcctgagagccctgtgcagagtgctgctgttcctgagccagttctgcatcctgagcggcggcgagcagagccaggccctggcccagagcatcaaggaccccggccccaccagaaccttcaccgtggtgcccagagccgccgagagcaccgagatccccccctacgtgatgaagtgccccagcaacggcctgtgcagcagactgcccgccgactgcatcgactgcaccaccaacttcagctgcacctacggcaagcccgtgaccttcgactgcgccgtgaagcccagcgtgacctgcgtggaccaggacttcaagagccagaagaacttcatcatcaacatgacctgcagattctgctggcagctgcccgagaccgactacgagtgcaccaacagcaccagctgcatgaccgtgagctgccccagacagagataccccgccaactgcaccgtgagagaccacgtgcactgcctgggcaacagaaccttccccaagatgctgtactgcaactggaccggcggctacaagtggagcaccgccctggccctgagcatcaccctgggcggcttcggcgccgacagattctacctgggccagtggagagagggcctgggcaagctgttcagcttcggcggcctgggcatctggaccctgatcgacgtgctgctgatcggcgtgggctacgtgggccccgccgacggcagcctgtacatctag

SEQ ID NO: 102578 - DNA, 666 bp, Artificial Sequence
  Description of Artificial Sequence: Synthetic coding sequence
atggccggcggcgtgctgcccctgagaggcctgagagccctgtgcagagtgctgctgttcctgagccagttctgcatcctgagcggcggcgagagcaccgagatccccccctacgtgatgaagtgccccagcaacggcctgtgcagcagactgcccgccgactgcatcgactgcaccaccaacttcagctgcacctacggcaagcccgtgaccttcgactgcgccgtgaagcccagcgtgacctgcgtggaccaggacttcaagagccagaagaacttcatcatcaacatgacctgcagattctgctggcagctgcccgagaccgactacgagtgcaccaacagcaccagctgcatgaccgtgagctgccccagacagagataccccgccaactgcaccgtgagagaccacgtgcactgcctgggcaacagaaccttccccaagatgctgtactgcaactggaccggcggctacaagtggagcaccgccctggccctgagcatcaccctgggcggcttcggcgccgacagattctacctgggccagtggagagagggcctgggcaagctgttcagcttcggcggcctgggcatctggaccctgatcgacgtgctgctgatcggcgtgggctacgtgggccccgccgacggcagcctgtacatctag

SEQ ID NO: 102579 - DNA, 1251 bp, Artificial Sequence
  Description of Artificial Sequence: Synthetic coding sequence
atggccagcagcagcggcagcagccccagacccgcccccgacgagaacgagttccccttcggctgcccccccaccgtgtgccaggaccccaaggagcccagagccctgtgctgcgccggctgcctgagcgagaaccccagaaacggcgaggaccagatctgccccaagtgcagaggcgaggacctgcagagcatcagccccggcagcagactgagaacccaggagaaggcccaccccgaggtggccgaggccggcatcggctgccccttcgccggcgtgggctgcagcttcaagggcagcccccagagcgtgcaggagcacgaggtgaccagccagaccagccacctgaacctgctgctgggcttcatgaagcagtggaaggccagactgggctgcggcctggagagcggccccatggccctggagcagaacctgagcgacctgcagctgcaggccgccgtggaggtggccggcgacctggaggtggactgctacagagccccctgcagcgagagccaggaggagctggccctgcagcacttcatgaaggagaagctgctggccgagctggagggcaagctgagagtgttcgagaacatcgtggccgtgctgaacaaggaggtggaggccagccacctggccctggccaccagcatccaccagagccagctggacagagagagaatcctgagcctggagcagagagtggtggagctgcagcagaccctggcccagaaggaccaggccctgggcaagctggagcagagcctgagactgatggaggaggccagcttcgacggcaccttcctgtggaagatcaccaacgtgaccagaagatgccacgagagcgcctgcggcagaaccgtgagcctgttcagccccgccttctacaccgccaagtacggctacaagctgtgcctgagactgtacctgaacggcgacggcaccggcaagagaacccacctgagcctgttcatcgtgatcatgagaggcgagtacgacgccctgctgccctggcccttcagaaacaaggtgaccttcatgctgctggaccagaacaacagagagcacgccatcgacgccttcagacccgacctgagcagcgccagcttccagagaccccagagcgagaccaacgtggccagcggctgccccctgttcttccccctgagcaagctgcagagccccaagcacgcctacgtgaaggacgacaccatgttcctgaagtgcatcgtggagaccagcacctag

SEQ ID NO: 102580 - DNA, 1251 bp, Artificial Sequence; identical to SEQ ID NO: 102579
  Description of Artificial Sequence: Synthetic coding sequence

SEQ ID NO: 102581 - DNA, 885 bp, Artificial Sequence
  Description of Artificial Sequence: Synthetic coding sequence
atgaagcagtggaaggccagactgggctgcggcctggagagcggccccatggccctggagcagaacctgagcgacctgcagctgcaggccgccgtggaggtggccggcgacctggaggtggactgctacagagccccctgcagcgagagccaggaggagctggccctgcagcacttcatgaaggagaagctgctggccgagctggagggcaagctgagagtgttcgagaacatcgtggccgtgctgaacaaggaggtggaggccagccacctggccctggccaccagcatccaccagagccagctggacagagagagaatcctgagcctggagcagagagtggtggagctgcagcagaccctggcccagaaggaccaggccctgggcaagctggagcagagcctgagactgatggaggaggccagcttcgacggcaccttcctgtggaagatcaccaacgtgaccagaagatgccacgagagcgcctgcggcagaaccgtgagcctgttcagccccgccttctacaccgccaagtacggctacaagctgtgcctgagactgtacctgaacggcgacggcaccggcaagagaacccacctgagcctgttcatcgtgatcatgagaggcgagtacgacgccctgctgccctggcccttcagaaacaaggtgaccttcatgctgctggaccagaacaacagagagcacgccatcgacgccttcagacccgacctgagcagcgccagcttccagagaccccagagcgagaccaacgtggccagcggctgccccctgttcttccccctgagcaagctgcagagccccaagcacgcctacgtgaaggacgacaccatgttcctgaagtgcatcgtggagaccagcacctag

SEQ ID NO: 102582 - DNA, 2076 bp, Artificial Sequence
  Description of Artificial Sequence: Synthetic coding sequence
atgaacgccgccgtggtgagaagaacccaggaggccctgggcaaggtgatcagaagaccccccctgaccgagaagctgctgagcaagccccccttcagatacctgcacgacatcatcaccgaggtgatcagaatgaccggcttcatgaagggcctgtacaccgacgccgagatgaagagcgacaacgtgaaggacaaggacgccaagatcagcttcctgcagaaggccatcgacgtggtggtgatggtgagcggcgagcccctgctggccaagcccgccagaatcgtggccggccacgagcccgagagaaccaacgagctgctgcagatcatcggcaagtgctgcctgaacaagctgagcagcgacgacgccgtgagaagagtgctggccggcgagaagggcgaggtgaagggcagagccagcctgaccagcagaagccaggagctggacaacaagaacgtgagagaggaggagagcagagtgcacaagaacaccgaggacagaggcgacgccgagatcaaggagagaagcaccagcagagacagaaagcagaaggaggagctgaaggaggacagaaagcccagagagaaggacaaggacaaggagaaggccaaggagaacggcggcaacagacacagagagggcgagagagagagagccaaggccagagccagacccgacaacgagagacagaaggacagaggcaacagagagagagacagagacagcgagagaaagaaggagaccgagagaaagagcgagggcggcaaggagaaggagagactgagagacagagacagagagagagacagagacaagggcaaggacagagacagaagaagagtgaagaacggcgagcacagctgggacctggacagagagaagaacagagagcacgacaagcccgagaagaagagcgccagcagcggcgagatgagcaagaagctgagcgacggcaccttcaaggacagcaaggccgagaccgagaccgagatcagcaccagagccagcaagagcctgaccaccaagaccagcaagagaagaagcaagaacagcgtggagggcagaaaggaggacaacatcagcgccaagagcctggacagcatcgtgagcggcatcaacaacgagcccaaccaggagaccaccaccagcgagatcggcaccaaggaggccaacatcaacagcaccagcatcagcgacgacaacagcgccagcctgagatgcgagaacatccagcccaaccccaccgagaagcagaagggcgacagcaccagcgacgccgagggcgacgccggccccgccggccaggacaagagcgaggtgcccgagacccccgagatccccaacgagctgagcagcaacatcagaagaatccccagacccggcagcgccagacccgccccccccagagtgaagagacaggacagcatggaggccctgcagatggacagaagcggcagcggcaagaccgtgagcaacgtgatcaccgagagccacaacagcgacaacgaggaggacgaccagttcgtggtggaggccgccccccagctgagcgagatgagcgagatcgagatggtgaccgccgtggagctggaggaggaggagaagcacggcggcctggtgaagaagatcctggagaccaagaaggactacgagaagctgcagcagagccccaagcccggcgagaaggagagaagcctgttcgagagcgcctggaagaaggagaaggacatcgtgagcaaggagatcgagaagctgagaaccagcatccagaccctgtgcaagagcgccctgcccctgggcaagatcatggactacatccaggaggacgtggacgccatgcagaacgagctgcagatgtggcacagcgagaacagacagcacgccgaggccctgcagcaggagcagagaatcaccgactgcgccgtggagcccctgaaggccgagctggccgagctggagcagctgatcaaggaccagcaggacaagatctgcgccgtgaaggccaacatcctgaagaacgaggagaagatccagaagatggtgtacagcatcaacctgaccagcagaagatag

SEQ ID NO: 102583 - DNA, 1878 bp, Artificial Sequence
  Description of Artificial Sequence: Synthetic coding sequence
atgaacgccgccgtggtgagaagaacccaggaggccctgggcaaggtgatcagaagaccccccctgaccgagaagctgctgagcaagccccccttcagatacctgcacgacatcatcaccgaggtgatcagaatgaccggcttcatgaagggcctgtacaccgacgccgagatgaagagcgacaacgtgaaggacaaggacgccaagatcagcttcctgcagaaggccatcgacgtggtggtgatggtgagcggcgagcccctgctggccaagcccgccagaatcgtggccggccacgagcccgagagaaccaacgagctgctgcagatcatcggcaagtgctgcctgaacaagctgagcagcgacgacgccgtgagaagagtgctggccggcgagaagggcgaggtgaagggcagagccagcctgaccagcagaagccaggagctggacaacaagaacgtgagagaggaggagagcagagtgcacaagaacaccgaggacagaggcgacgccgagatcaaggagagaagcaccagcagagacagaaagcagaaggaggagctgaaggaggacagaaagcccagagagaaggacaaggacaaggagaaggccaaggagaacggcggcaacagacacagagagggcgagagagagagagccaaggccagagccagacccgacaacgagagacagaaggacagaggcaacagagagagagacagagacagcgagagaaagaaggagaccgagagaaagagcgagggcggcaaggagaaggagagactgagagacagagacagagagagagacagagacaagggcaaggacagagacagaagaagagtgaagaacggcgagcacagctgggacctggacagagagaagaacagagagcacgacaagcccgagaagaagagcgccagcagcggcgagatgagcaagaagctgagcgacggcaccttcaaggacagcaaggccgagaccgagaccgagatcagcaccagagccagcaagagcctgaccaccaagaccagcaagagaagaagcaagaacagcgtggagggcgacagcaccagcgacgccgagggcgacgccggccccgccggccaggacaagagcgaggtgcccgagacccccgagatccccaacgagctgagcagcaacatcagaagaatccccagacccggcagcgccagacccgccccccccagagtgaagagacaggacagcatggaggccctgcagatggacagaagcggcagcggcaagaccgtgagcaacgtgatcaccgagagccacaacagcgacaacgaggaggacgaccagttcgtggtggaggccgccccccagctgagcgagatgagcgagatcgagatggtgaccgccgtggagctggaggaggaggagaagcacggcggcctggtgaagaagatcctggagaccaagaaggactacgagaagctgcagcagagccccaagcccggcgagaaggagagaagcctgttcgagagcgcctggaagaaggagaaggacatcgtgagcaaggagatcgagaagctgagaaccagcatccagaccctgtgcaagagcgccctgcccctgggcaagatcatggactacatccaggaggacgtggacgccatgcagaacgagctgcagatgtggcacagcgagaacagacagcacgccgaggccctgcagcaggagcagagaatcaccgactgcgccgtggagcccctgaaggccgagctggccgagctggagcagctgatcaaggaccagcaggacaagatctgcgccgtgaaggccaacatcctgaagaacgaggagaagatccagaagatggtgtacagcatcaacctgaccagcagaagatag

SEQ ID NO: 102584 - DNA, 2076 bp, Artificial Sequence
  Description of Artificial Sequence: Synthetic coding sequence
atgaacgccgccgtggtgagaagaacccaggaggccctgggcaaggtgatcagaagaccccccctgaccgagaagctgctgagcaagccccccttcagatacctgcacgacatcatcaccgaggtgatcagaatgaccggcttcatgaagggcctgtacaccgacgccgagatgaagagcgacaacgtgaaggacaaggacgccaagatcagcttcctgcagaaggccatcgacgtggtggtgatggtgagcggcgagcccctgctggccaagcccgccagaatcgtggccggccacgagcccgagagaaccaacgagctgctgcagatcatcggcaagtgctgcctgaacaagctgagcagcgacgacgccgtgagaagagtgctggccggcgagaagggcgaggtgaagggcagagccagcctgaccagcagaagccaggagctggacaacaagaacgtgagagaggaggagagcagagtgcacaagaacaccgaggacagaggcgacgccgagatcaaggagagaagcaccagcagagacagaaagcagaaggaggagctgaaggaggacagaaagcccagagagaaggacaaggacaaggagaaggccaaggagaacggcggcaacagacacagagagggcgagagagagagagccaaggccagagccagacccgacaacgagagacagaaggacagaggcaacagagagagagacagagacagcgagagaaagaaggagaccgagagaaagagcgagggcggcaaggagaaggagagactgagagacagagacagagagagagacagagacaagggcaaggacagagacagaagaagagtgaagaacggcgagcacagctgggacctggacagagagaagaacagagagcacgacaagcccgagaagaagagcgccagcagcggcgagatgagcaagaagctgagcgacggcaccttcaaggacagcaaggccgagaccgagaccgagatcagcaccagagccagcaagagcctgaccaccaagaccagcaagagaagaagcaagaacagcgtggagggcagaaaggaggacaacatcagcgccaagagcctggacagcatcgtgagcggcatcaacaacgagcccaaccaggagaccaccaccagcgagatcggcaccaaggaggccaacatcaacagcaccagcatcagcgacgacaacagcgccagcctgagatgcgagaacatccagcccaaccccaccgagaagcagaagggcaagaacggcagcgagagagagggcgacgccggccccgccggccaggacaagagcgaggtgcccgagacccccgagatccccaacgagctgagcagcaacatcagaagaatccccagacccggcagcgccagacccgccccccccagagtgaagagacaggacagcatggaggccctgcagatggacagaagcggcagcggcaagaccgtgagcaacgtgatcaccgagagccacaacagcgacaacgaggaggacgaccagttcgtggtggaggccgccccccagctgagcgagatgagcgagatcgagatggtgaccgccgtggagctggaggaggaggagaagcacggcggcctggtgaagaagatcctggagaccaagaaggactacgagaagctgcagcagagccccaagcccggcgagaaggagagaagcctgttcgagagcgcctggaagaaggagaaggacatcgtgagcaaggagatcgagaagctgagaaccagcatccagaccctgtgcaagagcgccctgcccctgggcaagatcatggactacatccaggaggacgtggacgccatgcagaacgagctgcagatgtggcacagcgagaacagacagcacgccgaggccctgcagcaggagcagagaatcaccgactgcgccgtggagcccctgaaggccgagctggccgagctggagcagctgatcaaggaccagcaggacaagatctgcgccgtgaaggccaacatcctgaagaacgaggagaagatccagaagatggtgtacagcatcaacctgaccagcagaagatag

SEQ ID NO: 102585 - DNA, 1878 bp, Artificial Sequence
  Description of Artificial Sequence: Synthetic coding sequence
atgaacgccgccgtggtgagaagaacccaggaggccctgggcaaggtgatcagaagaccccccctgaccgagaagctgctgagcaagccccccttcagatacctgcacgacatcatcaccgaggtgatcagaatgaccggcttcatgaagggcctgtacaccgacgccgagatgaagagcgacaacgtgaaggacaaggacgccaagatcagcttcctgcagaaggccatcgacgtggtggtgatggtgagcggcgagcccctgctggccaagcccgccagaatcgtggccggccacgagcccgagagaaccaacgagctgctgcagatcatcggcaagtgctgcctgaacaagctgagcagcgacgacgccgtgagaagagtgctggccggcgagaagggcgaggtgaagggcagagccagcctgaccagcagaagccaggagctggacaacaagaacgtgagagaggaggagagcagagtgcacaagaacaccgaggacagaggcgacgccgagatcaaggagagaagcaccagcagagacagaaagcagaaggaggagctgaaggaggacagaaagcccagagagaaggacaaggacaaggagaaggccaaggagaacggcggcaacagacacagagagggcgagagagagagagccaaggccagagccagacccgacaacgagagacagaaggacagaggcaacagagagagagacagagacagcgagagaaagaaggagaccgagagaaagagcgagggcggcaaggagaaggagagactgagagacagagacagagagagagacagagacaagggcaaggacagagacagaagaagagtgaagaacggcgagcacagctgggacctggacagagagaagaacagagagcacgacaagcccgagaagaagagcgccagcagcggcgagatgagcaagaagctgagcgacggcaccttcaaggacagcaaggccgagaccgagaccgagatcagcaccagagccagcaagagcctgaccaccaagaccagcaagagaagaagcaagaacagcgtggagggcaccgccaagctgatcctggagggcgacgccggccccgccggccaggacaagagcgaggtgcccgagacccccgagatccccaacgagctgagcagcaacatcagaagaatccccagacccggcagcgccagacccgccccccccagagtgaagagacaggacagcatggaggccctgcagatggacagaagcggcagcggcaagaccgtgagcaacgtgatcaccgagagccacaacagcgacaacgaggaggacgaccagttcgtggtggaggccgccccccagctgagcgagatgagcgagatcgagatggtgaccgccgtggagctggaggaggaggagaagcacggcggcctggtgaagaagatcctggagaccaagaaggactacgagaagctgcagcagagccccaagcccggcgagaaggagagaagcctgttcgagagcgcctggaagaaggagaaggacatcgtgagcaaggagatcgagaagctgagaaccagcatccagaccctgtgcaagagcgccctgcccctgggcaagatcatggactacatccaggaggacgtggacgccatgcagaacgagctgcagatgtggcacagcgagaacagacagcacgccgaggccctgcagcaggagcagagaatcaccgactgcgccgtggagcccctgaaggccgagctggccgagctggagcagctgatcaaggaccagcaggacaagatctgcgccgtgaaggccaacatcctgaagaacgaggagaagatccagaagatggtgtacagcatcaacctgaccagcagaagatag

SEQ ID NO: 102586 - DNA, 1674 bp, Artificial Sequence
  Description of Artificial Sequence: Synthetic coding sequence
atggcctacagcgaggagcacaagggcatgccctgcggcttcatcagacagaacagcggcaacagcatcagcctggacttcgagcccagcatcgagtaccagttcgtggagagactggaggagagatacaagtgcgccttctgccacagcgtgctgcacaacccccaccagaccggctgcggccacagattctgccagcactgcatcctgagcctgagagagctgaacaccgtgcccatctgccccgtggacaaggaggtgatcaagagccaggaggtgttcaaggacaactgctgcaagagagaggtgctgaacctgtacgtgtactgcagcaacgcccccggctgcaacgccaaggtgatcctgggcagataccaggaccacctgcagcagtgcctgttccagcccgtgcagtgcagcaacgagaagtgcagagagcccgtgctgagaaaggacctgaaggagcacctgagcgccagctgccagttcagaaaggagaagtgcctgtactgcaagaaggacgtggtggtgatcaacctgcagaaccacgaggagaacctgtgccccgagtaccccgtgttctgccccaacaactgcgccaagatcatcctgaagaccgaggtggacgagcacctggccgtgtgccccgaggccgagcaggactgccccttcaagcactacggctgcgccgtgaccgacaagagaagaaacctgcagcagcacgagcacagcgccctgagagagcacatgagactggtgctggagaagaacgtgcagctggaggagcagatcagcgacctgcacaagagcctggagcagaaggagagcaagatccagcagctggccgagaccatcaagaagctggagaaggagttcaagcagttcgcccagctgttcggcaagaacggcagcttcctgcccaacatccaggtgttcgccagccacatcgacaagagcgcctggctggaggcccaggtgcaccagctgctgcagatggtgaaccagcagcagaacaagttcgacctgagacccctgatggaggccgtggacaccgtgaagcagaagatcaccctgctggagaacaacgaccagagactggccgtgctggaggaggagaccaacaagcacgacacccacatcaacatccacaaggcccagctgagcaagaacgaggagagattcaagctgctggagggcacctgctacaacggcaagctgatctggaaggtgaccgactacaagatgaagaagagagaggccgtggacggccacaccgtgagcatcttcagccagagcttctacaccagcagatgcggctacagactgtgcgccagagcctacctgaacggcgacggcagcggcagaggcagccacctgagcctgtacttcgtggtgatgagaggcgagttcgacagcctgctgcagtggcccttcagacagagagtgaccctgatgctgctggaccagagcggcaagaagaacatcatggagaccttcaagcccgaccccaacagcagcagcttcaagagacccgacggcgagatgaacatcgccagcggctgccccagattcgtggcccacagcgtgctggagaacgccaagaacgcctacatcaaggacgacaccctgttcctgaaggtggccgtggacctgaccgacctggaggacctgtag

SEQ ID NO: 102587 - DNA, 1674 bp, Artificial Sequence; identical to SEQ ID NO: 102586
  Description of Artificial Sequence: Synthetic coding sequence

SEQ ID NO: 102588 - DNA, 1674 bp, Artificial Sequence; identical to SEQ ID NO: 102586
  Description of Artificial Sequence: Synthetic coding sequence

SEQ ID NO: 102589 - DNA, 1356 bp, Artificial Sequence
  Description of Artificial Sequence: Synthetic coding sequence
atggcctacagcgaggagcacaagggcatgccctgcggcttcatcagacagaacagcggcaacagcatcagcctggacttcgagcccagcatcgagtaccagttcgtggagagactggaggagagatacaagtgcgccttctgccacagcgtgctgcacaacccccaccagaccggctgcggccacagattctgccagcactgcatcctgagcctgagagagctgaacaccgtgcccatctgccccgtggacaaggaggtgatcaagagccaggaggtgttcaaggacaactgctgcaagagagaggtgctgaacctgtacgtgtactgcagcaacgcccccggctgcaacgccaaggtgatcctgggcagataccaggacaagagaagaaacctgcagcagcacgagcacagcgccctgagagagcacatgagactggtgctggagaagaacgtgcagctggaggagcagatcagcgacctgcacaagagcctggagcagaaggagagcaagatccagcagctggccgagaccatcaagaagctggagaaggagttcaagcagttcgcccagctgttcggcaagaacggcagcttcctgcccaacatccaggtgttcgccagccacatcgacaagagcgcctggctggaggcccaggtgcaccagctgctgcagatggtgaaccagcagcagaacaagttcgacctgagacccctgatggaggccgtggacaccgtgaagcagaagatcaccctgctggagaacaacgaccagagactggccgtgctggaggaggagaccaacaagcacgacacccacatcaacatccacaaggcccagctgagcaagaacgaggagagattcaagctgctggagggcacctgctacaacggcaagctgatctggaaggtgaccgactacaagatgaagaagagagaggccgtggacggccacaccgtgagcatcttcagccagagcttctacaccagcagatgcggctacagactgtgcgccagagcctacctgaacggcgacggcagcggcagaggcagccacctgagcctgtacttcgtggtgatgagaggcgagttcgacagcctgctgcagtggcccttcagacagagagtgaccctgatgctgctggaccagagcggcaagaagaacatcatggagaccttcaagcccgaccccaacagcagcagcttcaagagacccgacggcgagatgaacatcgccagcggctgccccagattcgtggcccacagcgtgctggagaacgccaagaacgcctacatcaaggacgacaccctgttcctgaaggtggccgtggacctgaccgacctggaggacctgtag

SEQ ID NO: 102590 - DNA, 1569 bp, Artificial Sequence
  Description of Artificial Sequence: Synthetic coding sequence
atgagcctgctgaactgcgagaacagctgcggcagcagccagagcgagagcgactgctgcgtggccatggccagcagctgcagcgccgtgaccaaggacgacagcgtgggcggcaccgccagcaccggcaacctgagcagcagcttcatggaggagatccagggctacgacgtggagttcgacccccccctggagagcaagtacgagtgccccatctgcctgatggccctgagagaggccgtgcagaccccctgcggccacagattctgcaaggcctgcatcatcaagagcatcagagacgccggccacaagtgccccgtggacaacgagatcctgctggagaaccagctgttccccgacaacttcgccaagagagagatcctgagcctgatggtgaagtgccccaacgagggctgcctgcacaagatggagctgagacacctggaggaccaccaggcccactgcgagttcgccctgatggactgcccccagtgccagagacccttccagaagttccacatcaacatccacatcctgaaggactgccccagaagacaggtgagctgcgacaactgcgccgccagcatggccttcgaggacaaggagatccacgaccagaactgccccctggccaacgtgatctgcgagtactgcaacaccatcctgatcagagagcagatgcccaaccactacgacctggactgccccaccgcccccatcccctgcaccttcagcaccttcggctgccacgagaagatgcagagaaaccacctggccagacacctgcaggagaacacccagagccacatgagaatgctggcccaggccgtgcacagcctgagcgtgatccccgacagcggctacatcagcgaggtgagaaacttccaggagaccatccaccagctggagggcagactggtgagacaggaccaccagatcagagagctgaccgccaagatggagacccagagcatgtacgtgagcgagctgaagagaaccatcagaaccctggaggacaaggtggccgagatcgaggcccagcagtgcaacggcatctacatctggaagatcggcaacttcggcatgcacctgaagtgccaggaggaggagaagcccgtggtgatccacagccccggcttctacaccggcaagcccggctacaagctgtgcatgagactgcacctgcagctgcccaccgcccagagatgcgccaactacatcagcctgttcgtgcacaccatgcagggcgagtacgacagccacctgccctggcccttccagggcaccatcagactgaccatcctggaccagagcgaggcccccgtgagacagaaccacgaggagatcatggacgccaagcccgagctgctggccttccagagacccaccatccccagaaaccccaagggcttcggctacgtgaccttcatgcacctggaggccctgagacagagaaccttcatcaaggacgacaccctgctggtgagatgcgaggtgagcaccagattcgacatgggcagcctgagaagagagggcttccagcccagaagcaccgacgccggcgtgtag

SEQ ID NO: 102591 - DNA, 1569 bp, Artificial Sequence; identical to SEQ ID NO: 102590
  Description of Artificial Sequence: Synthetic coding sequence

SEQ ID NO: 102592 - DNA, 2013 bp, Artificial Sequence
  Description of Artificial Sequence: Synthetic coding sequence
atgagcagcggcaagagcgccagatacaacagattcagcggcggccccagcaacctgcccacccccgacgtgaccaccggcaccagaatggagaccaccttcggccccgccttcagcgccgtgaccaccatcaccaaggccgacggcaccagcacctacaagcagcactgcagaacccccagcagcagcagcaccctggcctacagccccagagacgaggaggacagcatgccccccatcagcacccccagaagaagcgacagcgccatcagcgtgagaagcctgcacagcgagagcagcatgagcctgagaagcaccttcagcctgcccgaggaggaggaggagcccgagcccctggtgttcgccgagcagcccagcgtgaagctgtgctgccagctgtgctgcagcgtgttcaaggaccccgtgatcaccacctgcggccacaccttctgcagaagatgcgccctgaagagcgagaagtgccccgtggacaacgtgaagctgaccgtggtggtgaacaacatcgccgtggccgagcagatcggcgagctgttcatccactgcagacacggctgcagagtggccggcagcggcaagccccccatcttcgaggtggaccccagaggctgccccttcaccatcaagctgagcgccagaaaggaccacgagggcagctgcgactacagacccgtgagatgccccaacaaccccagctgcccccccctgctgagaatgaacctggaggcccacctgaaggagtgcgagcacatcaagtgcccccacagcaagtacggctgcaccttcatcggcaaccaggacacctacgagacccacctggagacctgcagattcgagggcctgaaggagttcctgcagcagaccgacgacagattccacgagatgcacgtggccctggcccagaaggaccaggagatcgccttcctgagaagcatgctgggcaagctgagcgagaagatcgaccagctggagaagagcctggagctgaagttcgacgtgctggacgagaaccagagcaagctgagcgaggacctgatggagttcagaagagacgccagcatgctgaacgacgagctgagccacatcaacgccagactgaacatgggcatcctgggcagctacgacccccagcagatcttcaagtgcaagggcaccttcgtgggccaccagggccccgtgtggtgcctgtgcgtgtacagcatgggcgacctgctgttcagcggcagcagcgacaagaccatcaaggtgtgggacacctgcaccacctacaagtgccagaagaccctggagggccacgacggcatcgtgctggccctgtgcatccagggctgcaagctgtacagcggcagcgccgactgcaccatcatcgtgtgggacatccagaacctgcagaaggtgaacaccatcagagcccacgacaaccccgtgtgcaccctggtgagcagccacaacgtgctgttcagcggcagcctgaaggccatcaaggtgtgggacatcgtgggcaccgagctgaagctgaagaaggagctgaccggcctgaaccactgggtgagagccctggtggccgcccagagctacctgtacagcggcagctaccagaccatcaagatctgggacatcagaaccctggactgcatccacgtgctgcagaccagcggcggcagcgtgtacagcatcgccgtgaccaaccaccacatcgtgtgcggcacctacgagaacctgatccacgtgtgggacatcgagagcaaggagcaggtgagaaccctgaccggccacgtgggcaccgtgtacgccctggccgtgatcagcacccccgaccagaccaaggtgttcagcgccagctacgacagaagcctgagagtgtggagcatggacaacatgatctgcacccagaccctgctgagacaccagggcagcgtgaccgccctggccgtgagcagaggcagactgttcagcggcgccgtggacagcaccgtgaaggtgtggacctgctag

SEQ ID NO: 102593 - DNA, 2115 bp, Artificial Sequence
  Description of Artificial Sequence: Synthetic coding sequence
atggccagagagctgagagccctgctgctgtggggcagaagactgagacccctgctgagagcccccgccctggccgccgtgcccggcggcaagcccatcctgtgccccagaagaaccaccgcccagctgggccccagaagaaaccccgcctggagcctgcaggccggcagactgttcagcacccagaccgccgaggacaaggaggagcccctgcacagcatcatcagcagcaccgagagcgtgcagggcagcaccagcaagcacgagttccaggccgagaccaagaagctgctggacatcgtggccagaagcctgtacagcgagaaggaggtgttcatcagagagctgatcagcaacgccagcgacgccctggagaagctgagacacaagctggtgagcgacggccaggccctgcccgagatggagatccacctgcagaccaacgccgagaagggcaccatcaccatccaggacaccggcatcggcatgacccaggaggagctggtgagcaacctgggcaccatcgccagaagcggcagcaaggccttcctggacgccctgcagaaccaggccgaggccagcagcaagatcatcggccagttcggcgtgggcttctacagcgccttcatggtggccgacagagtggaggtgtacagcagaagcgccgcccccggcagcctgggctaccagtggctgagcgacggcagcggcgtgttcgagatcgccgaggccagcggcgtgagaaccggcaccaagatcatcatccacctgaagagcgactgcaaggagttcagcagcgaggccagagtgagagacgtggtgaccaagtacagcaacttcgtgagcttccccctgtacctgaacggcagaagaatgaacaccctgcaggccatctggatgatggaccccaaggacgtgagagagtggcagcacgaggagttctacagatacgtggcccaggcccacgacaagcccagatacaccctgcactacaagaccgacgcccccctgaacatcagaagcatcttctacgtgcccgacatgaagcccagcatgttcgacgtgagcagagagctgggcagcagcgtggccctgtacagcagaaaggtgctgatccagaccaaggccaccgacatcctgcccaagtggctgagattcatcagaggcgtggtggacagcgaggacatccccctgaacctgagcagagagctgctgcaggagagcgccctgatcagaaagctgagagacgtgctgcagcagagactgatcaagttcttcatcgaccagagcaagaaggacgccgagaagtacgccaagttcttcgaggactacggcctgttcatgagagagggcatcgtgaccgccaccgagcaggaggtgaaggaggacatcgccaagctgctgagatacgagagcagcgccctgcccagcggccagctgaccagcctgagcgagtacgccagcagaatgagagccggcaccagaaacatctactacctgtgcgcccccaacagacacctggccgagcacagcccctactacgaggccatgaagaagaaggacaccgaggtgctgttctgcttcgagcagttcgacgagctgaccctgctgcacctgagagagttcgacaagaagaagctgatcagcgtggagaccgacatcgtggtggaccactacaaggaggagaagttcgaggacagaagccccgccgccgagtgcctgagcgagaaggagaccgaggagctgatggcctggatgagaaacgtgctgggcagcagagtgaccaacgtgaaggtgaccctgagactggacacccaccccgccatggtgaccgtgctggagatgggcgccgccagacacttcctgagaatgcagcagctggccaagacccaggaggagagagcccagctgctgcagcccaccctggagatcaaccccagacacgccctgatcaagaagctgaaccagctgagagccagcgagcccggcctggcccagctgctggtggaccagatctacgagaacgccatgatcgccgccggcctggtggacgaccccagagccatggtgggcagactgaacgagctgctggtgaaggccctggagagacactag

SEQ ID NO: 102594 - DNA, 1956 bp, Artificial Sequence
  Description of Artificial Sequence: Synthetic coding sequence
atggccagagagctgagagccctgctgctgtggggcagaagactgagacccctgctgagagcccccgccctggccgccgtgcccggcggcagcaccagcaagcacgagttccaggccgagaccaagaagctgctggacatcgtggccagaagcctgtacagcgagaaggaggtgttcatcagagagctgatcagcaacgccagcgacgccctggagaagctgagacacaagctggtgagcgacggccaggccctgcccgagatggagatccacctgcagaccaacgccgagaagggcaccatcaccatccaggacaccggcatcggcatgacccaggaggagctggtgagcaacctgggcaccatcgccagaagcggcagcaaggccttcctggacgccctgcagaaccaggccgaggccagcagcaagatcatcggccagttcggcgtgggcttctacagcgccttcatggtggccgacagagtggaggtgtacagcagaagcgccgcccccggcagcctgggctaccagtggctgagcgacggcagcggcgtgttcgagatcgccgaggccagcggcgtgagaaccggcaccaagatcatcatccacctgaagagcgactgcaaggagttcagcagcgaggccagagtgagagacgtggtgaccaagtacagcaacttcgtgagcttccccctgtacctgaacggcagaagaatgaacaccctgcaggccatctggatgatggaccccaaggacgtgagagagtggcagcacgaggagttctacagatacgtggcccaggcccacgacaagcccagatacaccctgcactacaagaccgacgcccccctgaacatcagaagcatcttctacgtgcccgacatgaagcccagcatgttcgacgtgagcagagagctgggcagcagcgtggccctgtacagcagaaaggtgctgatccagaccaaggccaccgacatcctgcccaagtggctgagattcatcagaggcgtggtggacagcgaggacatccccctgaacctgagcagagagctgctgcaggagagcgccctgatcagaaagctgagagacgtgctgcagcagagactgatcaagttcttcatcgaccagagcaagaaggacgccgagaagtacgccaagttcttcgaggactacggcctgttcatgagagagggcatcgtgaccgccaccgagcaggaggtgaaggaggacatcgccaagctgctgagatacgagagcagcgccctgcccagcggccagctgaccagcctgagcgagtacgccagcagaatgagagccggcaccagaaacatctactacctgtgcgcccccaacagacacctggccgagcacagcccctactacgaggccatgaagaagaaggacaccgaggtgctgttctgcttcgagcagttcgacgagctgaccctgctgcacctgagagagttcgacaagaagaagctgatcagcgtggagaccgacatcgtggtggaccactacaaggaggagaagttcgaggacagaagccccgccgccgagtgcctgagcgagaaggagaccgaggagctgatggcctggatgagaaacgtgctgggcagcagagtgaccaacgtgaaggtgaccctgagactggacacccaccccgccatggtgaccgtgctggagatgggcgccgccagacacttcctgagaatgcagcagctggccaagacccaggaggagagagcccagctgctgcagcccaccctggagatcaaccccagacacgccctgatcaagaagctgaaccagctgagagccagcgagcccggcctggcccagctgctggtggaccagatctacgagaacgccatgatcgccgccggcctggtggacgaccccagagccatggtgggcagactgaacgagctgctggtgaaggccctggagagacactag

SEQ ID NO: 102595 - DNA, 1911 bp, Artificial Sequence
  Description of Artificial Sequence: Synthetic coding sequence
atggagggcagaggcccctacagaatctacgaccccggcggcagcgtgcccagcggcgaggccagcgccgccttcgagagactggtgaaggagaacagcagactgaaggagaagatgcagggcatcaagatgctgggcgagctgctggaggagagccagatggaggccaccagactgagacagaaggccgaggagctggtgaaggacaacgagctgctgcccccccccagccccagcctgggcagcttcgaccccctggccgagctgaccggcaaggacagcaacgtgaccgccagccccaccgcccccgcctgccccagcgacaagcccgcccccgtgcagaagccccccagcagcggcaccagcagcgagttcgaggtggtgacccccgaggagcagaacagccccgagagcagcagccacgccaacgccatggccctgggccccctgcccagagaggacggcaacctgatgctgcacctgcagagactggagaccaccctgagcgtgtgcgccgaggagcccgaccacggccagctgttcacccacctgggcagaatggccctggagttcaacagactggccagcaaggtgcacaagaacgagcagagaaccagcatcctgcagaccctgtgcgagcagctgagaaaggagaacgaggccctgaaggccaagctggacaagggcctggagcagagagaccaggccgccgagagactgagagaggagaacctggagctgaagaagctgctgatgagcaacggcaacaaggagggcgccagcggcagacccggcagccccaagatggagggcaccggcaagaaggccgtggccggccagcagcaggccagcgtgaccgccggcaaggtgcccgaggtggtggccctgggcgccgccgagaagaaggtgaagatgctggagcagcagagaagcgagctgctggaggtgaacaagcagtgggaccagcacttcagaagcatgaagcagcagtacgagcagaagatcaccgagctgagacagaagctggccgacctgcagaagcaggtgaccgacctggaggccgagagagagcagaagcagagagacttcgacagaaagctgctgctggccaagagcaagatcgagatggaggagaccgacaaggagcagctgaccgccgaggccaaggagctgagacagaaggtgaagtacctgcaggaccagctgagccccctgaccagacagagagagtaccaggagaaggagatccagagactgaacaaggccctggaggaggccctgagcatccagaccccccccagcagcccccccaccgccttcggcagccccgagggcgccggcgccctgctgagaaagcaggagctggtgacccagaacgagctgctgaagcagcaggtgaagatcttcgaggaggacttccagagagagagaagcgacagagagagaatgaacgaggagaaggaggagctgaagaagcaggtggagaagctgcaggcccaggtgaccctgagcaacgcccagctgaaggccttcaaggacgaggagaaggccagagaggccctgagacagcagaagagaaaggccaaggccagcggcgagagataccacgtggagccccaccccgagcacctgtgcggcgcctacccctacgcctacccccccatgcccgccatggtgccccaccacggcttcgaggactggagccagatcagatacccccccccccccatggccatggagcaccccccccccctgcccaacagcagactgttccacctgcccgagtacacctggagactgccctgcggcggcgtgagaaaccccaaccagagcagccaggtgatggacccccccaccgccagacccaccgagcccgagagccccaagaacgacagagagggcccccagtag

SEQ ID NO: 102596 - DNA, 1911 bp, Artificial Sequence; identical to SEQ ID NO: 102595
  Description of Artificial Sequence: Synthetic coding sequence

SEQ ID NO: 102597 - DNA, 1590 bp, Artificial Sequence
  Description of Artificial Sequence: Synthetic coding sequence
atgctgggcgagctgctggaggagagccagatggaggccaccagactgagacagaaggccgaggagctggtgaaggacaacgagctgctgcccccccccagccccagcctgggcagcttcgaccccctggccgagctgaccggcaaggacagcaacgtgaccgccagccccaccgcccccgcctgccccagcgacaagcccgcccccgtgcagaagccccccagcagcggcaccagcagcgagttcgaggtggtgacccccgaggagcagaacagccccgagagcagcagccacgccaacgccatggccctgggccccctgcccagagaggacggcaacctgatgctgcacctgcagagactggagaccaccctgagcgtgtgcgccgaggagcccgaccacggccagctgttcacccacctgggcagaatggccctggagttcaacagactggccagcaaggtgcacaagaacgagcagagaaccagcatcctgcagaccctgtgcgagcagctgagaaaggagaacgaggccctgaaggccaagctggacaagggcctggagcagagagaccaggccgccgagagactgagagaggagaacctggagctgaagaagctgctgatgagcaacggcaacaaggagggcgccagcggcagacccggcagccccaagatggagggcaccggcaagaaggccgtggccggccagcagcaggccagcgtgaccgccggcaaggtgcccgaggtggtggccctgggcgccgccgagaagaaggtgaagatgctggagcagcagagaagcgagctgctggaggtgaacaagcagtgggaccagcacttcagaagcatgaagcagcagtacgagcagaagatcaccgagctgagacagaagctggccgacctgcagaagcaggtgaccgacctggaggccgagagagagcagaagcagagagacttcgacagaaagctgctgctggccaagagcaagatcgagatggaggagaccgacaaggagcagctgaccgccgaggccaaggagctgagacagaaggtgaagtacctgcaggaccagctgagccccctgaccagacagagagagtaccaggagaaggagatccagagactgaacaaggccctggaggaggccctgagcatccagaccccccccagcagcccccccaccgccttcggcagccccgagggcgccggcgccctgctgagaaagcaggagctggtgacccagaacgagctgctgaagcagcaggtgaagatcttcgaggaggacttccagagagagagaagcgacagagagagaatgaacgaggagaaggaggagctgaagaagcaggtggagaagctgcaggcccaggtgaccctgagcaacgcccagctgaaggccttcaaggacgaggagaaggccagagaggccctgagacagcagaagagaaaggccaagcccgagtacacctggagactgccctgcggcggcgtgagaaaccccaaccagagcagccaggtgatggacccccccaccgccagacccaccgagcccgagagccccaagaacgacagagagggcccccagtag

SEQ ID NO: 102598 - DNA, 1908 bp, Artificial Sequence
  Description of Artificial Sequence: Synthetic coding sequence
atggagggcagaggcccctacagaatctacgaccccggcggcagcgtgcccagcggcgaggccagcgccgccttcgagagactggtgaaggagaacagcagactgaaggagaagatgcagggcatcaagatgctgggcgagctgctggaggagagccagatggaggccaccagactgagacagaaggccgaggagctggtgaaggacaacgagctgctgcccccccccagccccagcctgggcagcttcgaccccctggccgagctgaccggcaaggacagcaacgtgaccgccagccccaccgcccccgcctgccccagcgacaagcccgcccccgtgcagaagccccccagcagcggcaccagcagcgagttcgaggtggtgacccccgaggagcagaacagccccgagagcagcagccacgccaacgccatggccctgggccccctgcccagagaggacggcaacctgatgctgcacctgcagagactggagaccaccctgagcgtgtgcgccgaggagcccgaccacggccagctgttcacccacctgggcagaatggccctggagttcaacagactggccagcaaggtgcacaagaacgagcagagaaccagcatcctgcagaccctgtgcgagcagctgagaaaggagaacgaggccctgaaggccaagctggacaagggcctggagcagagagaccaggccgccgagagactgagagaggagaacctggagctgaagaagctgctgatgagcaacggcaacaaggagggcgccagcggcagacccggcagccccaagatggagggcaccggcaagaaggccgtggccggccagcagcaggccagcgtgaccgccggcaaggtgcccgaggtggtggccctgggcgccgccgagaagaaggtgaagatgctggagcagcagagaagcgagctgctggaggtgaacaagcagtgggaccagcacttcagaagcatgaagcagcagtacgagcagaagatcaccgagctgagacagaagctggccgacctgcagaagcaggtgaccgacctggaggccgagagagagcagaagcagagagacttcgacagaaagctgctgctggccaagagcaagatcgagatggaggagaccgacaaggagcagctgaccgccgaggccaaggagctgagacagaaggtgaagtacctgcaggaccagctgagccccctgaccagacagagagagtaccaggagaaggagatccagagactgaacaaggccctggaggaggccctgagcatccagaccccccccagcagcccccccaccgccttcggcagccccgagggcgccggcgccctgctgagaaagcaggagctggtgacccagaacgagctgctgaagcagcaggtgaagatcttcgaggaggacttccagagagagagaagcgacagagagagaatgaacgaggagaaggaggagctgaagaagcaggtggagaagctgcaggcccaggtgaccctgagcaacgcccagctgaaggccttcaaggacgaggagaaggccagagaggccctgagacagcagaagagaaaggccaaggccagcggcgagagataccacgtggagccccaccccgagcacctgtgcggcgcctacccctacgcctacccccccatgcccgccatggtgccccaccacggcttcgaggactggagccagatcagatacccccccccccccatggccatggagcaccccccccccctgcccaacagcagactgttccacctgcccgagtacacctggagactgccctgcggcggcgtgagaaaccccaaccagagcagccaggtgatggacccccccaccgccagacccaccgagcccgagcccgccgacctgagactgcccagaaactag

SEQ ID NO: 102599 - DNA, 1479 bp, Artificial Sequence
  Description of Artificial Sequence: Synthetic coding sequence
atggaggccaccagactgagacagaaggccgaggagctggtgaaggacaacgagctgctgcccccccccagccccagcctgggcagcttcgaccccctggccgagctgaccggcaaggacagcaacgtgaccgccagccccaccgcccccgcctgccccagcgacaagcccgcccccgtgcagaagccccccagcagcggcaccagcagcgagttcgaggtggtgacccccgaggagcagaacagccccgagagcagcagccacgccaacgccatggccctgggccccctgcccagagaggacggcaacctgatgctgcacctgcagagactggagaccaccctgagcgtgtgcgccgaggagcccgaccacggccagctgttcacccacctgggcagaatggccctggagttcaacagactggccagcaaggtgcacaagaacgagcagagaaccagcatcctgcagaccctgtgcgagcagctgagaaaggagaacgaggccctgaaggccaagctggacaagggcctggagcagagagaccaggccgccgagagactgagagaggagaacctggagctgaagaagctgctgatgagcaacggcaacaaggagggcgccagcggcagacccggcagccccaagatggagggcaccggcaagaaggccgtggccggccagcagcaggccagcgtgaccgccggcaaggtgcccgaggtggtggccctgggcgccgccgagaagaaggtgaagatgctggagcagcagagaagcgagctgctggaggtgaacaagcagtgggaccagcacttcagaagcatgaagcagcagtacgagcagaagatcaccgagctgagacagaagctggccgacctgcagaagcaggtgaccgacctggaggccgagagagagcagaagcagagagacttcgacagaaagctgctgctggccaagagcaagatcgagatggaggagaccgacaaggagcagctgaccgccgaggccaaggagctgagacagaaggtgaagtacctgcaggaccagctgagccccctgaccagacagagagagtaccaggagaaggagatccagagactgaacaaggccctggaggaggccctgagcatccagaccccccccagcagcccccccaccgccttcggcagccccgagggcgccggcgccctgctgagaaagcaggagctggtgacccagaacgagctgctgaagcagcaggtgaagatcttcgaggaggacttccagagagagagaagcgacagagagagaatgaacgaggagaaggaggagctgaagaagcaggtggagaagctgcaggcccaggtgaccctgagcaacgcccagctgaaggccttcaaggacgaggagaaggccagagaggccctgagacagcagaagagaaaggccaagggcacccacagaggctgccccagacacctgcccgagagaaaggtgaagtag

SEQ ID NO: 102600 - DNA, 435 bp, Artificial Sequence
  Description of Artificial Sequence: Synthetic coding sequence
atggagggcagaggcccctacagaatctacgaccccggcggcagcgtgcccagcggcgaggccagcgccgccttcgagagactggtgaaggagaacagcagactgaaggagaagatgcagggcatcaagatgctgggcgagctgctggaggagagccagatggaggccaccagactgagacagaaggccgaggagctggtgaaggacaacgagctgctgcccccccccagccccagcctgggcagcttcgaccccctggccgagctgaccggcaaggacagcaacgtgaccgccagccccaccgcccccgcctgccccagcgacaagcccgcccccgtgcagaagccccccagcagcggcaccagcagcgagttcgaggtggtgacccccgaggagcagaacagccccgagagcagcagccacgccaacgcctag

SEQ ID NO: 102601 - DNA, 1752 bp, Artificial Sequence
  Description of Artificial Sequence: Synthetic coding sequence
atggaggccaccagactgagacagaaggccgaggagctggtgaaggacaacgagctgctgcccccccccagccccagcctgggcagcttcgaccccctggccgagctgaccggcaaggacagcaacgtgaccgccagccccaccgcccccgcctgccccagcgacaagcccgcccccgtgcagaagccccccagcagcggcaccagcagcgagttcgaggtggtgacccccgaggagcagaacagccccgagagcagcagccacgccaacgccatggccctgggccccctgcccagagaggacggcaacctgatgctgcacctgcagagactggagaccaccctgagcgtgtgcgccgaggagcccgaccacggccagctgttcacccacctgggcagaatggccctggagttcaacagactggccagcaaggtgcacaagaacgagcagagaaccagcatcctgcagaccctgtgcgagcagctgagaaaggagaacgaggccctgaaggccaagctggacaagggcctggagcagagagaccaggccgccgagagactgagagaggagaacctggagctgaagaagctgctgatgagcaacggcaacaaggagggcgccagcggcagacccggcagccccaagatggagggcaccggcaagaaggccgtggccggccagcagcaggccagcgtgaccgccggcaaggtgcccgaggtggtggccctgggcgccgccgagaagaaggtgaagatgctggagcagcagagaagcgagctgctggaggtgaacaagcagtgggaccagcacttcagaagcatgaagcagcagtacgagcagaagatcaccgagctgagacagaagctggccgacctgcagaagcaggtgaccgacctggaggccgagagagagcagaagcagagagacttcgacagaaagctgctgctggccaagagcaagatcgagatggaggagaccgacaaggagcagctgaccgccgaggccaaggagctgagacagaaggtgaagtacctgcaggaccagctgagccccctgaccagacagagagagtaccaggagaaggagatccagagactgaacaaggccctggaggaggccctgagcatccagaccccccccagcagcccccccaccgccttcggcagccccgagggcgccggcgccctgctgagaaagcaggagctggtgacccagaacgagctgctgaagcagcaggtgaagatcttcgaggaggacttccagagagagagaagcgacagagagagaatgaacgaggagaaggaggagctgaagaagcaggtggagaagctgcaggcccaggtgaccctgagcaacgcccagctgaaggccttcaaggacgaggagaaggccagagaggccctgagacagcagaagagaaaggccaaggccagcggcgagagataccacgtggagccccaccccgagcacctgtgcggcgcctacccctacgcctacccccccatgcccgccatggtgccccaccacggcttcgaggactggagccagatcagatacccccccccccccatggccatggagcaccccccccccctgcccaacagcagactgttccacctgcccgagtacacctggagactgccctgcggcggcgtgagaaaccccaaccagagcagccaggtgatggacccccccaccgccagacccaccgagcccgagagccccaagaacgacagagagggcccccagtag

SEQ ID NO: 102602 - DNA, 402 bp, Artificial Sequence
  Description of Artificial Sequence: Synthetic coding sequence
atggagggcagaggcccctacagaatctacgaccccggcggcagcgtgcccagcggcgaggccagcgccgccttcgagagactggtgaaggagaacagcagactgaaggagaagatgcagggcatcaagatgctgggcgagctgctggaggagagccagatggaggccaccagactgagacagaaggccgaggagctggtgaaggacaacgagctgctgcccccccccagccccagcctgggcagcttcgaccccctggccgagctgaccggcaaggacagcaacgtgaccgccagccccaccgcccccgcctgccccagcgacaagcccgcccccgtgcagaagccccccagcagcggcaccagcagcgagttcgaggtggtgacccccgaggagcagtag

SEQ ID NO: 102603 - DNA, 1911 bp, Artificial Sequence; identical to SEQ ID NO: 102595
  Description of Artificial Sequence: Synthetic coding sequence

SEQ ID NO: 102604 - DNA, 774 bp, Artificial Sequence
  Description of Artificial Sequence: Synthetic coding sequence
atggaggccaccagactgagacagaaggccgaggagctggtgaaggacaacgagctgctgcccccccccagccccagcctgggcagcttcgaccccctggccgagctgaccggcaaggacagcaacgtgaccgccagccccaccgcccccgcctgccccagcgacaagcccgcccccgtgcagaagccccccagcagcggcaccagcagcgagttcgaggtggtgacccccgaggagcagaacagccccgagagcagcagccacgccaacgccatggccctgggccccctgcccagagaggacggcaacctgatgctgcacctgcagagactggagaccaccctgagcgtgtgcgccgaggagcccgaccacggccagctgttcacccacctgggcagaatggccctggagttcaacagactggccagcaaggtgcacaagaacgagcagagaaccagcatcctgcagaccctgtgcgagcagctgagaaaggagaacgaggccctgaaggccaagctggacaagggcctggagcagagagaccaggccgccgagagactgagagaggagaacctggagctgaagaagctgctgatgagcaacggcaacaaggagggcgccagcggcagacccggcagccccaagatggagggcaccggcaagaaggccgtggccggccagcagcaggccagcgtgaccgccggcaaggtgcccgaggtggtggccctgggcgccgccgagaagaaggtgaagatgctggagcagcagagatag

SEQ ID NO: 102605 - DNA, 1911 bp, Artificial Sequence; identical to SEQ ID NO: 102595
  Description of Artificial Sequence: Synthetic coding sequence

SEQ ID NO: 102606 - DNA, 1719 bp, Artificial Sequence
  Description of Artificial Sequence: Synthetic coding sequence
atggagggcagaggcccctacagaatctacgaccccggcggcagcgtgcccagcggcgaggccagcgccgccttcgagagactggtgaaggagaacagcagactgaaggagaagatgcagggcatcaagatgctgggcgagctgctggaggagagccagatggaggccaccagactgagacagaaggccgaggagctggtgaaggacaacgagctgctgcccccccccagccccagcctgggcagcttcgaccccctggccgagctgaccggcaaggacagcaacgtgaccgccagccccaccgcccccgcctgccccagcgacaagcccgcccccgtgcagaagccccccagcagcggcaccagcagcgagttcgaggtggtgacccccgaggagcagaacagccccgagagcagcagccacgccaacgccatggccctgggccccctgcccagagaggacggcaacctgatgctgcacctgcagagactggagaccaccctgagcgtgtgcgccgaggagcccgaccacggccagctgttcacccacctgggcagaatggccctggagttcaacagactggccagcaaggtgcacaagaacgagcagagaaccagcatcctgcagaccctgtgcgagcagctgagaaaggagaacgaggccctgaaggccaagctggacaagggcctggagcagagagaccaggccgccgagagactgagagaggagaacctggagctgaagaagctgctgatgagcaacggcaacaaggagggcgccagcggcagacccggcagccccaagatggagggcaccggcaagaaggccgtggccggccagcagcaggccagcgtgaccgccggcaaggtgcccgaggtggtggccctgggcgccgccgagaagaaggtgaagatgctggagcagcagagaagcgagctgctggaggtgaacaagcagtgggaccagcacttcagaagcatgaagcagcagtacgagcagaagatcaccgagctgagacagaagctggccgacctgcagaagcaggtgaccgacctggaggccgagagagagcagaagcagagagacttcgacagaaagctgctgctggccaagagcaagatcgagatggaggagaccgacaaggagcagctgaccgccgaggccaaggagctgagacagaaggtgaagtacctgcaggaccagctgagccccctgaccagacagagagagtaccaggagaaggagatccagagactgaacaaggccctggaggaggccctgagcatccagaccccccccagcagcccccccaccgccttcggcagccccgagggcgccggcgccctgctgagaaagcaggagctggtgacccagaacgagctgctgaagcagcaggtgaagatcttcgaggaggacttccagagagagagaagcgacagagagagaatgaacgaggagaaggaggagctgaagaagcaggtggagaagctgcaggcccaggtgaccctgagcaacgcccagctgaaggccttcaaggacgaggagaaggccagagaggccctgagacagcagaagagaaaggccaagcccgagtacacctggagactgccctgcggcggcgtgagaaaccccaaccagagcagccaggtgatggacccccccaccgccagacccaccgagcccgagagccccaagaacgacagagagggcccccagtag

SEQ ID NO: 102607 - DNA, 1908 bp, Artificial Sequence; identical to SEQ ID NO: 102598
  Description of Artificial Sequence: Synthetic coding sequence

SEQ ID NO: 102608 - DNA, 1671 bp, Artificial Sequence
  Description of Artificial Sequence: Synthetic coding sequence
atggagggcagaggcccctacagaatctacgaccccggcggcagcgtgcccagcggcgaggccagcgccgccttcgagagactggtgaaggagaacagcagactgaaggagaagatgcagggcatcaagatgctgggcgagctgctggaggagagccagatggaggccaccagactgagacagaaggccgaggagctggtgaaggacaacgagctgctgcccccccccagccccagcctgggcagcttcgaccccctggccgagctgaccggcaaggacagcaacgtgaccgccagccccaccgcccccgcctgccccagcgacaagcccgcccccgtgcagaagccccccagcagcggcaccagcagcgagttcgaggtggtgacccccgaggagcagaacagccccgagagcagcagccacgccaacgccatggccctgggccccctgcccagagaggacggcaacctgatgctgcacctgcagagactggagaccaccctgagcgtgtgcgccgaggagcccgaccacggccagctgttcacccacctgggcagaatggccctggagttcaacagactggccagcaaggtgcacaagaacgagcagagaaccagcatcctgcagaccctgtgcgagcagctgagaaaggagaacgaggccctgaaggccaagctggacaagggcctggagcagagagaccaggccgccgagagactgagagaggagaacctggagctgaagaagctgctgatgagcaacggcaacaaggagggcgccagcggcagacccggcagccccaagatggagggcaccggcaagaaggccgtggccggccagcagcaggccagcgtgaccgccggcaaggtgcccgaggtggtggccctgggcgccgccgagaagaaggtgaagatgctggagcagcagagaagcgagctgctggaggtgaacaagcagtgggaccagcacttcagaagcatgaagcagcagtacgagcagaagatcaccgagctgagacagaagctggccgacctgcagaagcaggtgaccgacctggaggccgagagagagcagaagcagagagacttcgacagaaagctgctgctggccaagagcaagatcgagatggaggagaccgacaaggagcagctgaccgccgaggccaaggagctgagacagaaggtgaagtacctgcaggaccagctgagccccctgaccagacagagagagtaccaggagaaggagatccagagactgaacaaggccctggaggaggccctgagcatccagaccccccccagcagcccccccaccgccttcggcagccccgagggcgccggcgccctgctgagaaagcaggagctggtgacccagaacgagctgctgaagcagcaggtgaagatcttcgaggaggacttccagagagagagaagcgacagagagagaatgaacgaggagaaggaggagctgaagaagcaggtggagaagctgcaggcccaggtgaccctgagcaacgcccagctgaaggccttcaaggacgaggagaaggccagagaggccctgagacagcagaagagaaaggccaagagcctgcagaagatgaccgtgagaggcctgagcgagaccagactgtgccacctggccccccccagcagctgcagagccagctag

SEQ ID NO: 102609 - DNA, 1797 bp, Artificial Sequence
  Description of Artificial Sequence: Synthetic coding sequence
atgcagggcatcaagatgctgggcgagctgctggaggagagccagatggaggccaccagactgagacagaaggccgaggagctggtgaaggacaacgagctgctgcccccccccagccccagcctgggcagcttcgaccccctggccgagctgaccggcaaggacagcaacgtgaccgccagccccaccgcccccgcctgccccagcgacaagcccgcccccgtgcagaagccccccagcagcggcaccagcagcgagttcgaggtggtgacccccgaggagcagaacagccccgagagcagcagccacgccaacgccatggccctgggccccctgcccagagaggacggcaacctgatgctgcacctgcagagactggagaccaccctgagcgtgtgcgccgaggagcccgaccacggccagctgttcacccacctgggcagaatggccctggagttcaacagactggccagcaaggtgcacaagaacgagcagagaaccagcatcctgcagaccctgtgcgagcagctgagaaaggagaacgaggccctgaaggccaagctggacaagggcctggagcagagagaccaggccgccgagagactgagagaggagaacctggagctgaagaagctgctgatgagcaacggcaacaaggagggcgccagcggcagacccggcagccccaagatggagggcaccggcaagaaggccgtggccggccagcagcaggccagcgtgaccgccggcaaggtgcccgaggtggtggccctgggcgccgccgagaagaaggtgaagatgctggagcagcagagaagcgagctgctggaggtgaacaagcagtgggaccagcacttcagaagcatgaagcagcagtacgagcagaagatcaccgagctgagacagaagctggccgacctgcagaagcaggtgaccgacctggaggccgagagagagcagaagcagagagacttcgacagaaagctgctgctggccaagagcaagatcgagatggaggagaccgacaaggagcagctgaccgccgaggccaaggagctgagacagaaggtgaagtacctgcaggaccagctgagccccctgaccagacagagagagtaccaggagaaggagatccagagactgaacaaggccctggaggaggccctgagcatccagaccccccccagcagcccccccaccgccttcggcagccccgagggcgccggcgccctgctgagaaagcaggagctggtgacccagaacgagctgctgaagcagcaggtgaagatcttcgaggaggacttccagagagagagaagcgacagagagagaatgaacgaggagaaggaggagctgaagaagcaggtggagaagctgcaggcccaggtgaccctgagcaacgcccagctgaaggccttcaaggacgaggagaaggccagagaggccctgagacagcagaagagaaaggccaaggccagcggcgagagataccacgtggagccccaccccgagcacctgtgcggcgcctacccctacgcctacccccccatgcccgccatggtgccccaccacggcttcgaggactggagccagatcagatacccccccccccccatggccatggagcaccccccccccctgcccaacagcagactgttccacctgcccgagtacacctggagactgccctgcggcggcgtgagaaaccccaaccagagcagccaggtgatggacccccccaccgccagacccaccgagcccgagagccccaagaacgacagagagggcccccagtag

SEQ ID NO: 102610 - DNA, 1542 bp, Artificial Sequence
  Description of Artificial Sequence: Synthetic coding sequence
atgctgggcgagctgctggaggagagccagatggaggccaccagactgagacagaaggccgaggagctggtgaaggacaacgagctgctgcccccccccagccccagcctgggcagcttcgaccccctggccgagctgaccggcaaggacagcaacgtgaccgccagccccaccgcccccgcctgccccagcgacaagcccgcccccgtgcagaagccccccagcagcggcaccagcagcgagttcgaggtggtgacccccgaggagcagaacagccccgagagcagcagccacgccaacgccatggccctgggccccctgcccagagaggacggcaacctgatgctgcacctgcagagactggagaccaccctgagcgtgtgcgccgaggagcccgaccacggccagctgttcacccacctgggcagaatggccctggagttcaacagactggccagcaaggtgcacaagaacgagcagagaaccagcatcctgcagaccctgtgcgagcagctgagaaaggagaacgaggccctgaaggccaagctggacaagggcctggagcagagagaccaggccgccgagagactgagagaggagaacctggagctgaagaagctgctgatgagcaacggcaacaaggagggcgccagcggcagacccggcagccccaagatggagggcaccggcaagaaggccgtggccggccagcagcaggccagcgtgaccgccggcaaggtgcccgaggtggtggccctgggcgccgccgagaagaaggtgaagatgctggagcagcagagaagcgagctgctggaggtgaacaagcagtgggaccagcacttcagaagcatgaagcagcagtacgagcagaagatcaccgagctgagacagaagctggccgacctgcagaagcaggtgaccgacctggaggccgagagagagcagaagcagagagacttcgacagaaagctgctgctggccaagagcaagatcgagatggaggagaccgacaaggagcagctgaccgccgaggccaaggagctgagacagaaggtgaagtacctgcaggaccagctgagccccctgaccagacagagagagtaccaggagaaggagatccagagactgaacaaggccctggaggaggccctgagcatccagaccccccccagcagcccccccaccgccttcggcagccccgagggcgccggcgccctgctgagaaagcaggagctggtgacccagaacgagctgctgaagcagcaggtgaagatcttcgaggaggacttccagagagagagaagcgacagagagagaatgaacgaggagaaggaggagctgaagaagcaggtggagaagctgcaggcccaggtgaccctgagcaacgcccagctgaaggccttcaaggacgaggagaaggccagagaggccctgagacagcagaagagaaaggccaagagcctgcagaagatgaccgtgagaggcctgagcgagaccagactgtgccacctggccccccccagcagctgcagagccagctag

SEQ ID NO: 102611 - DNA, 1509 bp, Artificial Sequence
  Description of Artificial Sequence: Synthetic coding sequence
atgctgggcgagctgctggaggagagccagatggaggccaccagactgagacagaaggccgaggagctggtgaaggacaacgagctgctgcccccccccagccccagcctgggcagcttcgaccccctggccgagctgaccggcaaggacagcaacgtgaccgccagccccaccgcccccgcctgccccagcgacaagcccgcccccgtgcagaagccccccagcagcggcaccagcagcgagttcgaggtggtgacccccgaggagcagaacagccccgagagcagcagccacgccaacgccatggccctgggccccctgcccagagaggacggcaacctgatgctgcacctgcagagactggagaccaccctgagcgtgtgcgccgaggagcccgaccacggccagctgttcacccacctgggcagaatggccctggagttcaacagactggccagcaaggtgcacaagaacgagcagagaaccagcatcctgcagaccctgtgcgagcagctgagaaaggagaacgaggccctgaaggccaagctggacaagggcctggagcagagagaccaggccgccgagagactgagagaggagaacctggagctgaagaagctgctgatgagcaacggcaacaaggagggcgccagcggcagacccggcagccccaagatggagggcaccggcaagaaggccgtggccggccagcagcaggccagcgtgaccgccggcaaggtgcccgaggtggtggccctgggcgccgccgagaagaaggtgaagatgctggagcagcagagaagcgagctgctggaggtgaacaagcagtgggaccagcacttcagaagcatgaagcagcagtacgagcagaagatcaccgagctgagacagaagctggccgacctgcagaagcaggtgaccgacctggaggccgagagagagcagaagcagagagacttcgacagaaagctgctgctggccaagagcaagatcgagatggaggagaccgacaaggagcagctgaccgccgaggccaaggagctgagacagaaggtgaagtacctgcaggaccagctgagccccctgaccagacagagagagtaccaggagaaggagatccagagactgaacaaggccctggaggaggccctgagcatccagaccccccccagcagcccccccaccgccttcggcagccccgagggcgccggcgccctgctgagaaagcaggagctggtgacccagaacgagctgctgaagcagcaggtgaagatcttcgaggaggacttccagagagagagaagcgacagagagagaatgaacgaggagaaggaggagctgaagaagcaggtggagaagctgcaggcccaggtgaccctgagcaacgcccagctgaaggccttcaaggacgaggagaaggccagagaggccctgagacagcagaagagaaaggccaagggcacccacagaggctgccccagacacctgcccgagagaaaggtgaagtag

SEQ ID NO: 102612 - DNA, 1290 bp, Artificial Sequence
  Description of Artificial Sequence: Synthetic coding sequence
atgagcagagaccccggcagcggcggctgggaggaggcccccagagccgccgccgccctgtgcaccctgtaccacgaggccggccagagactgagaagactgcaggaccagctggccgccagagacgccctgatcgccagactgagagccagactggccgccctggagggcgacgccgcccccagcctggtggacgccctgctggagcaggtggccagattcagagagcagctgagaagacaggagggcggcgccgccgaggcccagatgagacaggagatcgagagactgaccgagagactggaggagaaggagagagagatgcagcagctgctgagccagccccagcacgagagagagaaggaggtggtgctgctgagaagaagcatggccgagggcgagagagccagagccgccagcgacgtgctgtgcagaagcctggccaacgagacccaccagctgagaagaaccctgaccgccaccgcccacatgtgccagcacctggccaagtgcctggacgagagacagcacgcccagagaaacgtgggcgagagaagccccgaccagagcgagcacaccgacggccacaccagcgtgcagagcgtgatcgagaagctgcaggaggagaacagactgctgaagcagaaggtgacccacgtggaggacctgaacgccaagtggcagagatacaacgccagcagagacgagtacgtgagaggcctgcacgcccagctgagaggcctgcagatcccccacgagcccgagctgatgagaaaggagatcagcagactgaacagacagctggaggagaagatcaacgactgcgccgaggtgaagcaggagctggccgccagcagaaccgccagagacgccgccctggagagagtgcagatgctggagcagcagatcctggcctacaaggacgacttcatgagcgagagagccgacagagagagagcccagagcagaatccaggagctggaggagaaggtggccagcctgctgcaccaggtgagctggagacaggacagcagagagcccgacgccggcagaatccacgccggcagcaagaccgccaagtacctggccgccgacgccctggagctgatggtgcccggcggctggagacccggcaccggcagccagcagcccgagccccccgccgagggcggccaccccggcgccgcccagagaggccagggcgacctgcagtgcccccactgcctgcagtgcttcagcgacgagcagggcgaggagctgctgagacacgtggccgagtgctgccagtag

SEQ ID NO: 102613 - DNA, 969 bp, Artificial Sequence
  Description of Artificial Sequence: Synthetic coding sequence
atgcagcagctgctgagccagccccagcacgagagagagaaggaggtggtgctgctgagaagaagcatggccgagggcgagagagccagagccgccagcgacgtgctgtgcagaagcctggccaacgagacccaccagctgagaagaaccctgaccgccaccgcccacatgtgccagcacctggccaagtgcctggacgagagacagcacgcccagagaaacgtgggcgagagaagccccgaccagagcgagcacaccgacggccacaccagcgtgcagagcgtgatcgagaagctgcaggaggagaacagactgctgaagcagaaggtgacccacgtggaggacctgaacgccaagtggcagagatacaacgccagcagagacgagtacgtgagaggcctgcacgcccagctgagaggcctgcagatcccccacgagcccgagctgatgagaaaggagatcagcagactgaacagacagctggaggagaagatcaacgactgcgccgaggtgaagcaggagctggccgccagcagaaccgccagagacgccgccctggagagagtgcagatgctggagcagcagatcctggcctacaaggacgacttcatgagcgagagagccgacagagagagagcccagagcagaatccaggagctggaggagaaggtggccagcctgctgcaccaggtgagctggagacaggacagcagagagcccgacgccggcagaatccacgccggcagcaagaccgccaagtacctggccgccgacgccctggagctgatggtgcccggcggctggagacccggcaccggcagccagcagcccgagccccccgccgagggcggccaccccggcgccgcccagagaggccagggcgacctgcagtgcccccactgcctgcagtgcttcagcgacgagcagggcgaggagctgctgagacacgtggccgagtgctgccagtag

SEQ ID NO: 102614 - DNA, 837 bp, Artificial Sequence
  Description of Artificial Sequence: Synthetic coding sequence
atggccgaggccagaagccagcccagcgccggcccccagctgaacgccctgcccgaccacagccccctgctgcagcccggcctggccgccctgagaagaagagccagagaggccggcgtgcccctggcccccctgcccctgaccgacagcttcctgctgagattcctgagagccagagacttcgacctggacctggcctggagactgctgaagaactactacaagtggagagccgagtgccccgagatcagcgccgacctgcaccccagaagcatcatcggcctgctgaaggccggctaccacggcgtgctgagaagcagagaccccaccggcagcaaggtgctgatctacagaatcgcccactgggaccccaaggtgttcaccgcctacgacgtgttcagagtgagcctgatcaccagcgagctgatcgtgcaggaggtggagacccagagaaacggcatcaaggccatcttcgacctggagggctggcagttcagccacgccttccagatcacccccagcgtggccaagaagatcgccgccgtgctgaccgacagcttccccctgaaggtgagaggcatccacctgatcaacgagcccgtgatcttccacgccgtgttcagcatgatcaagcccttcctgaccgagaagatcaaggagagaatccacatgcacggcaacaactacaagcagagcctgctgcagcacttccccgacatcctgcccctggagtacggcggcgaggagttcagcatggaggacatctgccaggagtggaccaacttcatcatgaagagcgaggactacctgagcagcatcagcgagagcatccagtag

SEQ ID NO: 102615 - DNA, 2361 bp, Artificial Sequence
  Description of Artificial Sequence: Synthetic coding sequence
atgaccagcatcttccacttcgccatcatcttcatgctgatcctgcagatcagaatccagctgagcgaggagagcgagttcctggtggacagaagcaagaacggcctgatccacgtgcccaaggacctgagccagaagaccaccatcctgaacatcagccagaactacatcagcgagctgtggaccagcgacatcctgagcctgagcaagctgagaatcctgatcatcagccacaacagaatccagtacctggacatcagcgtgttcaagttcaaccaggagctggagtacctggacctgagccacaacaagctggtgaagatcagctgccaccccaccgtgaacctgaagcacctggacctgagcttcaacgccttcgacgccctgcccatctgcaaggagttcggcaacatgagccagctgaagttcctgggcctgagcaccacccacctggagaagagcagcgtgctgcccatcgcccacctgaacatcagcaaggtgctgctggtgctgggcgagacctacggcgagaaggaggaccccgagggcctgcaggacttcaacaccgagagcctgcacatcgtgttccccaccaacaaggagttccacttcatcctggacgtgagcgtgaagaccgtggccaacctggagctgagcaacatcaagtgcgtgctggaggacaacaagtgcagctacttcctgagcatcctggccaagctgcagaccaaccccaagctgagcaacctgaccctgaacaacatcgagaccacctggaacagcttcatcagaatcctgcagctggtgtggcacaccaccgtgtggtacttcagcatcagcaacgtgaagctgcagggccagctggacttcagagacttcgactacagcggcaccagcctgaaggccctgagcatccaccaggtggtgagcgacgtgttcggcttcccccagagctacatctacgagatcttcagcaacatgaacatcaagaacttcaccgtgagcggcaccagaatggtgcacatgctgtgccccagcaagatcagccccttcctgcacctggacttcagcaacaacctgctgaccgacaccgtgttcgagaactgcggccacctgaccgagctggagaccctgatcctgcagatgaaccagctgaaggagctgagcaagatcgccgagatgaccacccagatgaagagcctgcagcagctggacatcagccagaacagcgtgagctacgacgagaagaagggcgactgcagctggaccaagagcctgctgagcctgaacatgagcagcaacatcctgaccgacaccatcttcagatgcctgccccccagaatcaaggtgctggacctgcacagcaacaagatcaagagcatccccaagcaggtggtgaagctggaggccctgcaggagctgaacgtggccttcaacagcctgaccgacctgcccggctgcggcagcttcagcagcctgagcgtgctgatcatcgaccacaacagcgtgagccaccccagcgccgacttcttccagagctgccagaagatgagaagcatcaaggccggcgacaaccccttccagtgcacctgcgagctgggcgagttcgtgaagaacatcgaccaggtgagcagcgaggtgctggagggctggcccgacagctacaagtgcgactaccccgagagctacagaggcaccctgctgaaggacttccacatgagcgagctgagctgcaacatcaccctgctgatcgtgaccatcgtggccaccatgctggtgctggccgtgaccgtgaccagcctgtgcagctacctggacctgccctggtacctgagaatggtgtgccagtggacccagaccagaagaagagccagaaacatccccctggaggagctgcagagaaacctgcagttccacgccttcatcagctacagcggccacgacagcttctgggtgaagaacgagctgctgcccaacctggagaaggagggcatgcagatctgcctgcacgagagaaacttcgtgcccggcaagagcatcgtggagaacatcatcacctgcatcgagaagagctacaagagcatcttcgtgctgagccccaacttcgtgcagagcgagtggtgccactacgagctgtacttcgcccaccacaacctgttccacgagggcagcaacagcctgatcctgatcctgctggagcccatcccccagtacagcatccccagcagctaccacaagctgaagagcctgatggccagaagaacctacctggagtggcccaaggagaagagcaagagaggcctgttctgggccaacctgagagccgccatcaacatcaagctgaccgagcaggccaagaagtag

SEQ ID NO: 102616 - DNA, 2361 bp, Artificial Sequence; identical to SEQ ID NO: 102615
  Description of Artificial Sequence: Synthetic coding sequence

SEQ ID NO: 102617 - DNA, 486 bp, Artificial Sequence
  Description of Artificial Sequence: Synthetic coding sequence
atgaccagcatcttccacttcgccatcatcttcatgctgatcctgcagatcagaatccagctgagcgaggagagcgagttcctggtggacagaagcaagaacggcctgatccacgtgcccaaggacctgagccagaagaccaccatcctgaacatcagccagaactacatcagcgagctgtggaccagcgacatcctgagcctgagcaagctgagaatcctgatcatcagccacaacagaatccagtacctggacatcagcgtgttcaagttcaaccaggagctggagtacctggacctgagccacaacaagctggtgaagatcagctgccaccccaccgtgaacctgaagcacctggacctgagcttcaacgccttcgacgccctgcccatctgcaaggagttcggcaacatgagccagctgaagttcctgggcctgagcaccacccacctggagaagagcagcgtgctgcccatcgcccactag

SEQ ID NO: 102618 - DNA, 147 bp, Artificial Sequence
  Description of Artificial Sequence: Synthetic coding sequence
atgaccagcatcttccacttcgccatcatcttcatgctgatcctgcagatcagaatccagctgagcgaggagagcgagttcctggtggacagaagcaagaacggcctgatccacgtgcccaaggacctgagccagaagaccacctag

SEQ ID NO: 102619 - DNA, 72 bp, Artificial Sequence
  Description of Artificial Sequence: Synthetic coding sequence
atgaccagcatcttccacttcgccatcatcttcatgctgatcctgcagatcagaatccagctgagcgagtag

SEQ ID NO: 102620 - DNA, 273 bp, Artificial Sequence
  Description of Artificial Sequence: Synthetic coding sequence
atgaccagcatcttccacttcgccatcatcttcatgctgatcctgcagatcagaatccagctgagcgaggagagcgagttcctggtggacagaagcaagaacggcctgatccacgtgcccaaggacctgagccagaagaccaccatcctgaacatcagccagaactacatcagcgagctgtggaccagcgacatcctgagcctgagcaagctgagaatcctgatcatcagccacaacagaatccagtacctggacatcagcgtgttcaagtag

SEQ ID NO: 102621 - DNA, 2355 bp, Artificial Sequence
  Description of Artificial Sequence: Synthetic coding sequence
atgccccacaccctgtggatggtgtgggtgctgggcgtgatcatcagcctgagcaaggaggagagcagcaaccaggccagcctgagctgcgacagaaacggcatctgcaagggcagcagcggcagcctgaacagcatccccagcggcctgaccgaggccgtgaagagcctggacctgagcaacaacagaatcacctacatcagcaacagcgacctgcagagatgcgtgaacctgcaggccctggtgctgaccagcaacggcatcaacaccatcgaggaggacagcttcagcagcctgggcagcctggagcacctggacctgagctacaactacctgagcaacctgagcagcagctggttcaagcccctgagcagcctgaccttcctgaacctgctgggcaacccctacaagaccctgggcgagaccagcctgttcagccacctgaccaagctgcagatcctgagagtgggcaacatggacaccttcaccaagatccagagaaaggacttcgccggcctgaccttcctggaggagctggagatcgacgccagcgacctgcagagctacgagcccaagagcctgaagagcatccagaacgtgagccacctgatcctgcacatgaagcagcacatcctgctgctggagatcttcgtggacgtgaccagcagcgtggagtgcctggagctgagagacaccgacctggacaccttccacttcagcgagctgagcaccggcgagaccaacagcctgatcaagaagttcaccttcagaaacgtgaagatcaccgacgagagcctgttccaggtgatgaagctgctgaaccagatcagcggcctgctggagctggagttcgacgactgcaccctgaacggcgtgggcaacttcagagccagcgacaacgacagagtgatcgaccccggcaaggtggagaccctgaccatcagaagactgcacatccccagattctacctgttctacgacctgagcaccctgtacagcctgaccgagagagtgaagagaatcaccgtggagaacagcaaggtgttcctggtgccctgcctgctgagccagcacctgaagagcctggagtacctggacctgagcgagaacctgatggtggaggagtacctgaagaacagcgcctgcgaggacgcctggcccagcctgcagaccctgatcctgagacagaaccacctggccagcctggagaagaccggcgagaccctgctgaccctgaagaacctgaccaacatcgacatcagcaagaacagcttccacagcatgcccgagacctgccagtggcccgagaagatgaagtacctgaacctgagcagcaccagaatccacagcgtgaccggctgcatccccaagaccctggagatcctggacgtgagcaacaacaacctgaacctgttcagcctgaacctgccccagctgaaggagctgtacatcagcagaaacaagctgatgaccctgcccgacgccagcctgctgcccatgctgctggtgctgaagatcagcagaaacgccatcaccaccttcagcaaggagcagctggacagcttccacaccctgaagaccctggaggccggcggcaacaacttcatctgcagctgcgagttcctgagcttcacccaggagcagcaggccctggccaaggtgctgatcgactggcccgccaactacctgtgcgacagccccagccacgtgagaggccagcaggtgcaggacgtgagactgagcgtgagcgagtgccacagaaccgccctggtgagcggcatgtgctgcgccctgttcctgctgatcctgctgaccggcgtgctgtgccacagattccacggcctgtggtacatgaagatgatgtgggcctggctgcaggccaagagaaagcccagaaaggcccccagcagaaacatctgctacgacgccttcgtgagctacagcgagagagacgcctactgggtggagaacctgatggtgcaggagctggagaacttcaacccccccttcaagctgtgcctgcacaagagagacttcatccccggcaagtggatcatcgacaacatcatcgacagcatcgagaagagccacaagaccgtgttcgtgctgagcgagaacttcgtgaagagcgagtggtgcaagtacgagctggacttcagccacttcagactgttcgacgagaacaacgacgccgccatcctgatcctgctggagcccatcgagaagaaggccatcccccagagattctgcaagctgagaaagatcatgaacaccaagacctacctggagtggcccatggacgaggcccagagagagggcttctgggtgaacctgagagccgccatcaagagctag

SEQ ID NO: 102622 - DNA, 2715 bp, Artificial Sequence
  Description of Artificial Sequence: Synthetic coding sequence
atgagacagaccctgccctgcatctacttctggggcggcctgctgcccttcggcatgctgtgcgccagcagcaccaccaagtgcaccgtgagccacgaggtggccgactgcagccacctgaagctgacccaggtgcccgacgacctgcccaccaacatcaccgtgctgaacctgacccacaaccagctgagaagactgcccgccgccaacttcaccagatacagccagctgaccagcctggacgtgggcttcaacaccatcagcaagctggagcccgagctgtgccagaagctgcccatgctgaaggtgctgaacctgcagcacaacgagctgagccagctgagcgacaagaccttcgccttctgcaccaacctgaccgagctgcacctgatgagcaacagcatccagaagatcaagaacaaccccttcgtgaagcagaagaacctgatcaccctggacctgagccacaacggcctgagcagcaccaagctgggcacccaggtgcagctggagaacctgcaggagctgctgctgagcaacaacaagatccaggccctgaagagcgaggagctggacatcttcgccaacagcagcctgaagaagctggagctgagcagcaaccagatcaaggagttcagccccggctgcttccacgccatcggcagactgttcggcctgttcctgaacaacgtgcagctgggccccagcctgaccgagaagctgtgcctggagctggccaacaccagcatcagaaacctgagcctgagcaacagccagctgagcaccaccagcaacaccaccttcctgggcctgaagtggaccaacctgaccatgctggacctgagctacaacaacctgaacgtggtgggcaacgacagcttcgcctggctgccccagctggagtacttcttcctggagtacaacaacatccagcacctgttcagccacagcctgcacggcctgttcaacgtgagatacctgaacctgaagagaagcttcaccaagcagagcatcagcctggccagcctgcccaagatcgacgacttcagcttccagtggctgaagtgcctggagcacctgaacatggaggacaacgacatccccggcatcaagagcaacatgttcaccggcctgatcaacctgaagtacctgagcctgagcaacagcttcaccagcctgagaaccctgaccaacgagaccttcgtgagcctggcccacagccccctgcacatcctgaacctgaccaagaacaagatcagcaagatcgagagcgacgccttcagctggctgggccacctggaggtgctggacctgggcctgaacgagatcggccaggagctgaccggccaggagtggagaggcctggagaacatcttcgagatctacctgagctacaacaagtacctgcagctgaccagaaacagcttcgccctggtgcccagcctgcagagactgatgctgagaagagtggccctgaagaacgtggacagcagccccagccccttccagcccctgagaaacctgaccatcctggacctgagcaacaacaacatcgccaacatcaacgacgacatgctggagggcctggagaagctggagatcctggacctgcagcacaacaacctggccagactgtggaagcacgccaaccccggcggccccatctacttcctgaagggcctgagccacctgcacatcctgaacctggagagcaacggcttcgacgagatccccgtggaggtgttcaaggacctgttcgagctgaagatcatcgacctgggcctgaacaacctgaacaccctgcccgccagcgtgttcaacaaccaggtgagcctgaagagcctgaacctgcagaagaacctgatcaccagcgtggagaagaaggtgttcggccccgccttcagaaacctgaccgagctggacatgagattcaaccccttcgactgcacctgcgagagcatcgcctggttcgtgaactggatcaacgagacccacaccaacatccccgagctgagcagccactacctgtgcaacacccccccccactaccacggcttccccgtgagactgttcgacaccagcagctgcaaggacagcgcccccttcgagctgttcttcatgatcaacaccagcatcctgctgatcttcatcttcatcgtgctgctgatccacttcgagggctggagaatcagcttctactggaacgtgagcgtgcacagagtgctgggcttcaaggagatcgacagacagaccgagcagttcgagtacgccgcctacatcatccacgcctacaaggacaaggactgggtgtgggagcacttcagcagcatggagaaggaggaccagagcctgaagttctgcctggaggagagagacttcgaggccggcgtgttcgagctggaggccatcgtgaacagcatcaagagaagcagaaagatcatcttcgtgatcacccaccacctgctgaaggaccccctgtgcaagagattcaaggtgcaccacgccgtgcagcaggccatcgagcagaacctggacagcatcatcctggtgttcctggaggagatccccgactacaagctgaaccacgccctgtgcctgagaagaggcatgttcaagagccactgcatcctgaactggcccgtgcagaaggagagaatcggcgccttcagacacaagctgcaggtggccctgggcagcaagaacagcgtgcactag

SEQ ID NO: 102623 - DNA, 1884 bp, Artificial Sequence
  Description of Artificial Sequence: Synthetic coding sequence
atgctggacctgagctacaacaacctgaacgtggtgggcaacgacagcttcgcctggctgccccagctggagtacttcttcctggagtacaacaacatccagcacctgttcagccacagcctgcacggcctgttcaacgtgagatacctgaacctgaagagaagcttcaccaagcagagcatcagcctggccagcctgcccaagatcgacgacttcagcttccagtggctgaagtgcctggagcacctgaacatggaggacaacgacatccccggcatcaagagcaacatgttcaccggcctgatcaacctgaagtacctgagcctgagcaacagcttcaccagcctgagaaccctgaccaacgagaccttcgtgagcctggcccacagccccctgcacatcctgaacctgaccaagaacaagatcagcaagatcgagagcgacgccttcagctggctgggccacctggaggtgctggacctgggcctgaacgagatcggccaggagctgaccggccaggagtggagaggcctggagaacatcttcgagatctacctgagctacaacaagtacctgcagctgaccagaaacagcttcgccctggtgcccagcctgcagagactgatgctgagaagagtggccctgaagaacgtggacagcagccccagccccttccagcccctgagaaacctgaccatcctggacctgagcaacaacaacatcgccaacatcaacgacgacatgctggagggcctggagaagctggagatcctggacctgcagcacaacaacctggccagactgtggaagcacgccaaccccggcggccccatctacttcctgaagggcctgagccacctgcacatcctgaacctggagagcaacggcttcgacgagatccccgtggaggtgttcaaggacctgttcgagctgaagatcatcgacctgggcctgaacaacctgaacaccctgcccgccagcgtgttcaacaaccaggtgagcctgaagagcctgaacctgcagaagaacctgatcaccagcgtggagaagaaggtgttcggccccgccttcagaaacctgaccgagctggacatgagattcaaccccttcgactgcacctgcgagagcatcgcctggttcgtgaactggatcaacgagacccacaccaacatccccgagctgagcagccactacctgtgcaacacccccccccactaccacggcttccccgtgagactgttcgacaccagcagctgcaaggacagcgcccccttcgagctgttcttcatgatcaacaccagcatcctgctgatcttcatcttcatcgtgctgctgatccacttcgagggctggagaatcagcttctactggaacgtgagcgtgcacagagtgctgggcttcaaggagatcgacagacagaccgagcagttcgagtacgccgcctacatcatccacgcctacaaggacaaggactgggtgtgggagcacttcagcagcatggagaaggaggaccagagcctgaagttctgcctggaggagagagacttcgaggccggcgtgttcgagctggaggccatcgtgaacagcatcaagagaagcagaaagatcatcttcgtgatcacccaccacctgctgaaggaccccctgtgcaagagattcaaggtgcaccacgccgtgcagcaggccatcgagcagaacctggacagcatcatcctggtgttcctggaggagatccccgactacaagctgaaccacgccctgtgcctgagaagaggcatgttcaagagccactgcatcctgaactggcccgtgcagaaggagagaatcggcgccttcagacacaagctgcaggtggccctgggcagcaagaacagcgtgcactag

SEQ ID NO: 102624 - DNA, 2613 bp, Artificial Sequence
  Description of Artificial Sequence: Synthetic coding sequence
atgagacagaccctgccctgcatctacttctggggcggcctgctgcccttcggcatgctgtgcgccagcagcaccaccaagtgcaccgtgagccacgaggtggccgactgcagccacctgaagctgacccaggtgcccgacgacctgcccaccaacatcaccgtgctgaacctgacccacaaccagctgagaagactgcccgccgccaacttcaccagatacagccagctgaccagcctggacgtgggcttcaacaccatcagcaagctggagcccgagctgtgccagaagctgcccatgctgaaggtgctgaacctgcagcacaacgagctgagccagctgagcgacaagaccttcgccttctgcaccaacctgaccgagctgcacctgatgagcaacagcatccagaagatcaagaacaaccccttcgtgaagcagaagaacctgatcaccctggacctgagccacaacggcctgagcagcaccaagctgggcacccaggtgcagctggagaacctgcaggagctgctgctgagcaacaacaagatccaggccctgaagagcgaggagctggacatcttcgccaacagcagcctgaagaagctggagctgagcagcaaccagatcaaggagttcagccccggctgcttccacgccatcggcagactgttcggcctgttcctgaacaacgtgcagctgggccccagcctgaccgagaagctgtgcctggagctggccaacaccagcatcagaaacctgagcctgagcaacagccagctgagcaccaccagcaacaccaccttcctgggcctgaagtggaccaacctgaccatgctggacctgagctacaacaacctgaacgtggtgggcaacgacagcttcgcctggctgccccagctggagtacttcttcctggagtacaacaacatccagcacctgttcagccacagcctgcacggcctgttcaacgtgagatacctgaacctgaagagaagcttcaccaagcagagcatcagcctggccagcctgcccaagatcgacgacttcagcttccagtggctgaagtgcctggagcacctgaacatggaggacaacgacatccccggcatcaagagcaacatgttcaccggcctgatcaacctgaagtacctgagcctgagcaacagcttcaccagcctgagaaccctgaccaacgagaccttcgtgagcctggcccacagccccctgcacatcctgaacctgaccaagaacaagatcagcaagatcgagagcgacgccttcagctggctgggccacctggaggtgctggacctgggcctgaacgagatcggccaggagctgaccggccaggagtggagaggcctggagaacatcttcgagatctacctgagctacaacaagtacctgcagctgaccagaaacagcttcgccctggtgcccagcctgcagagactgatgctgagaagagtggccctgaagaacgtggacagcagccccagccccttccagcccctgagaaacctgaccatcctggacctgagcaacaacaacatcgccaacatcaacgacgacatgctggagggcctggagaagctggagatcctggacctgcagcacaacaacctggccagactgtggaagcacgccaaccccggcggccccatctacttcctgaagggcctgagccacctgcacatcctgaacctggagagcaacggcttcgacgagatccccgtggaggtgttcaaggacctgttcgagctgaagatcatcgacctgggcctgaacaacctgaacaccctgcccgccagcgtgttcaacaaccaggtgagcctgaagagcctgaacctgcagaagaacctgatcaccagcgtggagaagaaggtgttcggccccgccttcagaaacctgaccgagctggacatgagattcaaccccttcgactgcacctgcgagagcatcgcctggttcgtgaactggatcaacgagacccacaccaacatccccgagctgagcagccactacctgtgcaacacccccccccactaccacggcttccccgtgagactgttcgacaccagcagctgcaaggacagcgcccccttcgagctgttcttcatgatcaacaccagcatcctgctgatcttcatcttcatcgtgctgctgatccacttcgagggctggagaatcagcttctactggaacgtgagcgtgcacagagtgctgggcttcaaggagatcgacagacagaccgagcagttcgagtacgccgcctacatcatccacgcctacaaggacaaggactgggtgtgggagcacttcagcagcatggagaaggaggaccagagcctgaagttctgcctggaggagagagacttcgaggccggcgtgttcgagctggaggccatcgtgaacagcatcaagagaagcagaaagatcatcttcgtgatcacccaccacctgctgaaggaccccctgtgcaagagattcaaggtgcaccacgccgtgcagcaggccatcgagcagaacctggacagcatcatcctggtgttcctggaggagatccccgactacaagctgaaccacgccctgtgcctgagaagagccaagtag

SEQ ID NO: 102625 - DNA, 2391 bp, Artificial Sequence
  Description of Artificial Sequence: Synthetic coding sequence
atgaccaaggacaaggagcccatcgtgaagagcttccacttcgtgtgcctgatgatcatcatcgtgggcaccagaatccagttcagcgacggcaacgagttcgccgtggacaagagcaagagaggcctgatccacgtgcccaaggacctgcccctgaagaccaaggtgctggacatgagccagaactacatcgccgagctgcaggtgagcgacatgagcttcctgagcgagctgaccgtgctgagactgagccacaacagaatccagctgctggacctgagcgtgttcaagttcaaccaggacctggagtacctggacctgagccacaaccagctgcagaagatcagctgccaccccatcgtgagcttcagacacctggacctgagcttcaacgacttcaaggccctgcccatctgcaaggagttcggcaacctgagccagctgaacttcctgggcctgagcgccatgaagctgcagaagctggacctgctgcccatcgcccacctgcacctgagctacatcctgctggacctgagaaactactacatcaaggagaacgagaccgagagcctgcagatcctgaacgccaagaccctgcacctggtgttccaccccaccagcctgttcgccatccaggtgaacatcagcgtgaacaccctgggctgcctgcagctgaccaacatcaagctgaacgacgacaactgccaggtgttcatcaagttcctgagcgagctgaccagaggcagcaccctgctgaacttcaccctgaaccacatcgagaccacctggaagtgcctggtgagagtgttccagttcctgtggcccaagcccgtggagtacctgaacatctacaacctgaccatcatcgagagcatcagagaggaggacttcacctacagcaagaccaccctgaaggccctgaccatcgagcacatcaccaaccaggtgttcctgttcagccagaccgccctgtacaccgtgttcagcgagatgaacatcatgatgctgaccatcagcgacacccccttcatccacatgctgtgcccccacgcccccagcaccttcaagttcctgaacttcacccagaacgtgttcaccgacagcatcttcgagaagtgcagcaccctggtgaagctggagaccctgatcctgcagaagaacggcctgaaggacctgttcaaggtgggcctgatgaccaaggacatgcccagcctggagatcctggacgtgagctggaacagcctggagagcggcagacacaaggagaactgcacctgggtggagagcatcgtggtgctgaacctgagcagcaacatgctgaccgacagcgtgttcagatgcctgccccccagaatcaaggtgctggacctgcacagcaacaagatcaagagcgtgcccaagcaggtggtgaagctggaggccctgcaggagctgaacgtggccttcaacagcctgaccgacctgcccggctgcggcagcttcagcagcctgagcgtgctgatcatcgaccacaacagcgtgagccaccccagcgccgacttcttccagagctgccagaagatgagaagcatcaaggccggcgacaaccccttccagtgcacctgcgagctgagagagttcgtgaagaacatcgaccaggtgagcagcgaggtgctggagggctggcccgacagctacaagtgcgactaccccgagagctacagaggcagccccctgaaggacttccacatgagcgagctgagctgcaacatcaccctgctgatcgtgaccatcggcgccaccatgctggtgctggccgtgaccgtgaccagcctgtgcatctacctggacctgccctggtacctgagaatggtgtgccagtggacccagaccagaagaagagccagaaacatccccctggaggagctgcagagaaacctgcagttccacgccttcatcagctacagcgagcacgacagcgcctgggtgaagagcgagctggtgccctacctggagaaggaggacatccagatctgcctgcacgagagaaacttcgtgcccggcaagagcatcgtggagaacatcatcaactgcatcgagaagagctacaagagcatcttcgtgctgagccccaacttcgtgcagagcgagtggtgccactacgagctgtacttcgcccaccacaacctgttccacgagggcagcaacaacctgatcctgatcctgctggagcccatcccccagaacagcatccccaacaagtaccacaagctgaaggccctgatgacccagagaacctacctgcagtggcccaaggagaagagcaagagaggcctgttctgggccaacatcagagccgccttcaacatgaagctgaccctggtgaccgagaacaacgacgtgaagagctag

SEQ ID NO: 102626 - DNA, 2391 bp, Artificial Sequence; identical to SEQ ID NO: 102625
  Description of Artificial Sequence: Synthetic coding sequence

SEQ ID NO: 102627 - DNA, 453 bp, Artificial Sequence
  Description of Artificial Sequence: Synthetic coding sequence
atgaccaaggacaaggagcccatcgtgaagagcttccacttcgtgtgcctgatgatcatcatcgtgggcaccagaatccagttcagcgacggcaacgagttcgccgtggacaagagcaagagaggcctgatccacgtgcccaaggacctgcccctgaagaccaaggtgctggacatgagccagaactacatcgccgagctgcaggtgagcgacatgagcttcctgagcgagctgaccgtgctgagactgagccacaacagaatccagctgctggacctgagcgtgttcaagttcaaccaggacctggagtacctggacctgagccacaaccagctgcagaagatcagctgccaccccatcgtgagcttcagacacctggacctgagcttcaacgacttcaaggccctgcccatctgcaaggagttcggcaacctgagccagctgaacttctag

SEQ ID NO: 102628 - DNA, 1443 bp, Artificial Sequence
  Description of Artificial Sequence: Synthetic coding sequence
atgaccaaggacaaggagcccatcgtgaagagcttccacttcgtgtgcctgatgatcatcatcgtgggcaccagaatccagttcagcgacggcaacgagttcgccgtggacaagagcaagagaggcctgatccacgtgcccaaggacctgcccctgaagaccaaggtgctggacatgagccagaactacatcgccgagctgcaggtgagcgacatgagcttcctgagcgagctgaccgtgctgagactgagccacaacagaatccagctgctggacctgagcgtgttcaagttcaaccaggacctggagtacctggacctgagccacaaccagctgcagaagatcagctgccaccccatcgtgagcttcagacacctggacctgagcttcaacgacttcaaggccctgcccatctgcaaggagttcggcaacctgagccagctgaacttcctgggcctgagcgccatgaagctgcagaagctggacctgctgcccatcgcccacctgcacctgagctacatcctgctggacctgagaaactactacatcaaggagaacgagaccgagagcctgcagatcctgaacgccaagaccctgcacctggtgttccaccccaccagcctgttcgccatccaggtgaacatcagcgtgaacaccctgggctgcctgcagctgaccaacatcaagctgaacgacgacaactgccaggtgttcatcaagttcctgagcgagctgaccagaggcagcaccctgctgaacttcaccctgaaccacatcgagaccacctggaagtgcctggtgagagtgttccagttcctgtggcccaagcccgtggagtacctgaacatctacaacctgaccatcatcgagagcatcagagaggaggacttcacctacagcaagaccaccctgaaggccctgaccatcgagcacatcaccaaccaggtgttcctgttcagccagaccgccctgtacaccgtgttcagcgagatgaacatcatgatgctgaccatcagcgacacccccttcatccacatgctgtgcccccacgcccccagcaccttcaagttcctgaacttcacccagaacgtgttcaccgacagcatcttcgagaagtgcagcaccctggtgaagctggagaccctgatcttcgtgctgagccccaacttcgtgcagagcgagtggtgccactacgagctgtacttcgcccaccacaacctgttccacgagggcagcaacaacctgatcctgatcctgctggagcccatcccccagaacagcatccccaacaagtaccacaagctgaaggccctgatgacccagagaacctacctgcagtggcccaaggagaagagcaagagaggcctgttctgggccaacatcagagccgccttcaacatgaagctgaccctggtgaccgagaacaacgacgtgaagagctag

SEQ ID NO: 102629 - DNA, 276 bp, Artificial Sequence
  Description of Artificial Sequence: Synthetic coding sequence
atgaccaaggacaaggagcccatcgtgaagagcttccacttcgtgtgcctgatgatcatcatcgtgggcaccagaatccagttcagcgacggcaacgagttcgccgtggacaagagcaagagaggcctgatccacgtgcccaaggacctgcccctgaagaccaaggtgctggacatgagccagaactacatcgccgagctgcaggtgagcgacatgagcttcctgagcgagctgaccgtgctgagactgagccacaacagaatccagctgctgtag

SEQ ID NO: 102630 - DNA, 3150 bp, Artificial Sequence
  Description of Artificial Sequence: Synthetic coding sequence
atggtgttccccatgtggaccctgaagagacagatcctgatcctgttcaacatcatcctgatcagcaagctgctgggcgccagatggttccccaagaccctgccctgcgacgtgaccctggacgtgcccaagaaccacgtgatcgtggactgcaccgacaagcacctgaccgagatccccggcggcatccccaccaacaccaccaacctgaccctgaccatcaaccacatccccgacatcagccccgccagcttccacagactggaccacctggtggagatcgacttcagatgcaactgcgtgcccatccccctgggcagcaagaacaacatgtgcatcaagagactgcagatcaagcccagaagcttcagcggcctgacctacctgaagagcctgtacctggacggcaaccagctgctggagatcccccagggcctgccccccagcctgcagctgctgagcctggaggccaacaacatcttcagcatcagaaaggagaacctgaccgagctggccaacatcgagatcctgtacctgggccagaactgctactacagaaacccctgctacgtgagctacagcatcgagaaggacgccttcctgaacctgaccaagctgaaggtgctgagcctgaaggacaacaacgtgaccgccgtgcccaccgtgctgcccagcaccctgaccgagctgtacctgtacaacaacatgatcgccaagatccaggaggacgacttcaacaacctgaaccagctgcagatcctggacctgagcggcaactgccccagatgctacaacgcccccttcccctgcgccccctgcaagaacaacagccccctgcagatccccgtgaacgccttcgacgccctgaccgagctgaaggtgctgagactgcacagcaacagcctgcagcacgtgccccccagatggttcaagaacatcaacaagctgcaggagctggacctgagccagaacttcctggccaaggagatcggcgacgccaagttcctgcacttcctgcccagcctgatccagctggacctgagcttcaacttcgagctgcaggtgtacagagccagcatgaacctgagccaggccttcagcagcctgaagagcctgaagatcctgagaatcagaggctacgtgttcaaggagctgaagagcttcaacctgagccccctgcacaacctgcagaacctggaggtgctggacctgggcaccaacttcatcaagatcgccaacctgagcatgttcaagcagttcaagagactgaaggtgatcgacctgagcgtgaacaagatcagccccagcggcgacagcagcgaggtgggcttctgcagcaacgccagaaccagcgtggagagctacgagccccaggtgctggagcagctgcactacttcagatacgacaagtacgccagaagctgcagattcaagaacaaggaggccagcttcatgagcgtgaacgagagctgctacaagtacggccagaccctggacctgagcaagaacagcatcttcttcgtgaagagcagcgacttccagcacctgagcttcctgaagtgcctgaacctgagcggcaacctgatcagccagaccctgaacggcagcgagttccagcccctggccgagctgagatacctggacttcagcaacaacagactggacctgctgcacagcaccgccttcgaggagctgcacaagctggaggtgctggacatcagcagcaacagccactacttccagagcgagggcatcacccacatgctgaacttcaccaagaacctgaaggtgctgcagaagctgatgatgaacgacaacgacatcagcagcagcaccagcagaaccatggagagcgagagcctgagaaccctggagttcagaggcaaccacctggacgtgctgtggagagagggcgacaacagatacctgcagctgttcaagaacctgctgaagctggaggagctggacatcagcaagaacagcctgagcttcctgcccagcggcgtgttcgacggcatgccccccaacctgaagaacctgagcctggccaagaacggcctgaagagcttcagctggaagaagctgcagtgcctgaagaacctggagaccctggacctgagccacaaccagctgaccaccgtgcccgagagactgagcaactgcagcagaagcctgaagaacctgatcctgaagaacaaccagatcagaagcctgaccaagtacttcctgcaggacgccttccagctgagatacctggacctgagcagcaacaagatccagatgatccagaagaccagcttccccgagaacgtgctgaacaacctgaagatgctgctgctgcaccacaacagattcctgtgcacctgcgacgccgtgtggttcgtgtggtgggtgaaccacaccgaggtgaccatcccctacctggccaccgacgtgacctgcgtgggccccggcgcccacaagggccagagcgtgatcagcctggacctgtacacctgcgagctggacctgaccaacctgatcctgttcagcctgagcatcagcgtgagcctgttcctgatggtgatgatgaccgccagccacctgtacttctgggacgtgtggtacatctaccacttctgcaaggccaagatcaagggctaccagagactgatcagccccgactgctgctacgacgccttcatcgtgtacgacaccaaggaccccgccgtgaccgagtgggtgctggccgagctggtggccaagctggaggaccccagagagaagcacttcaacctgtgcctggaggagagagactggctgcccggccagcccgtgctggagaacctgagccagagcatccagctgagcaagaagaccgtgttcgtgatgaccgacaagtacgccaagaccgagaacttcaagatcgccttctacctgagccaccagagactgatggacgagaaggtggacgtgatcatcctgatcttcctggagaagcccttccagaagagcaagttcctgcagctgagaaagagactgtgcggcagcagcgtgctggagtggcccaccaacccccaggcccacccctacttctggcagtgcctgaagaacgccctggccaccgacaaccacgtggcctacagccaggtgttcaaggagaccgtgtag

SEQ ID NO: 102631 - DNA, 1074 bp, Artificial Sequence
  Description of Artificial Sequence: Synthetic coding sequence
atgagaagacagctgagaagcagaagagcccccagcttcccctacagctacagatacagactggacgaccccgacgaggccaaccagaactacctggccgacgaggaggaggaggccgaggaggaggccagagtgaccgtggtgcccaagagcgaggaggaggaggaggaggaggagaaggaggaggaggaggaggaggagaaggaggaggaggagggccagggccagcccaccggcaacgcctggtggcagaagctgcagatcatgagcgagtacctgtgggaccccgagagaagaatgttcctggccagaaccggccagagctggagcctgatcctgctgatctacttcttcttctacgccagcctggccgccgtgatcaccctgtgcatgtacaccctgttcctgaccatcagcccctacatccccaccttcaccgagagagtgaagccccccggcgtgatgatcagacccttcgcccacagcctgaacttcaacttcaacgtgagcgagcccgacacctggcagcactacgtgatcagcctgaacggcttcctgcagggctacaacgacagcctgcaggaggagatgaacgtggactgcccccccggccagtacttcatccaggacggcaacgaggacgaggacaagaaggcctgccagttcaagagaagcttcctgaagaactgcagcggcctggaggaccccaccttcggctacagcaccggccagccctgcatcctgctgaagatgaacagaatcgtgggcttcagacccgagctgggcgaccccgtgaaggtgagctgcaaggtgcagagaggcgacgagaacgacatcagaagcatcagctactaccccgagagcgccagcttcgacctgagatactacccctactacggcaagctgacccacgtgaactacaccagccccctggtggccatgcacttcaccgacgtggtgaagaaccaggccgtgcccgtgcagtgccagctgaagggcaagggcgtgatcaacgacgtgatcaacgacagattcgtgggcagagtgatcttcaccctgaacatcgagacctag

SEQ ID NO: 102632 - DNA, 3180 bp, Artificial Sequence
  Description of Artificial Sequence: Synthetic coding sequence
atgaaggagagcagcctgcagaacagcagctgcagcctgggcaaggagaccaagaaggagaacatgttcctgcagagcagcatgctgacctgcatcttcctgctgatcagcggcagctgcgagctgtgcgccgaggagaacttcagcagaagctacccctgcgacgagaagaagcagaacgacagcgtgatcgccgagtgcagcaacagaagactgcaggaggtgccccagaccgtgggcaagtacgtgaccgagctggacctgagcgacaacttcatcacccacatcaccaacgagagcttccagggcctgcagaacctgaccaagatcaacctgaaccacaaccccaacgtgcagcaccagaacggcaaccccggcatccagagcaacggcctgaacatcaccgacggcgccttcctgaacctgaagaacctgagagagctgctgctggaggacaaccagctgccccagatccccagcggcctgcccgagagcctgaccgagctgagcctgatccagaacaacatctacaacatcaccaaggagggcatcagcagactgatcaacctgaagaacctgtacctggcctggaactgctacttcaacaaggtgtgcgagaagaccaacatcgaggacggcgtgttcgagaccctgaccaacctggagctgctgagcctgagcttcaacagcctgagccacgtgccccccaagctgcccagcagcctgagaaagctgttcctgagcaacacccagatcaagtacatcagcgaggaggacttcaagggcctgatcaacctgaccctgctggacctgagcggcaactgccccagatgcttcaacgcccccttcccctgcgtgccctgcgacggcggcgccagcatcaacatcgacagattcgccttccagaacctgacccagctgagatacctgaacctgagcagcaccagcctgagaaagatcaacgccgcctggttcaagaacatgccccacctgaaggtgctggacctggagttcaactacctggtgggcgagatcgccagcggcgccttcctgaccatgctgcccagactggagatcctggacctgagcttcaactacatcaagggcagctacccccagcacatcaacatcagcagaaacttcagcaagctgctgagcctgagagccctgcacctgagaggctacgtgttccaggagctgagagaggacgacttccagcccctgatgcagctgcccaacctgagcaccatcaacctgggcatcaacttcatcaagcagatcgacttcaagctgttccagaacttcagcaacctggagatcatctacctgagcgagaacagaatcagccccctggtgaaggacaccagacagagctacgccaacagcagcagcttccagagacacatcagaaagagaagaagcaccgacttcgagttcgacccccacagcaacttctaccacttcaccagacccctgatcaagccccagtgcgccgcctacggcaaggccctggacctgagcctgaacagcatcttcttcatcggccccaaccagttcgagaacctgcccgacatcgcctgcctgaacctgagcgccaacagcaacgcccaggtgctgagcggcaccgagttcagcgccatcccccacgtgaagtacctggacctgaccaacaacagactggacttcgacaacgccagcgccctgaccgagctgagcgacctggaggtgctggacctgagctacaacagccactacttcagaatcgccggcgtgacccaccacctggagttcatccagaacttcaccaacctgaaggtgctgaacctgagccacaacaacatctacaccctgaccgacaagtacaacctggagagcaagagcctggtggagctggtgttcagcggcaacagactggacatcctgtggaacgacgacgacaacagatacatcagcatcttcaagggcctgaagaacctgaccagactggacctgagcctgaacagactgaagcacatccccaacgaggccttcctgaacctgcccgccagcctgaccgagctgcacatcaacgacaacatgctgaagttcttcaactggaccctgctgcagcagttccccagactggagctgctggacctgagaggcaacaagctgctgttcctgaccgacagcctgagcgacttcaccagcagcctgagaaccctgctgctgagccacaacagaatcagccacctgcccagcggcttcctgagcgaggtgagcagcctgaagcacctggacctgagcagcaacctgctgaagaccatcaacaagagcgccctggagaccaagaccaccaccaagctgagcatgctggagctgcacggcaaccccttcgagtgcacctgcgacatcggcgacttcagaagatggatggacgagcacctgaacgtgaagatccccagactggtggacgtgatctgcgccagccccggcgaccagagaggcaagagcatcgtgagcctggagctgaccacctgcgtgagcgacgtgaccgccgtgatcctgttcttcttcaccttcttcatcaccaccatggtgatgctggccgccctggcccaccacctgttctactgggacgtgtggttcatctacaacgtgtgcctggccaaggtgaagggctacagaagcctgagcaccagccagaccttctacgacgcctacatcagctacgacaccaaggacgccagcgtgaccgactgggtgatcaacgagctgagataccacctggaggagagcagagacaagaacgtgctgctgtgcctggaggagagagactgggaccccggcctggccatcatcgacaacctgatgcagagcatcaaccagagcaagaagaccgtgttcgtgctgaccaagaagtacgccaagagctggaacttcaagaccgccttctacctggccctgcagagactgatggacgagaacatggacgtgatcatcttcatcctgctggagcccgtgctgcagcacagccagtacctgagactgagacagagaatctgcaagagcagcatcctgcagtggcccgacaaccccaaggccgagggcctgttctggcagaccctgagaaacgtggtgctgaccgagaacgacagcagatacaacaacatgtacgtggacagcatcaagcagtactag

SEQ ID NO: 102633 - DNA, 3099 bp, Artificial Sequence
  Description of Artificial Sequence: Synthetic coding sequence
atgggcttctgcagaagcgccctgcaccccctgagcctgctggtgcaggccatcatgctggccatgaccctggccctgggcaccctgcccgccttcctgccctgcgagctgcagccccacggcctggtgaactgcaactggctgttcctgaagagcgtgccccacttcagcatggccgcccccagaggcaacgtgaccagcctgagcctgagcagcaacagaatccaccacctgcacgacagcgacttcgcccacctgcccagcctgagacacctgaacctgaagtggaactgcccccccgtgggcctgagccccatgcacttcccctgccacatgaccatcgagcccagcaccttcctggccgtgcccaccctggaggagctgaacctgagctacaacaacatcatgaccgtgcccgccctgcccaagagcctgatcagcctgagcctgagccacaccaacatcctgatgctggacagcgccagcctggccggcctgcacgccctgagattcctgttcatggacggcaactgctactacaagaacccctgcagacaggccctggaggtggcccccggcgccctgctgggcctgggcaacctgacccacctgagcctgaagtacaacaacctgaccgtggtgcccagaaacctgcccagcagcctggagtacctgctgctgagctacaacagaatcgtgaagctggcccccgaggacctggccaacctgaccgccctgagagtgctggacgtgggcggcaactgcagaagatgcgaccacgcccccaacccctgcatggagtgccccagacacttcccccagctgcaccccgacaccttcagccacctgagcagactggagggcctggtgctgaaggacagcagcctgagctggctgaacgccagctggttcagaggcctgggcaacctgagagtgctggacctgagcgagaacttcctgtacaagtgcatcaccaagaccaaggccttccagggcctgacccagctgagaaagctgaacctgagcttcaactaccagaagagagtgagcttcgcccacctgagcctggcccccagcttcggcagcctggtggccctgaaggagctggacatgcacggcatcttcttcagaagcctggacgagaccaccctgagacccctggccagactgcccatgctgcagaccctgagactgcagatgaacttcatcaaccaggcccagctgggcatcttcagagccttccccggcctgagatacgtggacctgagcgacaacagaatcagcggcgccagcgagctgaccgccaccatgggcgaggccgacggcggcgagaaggtgtggctgcagcccggcgacctggcccccgcccccgtggacacccccagcagcgaggacttcagacccaactgcagcaccctgaacttcaccctggacctgagcagaaacaacctggtgaccgtgcagcccgagatgttcgcccagctgagccacctgcagtgcctgagactgagccacaactgcatcagccaggccgtgaacggcagccagttcctgcccctgaccggcctgcaggtgctggacctgagccacaacaagctggacctgtaccacgagcacagcttcaccgagctgcccagactggaggccctggacctgagctacaacagccagcccttcggcatgcagggcgtgggccacaacttcagcttcgtggcccacctgagaaccctgagacacctgagcctggcccacaacaacatccacagccaggtgagccagcagctgtgcagcaccagcctgagagccctggacttcagcggcaacgccctgggccacatgtgggccgagggcgacctgtacctgcacttcttccagggcctgagcggcctgatctggctggacctgagccagaacagactgcacaccctgctgccccagaccctgagaaacctgcccaagagcctgcaggtgctgagactgagagacaactacctggccttcttcaagtggtggagcctgcacttcctgcccaagctggaggtgctggacctggccggcaaccagctgaaggccctgaccaacggcagcctgcccgccggcaccagactgagaagactggacgtgagctgcaacagcatcagcttcgtggcccccggcttcttcagcaaggccaaggagctgagagagctgaacctgagcgccaacgccctgaagaccgtggaccacagctggttcggccccctggccagcgccctgcagatcctggacgtgagcgccaaccccctgcactgcgcctgcggcgccgccttcatggacttcctgctggaggtgcaggccgccgtgcccggcctgcccagcagagtgaagtgcggcagccccggccagctgcagggcctgagcatcttcgcccaggacctgagactgtgcctggacgaggccctgagctgggactgcttcgccctgagcctgctggccgtggccctgggcctgggcgtgcccatgctgcaccacctgtgcggctgggacctgtggtactgcttccacctgtgcctggcctggctgccctggagaggcagacagagcggcagagacgaggacgccctgccctacgacgccttcgtggtgttcgacaagacccagagcgccgtggccgactgggtgtacaacgagctgagaggccagctggaggagtgcagaggcagatgggccctgagactgtgcctggaggagagagactggctgcccggcaagaccctgttcgagaacctgtgggccagcgtgtacggcagcagaaagaccctgttcgtgctggcccacaccgacagagtgagcggcctgctgagagccagcttcctgctggcccagcagagactgctggaggacagaaaggacgtggtggtgctggtgatcctgagccccgacggcagaagaagcagatacgtgagactgagacagagactgtgcagacagagcgtgctgctgtggccccaccagcccagcggccagagaagcttctgggcccagctgggcatggccctgaccagagacaaccaccacttctacaacagaaacttctgccagggccccaccgccgagtag

SEQ ID NO: 102634 - DNA, 2139 bp, Artificial Sequence
  Description of Artificial Sequence: Synthetic coding sequence
atggcctgcaccggccccagcctgcccagcgccttcgacatcctgggcgccgccggccaggacaagctgctgtacctgaagcacaagctgaagacccccagacccggctgccagggccaggacctgctgcacgccatggtgctgctgaagctgggccaggagaccgaggccagaatcagcctggaggccctgaaggccgacgccgtggccagactggtggccagacagtgggccggcgtggacagcaccgaggaccccgaggagccccccgacgtgagctgggccgtggccagactgtaccacctgctggccgaggagaagctgtgccccgccagcctgagagacgtggcctaccaggaggccgtgagaaccctgagcagcagagacgaccacagactgggcgagctgcaggacgaggccagaaacagatgcggctgggacatcgccggcgaccccggcagcatcagaaccctgcagagcaacctgggctgcctgccccccagcagcgccctgcccagcggcaccagaagcctgcccagacccatcgacggcgtgagcgactggagccagggctgcagcctgagaagcaccggcagccccgccagcctggccagcaacctggagatcagccagagccccaccatgcccttcctgagcctgcacagaagcccccacggccccagcaagctgtgcgacgacccccaggccagcctggtgcccgagcccgtgcccggcggctgccaggagcccgaggagatgagctggccccccagcggcgagatcgccagcccccccgagctgcccagcagccccccccccggcctgcccgaggtggcccccgacgccaccagcaccggcctgcccgacacccccgccgcccccgagaccagcaccaactaccccgtggagtgcaccgagggcagcgccggcccccagagcctgcccctgcccatcctggagcccgtgaagaacccctgcagcgtgaaggaccagacccccctgcagctgagcgtggaggacaccaccagccccaacaccaagccctgcccccccacccccaccacccccgagaccagcccccccccccccccccccccccccagcagcaccccctgcagcgcccacctgacccccagcagcctgttccccagcagcctggagagcagcagcgagcagaagttctacaacttcgtgatcctgcacgccagagccgacgagcacatcgccctgagagtgagagagaagctggaggccctgggcgtgcccgacggcgccaccttctgcgaggacttccaggtgcccggcagaggcgagctgagctgcctgcaggacgccatcgaccacagcgccttcatcatcctgctgctgaccagcaacttcgactgcagactgagcctgcaccaggtgaaccaggccatgatgagcaacctgaccagacagggcagccccgactgcgtgatccccttcctgcccctggagagcagccccgcccagctgagcagcgacaccgccagcctgctgagcggcctggtgagactggacgagcacagccagatcttcgccagaaaggtggccaacaccttcaagccccacagactgcaggccagaaaggccatgtggagaaaggagcaggacaccagagccctgagagagcagagccagcacctggacggcgagagaatgcaggccgccgccctgaacgccgcctacagcgcctacctgcagagctacctgagctaccaggcccagatggagcagctgcaggtggccttcggcagccacatgagcttcggcaccggcgccccctacggcgccagaatgcccttcggcggccaggtgcccctgggcgcccccccccccttccccacctggcccggctgcccccagcccccccccctgcacgcctggcaggccggcaccccccccccccccagcccccagcccgccgccttcccccagagcctgcccttcccccagagccccgccttccccaccgccagccccgcccccccccagagccccggcctgcagcccctgatcatccaccacgcccagatggtgcagctgggcctgaacaaccacatgtggaaccagagaggcagccaggcccccgaggacaagacccaggaggccgagtag

SEQ ID NO: 102635 - DNA, 3042 bp, Artificial Sequence
  Description of Artificial Sequence: Synthetic coding sequence
atgggcctgggcaccctgagccccagaatgctggtgtggctggtggccagcggcatcgtgttctacggcgagctgtgggtgtgcgccggcctggactacgactacaccttcgacggcaacgaggaggacaagaccgagaccatcgactacaaggacccctgcaaggccgccgtgttctggggcgacatcgccctggacgacgaggacctgaacatcttccagatcgacagaaccatcgacctgacccagaaccccttcggcaacctgggccacaccaccggcggcctgggcgaccacgccatgagcaagaagagaggcgccctgtaccagctgatcgacagaatcagaagaatcggcttcggcctggagcagaacaacaccgtgaagggcaaggtgcccctgcagttcagcggccagaacgagaagaacagagtgcccagagccgccaccagcagaaccgagagaatctggcccggcggcgtgatcccctacgtgatcggcggcaacttcaccggcagccagagagccatgttcaagcaggccatgagacactgggagaagcacacctgcgtgaccttcatcgagagaagcgacgaggagagctacatcgtgttcacctacagaccctgcggctgctgcagctacgtgggcagaagaggcaacggcccccaggccatcagcatcggcaagaactgcgacaagttcggcatcgtggtgcacgagctgggccacgtgatcggcttctggcacgagcacaccagacccgacagagacaaccacgtgaccatcatcagagagaacatccagcccggccaggagtacaacttcctgaagatggagcccggcgaggtgaacagcctgggcgagagatacgacttcgacagcatcatgcactacgccagaaacaccttcagcagaggcatgttcctggacaccatcctgcccagcagagacgacaacggcatcagacccgccatcggccagagaaccagactgagcaagggcgacatcgcccaggccagaaagctgtacagatgccccgcctgcggcgagaccctgcaggagagcaacggcaacctgagcagccccggcttccccaacggctaccccagctacacccactgcatctggagagtgagcgtgacccccggcgagaagatcgtgctgaacttcaccaccatggacctgtacaagagcagcctgtgctggtacgactacatcgaggtgagagacggctactggagaaagagccccctgctgggcagattctgcggcgacaagctgcccgaggtgctgaccagcaccgacagcagaatgtggatcgagttcagaagcagcagcaactgggtgggcaagggcttcgccgccgtgtacgaggccatctgcggcggcgagatcagaaagaacgagggccagatccagagccccaactaccccgacgactacagacccatgaaggagtgcgtgtggaagatcaccgtgagcgagagctaccacgtgggcctgaccttccagagcttcgagatcgagagacacgacaactgcgcctacgactacctggaggtgagagacggcaccagcgagaacagccccctgatcggcagattctgcggctacgacaagcccgaggacatcagaagcaccagcaacaccctgtggatgaagttcgtgagcgacggcaccgtgaacaaggccggcttcgccgccaacttcttcaaggaggaggacgagtgcgccaagcccgacagaggcggctgcgagcagagatgcctgaacaccctgggcagctaccagtgcgcctgcgagcccggctacgagctgggccccgacagaagaagctgcgaggccgcctgcggcggcctgctgaccaagctgaacggcaccatcaccacccccggctggcccaaggagtacccccccaacaagaactgcgtgtggcaggtggtggcccccacccagtacagaatcagcgtgaagttcgagttcttcgagctggagggcaacgaggtgtgcaagtacgactacgtggagatctggagcggcctgagcagcgagagcaagctgcacggcaagttctgcggcgccgaggtgcccgaggtgatcaccagccagttcaacaacatgagaatcgagttcaagagcgacaacaccgtgagcaagaagggcttcaaggcccacttcttcagcgacaaggacgagtgcagcaaggacaacggcggctgccagcacgagtgcgtgaacaccatgggcagctacatgtgccagtgcagaaacggcttcgtgctgcacgacaacaagcacgactgcaaggaggccgagtgcgagcagaagatccacagccccagcggcctgatcaccagccccaactggcccgacaagtaccccagcagaaaggagtgcacctgggagatcagcgccacccccggccacagaatcaagctggccttcagcgagttcgagatcgagcagcaccaggagtgcgcctacgaccacctggaggtgttcgacggcgagaccgagaagagccccatcctgggcagactgtgcggcaacaagatccccgaccccctggtggccaccggcaacaagatgttcgtgagattcgtgagcgacgccagcgtgcagagaaagggcttccaggccacccacagcaccgagtgcggcggcagactgaaggccgagagcaagcccagagacctgtacagccacgcccagttcggcgacaacaactaccccggccaggtggactgcgagtggctgctggtgagcgagagaggcagcagactggagctgagcttccagaccttcgaggtggaggaggaggccgactgcggctacgactacgtggagctgttcgacggcctggacagcaccgccgtgggcctgggcagattctgcggcagcggcccccccgaggagatctacagcatcggcgacagcgtgctgatccacttccacaccgacgacaccatcaacaagaagggcttccacatcagatacaagagcatcagataccccgacaccacccacaccaagaagtag

SEQ ID NO: 102636 - DNA, 1179 bp, Artificial Sequence
  Description of Artificial Sequence: Synthetic coding sequence
atgggcctgggcaccctgagccccagaatgctggtgtggctggtggccagcggcatcgtgttctacggcgagctgtgggtgtgcgccggcctggactacgactacaccttcgacggcaacgaggaggacaagaccgagaccatcgactacaaggacccctgcaaggccgccgtgttctggggcgacatcgccctggacgacgaggacctgaacatcttccagatcgacagaaccatcgacctgacccagaaccccttcggcaacctgggccacaccaccggcggcctgggcgaccacgccatgagcaagaagagaggcgccctgtaccagctgatcgacagaatcagaagaatcggcttcggcctggagcagaacaacaccgtgaagggcaaggtgcccctgcagttcagcggccagaacgagaagaacagagtgcccagagccgccaccagcagaaccgagagaatctggcccggcggcgtgatcccctacgtgatcggcggcaacttcaccggcagccagagagccatgttcaagcaggccatgagacactgggagaagcacacctgcgtgaccttcatcgagagaagcgacgaggagagctacatcgtgttcacctacagaccctgcggctgctgcagctacgtgggcagaagaggcaacggcccccaggccatcagcatcggcaagaactgcgacaagttcggcatcgtggtgcacgagctgggccacgtgatcggcttctggcacgagcacaccagacccgacagagacaaccacgtgaccatcatcagagagaacatccagcccggccaggagtacaacttcctgaagatggagcccggcgaggtgaacagcctgggcgagagatacgacttcgacagcatcatgcactacgccagaaacaccttcagcagaggcatgttcctggacaccatcctgcccagcagagacgacaacggcatcagacccgccatcggccagagaaccagactgagcaagggcgacatcgcccaggccagaaagctgtacagatgccccgcctgcggcgagaccctgcaggagagcaacggcaacctgagcagccccggcttccccaacggctaccccagctacacccactgcatctggagagtgagcgtgacccccggcgagaaggtggtgttcagcctgtgctag

SEQ ID NO: 102637 - DNA, 3048 bp, Artificial Sequence
  Description of Artificial Sequence: Synthetic coding sequence
atgcccagagccaccgccctgggcgccctggtgagcctgctgctgctgctgcccctgcccagaggcgccggcggcctgggcgagagacccgacgccaccgccgactacagcgagctggacggcgaggagggcaccgagcagcagctggagcactaccacgacccctgcaaggccgccgtgttctggggcgacatcgccctggacgaggacgacctgaagctgttccacatcgacaaggccagagactggaccaagcagaccgtgggcgccaccggccacagcaccggcggcctggaggagcaggccagcgagagcagccccgacaccaccgccatggacaccggcaccaaggaggccggcaaggacggcagagagaacaccaccctgctgcacagccccggcaccctgcacgccgccgccaagaccttcagccccagagtgagaagagccaccaccagcagaaccgagagaatctggcccggcggcgtgatcccctacgtgatcggcggcaacttcaccggcagccagagagccatcttcaagcaggccatgagacactgggagaagcacacctgcgtgaccttcatcgagagaaccgacgaggagagcttcatcgtgttcagctacagaacctgcggctgctgcagctacgtgggcagaagaggcggcggcccccaggccatcagcatcggcaagaactgcgacaagttcggcatcgtggcccacgagctgggccacgtggtgggcttctggcacgagcacaccagacccgacagagaccagcacgtgaccatcatcagagagaacatccagcccggccaggagtacaacttcctgaagatggaggccggcgaggtgagcagcctgggcgagacctacgacttcgacagcatcatgcactacgccagaaacaccttcagcagaggcgtgttcctggacaccatcctgcccagacaggacgacaacggcgtgagacccaccatcggccagagagtgagactgagccagggcgacatcgcccaggccagaaagctgtacaagtgccccgcctgcggcgagaccctgcaggacaccaccggcaacttcagcgcccccggcttccccaacggctaccccagctacagccactgcgtgtggagaatcagcgtgacccccggcgagaagatcgtgctgaacttcaccagcatggacctgttcaagagcagactgtgctggtacgactacgtggaggtgagagacggctactggagaaaggcccccctgctgggcagattctgcggcgacaagatccccgagcccctggtgagcaccgacagcagactgtgggtggagttcagaagcagcagcaacatcctgggcaagggcttcttcgccgcctacgaggccacctgcggcggcgacatgaacaaggacgccggccagatccagagccccaactaccccgacgactacagacccagcaaggagtgcgtgtggagaatcaccgtgagcgagggcttccacgtgggcctgaccttccaggccttcgagatcgagagacacgacagctgcgcctacgactacctggaggtgagagacggccccaccgaggagagcgccctgatcggccacttctgcggctacgagaagcccgaggacgtgaagagcagcagcaacagactgtggatgaagttcgtgagcgacggcagcatcaacaaggccggcttcgccgccaacttcttcaaggaggtggacgagtgcagctggcccgaccacggcggctgcgagcacagatgcgtgaacaccctgggcagctacaagtgcgcctgcgaccccggctacgagctggccgccgacaagaagatgtgcgaggtggcctgcggcggcttcatcaccaagctgaacggcaccatcaccagccccggctggcccaaggagtaccccaccaacaagaactgcgtgtggcaggtggtggcccccgcccagtacagaatcagcctgcagttcgaggtgttcgagctggagggcaacgacgtgtgcaagtacgacttcgtggaggtgagaagcggcctgagccccgacgccaagctgcacggcagattctgcggcagcgagacccccgaggtgatcaccagccagagcaacaacatgagagtggagttcaagagcgacaacaccgtgagcaagagaggcttcagagcccacttcttcagcgacaaggacgagtgcgccaaggacaacggcggctgccagcacgagtgcgtgaacaccttcggcagctacctgtgcagatgcagaaacggctactggctgcacgagaacggccacgactgcaaggaggccggctgcgcccacaagatcagcagcgtggagggcaccctggccagccccaactggcccgacaagtaccccagcagaagagagtgcacctggaacatcagcagcaccgccggccacagagtgaagctgaccttcaacgagttcgagatcgagcagcaccaggagtgcgcctacgaccacctggagatgtacgacggccccgacagcctggcccccatcctgggcagattctgcggcagcaagaagcccgaccccaccgtggccagcggcagcagcatgttcctgagattctacagcgacgccagcgtgcagagaaagggcttccaggccgtgcacagcaccgagtgcggcggcagactgaaggccgaggtgcagaccaaggagctgtacagccacgcccagttcggcgacaacaactaccccagcgaggccagatgcgactgggtgatcgtggccgaggacggctacggcgtggagctgaccttcagaaccttcgaggtggaggaggaggccgactgcggctacgactacatggaggcctacgacggctacgacagcagcgcccccagactgggcagattctgcggcagcggccccctggaggagatctacagcgccggcgacagcctgatgatcagattcagaaccgacgacaccatcaacaagaagggcttccacgccagatacaccagcaccaagttccaggacgccctgcacatgaagaagtag

SEQ ID NO: 102638 - DNA, 2298 bp, Artificial Sequence
  Description of Artificial Sequence: Synthetic coding sequence
atgagcggcgaccacctgcacaacgacagccagatcgaggccgacttcagactgaacgacagccacaagcacaaggacaagcacaaggacagagagcacagacacaaggagcacaagaaggagaaggacagagagaagagcaagcacagcaacagcgagcacaaggacagcgagaagaagcacaaggagaaggagaagaccaagcacaaggacggcagcagcgagaagcacaaggacaagcacaaggacagagacaaggagaagagaaaggaggagaaggtgagagccagcggcgacgccaagatcaagaaggagaaggagaacggcttcagcagccccccccagatcaaggacgagcccgaggacgacggctacttcgtgccccccaaggaggacatcaagcccctgaagagacccagagacgaggacgacgccgactacaagcccaagaagatcaagaccgaggacaccaagaaggagaagaagagaaagctggaggaggaggaggacggcaagctgaagaagcccaagaacaaggacaaggacaagaaggtgcccgagcccgacaacaagaagaagaagcccaagaaggaggaggagcagaagtggaagtggtgggaggaggagagataccccgagggcatcaagtggaagttcctggagcacaagggccccgtgttcgcccccccctacgagcccctgcccgagaacgtgaagttctactacgacggcaaggtgatgaagctgagccccaaggccgaggaggtggccaccttcttcgccaagatgctggaccacgagtacaccaccaaggagatcttcagaaagaacttcttcaaggactggagaaaggagatgaccaacgaggagaagaacatcatcaccaacctgagcaagtgcgacttcacccagatgagccagtacttcaaggcccagaccgaggccagaaagcagatgagcaaggaggagaagctgaagatcaaggaggagaacgagaagctgctgaaggagtacggcttctgcatcatggacaaccacaaggagagaatcgccaacttcaagatcgagccccccggcctgttcagaggcagaggcaaccaccccaagatgggcatgctgaagagaagaatcatgcccgaggacatcatcatcaactgcagcaaggacgccaaggtgcccagccccccccccggccacaagtggaaggaggtgagacacgacaacaaggtgacctggctggtgagctggaccgagaacatccagggcagcatcaagtacatcatgctgaaccccagcagcagaatcaagggcgagaaggactggcagaagtacgagaccgccagaagactgaagaagtgcgtggacaagatcagaaaccagtacagagaggactggaagagcaaggagatgaaggtgagacagagagccgtggccctgtacttcatcgacaagctggccctgagagccggcaacgagaaggaggagggcgagaccgccgacaccgtgggctgctgcagcctgagagtggagcacatcaacctgcaccccgagctggacggccaggagtacgtggtggagttcgacttcctgggcaaggacagcatcagatactacaacaaggtgcccgtggagaagagagtgttcaagaacctgcagctgttcatggagaacaagcagcccgaggacgacctgttcgacagactgaacaccggcatcctgaacaagcacctgcaggacctgatggagggcctgaccgccaaggtgttcagaacctacaacgccagcatcaccctgcagcagcagctgaaggagctgaccgcccccgacgagaacatccccgccaagatcctgagctacaacagagccaacagagccgtggccatcctgtgcaaccaccagagagccccccccaagaccttcgagaagagcatgatgaacctgcagaccaagatcgacgccaagaaggagcagctggccgacgccagaagagacctgaagagcgccaaggccgacgccaaggtgatgaaggacgccaagaccaagaaggtggtggagagcaagaagaaggccgtgcagagactggaggagcagctgatgaagctggaggtgcaggccaccgacagagaggagaacaagcagatcgccctgggcaccagcaagctgaactacctggaccccagaatcaccgtggcctggtgcaagaagtggggcgtgcccatcgagaagatctacaacaagacccagagagagaagttcgcctgggccatcgacatggccgacgaggactacgagttctag

SEQ ID NO: 102639 - DNA, 1806 bp, Artificial Sequence
  Description of Artificial Sequence: Synthetic coding sequence
atgagagtggtgagactgctgagactgagagccgccctgaccctgctgggcgaggtgcccagaagacccgccagcagaggcgtgcccggcagcagaagaacccagaagggcagcggcgccagatgggagaaggagaagcacgaggacggcgtgaagtggagacagctggagcacaagggcccctacttcgcccccccctacgagcccctgcccgacggcgtgagattcttctacgagggcagacccgtgagactgagcgtggccgccgaggaggtggccaccttctacggcagaatgctggaccacgagtacaccaccaaggaggtgttcagaaagaacttcttcaacgactggagaaaggagatggccgtggaggagagagaggtgatcaagagcctggacaagtgcgacttcaccgagatccacagatacttcgtggacaaggccgccgccagaaaggtgctgagcagagaggagaagcagaagctgaaggaggaggccgagaagctgcagcaggagttcggctactgcatcctggacggccaccaggagaagatcggcaacttcaagatcgagccccccggcctgttcagaggcagaggcgaccaccccaagatgggcatgctgaagagaagaatcacccccgaggacgtggtgatcaactgcagcagagacagcaagatccccgagccccccgccggccaccagtggaaggaggtgagaagcgacaacaccgtgacctggctggccgcctggaccgagagcgtgcagaacagcatcaagtacatcatgctgaacccctgcagcaagctgaagggcgagaccgcctggcagaagttcgagaccgccagaagactgagaggcttcgtggacgagatcagaagccagtacagagccgactggaagagcagagagatgaagaccagacagagagccgtggccctgtacttcatcgacaagctggccctgagagccggcaacgagaaggaggacggcgaggccgccgacaccgtgggctgctgcagcctgagagtggagcacgtgcagctgcaccccgaggccgacggctgccagcacgtggtggagttcgacttcctgggcaaggactgcatcagatactacaacagagtgcccgtggagaagcccgtgtacaagaacctgcagctgttcatggagaacaaggaccccagagacgacctgttcgacagactgaccaccaccagcctgaacaagcacctgcaggagctgatggacggcctgaccgccaaggtgttcagaacctacaacgccagcatcaccctgcaggagcagctgagagccctgaccagagccgaggacagcatcgccgccaagatcctgagctacaacagagccaacagagtggtggccatcctgtgcaaccaccagagagccacccccagcaccttcgagaagagcatgcagaacctgcagaccaagatccaggccaagaaggagcaggtggccgaggccagagccgagctgagaagagccagagccgagcacaaggcccagggcgacggcaagagcagaagcgtgctggagaagaagagaagactgctggagaagctgcaggagcagctggcccagctgagcgtgcaggccaccgacaaggaggagaacaagcaggtggccctgggcaccagcaagctgaactacctggaccccagaatcagcatcgcctggtgcaagagattcagagtgcccgtggagaagatctacagcaagacccagagagagagattcgcctgggccctggccatggccggcgaggacttcgagttctag

SEQ ID NO: 102640 - DNA, 1512 bp, Artificial Sequence
  Description of Artificial Sequence: Synthetic coding sequence
atgctggaccacgagtacaccaccaaggaggtgttcagaaagaacttcttcaacgactggagaaaggagatggccgtggaggagagagaggtgatcaagagcctggacaagtgcgacttcaccgagatccacagatacttcgtggacaaggccgccgccagaaaggtgctgagcagagaggagaagcagaagctgaaggaggaggccgagaagctgcagcaggagttcggctactgcatcctggacggccaccaggagaagatcggcaacttcaagatcgagccccccggcctgttcagaggcagaggcgaccaccccaagatgggcatgctgaagagaagaatcacccccgaggacgtggtgatcaactgcagcagagacagcaagatccccgagccccccgccggccaccagtggaaggaggtgagaagcgacaacaccgtgacctggctggccgcctggaccgagagcgtgcagaacagcatcaagtacatcatgctgaacccctgcagcaagctgaagggcgagaccgcctggcagaagttcgagaccgccagaagactgagaggcttcgtggacgagatcagaagccagtacagagccgactggaagagcagagagatgaagaccagacagagagccgtggccctgtacttcatcgacaagctggccctgagagccggcaacgagaaggaggacggcgaggccgccgacaccgtgggctgctgcagcctgagagtggagcacgtgcagctgcaccccgaggccgacggctgccagcacgtggtggagttcgacttcctgggcaaggactgcatcagatactacaacagagtgcccgtggagaagcccgtgtacaagaacctgcagctgttcatggagaacaaggaccccagagacgacctgttcgacagactgaccaccaccagcctgaacaagcacctgcaggagctgatggacggcctgaccgccaaggtgttcagaacctacaacgccagcatcaccctgcaggagcagctgagagccctgaccagagccgaggacagcatcgccgccaagatcctgagctacaacagagccaacagagtggtggccatcctgtgcaaccaccagagagccacccccagcaccttcgagaagagcatgcagaacctgcagaccaagatccaggccaagaaggagcaggtggccgaggccagagccgagctgagaagagccagagccgagcacaaggcccagggcgacggcaagagcagaagcgtgctggagaagaagagaagactgctggagaagctgcaggagcagctggcccagctgagcgtgcaggccaccgacaaggaggagaacaagcaggtggccctgggcaccagcaagctgaactacctggaccccagaatcagcatcgcctggtgcaagagattcagagtgcccgtggagaagatctacagcaagacccagagagagagattcgcctgggccctggccatggccggcgaggacttcgagttctag

SEQ ID NO: 102641 - DNA, 1512 bp, Artificial Sequence; identical to SEQ ID NO: 102640
  Description of Artificial Sequence: Synthetic coding sequence

SEQ ID NO: 102642 - DNA, 1512 bp, Artificial Sequence; identical to SEQ ID NO: 102640
  Description of Artificial Sequence: Synthetic coding sequence

SEQ ID NO: 102643 - DNA, 4569 bp, Artificial Sequence
  Description of Artificial Sequence: Synthetic coding sequence
atgagcagaaacgacaaggagcccttcttcgtgaagttcctgaagagcagcgacaacagcaagtgcttcttcaaggccctggagagcatcaaggagttccagagcgaggagtacctgcagatcatcaccgaggaggaggccctgaagatcaaggagaacgacagaagcctgtacatctgcgaccccttcagcggcgtggtgttcgaccacctgaagaagctgggctgcagaatcgtgggcccccaggtggtgatcttctgcatgcaccaccagagatgcgtgcccagagccgagcaccccgtgtacaacatggtgatgagcgacgtgaccatcagctgcaccagcctggagaaggagaagagagaggaggtgcacaagtacgtgcagatgatgggcggcagagtgtacagagacctgaacgtgagcgtgacccacctgatcgccggcgaggtgggcagcaagaagtacctggtggccgccaacctgaagaagcccatcctgctgcccagctggatcaagaccctgtgggagaagagccaggagaagaagatcaccagatacaccgacatcaacatggaggacttcaagtgccccatcttcctgggctgcatcatctgcgtgaccggcctgtgcggcctggacagaaaggaggtgcagcagctgaccgtgaagcacggcggccagtacatgggccagctgaagatgaacgagtgcacccacctgatcgtgcaggagcccaagggccagaagtacgagtgcgccaagagatggaacgtgcactgcgtgaccacccagtggttcttcgacagcatcgagaagggcttctgccaggacgagagcatctacaagaccgagcccagacccgaggccaagaccatgcccaacagcagcacccccaccagccagatcaacaccatcgacagcagaaccctgagcgacgtgagcaacatcagcaacatcaacgccagctgcgtgagcgagagcatctgcaacagcctgaacagcaagctggagcccaccctggagaacctggagaacctggacgtgagcgccttccaggcccccgaggacctgctggacggctgcagaatctacctgtgcggcttcagcggcagaaagctggacaagctgagaagactgatcaacagcggcggcggcgtgagattcaaccagctgaacgaggacgtgacccacgtgatcgtgggcgactacgacgacgagctgaagcagttctggaacaagagcgcccacagaccccacgtggtgggcgccaagtggctgctggagtgcttcagcaagggctacatgctgagcgaggagccctacatccacgccaactaccagcccgtggagatccccgtgagccacaagcccgagagcaaggccgccctgctgaagaagaagaacagcagcttcagcaagaaggacttcgcccccagcgagaagcacgagcaggccgacgaggacctgctgagccagtacgagaacggcagcagcaccgtggtggaggccaagaccagcgaggccagacccttcaacgacagcacccacgccgagcccctgaacgacagcacccacatcagcctgcaggaggagaaccagagcagcgtgagccactgcgtgcccgacgtgagcaccatcaccgaggagggcctgttcagccagaagagcttcctggtgctgggcttcagcaacgagaacgagagcaacatcgccaacatcatcaaggagaacgccggcaagatcatgagcctgctgagcagaaccgtggccgactacgccgtggtgcccctgctgggctgcgaggtggaggccaccgtgggcgaggtggtgaccaacacctggctggtgacctgcatcgactaccagaccctgttcgaccccaagagcaaccccctgttcacccccgtgcccgtgatgaccggcatgacccccctggaggactgcgtgatcagcttcagccagtgcgccggcgccgagaaggagagcctgaccttcctggccaacctgctgggcgccagcgtgcaggagtacttcgtgagaaagagcaacgccaagaagggcatgttcgccagcacccacctgatcctgaaggagagaggcggcagcaagtacgaggccgccaagaagtggaacctgcccgccgtgaccatcgcctggctgctggagaccgccagaaccggcaagagagccgacgagagccacttcctgatcgagaacagcaccaaggaggagagaagcctggagaccgagatcaccaacggcatcaacctgaacagcgacaccgccgagcaccccggcaccagactgcagacccacagaaagaccgtggtgacccccctggacatgaacagattccagagcaaggccttcagagccgtggtgagccagcacgccagacaggtggccgccagccccgccgtgggccagcccctgcagaaggagcccagcctgcacctggacacccccagcaagttcctgagcaaggacaagctgttcaagcccagcttcgacgtgaaggacgccctggccgccctggagacccccggcagacccagccagcagaagagaaagcccagcacccccctgagcgaggtgatcgtgaagaacctgcagctggccctggccaacagcagcagaaacgccgtggccctgagcgccagcccccagctgaaggaggcccagagcgagaaggaggaggcccccaagcccctgcacaaggtggtggtgtgcgtgagcaagaagctgagcaagaagcagagcgagctgaacggcatcgccgccagcctgggcgccgactacagatggagcttcgacgagaccgtgacccacttcatctaccagggcagacccaacgacaccaacagagagtacaagagcgtgaaggagagaggcgtgcacatcgtgagcgagcactggctgctggactgcgcccaggagtgcaagcacctgcccgagagcctgtacccccacacctacaaccccaagatgagcctggacatcagcgccgtgcaggacggcagactgtgcaacagcagactgctgagcgccgtgagcagcaccaaggacgacgagcccgaccccctgatcctggaggagaacgacgtggacaacatggccaccaacaacaaggagagcgcccccagcaacggcagcggcaagaacgacagcaagggcgtgctgacccagaccctggagatgagagagaacttccagaagcagctgcaggagatcatgagcgccaccagcatcgtgaagccccagggccagagaaccagcctgagcagaagcggctgcaacagcgccagcagcacccccgacagcaccagaagcgccagaagcggcagaagcagagtgctggaggccctgagacagagcagacagaccgtgcccgacgtgaacaccgagcccagccagaacgagcagatcatctgggacgaccccaccgccagagaggagagagccagactggccagcaacctgcagtggcccagctgccccacccagtacagcgagctgcaggtggacatccagaacctggaggacagccccttccagaagcccctgcacgacagcgagatcgccaagcaggccgtgtgcgaccccggcaacatcagagtgaccgaggcccccaagcaccccatcagcgaggagctggagacccccatcaaggacagccacctgatccccaccccccaggcccccagcatcgccttccccctggccaacccccccgtggccccccaccccagagagaagatcatcaccatcgaggagacccacgaggagctgaagaagcagtacatcttccagctgagcagcctgaacccccaggagagaatcgactactgccacctgatcgagaagctgggcggcctggtgatcgagaagcagtgcttcgaccccacctgcacccacatcgtggtgggccaccccctgagaaacgagaagtacctggccagcgtggccgccggcaagtgggtgctgcacagaagctacctggaggcctgcagaaccgccggccacttcgtgcaggaggaggactacgagtggggcagcagcagcatcctggacgtgctgaccggcatcaacgtgcagcagagaagactggccctggccgccatgagatggagaaagaagatccagcagagacaggagagcggcatcgtggagggcgccttcagcggctggaaggtgatcctgcacgtggaccagagcagagaggccggcttcaagagactgctgcagagcggcggcgccaaggtgctgcccggccacagcgtgcccctgttcaaggaggccacccacctgttcagcgacctgaacaagctgaagcccgacgacagcggcgtgaacatcgccgaggccgccgcccagaacgtgtactgcctgagaaccgagtacatcgccgactacctgatgcaggagagccccccccacgtggagaactactgcctgcccgaggccatcagcttcatccagaacaacaaggagctgggcaccggcctgagccagaagagaaaggcccccaccgagaagaacaagatcaagagacccagagtgcactag

SEQ ID NO: 102644 - DNA, 3138 bp, Artificial Sequence
  Description of Artificial Sequence: Synthetic coding sequence
atgggcagccagccccccctgggcagccccctgagcagagaggagggcgaggcccccccccccgcccccgccagcgagggcagaagaagaagcagaagagtgagactgagaggcagctgcagacacagacccagcttcctgggctgcagagagctggccgccagcgcccccgccagacccgcccccgccagcagcgagatcatggccagcgccgccaaggagttcaagatggacaacttcagccccaaggccggcaccagcaagctgcagcagaccgtgcccgccgacgccagccccgacagcaagtgccccatctgcctggacagattcgacaacgtgagctacctggacagatgcctgcacaagttctgcttcagatgcgtgcaggagtggagcaagaacaaggccgagtgccccctgtgcaagcagcccttcgacagcatcttccacagcgtgagagccgaggacgacttcaaggagtacgtgctgagacccagctacaacggcagcttcgtgacccccgacagaagattcagatacagaaccaccctgaccagagagagaaacgccagcgtgtacagccccagcggccccgtgaacagaagaaccaccaccccccccgacagcggcgtgctgttcgagggcctgggcatcagcaccagacccagagacgtggagatcccccagttcatgagacagatcgccgtgagaagacccaccaccgccgacgagagaagcctgagaaagatccaggagcaggacatcatcaacttcagaagaaccctgtacagagccggcgccagagtgagaaacatcgaggacggcggcagatacagagacatcagcgccgagttcttcagaagaaaccccgcctgcctgcacagactggtgccctggctgaagagagagctgaccgtgctgttcggcgcccacggcagcctggtgaacatcgtgcagcacatcatcatgagcaacgtgaccagatacgacctggagagccaggccttcgtgagcgacctgagacccttcctgctgaacagaaccgagcacttcatccacgagttcatcagcttcgccagaagccccttcaacatggccgccttcgaccagcacgccaactacgactgccccgcccccagctacgaggagggcagccacagcgacagcagcgtgatcaccatcagccccgacgaggccgagacccaggagctggacatcaacgtggccaccgtgagccaggccccctgggacgacgagacccccggccccagctacagcagcagcgagcaggtgcacgtgaccatgagcagcctgctgaacaccagcgacagcagcgacgaggagctggtgaccggcggcgccaccagccagatccagggcgtgcagaccaacgacgacctgaacaacgacagcgacgacagcagcgacaactgcgtgatcgtgggcttcgtgaagcccctggccgagagaacccccgagctggtggagctgagcagcgacagcgaggacctgggcagctacgagaagatggagaccgtgaagacccaggagcaggagcagagctacagcagcggcgacagcgacgtgagcagatgcagcagcccccacagcgtgctgggcaaggacgagcagatcaacaagggccactgcgacagcagcaccagaatcaagagcaagaaggaggagaagagaagcaccagcctgagcagccccagaaacctgaacagcagcgtgagaggcgacagagtgtacagcccctacaaccacagacacagaaagagaggcagaagcagaagcagcgacagcagaagccagagcagaagcggccacgaccagaagaaccacagaaagcaccacggcaagaagagaatgaagagcaagagaagcagaagcagagagagcagcagacccagaggcagaagagacaagaagagaagcagaaccagagacagcagctggagcagaagaagccagaccctgagcctgagcagcgagagcaccagcagaagcagaagcagaagcagcgaccacggcaagagaagaagcagaagcagaaacagagacagatactacctgagaaacaactacggcagcagatacaagtgggagtacacctactacagcagaaacaaggacagagacggctacgagagcagctacagaagaagaaccctgagcagagcccactacagcagacagagcagcagccccgagttcagagtgcagagcttcagcgagagaaccaacgccagaaagaagaacaaccacagcgagagaaagtactactactacgagagacacagaagcagaagcctgagcagcaacagaagcagaaccgccagcaccggcaccgacagagtgagaaacgagaagcccggcggcaagagaaagtacaagaccagacacctggagggcaccaacgaggtggcccagcccagcagagagttcgccagcaaggccaaggacagccactaccagaagagcagcagcaagctggacggcaactacaagaacgagagcgacaccttcagcgacagcagaagcagcgacagagagaccaagcacaagagaagaaagagaaagaccagaagcctgagcgtggagatcgtgtacgagggcaaggccaccgacaccaccaagcaccacaagaagaagaagaagaagcacaagaagaagcacaagaagcaccacggcgacaacgccagcagaagccccgtggtgatcaccatcgacagcgacagcgacaaggacagcgaggtgaaggaggacaccgagtgcgacaacagcggcccccaggaccccctgcagaacgagttcctggcccccagcctggagcccttcgagaccaaggacgtggtgaccatcgaggccgagttcggcgtgctggacaaggagtgcgacatcgccaccctgagcaacaacctgaacaacgccaacaagaccgtggacaacatcccccccctggccgccagcgtggagcagaccctggacgtgagagaggagagcaccttcgtgagcgacctggagaaccagcccagcaacatcgtgagcctgcagaccgagcccagcagacagctgcccagccccagaaccagcctgatgagcgtgtgcctgggcagagactgcgacatgagctag

SEQ ID NO: 102645 - DNA, 2943 bp, Artificial Sequence
  Description of Artificial Sequence: Synthetic coding sequence
atgatcatggccagcgccgccaaggagttcaagatggacaacttcagccccaaggccggcaccagcaagctgcagcagaccgtgcccgccgacgccagccccgacagcaagtgccccatctgcctggacagattcgacaacgtgagctacctggacagatgcctgcacaagttctgcttcagatgcgtgcaggagtggagcaagaacaaggccgagtgccccctgtgcaagcagcccttcgacagcatcttccacagcgtgagagccgaggacgacttcaaggagtacgtgctgagacccagctacaacggcagcttcgtgacccccgacagaagattcagatacagaaccaccctgaccagagagagaaacgccagcgtgtacagccccagcggccccgtgaacagaagaaccaccaccccccccgacagcggcgtgctgttcgagggcctgggcatcagcaccagacccagagacgtggagatcccccagttcatgagacagatcgccgtgagaagacccaccaccgccgacgagagaagcctgagaaagatccaggagcaggacatcatcaacttcagaagaaccctgtacagagccggcgccagagtgagaaacatcgaggacggcggcagatacagagacatcagcgccgagttcttcagaagaaaccccgcctgcctgcacagactggtgccctggctgaagagagagctgaccgtgctgttcggcgcccacggcagcctggtgaacatcgtgcagcacatcatcatgagcaacgtgaccagatacgacctggagagccaggccttcgtgagcgacctgagacccttcctgctgaacagaaccgagcacttcatccacgagttcatcagcttcgccagaagccccttcaacatggccgccttcgaccagcacgccaactacgactgccccgcccccagctacgaggagggcagccacagcgacagcagcgtgatcaccatcagccccgacgaggccgagacccaggagctggacatcaacgtggccaccgtgagccaggccccctgggacgacgagacccccggccccagctacagcagcagcgagcaggtgcacgtgaccatgagcagcctgctgaacaccagcgacagcagcgacgaggagctggtgaccggcggcgccaccagccagatccagggcgtgcagaccaacgacgacctgaacaacgacagcgacgacagcagcgacaactgcgtgatcgtgggcttcgtgaagcccctggccgagagaacccccgagctggtggagctgagcagcgacagcgaggacctgggcagctacgagaagatggagaccgtgaagacccaggagcaggagcagagctacagcagcggcgacagcgacgtgagcagatgcagcagcccccacagcgtgctgggcaaggacgagcagatcaacaagggccactgcgacagcagcaccagaatcaagagcaagaaggaggagaagagaagcaccagcctgagcagccccagaaacctgaacagcagcgtgagaggcgacagagtgtacagcccctacaaccacagacacagaaagagaggcagaagcagaagcagcgacagcagaagccagagcagaagcggccacgaccagaagaaccacagaaagcaccacggcaagaagagaatgaagagcaagagaagcagaagcagagagagcagcagacccagaggcagaagagacaagaagagaagcagaaccagagacagcagctggagcagaagaagccagaccctgagcctgagcagcgagagcaccagcagaagcagaagcagaagcagcgaccacggcaagagaagaagcagaagcagaaacagagacagatactacctgagaaacaactacggcagcagatacaagtgggagtacacctactacagcagaaacaaggacagagacggctacgagagcagctacagaagaagaaccctgagcagagcccactacagcagacagagcagcagccccgagttcagagtgcagagcttcagcgagagaaccaacgccagaaagaagaacaaccacagcgagagaaagtactactactacgagagacacagaagcagaagcctgagcagcaacagaagcagaaccgccagcaccggcaccgacagagtgagaaacgagaagcccggcggcaagagaaagtacaagaccagacacctggagggcaccaacgaggtggcccagcccagcagagagttcgccagcaaggccaaggacagccactaccagaagagcagcagcaagctggacggcaactacaagaacgagagcgacaccttcagcgacagcagaagcagcgacagagagaccaagcacaagagaagaaagagaaagaccagaagcctgagcgtggagatcgtgtacgagggcaaggccaccgacaccaccaagcaccacaagaagaagaagaagaagcacaagaagaagcacaagaagcaccacggcgacaacgccagcagaagccccgtggtgatcaccatcgacagcgacagcgacaaggacagcgaggtgaaggaggacaccgagtgcgacaacagcggcccccaggaccccctgcagaacgagttcctggcccccagcctggagcccttcgagaccaaggacgtggtgaccatcgaggccgagttcggcgtgctggacaaggagtgcgacatcgccaccctgagcaacaacctgaacaacgccaacaagaccgtggacaacatcccccccctggccgccagcgtggagcagaccctggacgtgagagaggagagcaccttcgtgagcgacctggagaaccagcccagcaacatcgtgagcctgcagaccgagcccagcagacagctgcccagccccagaaccagcctgatgagcgtgtgcctgggcagagactgcgacatgagctag

SEQ ID NO: 102646 - DNA, 999 bp, Artificial Sequence
  Description of Artificial Sequence: Synthetic coding sequence
atgaagctgggcagagccgtgctgggcctgctgctgctggcccccagcgtggtgcaggccgtggagcccatcagcctgggcctggccctggccggcgtgctgaccggctacatctaccccagactgtactgcctgttcgccgagtgctgcggccagaagagaagcctgagcagagaggccctgcagaaggacctggacgacaacctgttcggccagcacctggccaagaagatcatcctgaacgccgtgttcggcttcatcaacaaccccaagcccaagaagcccctgaccctgagcctgcacggctggaccggcaccggcaagaacttcgtgagcaagatcatcgccgagaacatctacgagggcggcctgaacagcgactacgtgcacctgttcgtggccaccctgcacttcccccacgccagcaacatcaccctgtacaaggaccagctgcagctgtggatcagaggcaacgtgagcgcctgcgccagaagcatcttcatcttcgacgagatggacaagatgcacgccggcctgatcgacgccatcaagcccttcctggactactacgacctggtggacggcgtgagctaccagaaggccatgttcatcttcctgagcaacgccggcgccgagagaatcaccgacgtggccctggacttctggagaagcggcaagcagagagaggacatcaagctgaaggacatcgagcacgccctgagcgtgagcgtgttcaacaacaagaacagcggcttctggcacagcagcctgatcgacagaaacctgatcgactacttcgtgcccttcctgcccctggagtacaagcacctgaagatgtgcatcagagtggagatgcagagcagaggctacgagatcgacgaggacatcgtgagcagagtggccgaggagatgaccttcttccccaaggaggagagagtgttcagcgacaagggctgcaagaccgtgttcaccaagctggactactactacgacgactag

SEQ ID NO: 102647 - DNA, 906 bp, Artificial Sequence
  Description of Artificial Sequence: Synthetic coding sequence
atgaagctgggcagagccgtgctgggcctgctgctgctggcccccagcgtggtgcaggccgtggagcccatcagcctgggcctggccctggccggcgtgctgaccggctacatctaccccagactgtactgcctgttcgccgagtgctgcggccagaagagaagcctgagcagagaggccctgcagaaggacctggacgacaacctgttcggccagcacctggccaagaagatcatcctgaacgccgtgttcggcttcatcaacaaccccaagcccaagaagcccctgaccctgagcctgttcgtggccaccctgcacttcccccacgccagcaacatcaccctgtacaaggaccagctgcagctgtggatcagaggcaacgtgagcgcctgcgccagaagcatcttcatcttcgacgagatggacaagatgcacgccggcctgatcgacgccatcaagcccttcctggactactacgacctggtggacggcgtgagctaccagaaggccatgttcatcttcctgagcaacgccggcgccgagagaatcaccgacgtggccctggacttctggagaagcggcaagcagagagaggacatcaagctgaaggacatcgagcacgccctgagcgtgagcgtgttcaacaacaagaacagcggcttctggcacagcagcctgatcgacagaaacctgatcgactacttcgtgcccttcctgcccctggagtacaagcacctgaagatgtgcatcagagtggagatgcagagcagaggctacgagatcgacgaggacatcgtgagcagagtggccgaggagatgaccttcttccccaaggaggagagagtgttcagcgacaagggctgcaagaccgtgttcaccaagctggactactactacgacgactag

SEQ ID NO: 102648 - DNA, 1011 bp, Artificial Sequence
  Description of Artificial Sequence: Synthetic coding sequence
atgctgagagccggctggctgagaggcgccgccgccctggccctgctgctggccgccagagtggtggccgccttcgagcccatcaccgtgggcctggccatcggcgccgccagcgccatcaccggctacctgagctacaacgacatctactgcagattcgccgagtgctgcagagaggagagacccctgaacgccagcgccctgaagctggacctggaggagaagctgttcggccagcacctggccaccgaggtgatcttcaaggccctgaccggcttcagaaacaacaagaaccccaagaagcccctgaccctgagcctgcacggctgggccggcaccggcaagaacttcgtgagccagatcgtggccgagaacctgcaccccaagggcctgaagagcaacttcgtgcacctgttcgtgagcaccctgcacttcccccacgagcagaagatcaagctgtaccaggaccagctgcagaagtggatcagaggcaacgtgagcgcctgcgccaacagcgtgttcatcttcgacgagatggacaagctgcaccccggcatcatcgacgccatcaagcccttcctggactactacgagcaggtggacggcgtgagctacagaaaggccatcttcatcttcctgagcaacgccggcggcgacctgatcaccaagaccgccctggacttctggagagccggcagaaagagagaggacatccagctgaaggacctggagcccgtgctgagcgtgggcgtgttcaacaacaagcacagcggcctgtggcacagcggcctgatcgacaagaacctgatcgactacttcatccccttcctgcccctggagtacagacacgtgaagatgtgcgtgagagccgagatgagagccagaggcagcgccatcgacgaggacatcgtgaccagagtggccgaggagatgaccttcttccccagagacgagaagatctacagcgacaagggctgcaagaccgtgcagagcagactggacttccactag

SEQ ID NO: 102649 - DNA, 426 bp, Artificial Sequence
  Description of Artificial Sequence: Synthetic coding sequence
tgaagagtggtggccgccttcgagcccatcaccgtgggcctggccatcggcgccgccagcgccatcaccggctacctgagctacaacgacatctactgcagattcgccgagtgctgcagagaggagagacccctgaacgccagcgccctgaagctggacctggaggagaagctgttcggccagcacctggccaccgaggtgatcttcaaggccctgaccggcttcagaaacaacaagaaccccaagaagcccctgaccctgagcctgcacggctgggccggcaccggcaagaacttcgtgagccagatcgtggccgagaacctgcaccccaagggcctgaagagcaacttcgtgcacctgttcgtgagcaccctgcacttcccccacgagcagaagatcaagctgtaccagagcagcctgacctag

SEQ ID NO: 102650 - DNA, 918 bp, Artificial Sequence
  Description of Artificial Sequence: Synthetic coding sequence
atgctgagagccggctggctgagaggcgccgccgccctggccctgctgctggccgccagagtggtggccgccttcgagcccatcaccgtgggcctggccatcggcgccgccagcgccatcaccggctacctgagctacaacgacatctactgcagattcgccgagtgctgcagagaggagagacccctgaacgccagcgccctgaagctggacctggaggagaagctgttcggccagcacctggccaccgaggtgatcttcaaggccctgaccggcttcagaaacaacaagaaccccaagaagcccctgaccctgagcctgttcgtgagcaccctgcacttcccccacgagcagaagatcaagctgtaccaggaccagctgcagaagtggatcagaggcaacgtgagcgcctgcgccaacagcgtgttcatcttcgacgagatggacaagctgcaccccggcatcatcgacgccatcaagcccttcctggactactacgagcaggtggacggcgtgagctacagaaaggccatcttcatcttcctgagcaacgccggcggcgacctgatcaccaagaccgccctggacttctggagagccggcagaaagagagaggacatccagctgaaggacctggagcccgtgctgagcgtgggcgtgttcaacaacaagcacagcggcctgtggcacagcggcctgatcgacaagaacctgatcgactacttcatccccttcctgcccctggagtacagacacgtgaagatgtgcgtgagagccgagatgagagccagaggcagcgccatcgacgaggacatcgtgaccagagtggccgaggagatgaccttcttccccagagacgagaagatctacagcgacaagggctgcaagaccgtgcagagcagactggacttccactag

SEQ ID NO: 102651 - DNA, 1011 bp, Artificial Sequence
  Description of Artificial Sequence: Synthetic coding sequence
atgctgagaggcccctggagacagctgtggctgttcttcctgctgctgctgcccggcgcccccgagcccagaggcgccagcagaccctgggagggcaccgacgagcccggcagcgcctgggcctggcccggcttccagagactgcaggagcagctgagagccgccggcgccctgagcaagagatactggaccctgttcagctgccaggtgtggcccgacgactgcgacgaggacgaggaggccgccaccggccccctgggctggagactgcccctgctgggccagagatacctggacctgctgaccacctggtactgcagcttcaaggactgctgccccagaggcgactgcagaatcagcaacaacttcaccggcctggagtgggacctgaacgtgagactgcacggccagcacctggtgcagcagctggtgctgagaaccgtgagaggctacctggagaccccccagcccgagaaggccctggccctgagcttccacggctggagcggcaccggcaagaacttcgtggccagaatgctggtggagaacctgtacagagacggcctgatgagcgactgcgtgagaatgttcatcgccaccttccacttcccccaccccaagtacgtggacctgtacaaggagcagctgatgagccagatcagagagacccagcagctgtgccaccagaccctgttcatcttcgacgaggccgagaagctgcaccccggcctgctggaggtgctgggcccccacctggagagaagagcccccgagggccacagagccgagagcccctggaccatcttcctgttcctgagcaacctgagaggcgacatcatcaacgaggtggtgctgaagctgctgaaggccggctggagcagagaggagatcaccatggagcacctggagccccacctgcaggccgagatcgtggagaccatcggcttcagcttcctgaccaccagatggccccacctggacctgcccaccagcagcgtggcccccacctag

SEQ ID NO: 102652 - DNA, 462 bp, Artificial Sequence
  Description of Artificial Sequence: Synthetic coding sequence
atgctgagaggcccctggagacagctgtggctgttcttcctgctgctgctgcccggcgcccccgagcccagaggcgccagcagaccctgggagggcaccgacgagcccggcagcgcctgggcctggcccggcttccagagactgcaggagcagctgagagccgccggcgccctgagcaagagatactggaccctgttcagctgccaggtgtggcccgacgactgcgacgaggacgaggaggccgccaccggccccctgggctggagactgcccctgctgggccagagatacctggacctgctgaccacctggtactgcagcttcaaggactgctgccccagaggcgactgcagaatcagcaacaacttcaccggcaagaacttcgtggccagaatgctggtggagaacctgtacagagacggcctgatgagcgactgcgtgagaatgttcatcgccacctag

SEQ ID NO: 102653 - DNA, 1194 bp, Artificial Sequence
  Description of Artificial Sequence: Synthetic coding sequence
atgctgagaggcccctggagacagctgtggctgttcttcctgctgctgctgcccggcgcccccgagcccagaggcgccagcagaccctgggagggcaccgacgagcccggcagcgcctgggcctggcccggcttccagagactgcaggagcagctgagagccgccggcgccctgagcaagagatactggaccctgttcagctgccaggtgtggcccgacgactgcgacgaggacgaggaggccgccaccggccccctgggctggagactgcccctgctgggccagagatacctggacctgctgaccacctggtactgcagcttcaaggactgctgccccagaggcgactgcagaatcagcaacaacttcaccggcctggagtgggacctgaacgtgagactgcacggccagcacctggtgcagcagctggtgctgagaaccgtgagaggctacctggagaccccccagcccgagaaggccctggccctgagcttccacggctggagcggcaccggcaagaacttcgtggccagaatgctggtggagaacctgtacagagacggcctgatgagcgactgcgtgagaatgttcatcgccaccttccacttcccccaccccaagtacgtggacctgtacaaggagcagctgatgagccagatcagagagacccagcagctgtgccaccagaccctgttcatcttcgacgaggccgagaagctgcaccccggcctgctggaggtgctgggcccccacctggagagaagagcccccgagggccacagagccgagagcccctggaccatcttcctgttcctgagcaacctgagaggcgacatcatcaacgaggtggtgctgaagctgctgaaggccggctggagcagagaggagatcaccatggagcacctggagccccacctgcaggccgagatcgtggagaccatcgacaacggcttcggccacagcagactggtgaaggagaacctgatcgactacttcatccccttcctgcccctggagtacagacacgtgagactgtgcgccagagacgccttcctgagccaggagctgctgtacaaggaggagaccctggacgagatcgcccagatgatggtgtacgtgcccaaggaggagcagctgttcagcagccagggctgcaagagcatcagccagagaatcaactacttcctgagctag

SEQ ID NO: 102654 - DNA, 525 bp, Artificial Sequence
  Description of Artificial Sequence: Synthetic coding sequence
atgggcctgtgcgtgcccttcgccgtgaccaccagcttcctgagcctgggcctggagtgggacctgaacgtgagactgcacggccagcacctggtgcagcagctggtgctgagaaccgtgagaggctacctggagaccccccagcccgagaaggccctggccctgagcttccacggctggagcggcaccggcaagaacttcgtggccagaatgctggtggagaacctgtacagagacggcctgatgagcgactgcgtgagaatgttcatcgccaccttccacttcccccaccccaagtacgtggacctgtacaaggagcagctgatgagccagatcagagagacccagcagctgtgccaccagaccctgttcatcttcgacgaggccgagaagctgcaccccggcctgctggaggtgctgggcccccacctggagagaagagcccccgagggccacagagccgagagcccctggaccatcttcctgttcctgagcaacctgagaggcgacatcatcaacgagtag

SEQ ID NO: 102655 - DNA, 1866 bp, Artificial Sequence
  Description of Artificial Sequence: Synthetic coding sequence
atggagttccccggcggcaacgacaactacctgaccatcaccggccccagccaccccttcctgagcggcgccgagaccttccacacccccagcctgggcgacgaggagttcgagatcccccccatcagcctggacagcgaccccagcctggccgtgagcgacgtggtgggccacttcgacgacctggccgaccccagcagcagccaggacggcagcttcagcgcccagtacggcgtgcagaccctggacatgcccgtgggcatgacccacggcctgatggagcagggcggcggcctgctgagcggcggcctgaccatggacctggaccacagcatcggcacccagtacagcgccaacccccccgtgaccatcgacgtgcccatgaccgacatgaccagcggcctgatgggccacagccagctgaccaccatcgaccagagcgagctgagcagccagctgggcctgagcctgggcggcggcaccatcctgccccccgcccagagccccgaggacagactgagcaccacccccagccccaccagcagcctgcacgaggacggcgtggaggacttcagaagacagctgcccagccagaagaccgtggtggtggaggccggcaagaagcagaaggcccccaagaagagaaagaagaaggaccccaacgagccccagaagcccgtgagcgcctacgccctgttcttcagagacacccaggccgccatcaagggccagaaccccaacgccaccttcggcgaggtgagcaagatcgtggccagcatgtgggacagcctgggcgaggagcagaagcaggtgtacaagagaaagaccgaggccgccaagaaggagtacctgaaggccctggccgcctacaaggacaaccaggagtgccaggccaccgtggagaccgtggagctggaccccgccccccccagccagacccccagccccccccccatggccaccgtggaccccgccagccccgcccccgccagcatcgagccccccgccctgagccccagcatcgtggtgaacagcaccctgagcagctacgtggccaaccaggccagcagcggcgccggcggccagcccaacatcaccaagctgatcatcaccaagcagatgctgcccagcagcatcaccatgagccagggcggcatggtgaccgtgatccccgccaccgtggtgaccagcagaggcctgcagctgggccagaccagcaccgccaccatccagcccagccagcaggcccagatcgtgaccagaagcgtgctgcaggccgccgccgccgccgccgccgccgccagcatgcagctgcccccccccagactgcagcccccccccctgcagcagatgccccagccccccacccagcagcaggtgaccatcctgcagcagcccccccccctgcaggccatgcagcagccccccccccagaaggtgagaatcaacctgcagcagcagcccccccccctgcagatcaagagcgtgcccctgcccaccctgaagatgcagaccaccctggtgccccccaccgtggagagcagccccgagagacccatgaacaacagccccgaggcccacaccgtggaggcccccagccccgagaccatctgcgagatgatcaccgacgtggtgcccgaggtggagagccccagccagatggacgtggagctggtgagcggcagccccgtggccctgagcccccagcccagatgcgtgagaagcggctgcgagaacccccccatcgtgagcaaggactgggacaacgagtactgcagcaacgagtgcgtggtgaagcactgcagagacgtgttcctggcctgggtggccagcagaaacagcaacaccgtggtgttcgtgaagtag

SEQ ID NO: 102656 - DNA, 1866 bp, Artificial Sequence; identical to SEQ ID NO: 102655
  Description of Artificial Sequence: Synthetic coding sequence

SEQ ID NO: 102657 - DNA, 1797 bp, Artificial Sequence
  Description of Artificial Sequence: Synthetic coding sequence
atggagaccttccacacccccagcctgggcgacgaggagttcgagatcccccccatcagcctggacagcgaccccagcctggccgtgagcgacgtggtgggccacttcgacgacctggccgaccccagcagcagccaggacggcagcttcagcgcccagtacggcgtgcagaccctggacatgcccgtgggcatgacccacggcctgatggagcagggcggcggcctgctgagcggcggcctgaccatggacctggaccacagcatcggcacccagtacagcgccaacccccccgtgaccatcgacgtgcccatgaccgacatgaccagcggcctgatgggccacagccagctgaccaccatcgaccagagcgagctgagcagccagctgggcctgagcctgggcggcggcaccatcctgccccccgcccagagccccgaggacagactgagcaccacccccagccccaccagcagcctgcacgaggacggcgtggaggacttcagaagacagctgcccagccagaagaccgtggtggtggaggccggcaagaagcagaaggcccccaagaagagaaagaagaaggaccccaacgagccccagaagcccgtgagcgcctacgccctgttcttcagagacacccaggccgccatcaagggccagaaccccaacgccaccttcggcgaggtgagcaagatcgtggccagcatgtgggacagcctgggcgaggagcagaagcaggtgtacaagagaaagaccgaggccgccaagaaggagtacctgaaggccctggccgcctacaaggacaaccaggagtgccaggccaccgtggagaccgtggagctggaccccgccccccccagccagacccccagccccccccccatggccaccgtggaccccgccagccccgcccccgccagcatcgagccccccgccctgagccccagcatcgtggtgaacagcaccctgagcagctacgtggccaaccaggccagcagcggcgccggcggccagcccaacatcaccaagctgatcatcaccaagcagatgctgcccagcagcatcaccatgagccagggcggcatggtgaccgtgatccccgccaccgtggtgaccagcagaggcctgcagctgggccagaccagcaccgccaccatccagcccagccagcaggcccagatcgtgaccagaagcgtgctgcaggccgccgccgccgccgccgccgccgccagcatgcagctgcccccccccagactgcagcccccccccctgcagcagatgccccagccccccacccagcagcaggtgaccatcctgcagcagcccccccccctgcaggccatgcagcagccccccccccagaaggtgagaatcaacctgcagcagcagcccccccccctgcagatcaagagcgtgcccctgcccaccctgaagatgcagaccaccctggtgccccccaccgtggagagcagccccgagagacccatgaacaacagccccgaggcccacaccgtggaggcccccagccccgagaccatctgcgagatgatcaccgacgtggtgcccgaggtggagagccccagccagatggacgtggagctggtgagcggcagccccgtggccctgagcccccagcccagatgcgtgagaagcggctgcgagaacccccccatcgtgagcaaggactgggacaacgagtactgcagcaacgagtgcgtggtgaagcactgcagagacgtgttcctggcctgggtggccagcagaaacagcaacaccgtggtgttcgtgaagtag

SEQ ID NO: 102658 - DNA, 1650 bp, Artificial Sequence
  Description of Artificial Sequence: Synthetic coding sequence
atgagaaacctgaagagccacctgagcccctggatcctgatcccccactggctgagccagatgtggctggccaccctgatgacctggcagttcttcagccccgacctggaccacagcatcggcacccagtacagcgccaacccccccgtgaccatcgacgtgcccatgaccgacatgaccagcggcctgatgggccacagccagctgaccaccatcgaccagagcgagctgagcagccagctgggcctgagcctgggcggcggcaccatcctgccccccgcccagagccccgaggacagactgagcaccacccccagccccaccagcagcctgcacgaggacggcgtggaggacttcagaagacagctgcccagccagaagaccgtggtggtggaggccggcaagaagcagaaggcccccaagaagagaaagaagaaggaccccaacgagccccagaagcccgtgagcgcctacgccctgttcttcagagacacccaggccgccatcaagggccagaaccccaacgccaccttcggcgaggtgagcaagatcgtggccagcatgtgggacagcctgggcgaggagcagaagcaggtgtacaagagaaagaccgaggccgccaagaaggagtacctgaaggccctggccgcctacaaggacaaccaggagtgccaggccaccgtggagaccgtggagctggaccccgccccccccagccagacccccagccccccccccatggccaccgtggaccccgccagccccgcccccgccagcatcgagccccccgccctgagccccagcatcgtggtgaacagcaccctgagcagctacgtggccaaccaggccagcagcggcgccggcggccagcccaacatcaccaagctgatcatcaccaagcagatgctgcccagcagcatcaccatgagccagggcggcatggtgaccgtgatccccgccaccgtggtgaccagcagaggcctgcagctgggccagaccagcaccgccaccatccagcccagccagcaggcccagatcgtgaccagaagcgtgctgcaggccgccgccgccgccgccgccgccgccagcatgcagctgcccccccccagactgcagcccccccccctgcagcagatgccccagccccccacccagcagcaggtgaccatcctgcagcagcccccccccctgcaggccatgcagcagccccccccccagaaggtgagaatcaacctgcagcagcagcccccccccctgcagatcaagagcgtgcccctgcccaccctgaagatgcagaccaccctggtgccccccaccgtggagagcagccccgagagacccatgaacaacagccccgaggcccacaccgtggaggcccccagccccgagaccatctgcgagatgatcaccgacgtggtgcccgaggtggagagccccagccagatggacgtggagctggtgagcggcagccccgtggccctgagcccccagcccagatgcgtgagaagcggctgcgagaacccccccatcgtgagcaaggactgggacaacgagtactgcagcaacgagtgcgtggtgaagcactgcagagacgtgttcctggcctgggtggccagcagaaacagcaacaccgtggtgttcgtgaagtag

SEQ ID NO: 102659 - DNA, 1020 bp, Artificial Sequence
  Description of Artificial Sequence: Synthetic coding sequence
atgatgcccttctgccacaacatcatcaacatcagctgcgtgaagaacaactggagcaacgacgtgagagccagcctgtacagcctgatggtgctgatcatcctgaccaccctggtgggcaacctgatcgtgatcgtgagcatcagccacttcaagcagctgcacacccccaccaactggctgatccacagcatggccaccgtggacttcctgctgggctgcctggtgatgccctacagcatggtgagaagcgccgagcactgctggtacttcggcgaggtgttctgcaagatccacaccagcaccgacatcatgctgagcagcgccagcatcttccacctgagcttcatcagcatcgacagatactacgccgtgtgcgaccccctgagatacaaggccaagatgaacatcctggtgatctgcgtgatgatcttcatcagctggagcgtgcccgccgtgttcgccttcggcatgatcttcctggagctgaacttcaagggcgccgaggagatctactacaagcacgtgcactgcagaggcggctgcagcgtgttcttcagcaagatcagcggcgtgctgaccttcatgaccagcttctacatccccggcagcatcatgctgtgcgtgtactacagaatctacctgatcgccaaggagcaggccagactgatcagcgacgccaaccagaagctgcagatcggcctggagatgaagaacggcatcagccagagcaaggagagaaaggccgtgaagaccctgggcatcgtgatgggcgtgttcctgatctgctggtgccccttcttcatctgcaccgtgatggaccccttcctgcactacatcatcccccccaccctgaacgacgtgctgatctggttcggctacctgaacagcaccttcaaccccatggtgtacgccttcttctacccctggttcagaaaggccctgaagatgatgctgttcggcaagatcttccagaaggacagcagcagatgcaagctgttcctggagctgagcagctag

SEQ ID NO: 102660 - DNA, 921 bp, Artificial Sequence
  Description of Artificial Sequence: Synthetic coding sequence
atgtacagcttcatggccggcagcatcttcatcaccatcttcggcaacctggccatgatcatcagcatcagctacttcaagcagctgcacacccccaccaacttcctgatcctgagcatggccatcaccgacttcctgctgggcttcaccatcatgccctacagcatgatcagaagcgtggagaactgctggtacttcggcctgaccttctgcaagatctactacagcttcgacctgatgctgagcatcaccagcatcttccacctgtgcagcgtggccatcgacagattctacgccatctgctaccccctgctgtacagcaccaagatcaccatccccgtgatcaagagactgctgctgctgtgctggagcgtgcccggcgccttcgccttcggcgtggtgttcagcgaggcctacgccgacggcatcgagggctacgacatcctggtggcctgcagcagcagctgccccgtgatgttcaacaagctgtggggcaccaccctgttcatggccggcttcttcacccccggcagcatgatggtgggcatctacggcaagatcttcgccgtgagcagaaagcacgcccacgccatcaacaacctgagagagaaccagaacaaccaggtgaagaaggacaagaaggccgccaagaccctgggcatcgtgatcggcgtgttcctgctgtgctggttcccctgcttcttcaccatcctgctggaccccttcctgaacttcagcacccccgtggtgctgttcgacgccctgacctggttcggctacttcaacagcacctgcaaccccctgatctacggcttcttctacccctggttcagaagagccctgaagtacatcctgctgggcaagatcttcagcagctgcttccacaacaccatcctgtgcatgcagaaggagagcgagtag

SEQ ID NO: 102661 - DNA, 1056 bp, Artificial Sequence
  Description of Artificial Sequence: Synthetic coding sequence
atggccgtgagcagcgagcagcacgagctgagccacttcaagagaacccagaccaagaaggagaagttcaactgcagcgagtacggcaacagaagctgccccgagaacgagagaagcctgggcgtgagagtggccatgtacagcttcatggccggcagcatcttcatcaccatcttcggcaacctggccatgatcatcagcatcagctacttcaagcagctgcacacccccaccaacttcctgatcctgagcatggccatcaccgacttcctgctgggcttcaccatcatgccctacagcatgatcagaagcgtggagaactgctggtacttcggcctgaccttctgcaagatctactacagcttcgacctgatgctgagcatcaccagcatcttccacctgtgcagcgtggccatcgacagattctacgccatctgctaccccctgctgtacagcaccaagatcaccatccccgtgatcaagagactgctgctgctgtgctggagcgtgcccggcgccttcgccttcggcgtggtgttcagcgaggcctacgccgacggcatcgagggctacgacatcctggtggcctgcagcagcagctgccccgtgatgttcaacaagctgtggggcaccaccctgttcatggccggcttcttcacccccggcagcatgatggtgggcatctacggcaagatcttcgccgtgagcagaaagcacgcccacgccatcaacaacctgagagagaaccagaacaaccaggtgaagaaggacaagaaggccgccaagaccctgggcatcgtgatcggcgtgttcctgctgtgctggttcccctgcttcttcaccatcctgctggaccccttcctgaacttcagcacccccgtggtgctgttcgacgccctgacctggttcggctacttcaacagcacctgcaaccccctgatctacggcttcttctacccctggttcagaagagccctgaagtacatcctgctgggcaagatcttcagcagctgcttccacaacaccatcctgtgcatgcagaaggagagcgagtag

SEQ ID NO: 102662 - DNA, 921 bp, Artificial Sequence; identical to SEQ ID NO: 102660
  Description of Artificial Sequence: Synthetic coding sequence

SEQ ID NO: 102663 - DNA, 1038 bp, Artificial Sequence
  Description of Artificial Sequence: Synthetic coding sequence
atgagcagcaacagcagcctgctggtggccgtgcagctgtgctacgccaacgtgaacggcagctgcgtgaagatccccttcagccccggcagcagagtgatcctgtacatcgtgttcggcttcggcgccgtgctggccgtgttcggcaacctgctggtgatgatcagcatcctgcacttcaagcagctgcacagccccaccaacttcctggtggccagcctggcctgcgccgacttcctggtgggcgtgaccgtgatgcccttcagcatggtgagaaccgtggagagctgctggtacttcggcagaagcttctgcaccttccacacctgctgcgacgtggccttctgctacagcagcctgttccacctgtgcttcatcagcatcgacagatacatcgccgtgaccgaccccctggtgtaccccaccaagttcaccgtgagcgtgagcggcatctgcatcagcgtgagctggatcctgcccctgatgtacagcggcgccgtgttctacaccggcgtgtacgacgacggcctggaggagctgagcgacgccctgaactgcatcggcggctgccagaccgtggtgaaccagaactgggtgctgaccgacttcctgagcttcttcatccccaccttcatcatgatcatcctgtacggcaacatcttcctggtggccagaagacaggccaagaagatcgagaacaccggcagcaagaccgagagcagcagcgagagctacaaggccagagtggccagaagagagagaaaggccgccaagaccctgggcgtgaccgtggtggccttcatgatcagctggctgccctacagcatcgacagcctgatcgacgccttcatgggcttcatcacccccgcctgcatctacgagatctgctgctggtgcgcctactacaacagcgccatgaaccccctgatctacgccctgttctacccctggttcagaaaggccatcaaggtgatcgtgaccggccaggtgctgaagaacagcagcgccaccatgaacctgttcagcgagcacatctag

SEQ ID NO: 102664 - DNA, 957 bp, Artificial Sequence
  Description of Artificial Sequence: Synthetic coding sequence
gtgaacggcagctgcgtgaagatccccttcagccccggcagcagagtgatcctgtacatcgtgttcggcttcggcgccgtgctggccgtgttcggcaacctgctggtgatgatcagcatcctgcacttcaagcagctgcacagccccaccaacttcctggtggccagcctggcctgcgccgacttcctggtgggcgtgaccgtgatgcccttcagcatggtgagaaccgtggagagctgctggtacttcggcagaagcttctgcaccttccacacctgctgcgacgtggccttctgctacagcagcctgttccacctgtgcttcatcagcatcgacagatacatcgccgtgaccgaccccctggtgtaccccaccaagttcaccgtgagcgtgagcggcatctgcatcagcgtgagctggatcctgcccctgatgtacagcggcgccgtgttctacaccggcgtgtacgacgacggcctggaggagctgagcgacgccctgaactgcatcggcggctgccagaccgtggtgaaccagaactgggtgctgaccgacttcctgagcttcttcatccccaccttcatcatgatcatcctgtacggcaacatcttcctggtggccagaagacaggccaagaagatcgagaacaccgagagctacaaggccagagtggccagaagagagagaaaggccgccaagaccctgggcgtgaccgtggtggccttcatgatcagctggctgccctacagcatcgacagcctgatcgacgccttcatgggcttcatcacccccgcctgcatctacgagatctgctgctggtgcgcctactacaacagcgccatgaaccccctgatctacgccctgttctacccctggttcagaaaggccatcaaggtgatcgtgaccggccaggtgctgaagaacagcagcgccaccatgaacctgttcagcgagtag

SEQ ID NO: 102665 - DNA, 1410 bp, Artificial Sequence
  Description of Artificial Sequence: Synthetic coding sequence
atgcccatcagagccctgtgcaccatctgcagcgacttcttcgaccacagcagagacgtggccgccatccactgcggccacaccttccacctgcagtgcctgatccagtggttcgagaccgcccccagcagaacctgcccccagtgcagaatccaggtgggcaagagaaccatcatcaacaagctgttcttcgacctggcccaggaggaggagaacgtgctggacgccgagttcctgaagaacgagctggacaacgtgagagcccagctgagccagaaggacaaggagaagagagacagccaggtgatcatcgacaccctgagagacaccctggaggagagaaacgccaccgtggtgagcctgcagcaggccctgggcaaggccgagatgctgtgcagcaccctgaagaagcagatgaagtacctggagcagcagcaggacgagaccaagcaggcccaggaggaggccagaagactgagaagcaagatgaagaccatggagcagatcgagctgctgctgcagagccagagacccgaggtggaggagatgatcagagacatgggcgtgggccagagcgccgtggagcagctggccgtgtactgcgtgagcctgaagaaggagtacgagaacctgaaggaggccagaaaggccagcggcgaggtggccgacaagctgagaaaggacctgttcagcagcagaagcaagctgcagaccgtgtacagcgagctggaccaggccaagctggagctgaagagcgcccagaaggacctgcagagcgccgacaaggagatcatgagcctgaagaagaagctgaccatgctgcaggagaccctgaacctgccccccgtggccagcgagaccgtggacagactggtgctggagagccccgcccccgtggaggtgaacctgaagctgagaagacccagcttcagagacgacatcgacctgaacgccaccttcgacgtggacaccccccccgccagacccagcagcagccagcacggctactacgagaagctgtgcctggagaagagccacagccccatccaggacgtgcccaagaagatctgcaagggccccagaaaggagagccagctgagcctgggcggccagagctgcgccggcgagcccgacgaggagctggtgggcgccttccccatcttcgtgagaaacgccatcctgggccagaagcagcccaagagacccagaagcgagagcagctgcagcaaggacgtggtgagaaccggcttcgacggcctgggcggcagaaccaagttcatccagcccaccgacaccgtgatgatcagacccctgcccgtgaagcccaagaccaaggtgaagcagagagtgagagtgaagaccgtgcccagcctgttccaggccaagctggacaccttcctgtggagctag

SEQ ID NO: 102666 - DNA, 4059 bp, Artificial Sequence
  Description of Artificial Sequence: Synthetic coding sequence
atggccagcgacagccccgccagaagcctggacgagatcgacctgagcgccctgagagaccccgccggcatcttcgagctggtggagctggtgggcaacggcacctacggccaggtgtacaagggcagacacgtgaagaccggccagctggccgccatcaaggtgatggacgtgaccggcgacgaggaggaggagatcaagcaggagatcaacatgctgaagaagtacagccaccacagaaacatcgccacctactacggcgccttcatcaagaagaacccccccggcatggacgaccagctgtggctggtgatggagttctgcggcgccggcagcgtgaccgacctgatcaagaacaccaagggcaacaccctgaaggaggagtggatcgcctacatctgcagagagatcctgagaggcctgagccacctgcaccagcacaaggtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgacttcaagagcgacctgtggagcctgggcatcaccgccatcgagatggccgagggcgccccccccctgtgcgacatgcaccccatgagagccctgttcctgatccccagaaaccccgcccccagactgaagagcaagaagtggagcaagaagttccagagcttcatcgagagctgcctggtgaagaaccacagccagagacccgccaccgagcagctgatgaagcaccccttcatcagagaccagcccaacgagagacaggtgagaatccagctgaaggaccacatcgacagaaccaagaagaagagaggcgagaaggacgagaccgagtacgagtacagcggcagcgaggaggaggaggaggagaacgacagcggcgagcccagcagcatcctgaacctgcccggcgagagcaccctgagaagagacttcctgagactgcagctggccaacaaggagagaagcgaggccctgagaagacagcagctggagcagcagcagagagagaacgaggagcacaagagacagctgctggccgagagacagaagagaatcgaggagcagaaggagcagagaagaagactggaggagcagcagagaagagagaaggagctgagaaagcagcaggagagagagcagagaagacactacgaggagcagatgagaagagaggaggagagaagaagagccgagcacgagcaggagtacatcagaagacagctggaggaggagcagagacagctggagatcctgcagcagcagctgctgcacgagcaggccctgctgctggagtacaagagaaagcagctggaggagcagagacaggccgagagactgcagagacagctgaagcaggagagagactacctggtgagcctgcagcaccagagacaggagcagagacccgtggagaagaagcccctgtaccactacaaggagggcatgagccccagcgagaagcccgcctgggccaaggaggtggaggagagaagcagactgaacagacagagcagccccgccatgccccacaaggtggccaacagaatcagcgaccccaacctgccccccagaagcgagagcttcagcatcagcggcgtgcagcccgccagaaccccccccatgctgagacccgtggacccccagatcccccacctggtggccgtgaagagccagggccccgccctgaccgccagccagagcgtgcacgagcagcccaccaagggcctgagcggcttccaggaggccctgaacgtgaccagccacagagtggagatgcccagacagaacagcgaccccaccagcgagaacccccccctgcccaccagaatcgagaagttcgacagaagcagctggctgagacaggaggaggacatcccccccaaggtgccccagagaaccaccagcatcagccccgccctggccagaaagaacagccccggcaacggcagcgccctgggccccagactgggcagccagcccatcagagccagcaaccccgacctgagaagaaccgagcccatcctggagagccccctgcagagaaccagcagcggcagcagcagcagcagcagcacccccagcagccagcccagcagccagggcggcagccagcccggcagccaggccggcagcagcgagagaaccagagtgagagccaacagcaagagcgagggcagccccgtgctgccccacgagcccgccaaggtgaagcccgaggagagcagagacatcaccagacccagcagacccgccgacctgaccgccctggccaaggagctgagagagctgagaatcgaggagaccaacagacccatgaagaaggtgaccgactacagcagcagcagcgaggagagcgagagcagcgaggaggaggaggaggacggcgagagcgagacccacgacggcaccgtggccgtgagcgacatccccagactgatccccaccggcgcccccggcagcaacgagcagtacaacgtgggcatggtgggcacccacggcctggagaccagccacgccgacagcttcagcggcagcatcagcagagagggcaccctgatgatcagagagaccagcggcgagaagaagagaagcggccacagcgacagcaacggcttcgccggccacatcaacctgcccgacctggtgcagcagagccacagccccgccggcacccccaccgagggcctgggcagagtgagcacccacagccaggagatggacagcggcaccgagtacggcatgggcagcagcaccaaggccagcttcacccccttcgtggaccccagagtgtaccagaccagccccaccgacgaggacgaggaggacgaggagagcagcgccgccgccctgttcaccagcgagctgctgagacaggagcaggccaagctgaacgaggccagaaagatcagcgtggtgaacgtgaaccccaccaacatcagaccccacagcgacacccccgagatcagaaagtacaagaagagattcaacagcgagatcctgtgcgccgccctgtggggcgtgaacctgctggtgggcaccgagaacggcctgatgctgctggacagaagcggccagggcaaggtgtacaacctgatcaacagaagaagattccagcagatggacgtgctggagggcctgaacgtgctggtgaccatcagcggcaagaagaacaagctgagagtgtactacctgagctggctgagaaacagaatcctgcacaacgaccccgaggtggagaagaagcagggctggatcaccgtgggcgacctggagggctgcatccactacaaggtggtgaagtacgagagaatcaagttcctggtgatcgccctgaagaacgccgtggagatctacgcctgggcccccaagccctaccacaagttcatggccttcaagagcttcgccgacctgcagcacaagcccctgctggtggacctgaccgtggaggagggccagagactgaaggtgatcttcggcagccacaccggcttccacgtgatcgacgtggacagcggcaacagctacgacatctacatccccagccacatccagggcaacatcaccccccacgccatcgtgatcctgcccaagaccgacggcatggagatgctggtgtgctacgaggacgagggcgtgtacgtgaacacctacggcagaatcaccaaggacgtggtgctgcagtggggcgagatgcccaccagcgtggcctacatccacagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgttcttcatgaccctgaacagaaacagcatgatgaactggtag

SEQ ID NO: 102667 - DNA, 3831 bp, Artificial Sequence
  Description of Artificial Sequence: Synthetic coding sequence
atggccagcgacagccccgccagaagcctggacgagatcgacctgagcgccctgagagaccccgccggcatcttcgagctggtggagctggtgggcaacggcacctacggccaggtgtacaagggcagacacgtgaagaccggccagctggccgccatcaaggtgatggacgtgaccggcgacgaggaggaggagatcaagcaggagatcaacatgctgaagaagtacagccaccacagaaacatcgccacctactacggcgccttcatcaagaagaacccccccggcatggacgaccagctgtggctggtgatggagttctgcggcgccggcagcgtgaccgacctgatcaagaacaccaagggcaacaccctgaaggaggagtggatcgcctacatctgcagagagatcctgagaggcctgagccacctgcaccagcacaaggtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgacttcaagagcgacctgtggagcctgggcatcaccgccatcgagatggccgagggcgccccccccctgtgcgacatgcaccccatgagagccctgttcctgatccccagaaaccccgcccccagactgaagagcaagaagtggagcaagaagttccagagcttcatcgagagctgcctggtgaagaaccacagccagagacccgccaccgagcagctgatgaagcaccccttcatcagagaccagcccaacgagagacaggtgagaatccagctgaaggaccacatcgacagaaccaagaagaagagaggcgagaaggacgagaccgagtacgagtacagcggcagcgaggaggaggaggaggagaacgacagcggcgagcccagcagcatcctgaacctgcccggcgagagcaccctgagaagagacttcctgagactgcagctggccaacaaggagagaagcgaggccctgagaagacagcagctggagcagcagcagagagagaacgaggagcacaagagacagctgctggccgagagacagaagagaatcgaggagcagaaggagcagagaagaagactggaggagcagcagagaagagagaaggagctgagaaagcagcaggagagagagcagagaagacactacgaggagcagatgagaagagaggaggagagaagaagagccgagcacgagcaggagtacaagagaaagcagctggaggagcagagacaggccgagagactgcagagacagctgaagcaggagagagactacctggtgagcctgcagcaccagagacaggagcagagacccgtggagaagaagcccctgtaccactacaaggagggcatgagccccagcgagaagcccgcctgggccaaggagatcccccacctggtggccgtgaagagccagggccccgccctgaccgccagccagagcgtgcacgagcagcccaccaagggcctgagcggcttccaggaggccctgaacgtgaccagccacagagtggagatgcccagacagaacagcgaccccaccagcgagaacccccccctgcccaccagaatcgagaagttcgacagaagcagctggctgagacaggaggaggacatcccccccaaggtgccccagagaaccaccagcatcagccccgccctggccagaaagaacagccccggcaacggcagcgccctgggccccagactgggcagccagcccatcagagccagcaaccccgacctgagaagaaccgagcccatcctggagagccccctgcagagaaccagcagcggcagcagcagcagcagcagcacccccagcagccagcccagcagccagggcggcagccagcccggcagccaggccggcagcagcgagagaaccagagtgagagccaacagcaagagcgagggcagccccgtgctgccccacgagcccgccaaggtgaagcccgaggagagcagagacatcaccagacccagcagacccgccagctacaagaaggccatcgacgaggacctgaccgccctggccaaggagctgagagagctgagaatcgaggagaccaacagacccatgaagaaggtgaccgactacagcagcagcagcgaggagagcgagagcagcgaggaggaggaggaggacggcgagagcgagacccacgacggcaccgtggccgtgagcgacatccccagactgatccccaccggcgcccccggcagcaacgagcagtacaacgtgggcatggtgggcacccacggcctggagaccagccacgccgacagcttcagcggcagcatcagcagagagggcaccctgatgatcagagagaccagcggcgagaagaagagaagcggccacagcgacagcaacggcttcgccggccacatcaacctgcccgacctggtgcagcagagccacagccccgccggcacccccaccgagggcctgggcagagtgagcacccacagccaggagatggacagcggcaccgagtacggcatgggcagcagcaccaaggccagcttcacccccttcgtggaccccagagtgtaccagaccagccccaccgacgaggacgaggaggacgaggagagcagcgccgccgccctgttcaccagcgagctgctgagacaggagcaggccaagctgaacgaggccagaaagatcagcgtggtgaacgtgaaccccaccaacatcagaccccacagcgacacccccgagatcagaaagtacaagaagagattcaacagcgagatcctgtgcgccgccctgtggggcgtgaacctgctggtgggcaccgagaacggcctgatgctgctggacagaagcggccagggcaaggtgtacaacctgatcaacagaagaagattccagcagatggacgtgctggagggcctgaacgtgctggtgaccatcagcggcaagaagaacaagctgagagtgtactacctgagctggctgagaaacagaatcctgcacaacgaccccgaggtggagaagaagcagggctggatcaccgtgggcgacctggagggctgcatccactacaaggtggtgaagtacgagagaatcaagttcctggtgatcgccctgaagaacgccgtggagatctacgcctgggcccccaagccctaccacaagttcatggccttcaagagcttcgccgacctgcagcacaagcccctgctggtggacctgaccgtggaggagggccagagactgaaggtgatcttcggcagccacaccggcttccacgtgatcgacgtggacagcggcaacagctacgacatctacatccccagccacatccagggcaacatcaccccccacgccatcgtgatcctgcccaagaccgacggcatggagatgctggtgtgctacgaggacgagggcgtgtacgtgaacacctacggcagaatcaccaaggacgtggtgctgcagtggggcgagatgcccaccagcgtggcctacatccacagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgttcttcatgaccctgaacagaaacagcatgatgaactggtag

SEQ ID NO: 102668 - DNA, 3996 bp, Artificial Sequence
  Description of Artificial Sequence: Synthetic coding sequence
atggccagcgacagccccgccagaagcctggacgagatcgacctgagcgccctgagagaccccgccggcatcttcgagctggtggagctggtgggcaacggcacctacggccaggtgtacaagggcagacacgtgaagaccggccagctggccgccatcaaggtgatggacgtgaccggcgacgaggaggaggagatcaagcaggagatcaacatgctgaagaagtacagccaccacagaaacatcgccacctactacggcgccttcatcaagaagaacccccccggcatggacgaccagctgtggctggtgatggagttctgcggcgccggcagcgtgaccgacctgatcaagaacaccaagggcaacaccctgaaggaggagtggatcgcctacatctgcagagagatcctgagaggcctgagccacctgcaccagcacaaggtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgacttcaagagcgacctgtggagcctgggcatcaccgccatcgagatggccgagggcgccccccccctgtgcgacatgcaccccatgagagccctgttcctgatccccagaaaccccgcccccagactgaagagcaagaagtggagcaagaagttccagagcttcatcgagagctgcctggtgaagaaccacagccagagacccgccaccgagcagctgatgaagcaccccttcatcagagaccagcccaacgagagacaggtgagaatccagctgaaggaccacatcgacagaaccaagaagaagagaggcgagaaggacgagaccgagtacgagtacagcggcagcgaggaggaggaggaggagaacgacagcggcgagcccagcagcatcctgaacctgcccggcgagagcaccctgagaagagacttcctgagactgcagctggccaacaaggagagaagcgaggccctgagaagacagcagctggagcagcagcagagagagaacgaggagcacaagagacagctgctggccgagagacagaagagaatcgaggagcagaaggagcagagaagaagactggaggagcagcagagaagagagaaggagctgagaaagcagcaggagagagagcagagaagacactacgaggagcagatgagaagagaggaggagagaagaagagccgagcacgagcaggagtacaagagaaagcagctggaggagcagagacaggccgagagactgcagagacagctgaagcaggagagagactacctggtgagcctgcagcaccagagacaggagcagagacccgtggagaagaagcccctgtaccactacaaggagggcatgagccccagcgagaagcccgcctgggccaaggaggtggaggagagaagcagactgaacagacagagcagccccgccatgccccacaaggtggccaacagaatcagcgaccccaacctgccccccagaagcgagagcttcagcatcagcggcgtgcagcccgccagaaccccccccatgctgagacccgtggacccccagatcccccacctggtggccgtgaagagccagggccccgccctgaccgccagccagagcgtgcacgagcagcccaccaagggcctgagcggcttccaggaggccctgaacgtgaccagccacagagtggagatgcccagacagaacagcgaccccaccagcgagaacccccccctgcccaccagaatcgagaagttcgacagaagcagctggctgagacaggaggaggacatcccccccaaggtgccccagagaaccaccagcatcagccccgccctggccagaaagaacagccccggcaacggcagcgccctgggccccagactgggcagccagcccatcagagccagcaaccccgacctgagaagaaccgagcccatcctggagagccccctgcagagaaccagcagcggcagcagcagcagcagcagcacccccagcagccagcccagcagccagggcggcagccagcccggcagccaggccggcagcagcgagagaaccagagtgagagccaacagcaagagcgagggcagccccgtgctgccccacgagcccgccaaggtgaagcccgaggagagcagagacatcaccagacccagcagacccgccagctacaagaaggccatcgacgaggacctgaccgccctggccaaggagctgagagagctgagaatcgaggagaccaacagacccatgaagaaggtgaccgactacagcagcagcagcgaggagagcgagagcagcgaggaggaggaggaggacggcgagagcgagacccacgacggcaccgtggccgtgagcgacatccccagactgatccccaccggcgcccccggcagcaacgagcagtacaacgtgggcatggtgggcacccacggcctggagaccagccacgccgacagcttcagcggcagcatcagcagagagggcaccctgatgatcagagagaccagcggcgagaagaagagaagcggccacagcgacagcaacggcttcgccggccacatcaacctgcccgacctggtgcagcagagccacagccccgccggcacccccaccgagggcctgggcagagtgagcacccacagccaggagatggacagcggcaccgagtacggcatgggcagcagcaccaaggccagcttcacccccttcgtggaccccagagtgtaccagaccagccccaccgacgaggacgaggaggacgaggagagcagcgccgccgccctgttcaccagcgagctgctgagacaggagcaggccaagctgaacgaggccagaaagatcagcgtggtgaacgtgaaccccaccaacatcagaccccacagcgacacccccgagatcagaaagtacaagaagagattcaacagcgagatcctgtgcgccgccctgtggggcgtgaacctgctggtgggcaccgagaacggcctgatgctgctggacagaagcggccagggcaaggtgtacaacctgatcaacagaagaagattccagcagatggacgtgctggagggcctgaacgtgctggtgaccatcagcggcaagaagaacaagctgagagtgtactacctgagctggctgagaaacagaatcctgcacaacgaccccgaggtggagaagaagcagggctggatcaccgtgggcgacctggagggctgcatccactacaaggtggtgaagtacgagagaatcaagttcctggtgatcgccctgaagaacgccgtggagatctacgcctgggcccccaagccctaccacaagttcatggccttcaagagcttcgccgacctgcagcacaagcccctgctggtggacctgaccgtggaggagggccagagactgaaggtgatcttcggcagccacaccggcttccacgtgatcgacgtggacagcggcaacagctacgacatctacatccccagccacatccagggcaacatcaccccccacgccatcgtgatcctgcccaagaccgacggcatggagatgctggtgtgctacgaggacgagggcgtgtacgtgaacacctacggcagaatcaccaaggacgtggtgctgcagtggggcgagatgcccaccagcgtggcctacatccacagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgttcttcatgaccctgaacagaaacagcatgatgaactggtag

SEQ ID NO: 102669 - DNA, 4017 bp, Artificial Sequence
  Description of Artificial Sequence: Synthetic coding sequence
atggccagcgacagccccgccagaagcctggacgagatcgacctgagcgccctgagagaccccgccggcatcttcgagctggtggagctggtgggcaacggcacctacggccaggtgtacaagggcagacacgtgaagaccggccagctggccgccatcaaggtgatggacgtgaccggcgacgaggaggaggagatcaagcaggagatcaacatgctgaagaagtacagccaccacagaaacatcgccacctactacggcgccttcatcaagaagaacccccccggcatggacgaccagctgtggctggtgatggagttctgcggcgccggcagcgtgaccgacctgatcaagaacaccaagggcaacaccctgaaggaggagtggatcgcctacatctgcagagagatcctgagaggcctgagccacctgcaccagcacaaggtgatccacagagacatcaagggccagaacgtgctgctgaccgagaacgccgaggtgaagatcgtggacttcggcgtgagcgcccagctggacagaaccgtgggcagaagaaacaccttcatcggcaccccctactggatggcccccgaggtgatcgcctgcgacgagaaccccgacgccacctacgacttcaagagcgacctgtggagcctgggcatcaccgccatcgagatggccgagggcgccccccccctgtgcgacatgcaccccatgagagccctgttcctgatccccagaaaccccgcccccagactgaagagcaagaagtggagcaagaagttccagagcttcatcgagagctgcctggtgaagaaccacagccagagacccgccaccgagcagctgatgaagcaccccttcatcagagaccagcccaacgagagacaggtgagaatccagctgaaggaccacatcgacagaaccaagaagaagagaggcgagaaggacgagaccgagtacgagtacagcggcagcgaggaggaggaggaggagaacgacagcggcgagcccagcagcatcctgaacctgcccggcgagagcaccctgagaagagacttcctgagactgcagctggccaacaaggagagaagcgaggccctgagaagacagcagctggagcagcagcagagagagaacgaggagcacaagagacagctgctggccgagagacagaagagaatcgaggagcagaaggagcagagaagaagactggaggagcagcagagaagagagaaggagctgagaaagcagcaggagagagagcagagaagacactacgaggagcagatgagaagagaggaggagagaagaagagccgagcacgagcaggagtacaagagaaagcagctggaggagcagagacaggccgagagactgcagagacagctgaagcaggagagagactacctggtgagcctgcagcaccagagacaggagcagagacccgtggagaagaagcccctgtaccactacaaggagggcatgagccccagcgagaagcccgcctgggccaaggaggtggaggagagaagcagactgaacagacagagcagccccgccatgccccacaaggtggccaacagaatcagcgaccccaacctgccccccagaagcgagagcttcagcatcagcggcgtgcagcccgccagaaccccccccatgctgagacccgtggacccccagatcccccacctggtggccgtgaagagccagggccccgccctgaccgccagccagagcgtgcacgagcagcccaccaagggcctgagcggcttccaggaggccctgaacgtgaccagccacagagtggagatgcccagacagaacagcgaccccaccagcgagaacccccccctgcccaccagaatcgagaagttcgacagaagcagctggctgagacaggaggaggacatcccccccaaggtgccccagagaaccaccagcatcagccccgccctggccagaaagaacagccccggcaacggcagcgccctgggccccagactgggcagccagcccatcagagccagcaaccccgacctgagaagaaccgagcccatcctggagagccccctgcagagaaccagcagcggcagcagcagcagcagcagcacccccagcagccagcccagcagccagggcggcagccagcccggcagccaggccggcagcagcgagagaaccagagtgagagccaacagcaagagcgagggcagccccgtgctgccccacgagcccgccaaggtgaagcccgaggagagcagagacatcaccagacccagcagacccgccgtgagcgccttcctgagcaagagcttcgagctgctgatctaccaggacctgaccgccctggccaaggagctgagagagctgagaatcgaggagaccaacagacccatgaagaaggtgaccgactacagcagcagcagcgaggagagcgagagcagcgaggaggaggaggaggacggcgagagcgagacccacgacggcaccgtggccgtgagcgacatccccagactgatccccaccggcgcccccggcagcaacgagcagtacaacgtgggcatggtgggcacccacggcctggagaccagccacgccgacagcttcagcggcagcatcagcagagagggcaccctgatgatcagagagaccagcggcgagaagaagagaagcggccacagcgacagcaacggcttcgccggccacatcaacctgcccgacctggtgcagcagagccacagccccgccggcacccccaccgagggcctgggcagagtgagcacccacagccaggagatggacagcggcaccgagtacggcatgggcagcagcaccaaggccagcttcacccccttcgtggaccccagagtgtaccagaccagccccaccgacgaggacgaggaggacgaggagagcagcgccgccgccctgttcaccagcgagctgctgagacaggagcaggccaagctgaacgaggccagaaagatcagcgtggtgaacgtgaaccccaccaacatcagaccccacagcgacacccccgagatcagaaagtacaagaagagattcaacagcgagatcctgtgcgccgccctgtggggcgtgaacctgctggtgggcaccgagaacggcctgatgctgctggacagaagcggccagggcaaggtgtacaacctgatcaacagaagaagattccagcagatggacgtgctggagggcctgaacgtgctggtgaccatcagcggcaagaagaacaagctgagagtgtactacctgagctggctgagaaacagaatcctgcacaacgaccccgaggtggagaagaagcagggctggatcaccgtgggcgacctggagggctgcatccactacaaggtggtgaagtacgagagaatcaagttcctggtgatcgccctgaagaacgccgtggagatctacgcctgggcccccaagccctaccacaagttcatggccttcaagagcttcgccgacctgcagcacaagcccctgctggtggacctgaccgtggaggagggccagagactgaaggtgatcttcggcagccacaccggcttccacgtgatcgacgtggacagcggcaacagctacgacatctacatccccagccacatccagggcaacatcaccccccacgccatcgtgatcctgcccaagaccgacggcatggagatgctggtgtgctacgaggacgagggcgtgtacgtgaacacctacggcagaatcaccaaggacgtggtgctgcagtggggcgagatgcccaccagcgtggcctacatccacagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgttcttcatgaccctgaacagaaacagcatgatgaactggtag

SEQ ID NO: 102670 - DNA, 4083 bp, Artificial Sequence
  Description of Artificial Sequence: Synthetic coding sequence
atggccagcgacagccccgccagaagcctggacgagatcgacctgagcgccctgagagaccccgccggcatcttcgagctggtggagctggtgggcaacggcacctacggccaggtgtacaagggcagacacgtgaagaccggccagctggccgccatcaaggtgatggacgtgaccggcgacgaggaggaggagatcaagcaggagatcaacatgctgaagaagtacagccaccacagaaacatcgccacctactacggcgccttcatcaagaagaacccccccggcatggacgaccagctgtggctggtgatggagttctgcggcgccggcagcgtgaccgacctgatcaagaacaccaagggcaacaccctgaaggaggagtggatcgcctacatctgcagagagatcctgagaggcctgagccacctgcaccagcacaaggtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgacttcaagagcgacctgtggagcctgggcatcaccgccatcgagatggccgagggcgccccccccctgtgcgacatgcaccccatgagagccctgttcctgatccccagaaaccccgcccccagactgaagagcaagaagtggagcaagaagttccagagcttcatcgagagctgcctggtgaagaaccacagccagagacccgccaccgagcagctgatgaagcaccccttcatcagagaccagcccaacgagagacaggtgagaatccagctgaaggaccacatcgacagaaccaagaagaagagaggcgagaaggacgagaccgagtacgagtacagcggcagcgaggaggaggaggaggagaacgacagcggcgagcccagcagcatcctgaacctgcccggcgagagcaccctgagaagagacttcctgagactgcagctggccaacaaggagagaagcgaggccctgagaagacagcagctggagcagcagcagagagagaacgaggagcacaagagacagctgctggccgagagacagaagagaatcgaggagcagaaggagcagagaagaagactggaggagcagcagagaagagagaaggagctgagaaagcagcaggagagagagcagagaagacactacgaggagcagatgagaagagaggaggagagaagaagagccgagcacgagcaggagtacatcagaagacagctggaggaggagcagagacagctggagatcctgcagcagcagctgctgcacgagcaggccctgctgctggagtacaagagaaagcagctggaggagcagagacaggccgagagactgcagagacagctgaagcaggagagagactacctggtgagcctgcagcaccagagacaggagcagagacccgtggagaagaagcccctgtaccactacaaggagggcatgagccccagcgagaagcccgcctgggccaaggaggtggaggagagaagcagactgaacagacagagcagccccgccatgccccacaaggtggccaacagaatcagcgaccccaacctgccccccagaagcgagagcttcagcatcagcggcgtgcagcccgccagaaccccccccatgctgagacccgtggacccccagatcccccacctggtggccgtgaagagccagggccccgccctgaccgccagccagagcgtgcacgagcagcccaccaagggcctgagcggcttccaggaggccctgaacgtgaccagccacagagtggagatgcccagacagaacagcgaccccaccagcgagaacccccccctgcccaccagaatcgagaagttcgacagaagcagctggctgagacaggaggaggacatcccccccaaggtgccccagagaaccaccagcatcagccccgccctggccagaaagaacagccccggcaacggcagcgccctgggccccagactgggcagccagcccatcagagccagcaaccccgacctgagaagaaccgagcccatcctggagagccccctgcagagaaccagcagcggcagcagcagcagcagcagcacccccagcagccagcccagcagccagggcggcagccagcccggcagccaggccggcagcagcgagagaaccagagtgagagccaacagcaagagcgagggcagccccgtgctgccccacgagcccgccaaggtgaagcccgaggagagcagagacatcaccagacccagcagacccgccagctacaagaaggccatcgacgaggacctgaccgccctggccaaggagctgagagagctgagaatcgaggagaccaacagacccatgaagaaggtgaccgactacagcagcagcagcgaggagagcgagagcagcgaggaggaggaggaggacggcgagagcgagacccacgacggcaccgtggccgtgagcgacatccccagactgatccccaccggcgcccccggcagcaacgagcagtacaacgtgggcatggtgggcacccacggcctggagaccagccacgccgacagcttcagcggcagcatcagcagagagggcaccctgatgatcagagagaccagcggcgagaagaagagaagcggccacagcgacagcaacggcttcgccggccacatcaacctgcccgacctggtgcagcagagccacagccccgccggcacccccaccgagggcctgggcagagtgagcacccacagccaggagatggacagcggcaccgagtacggcatgggcagcagcaccaaggccagcttcacccccttcgtggaccccagagtgtaccagaccagccccaccgacgaggacgaggaggacgaggagagcagcgccgccgccctgttcaccagcgagctgctgagacaggagcaggccaagctgaacgaggccagaaagatcagcgtggtgaacgtgaaccccaccaacatcagaccccacagcgacacccccgagatcagaaagtacaagaagagattcaacagcgagatcctgtgcgccgccctgtggggcgtgaacctgctggtgggcaccgagaacggcctgatgctgctggacagaagcggccagggcaaggtgtacaacctgatcaacagaagaagattccagcagatggacgtgctggagggcctgaacgtgctggtgaccatcagcggcaagaagaacaagctgagagtgtactacctgagctggctgagaaacagaatcctgcacaacgaccccgaggtggagaagaagcagggctggatcaccgtgggcgacctggagggctgcatccactacaaggtggtgaagtacgagagaatcaagttcctggtgatcgccctgaagaacgccgtggagatctacgcctgggcccccaagccctaccacaagttcatggccttcaagagcttcgccgacctgcagcacaagcccctgctggtggacctgaccgtggaggagggccagagactgaaggtgatcttcggcagccacaccggcttccacgtgatcgacgtggacagcggcaacagctacgacatctacatccccagccacatccagggcaacatcaccccccacgccatcgtgatcctgcccaagaccgacggcatggagatgctggtgtgctacgaggacgagggcgtgtacgtgaacacctacggcagaatcaccaaggacgtggtgctgcagtggggcgagatgcccaccagcgtggcctacatccacagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgttcttcatgaccctgaacagaaacagcatgatgaactggtag

SEQ ID NO: 102671 - DNA, 3894 bp, Artificial Sequence
  Description of Artificial Sequence: Synthetic coding sequence
atggccagcgacagccccgccagaagcctggacgagatcgacctgagcgccctgagagaccccgccggcatcttcgagctggtggagctggtgggcaacggcacctacggccaggtgtacaagggcagacacgtgaagaccggccagctggccgccatcaaggtgatggacgtgaccggcgacgaggaggaggagatcaagcaggagatcaacatgctgaagaagtacagccaccacagaaacatcgccacctactacggcgccttcatcaagaagaacccccccggcatggacgaccagctgtggctggtgatggagttctgcggcgccggcagcgtgaccgacctgatcaagaacaccaagggcaacaccctgaaggaggagtggatcgcctacatctgcagagagatcctgagaggcctgagccacctgcaccagcacaaggtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgacttcaagagcgacctgtggagcctgggcatcaccgccatcgagatggccgagggcgccccccccctgtgcgacatgcaccccatgagagccctgttcctgatccccagaaaccccgcccccagactgaagagcaagaagtggagcaagaagttccagagcttcatcgagagctgcctggtgaagaaccacagccagagacccgccaccgagcagctgatgaagcaccccttcatcagagaccagcccaacgagagacaggtgagaatccagctgaaggaccacatcgacagaaccaagaagaagagaggcgagaaggacgagaccgagtacgagtacagcggcagcgaggaggaggaggaggagaacgacagcggcgagcccagcagcatcctgaacctgcccggcgagagcaccctgagaagagacttcctgagactgcagctggccaacaaggagagaagcgaggccctgagaagacagcagctggagcagcagcagagagagaacgaggagcacaagagacagctgctggccgagagacagaagagaatcgaggagcagaaggagcagagaagaagactggaggagcagcagagaagagagaaggagctgagaaagcagcaggagagagagcagagaagacactacgaggagcagatgagaagagaggaggagagaagaagagccgagcacgagcaggagtacatcagaagacagctggaggaggagcagagacagctggagatcctgcagcagcagctgctgcacgagcaggccctgctgctggagtacaagagaaagcagctggaggagcagagacaggccgagagactgcagagacagctgaagcaggagagagactacctggtgagcctgcagcaccagagacaggagcagagacccgtggagaagaagcccctgtaccactacaaggagggcatgagccccagcgagaagcccgcctgggccaaggagatcccccacctggtggccgtgaagagccagggccccgccctgaccgccagccagagcgtgcacgagcagcccaccaagggcctgagcggcttccaggaggccctgaacgtgaccagccacagagtggagatgcccagacagaacagcgaccccaccagcgagaacccccccctgcccaccagaatcgagaagttcgacagaagcagctggctgagacaggaggaggacatcccccccaaggtgccccagagaaccaccagcatcagccccgccctggccagaaagaacagccccggcaacggcagcgccctgggccccagactgggcagccagcccatcagagccagcaaccccgacctgagaagaaccgagcccatcctggagagccccctgcagagaaccagcagcggcagcagcagcagcagcagcacccccagcagccagcccagcagccagggcggcagccagcccggcagccaggccggcagcagcgagagaaccagagtgagagccaacagcaagagcgagggcagccccgtgctgccccacgagcccgccaaggtgaagcccgaggagagcagagacatcaccagacccagcagacccgccgacctgaccgccctggccaaggagctgagagagctgagaatcgaggagaccaacagacccatgaagaaggtgaccgactacagcagcagcagcgaggagagcgagagcagcgaggaggaggaggaggacggcgagagcgagacccacgacggcaccgtggccgtgagcgacatccccagactgatccccaccggcgcccccggcagcaacgagcagtacaacgtgggcatggtgggcacccacggcctggagaccagccacgccgacagcttcagcggcagcatcagcagagagggcaccctgatgatcagagagaccagcggcgagaagaagagaagcggccacagcgacagcaacggcttcgccggccacatcaacctgcccgacctggtgcagcagagccacagccccgccggcacccccaccgagggcctgggcagagtgagcacccacagccaggagatggacagcggcaccgagtacggcatgggcagcagcaccaaggccagcttcacccccttcgtggaccccagagtgtaccagaccagccccaccgacgaggacgaggaggacgaggagagcagcgccgccgccctgttcaccagcgagctgctgagacaggagcaggccaagctgaacgaggccagaaagatcagcgtggtgaacgtgaaccccaccaacatcagaccccacagcgacacccccgagatcagaaagtacaagaagagattcaacagcgagatcctgtgcgccgccctgtggggcgtgaacctgctggtgggcaccgagaacggcctgatgctgctggacagaagcggccagggcaaggtgtacaacctgatcaacagaagaagattccagcagatggacgtgctggagggcctgaacgtgctggtgaccatcagcggcaagaagaacaagctgagagtgtactacctgagctggctgagaaacagaatcctgcacaacgaccccgaggtggagaagaagcagggctggatcaccgtgggcgacctggagggctgcatccactacaaggtggtgaagtacgagagaatcaagttcctggtgatcgccctgaagaacgccgtggagatctacgcctgggcccccaagccctaccacaagttcatggccttcaagagcttcgccgacctgcagcacaagcccctgctggtggacctgaccgtggaggagggccagagactgaaggtgatcttcggcagccacaccggcttccacgtgatcgacgtggacagcggcaacagctacgacatctacatccccagccacatccagggcaacatcaccccccacgccatcgtgatcctgcccaagaccgacggcatggagatgctggtgtgctacgaggacgagggcgtgtacgtgaacacctacggcagaatcaccaaggacgtggtgctgcagtggggcgagatgcccaccagcgtggcctacatccacagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgttcttcatgaccctgaacagaaacagcatgatgaactggtag

SEQ ID NO: 102672 - DNA, 3972 bp, Artificial Sequence
  Description of Artificial Sequence: Synthetic coding sequence
atggccagcgacagccccgccagaagcctggacgagatcgacctgagcgccctgagagaccccgccggcatcttcgagctggtggagctggtgggcaacggcacctacggccaggtgtacaagggcagacacgtgaagaccggccagctggccgccatcaaggtgatggacgtgaccggcgacgaggaggaggagatcaagcaggagatcaacatgctgaagaagtacagccaccacagaaacatcgccacctactacggcgccttcatcaagaagaacccccccggcatggacgaccagctgtggctggtgatggagttctgcggcgccggcagcgtgaccgacctgatcaagaacaccaagggcaacaccctgaaggaggagtggatcgcctacatctgcagagagatcctgagaggcctgagccacctgcaccagcacaaggtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgacttcaagagcgacctgtggagcctgggcatcaccgccatcgagatggccgagggcgccccccccctgtgcgacatgcaccccatgagagccctgttcctgatccccagaaaccccgcccccagactgaagagcaagaagtggagcaagaagttccagagcttcatcgagagctgcctggtgaagaaccacagccagagacccgccaccgagcagctgatgaagcaccccttcatcagagaccagcccaacgagagacaggtgagaatccagctgaaggaccacatcgacagaaccaagaagaagagaggcgagaaggacgagaccgagtacgagtacagcggcagcgaggaggaggaggaggagaacgacagcggcgagcccagcagcatcctgaacctgcccggcgagagcaccctgagaagagacttcctgagactgcagctggccaacaaggagagaagcgaggccctgagaagacagcagctggagcagcagcagagagagaacgaggagcacaagagacagctgctggccgagagacagaagagaatcgaggagcagaaggagcagagaagaagactggaggagcagcagagaagagagaaggagctgagaaagcagcaggagagagagcagagaagacactacgaggagcagatgagaagagaggaggagagaagaagagccgagcacgagcaggagtacaagagaaagcagctggaggagcagagacaggccgagagactgcagagacagctgaagcaggagagagactacctggtgagcctgcagcaccagagacaggagcagagacccgtggagaagaagcccctgtaccactacaaggagggcatgagccccagcgagaagcccgcctgggccaaggaggtggaggagagaagcagactgaacagacagagcagccccgccatgccccacaaggtggccaacagaatcagcgaccccaacctgccccccagaagcgagagcttcagcatcagcggcgtgcagcccgccagaaccccccccatgctgagacccgtggacccccagatcccccacctggtggccgtgaagagccagggccccgccctgaccgccagccagagcgtgcacgagcagcccaccaagggcctgagcggcttccaggaggccctgaacgtgaccagccacagagtggagatgcccagacagaacagcgaccccaccagcgagaacccccccctgcccaccagaatcgagaagttcgacagaagcagctggctgagacaggaggaggacatcccccccaaggtgccccagagaaccaccagcatcagccccgccctggccagaaagaacagccccggcaacggcagcgccctgggccccagactgggcagccagcccatcagagccagcaaccccgacctgagaagaaccgagcccatcctggagagccccctgcagagaaccagcagcggcagcagcagcagcagcagcacccccagcagccagcccagcagccagggcggcagccagcccggcagccaggccggcagcagcgagagaaccagagtgagagccaacagcaagagcgagggcagccccgtgctgccccacgagcccgccaaggtgaagcccgaggagagcagagacatcaccagacccagcagacccgccgacctgaccgccctggccaaggagctgagagagctgagaatcgaggagaccaacagacccatgaagaaggtgaccgactacagcagcagcagcgaggagagcgagagcagcgaggaggaggaggaggacggcgagagcgagacccacgacggcaccgtggccgtgagcgacatccccagactgatccccaccggcgcccccggcagcaacgagcagtacaacgtgggcatggtgggcacccacggcctggagaccagccacgccgacagcttcagcggcagcatcagcagagagggcaccctgatgatcagagagaccagcggcgagaagaagagaagcggccacagcgacagcaacggcttcgccggccacatcaacctgcccgacctggtgcagcagagccacagccccgccggcacccccaccgagggcctgggcagagtgagcacccacagccaggagatggacagcggcaccgagtacggcatgggcagcagcaccaaggccagcttcacccccttcgtggaccccagagtgtaccagaccagccccaccgacgaggacgaggaggacgaggagagcagcgccgccgccctgttcaccagcgagctgctgagacaggagcaggccaagctgaacgaggccagaaagatcagcgtggtgaacgtgaaccccaccaacatcagaccccacagcgacacccccgagatcagaaagtacaagaagagattcaacagcgagatcctgtgcgccgccctgtggggcgtgaacctgctggtgggcaccgagaacggcctgatgctgctggacagaagcggccagggcaaggtgtacaacctgatcaacagaagaagattccagcagatggacgtgctggagggcctgaacgtgctggtgaccatcagcggcaagaagaacaagctgagagtgtactacctgagctggctgagaaacagaatcctgcacaacgaccccgaggtggagaagaagcagggctggatcaccgtgggcgacctggagggctgcatccactacaaggtggtgaagtacgagagaatcaagttcctggtgatcgccctgaagaacgccgtggagatctacgcctgggcccccaagccctaccacaagttcatggccttcaagagcttcgccgacctgcagcacaagcccctgctggtggacctgaccgtggaggagggccagagactgaaggtgatcttcggcagccacaccggcttccacgtgatcgacgtggacagcggcaacagctacgacatctacatccccagccacatccagggcaacatcaccccccacgccatcgtgatcctgcccaagaccgacggcatggagatgctggtgtgctacgaggacgagggcgtgtacgtgaacacctacggcagaatcaccaaggacgtggtgctgcagtggggcgagatgcccaccagcgtggcctacatccacagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgttcttcatgaccctgaacagaaacagcatgatgaactggtag

SEQ ID NO: 102673 - DNA, 3807 bp, Artificial Sequence
  Description of Artificial Sequence: Synthetic coding sequence
atggccagcgacagccccgccagaagcctggacgagatcgacctgagcgccctgagagaccccgccggcatcttcgagctggtggagctggtgggcaacggcacctacggccaggtgtacaagggcagacacgtgaagaccggccagctggccgccatcaaggtgatggacgtgaccggcgacgaggaggaggagatcaagcaggagatcaacatgctgaagaagtacagccaccacagaaacatcgccacctactacggcgccttcatcaagaagaacccccccggcatggacgaccagctgtggctggtgatggagttctgcggcgccggcagcgtgaccgacctgatcaagaacaccaagggcaacaccctgaaggaggagtggatcgcctacatctgcagagagatcctgagaggcctgagccacctgcaccagcacaaggtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgacttcaagagcgacctgtggagcctgggcatcaccgccatcgagatggccgagggcgccccccccctgtgcgacatgcaccccatgagagccctgttcctgatccccagaaaccccgcccccagactgaagagcaagaagtggagcaagaagttccagagcttcatcgagagctgcctggtgaagaaccacagccagagacccgccaccgagcagctgatgaagcaccccttcatcagagaccagcccaacgagagacaggtgagaatccagctgaaggaccacatcgacagaaccaagaagaagagaggcgagaaggacgagaccgagtacgagtacagcggcagcgaggaggaggaggaggagaacgacagcggcgagcccagcagcatcctgaacctgcccggcgagagcaccctgagaagagacttcctgagactgcagctggccaacaaggagagaagcgaggccctgagaagacagcagctggagcagcagcagagagagaacgaggagcacaagagacagctgctggccgagagacagaagagaatcgaggagcagaaggagcagagaagaagactggaggagcagcagagaagagagaaggagctgagaaagcagcaggagagagagcagagaagacactacgaggagcagatgagaagagaggaggagagaagaagagccgagcacgagcaggagtacaagagaaagcagctggaggagcagagacaggccgagagactgcagagacagctgaagcaggagagagactacctggtgagcctgcagcaccagagacaggagcagagacccgtggagaagaagcccctgtaccactacaaggagggcatgagccccagcgagaagcccgcctgggccaaggagatcccccacctggtggccgtgaagagccagggccccgccctgaccgccagccagagcgtgcacgagcagcccaccaagggcctgagcggcttccaggaggccctgaacgtgaccagccacagagtggagatgcccagacagaacagcgaccccaccagcgagaacccccccctgcccaccagaatcgagaagttcgacagaagcagctggctgagacaggaggaggacatcccccccaaggtgccccagagaaccaccagcatcagccccgccctggccagaaagaacagccccggcaacggcagcgccctgggccccagactgggcagccagcccatcagagccagcaaccccgacctgagaagaaccgagcccatcctggagagccccctgcagagaaccagcagcggcagcagcagcagcagcagcacccccagcagccagcccagcagccagggcggcagccagcccggcagccaggccggcagcagcgagagaaccagagtgagagccaacagcaagagcgagggcagccccgtgctgccccacgagcccgccaaggtgaagcccgaggagagcagagacatcaccagacccagcagacccgccgacctgaccgccctggccaaggagctgagagagctgagaatcgaggagaccaacagacccatgaagaaggtgaccgactacagcagcagcagcgaggagagcgagagcagcgaggaggaggaggaggacggcgagagcgagacccacgacggcaccgtggccgtgagcgacatccccagactgatccccaccggcgcccccggcagcaacgagcagtacaacgtgggcatggtgggcacccacggcctggagaccagccacgccgacagcttcagcggcagcatcagcagagagggcaccctgatgatcagagagaccagcggcgagaagaagagaagcggccacagcgacagcaacggcttcgccggccacatcaacctgcccgacctggtgcagcagagccacagccccgccggcacccccaccgagggcctgggcagagtgagcacccacagccaggagatggacagcggcaccgagtacggcatgggcagcagcaccaaggccagcttcacccccttcgtggaccccagagtgtaccagaccagccccaccgacgaggacgaggaggacgaggagagcagcgccgccgccctgttcaccagcgagctgctgagacaggagcaggccaagctgaacgaggccagaaagatcagcgtggtgaacgtgaaccccaccaacatcagaccccacagcgacacccccgagatcagaaagtacaagaagagattcaacagcgagatcctgtgcgccgccctgtggggcgtgaacctgctggtgggcaccgagaacggcctgatgctgctggacagaagcggccagggcaaggtgtacaacctgatcaacagaagaagattccagcagatggacgtgctggagggcctgaacgtgctggtgaccatcagcggcaagaagaacaagctgagagtgtactacctgagctggctgagaaacagaatcctgcacaacgaccccgaggtggagaagaagcagggctggatcaccgtgggcgacctggagggctgcatccactacaaggtggtgaagtacgagagaatcaagttcctggtgatcgccctgaagaacgccgtggagatctacgcctgggcccccaagccctaccacaagttcatggccttcaagagcttcgccgacctgcagcacaagcccctgctggtggacctgaccgtggaggagggccagagactgaaggtgatcttcggcagccacaccggcttccacgtgatcgacgtggacagcggcaacagctacgacatctacatccccagccacatccagggcaacatcaccccccacgccatcgtgatcctgcccaagaccgacggcatggagatgctggtgtgctacgaggacgagggcgtgtacgtgaacacctacggcagaatcaccaaggacgtggtgctgcagtggggcgagatgcccaccagcgtggcctacatccacagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgttcttcatgaccctgaacagaaacagcatgatgaactggtag

SEQ ID NO: 102674 - DNA, 3918 bp, Artificial Sequence
  Description of Artificial Sequence: Synthetic coding sequence
atggccagcgacagccccgccagaagcctggacgagatcgacctgagcgccctgagagaccccgccggcatcttcgagctggtggagctggtgggcaacggcacctacggccaggtgtacaagggcagacacgtgaagaccggccagctggccgccatcaaggtgatggacgtgaccggcgacgaggaggaggagatcaagcaggagatcaacatgctgaagaagtacagccaccacagaaacatcgccacctactacggcgccttcatcaagaagaacccccccggcatggacgaccagctgtggctggtgatggagttctgcggcgccggcagcgtgaccgacctgatcaagaacaccaagggcaacaccctgaaggaggagtggatcgcctacatctgcagagagatcctgagaggcctgagccacctgcaccagcacaaggtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgacttcaagagcgacctgtggagcctgggcatcaccgccatcgagatggccgagggcgccccccccctgtgcgacatgcaccccatgagagccctgttcctgatccccagaaaccccgcccccagactgaagagcaagaagtggagcaagaagttccagagcttcatcgagagctgcctggtgaagaaccacagccagagacccgccaccgagcagctgatgaagcaccccttcatcagagaccagcccaacgagagacaggtgagaatccagctgaaggaccacatcgacagaaccaagaagaagagaggcgagaaggacgagaccgagtacgagtacagcggcagcgaggaggaggaggaggagaacgacagcggcgagcccagcagcatcctgaacctgcccggcgagagcaccctgagaagagacttcctgagactgcagctggccaacaaggagagaagcgaggccctgagaagacagcagctggagcagcagcagagagagaacgaggagcacaagagacagctgctggccgagagacagaagagaatcgaggagcagaaggagcagagaagaagactggaggagcagcagagaagagagaaggagctgagaaagcagcaggagagagagcagagaagacactacgaggagcagatgagaagagaggaggagagaagaagagccgagcacgagcaggagtacatcagaagacagctggaggaggagcagagacagctggagatcctgcagcagcagctgctgcacgagcaggccctgctgctggagtacaagagaaagcagctggaggagcagagacaggccgagagactgcagagacagctgaagcaggagagagactacctggtgagcctgcagcaccagagacaggagcagagacccgtggagaagaagcccctgtaccactacaaggagggcatgagccccagcgagaagcccgcctgggccaaggagatcccccacctggtggccgtgaagagccagggccccgccctgaccgccagccagagcgtgcacgagcagcccaccaagggcctgagcggcttccaggaggccctgaacgtgaccagccacagagtggagatgcccagacagaacagcgaccccaccagcgagaacccccccctgcccaccagaatcgagaagttcgacagaagcagctggctgagacaggaggaggacatcccccccaaggtgccccagagaaccaccagcatcagccccgccctggccagaaagaacagccccggcaacggcagcgccctgggccccagactgggcagccagcccatcagagccagcaaccccgacctgagaagaaccgagcccatcctggagagccccctgcagagaaccagcagcggcagcagcagcagcagcagcacccccagcagccagcccagcagccagggcggcagccagcccggcagccaggccggcagcagcgagagaaccagagtgagagccaacagcaagagcgagggcagccccgtgctgccccacgagcccgccaaggtgaagcccgaggagagcagagacatcaccagacccagcagacccgccagctacaagaaggccatcgacgaggacctgaccgccctggccaaggagctgagagagctgagaatcgaggagaccaacagacccatgaagaaggtgaccgactacagcagcagcagcgaggagagcgagagcagcgaggaggaggaggaggacggcgagagcgagacccacgacggcaccgtggccgtgagcgacatccccagactgatccccaccggcgcccccggcagcaacgagcagtacaacgtgggcatggtgggcacccacggcctggagaccagccacgccgacagcttcagcggcagcatcagcagagagggcaccctgatgatcagagagaccagcggcgagaagaagagaagcggccacagcgacagcaacggcttcgccggccacatcaacctgcccgacctggtgcagcagagccacagccccgccggcacccccaccgagggcctgggcagagtgagcacccacagccaggagatggacagcggcaccgagtacggcatgggcagcagcaccaaggccagcttcacccccttcgtggaccccagagtgtaccagaccagccccaccgacgaggacgaggaggacgaggagagcagcgccgccgccctgttcaccagcgagctgctgagacaggagcaggccaagctgaacgaggccagaaagatcagcgtggtgaacgtgaaccccaccaacatcagaccccacagcgacacccccgagatcagaaagtacaagaagagattcaacagcgagatcctgtgcgccgccctgtggggcgtgaacctgctggtgggcaccgagaacggcctgatgctgctggacagaagcggccagggcaaggtgtacaacctgatcaacagaagaagattccagcagatggacgtgctggagggcctgaacgtgctggtgaccatcagcggcaagaagaacaagctgagagtgtactacctgagctggctgagaaacagaatcctgcacaacgaccccgaggtggagaagaagcagggctggatcaccgtgggcgacctggagggctgcatccactacaaggtggtgaagtacgagagaatcaagttcctggtgatcgccctgaagaacgccgtggagatctacgcctgggcccccaagccctaccacaagttcatggccttcaagagcttcgccgacctgcagcacaagcccctgctggtggacctgaccgtggaggagggccagagactgaaggtgatcttcggcagccacaccggcttccacgtgatcgacgtggacagcggcaacagctacgacatctacatccccagccacatccagggcaacatcaccccccacgccatcgtgatcctgcccaagaccgacggcatggagatgctggtgtgctacgaggacgagggcgtgtacgtgaacacctacggcagaatcaccaaggacgtggtgctgcagtggggcgagatgcccaccagcgtggcctacatccacagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgttcttcatgaccctgaacagaaacagcatgatgaactggtag

SEQ ID NO: 102675 - DNA, 3939 bp, Artificial Sequence
  Description of Artificial Sequence: Synthetic coding sequence
atggccagcgacagccccgccagaagcctggacgagatcgacctgagcgccctgagagaccccgccggcatcttcgagctggtggagctggtgggcaacggcacctacggccaggtgtacaagggcagacacgtgaagaccggccagctggccgccatcaaggtgatggacgtgaccggcgacgaggaggaggagatcaagcaggagatcaacatgctgaagaagtacagccaccacagaaacatcgccacctactacggcgccttcatcaagaagaacccccccggcatggacgaccagctgtggctggtgatggagttctgcggcgccggcagcgtgaccgacctgatcaagaacaccaagggcaacaccctgaaggaggagtggatcgcctacatctgcagagagatcctgagaggcctgagccacctgcaccagcacaaggtgatccacagagacatcaagggccagaacgtgctgctgaccgagaacgccgaggtgaagatcgtggacttcggcgtgagcgcccagctggacagaaccgtgggcagaagaaacaccttcatcggcaccccctactggatggcccccgaggtgatcgcctgcgacgagaaccccgacgccacctacgacttcaagagcgacctgtggagcctgggcatcaccgccatcgagatggccgagggcgccccccccctgtgcgacatgcaccccatgagagccctgttcctgatccccagaaaccccgcccccagactgaagagcaagaagtggagcaagaagttccagagcttcatcgagagctgcctggtgaagaaccacagccagagacccgccaccgagcagctgatgaagcaccccttcatcagagaccagcccaacgagagacaggtgagaatccagctgaaggaccacatcgacagaaccaagaagaagagaggcgagaaggacgagaccgagtacgagtacagcggcagcgaggaggaggaggaggagaacgacagcggcgagcccagcagcatcctgaacctgcccggcgagagcaccctgagaagagacttcctgagactgcagctggccaacaaggagagaagcgaggccctgagaagacagcagctggagcagcagcagagagagaacgaggagcacaagagacagctgctggccgagagacagaagagaatcgaggagcagaaggagcagagaagaagactggaggagcagcagagaagagagaaggagctgagaaagcagcaggagagagagcagagaagacactacgaggagcagatgagaagagaggaggagagaagaagagccgagcacgagcaggagtacatcagaagacagctggaggaggagcagagacagctggagatcctgcagcagcagctgctgcacgagcaggccctgctgctggagtacaagagaaagcagctggaggagcagagacaggccgagagactgcagagacagctgaagcaggagagagactacctggtgagcctgcagcaccagagacaggagcagagacccgtggagaagaagcccctgtaccactacaaggagggcatgagccccagcgagaagcccgcctgggccaaggagatcccccacctggtggccgtgaagagccagggccccgccctgaccgccagccagagcgtgcacgagcagcccaccaagggcctgagcggcttccaggaggccctgaacgtgaccagccacagagtggagatgcccagacagaacagcgaccccaccagcgagaacccccccctgcccaccagaatcgagaagttcgacagaagcagctggctgagacaggaggaggacatcccccccaaggtgccccagagaaccaccagcatcagccccgccctggccagaaagaacagccccggcaacggcagcgccctgggccccagactgggcagccagcccatcagagccagcaaccccgacctgagaagaaccgagcccatcctggagagccccctgcagagaaccagcagcggcagcagcagcagcagcagcacccccagcagccagcccagcagccagggcggcagccagcccggcagccaggccggcagcagcgagagaaccagagtgagagccaacagcaagagcgagggcagccccgtgctgccccacgagcccgccaaggtgaagcccgaggagagcagagacatcaccagacccagcagacccgccgtgagcgccttcctgagcaagagcttcgagctgctgatctaccaggacctgaccgccctggccaaggagctgagagagctgagaatcgaggagaccaacagacccatgaagaaggtgaccgactacagcagcagcagcgaggagagcgagagcagcgaggaggaggaggaggacggcgagagcgagacccacgacggcaccgtggccgtgagcgacatccccagactgatccccaccggcgcccccggcagcaacgagcagtacaacgtgggcatggtgggcacccacggcctggagaccagccacgccgacagcttcagcggcagcatcagcagagagggcaccctgatgatcagagagaccagcggcgagaagaagagaagcggccacagcgacagcaacggcttcgccggccacatcaacctgcccgacctggtgcagcagagccacagccccgccggcacccccaccgagggcctgggcagagtgagcacccacagccaggagatggacagcggcaccgagtacggcatgggcagcagcaccaaggccagcttcacccccttcgtggaccccagagtgtaccagaccagccccaccgacgaggacgaggaggacgaggagagcagcgccgccgccctgttcaccagcgagctgctgagacaggagcaggccaagctgaacgaggccagaaagatcagcgtggtgaacgtgaaccccaccaacatcagaccccacagcgacacccccgagatcagaaagtacaagaagagattcaacagcgagatcctgtgcgccgccctgtggggcgtgaacctgctggtgggcaccgagaacggcctgatgctgctggacagaagcggccagggcaaggtgtacaacctgatcaacagaagaagattccagcagatggacgtgctggagggcctgaacgtgctggtgaccatcagcggcaagaagaacaagctgagagtgtactacctgagctggctgagaaacagaatcctgcacaacgaccccgaggtggagaagaagcagggctggatcaccgtgggcgacctggagggctgcatccactacaaggtggtgaagtacgagagaatcaagttcctggtgatcgccctgaagaacgccgtggagatctacgcctgggcccccaagccctaccacaagttcatggccttcaagagcttcgccgacctgcagcacaagcccctgctggtggacctgaccgtggaggagggccagagactgaaggtgatcttcggcagccacaccggcttccacgtgatcgacgtggacagcggcaacagctacgacatctacatccccagccacatccagggcaacatcaccccccacgccatcgtgatcctgcccaagaccgacggcatggagatgctggtgtgctacgaggacgagggcgtgtacgtgaacacctacggcagaatcaccaaggacgtggtgctgcagtggggcgagatgcccaccagcgtggcctacatccacagcaaccagatcatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgttcttcatgaccctgaacagaaacagcatgatgaactggtag

SEQ ID NO: 102676 - DNA, 1725 bp, Artificial Sequence
  Description of Artificial Sequence: Synthetic coding sequence
atgcccccccagctgcaggagaccagaatgaacagaagcatccccgtggaggtggacgagagcgagccctaccccagccagctgctgaagcccatccccgagtacagccccgaggaggagagcgagccccccgcccccaacatcagaaacatggcccccaacagcctgagcgcccccaccatgctgcacaacagcagcggcgacttcagccaggcccacagcaccctgaagctggccaaccaccagagacccgtgagcagacaggtgacctgcctgagaacccaggtgctggaggacagcgaggacagcttctgcagaagacaccccggcctgggcaaggccttccccagcggctgcagcgccgtgagcgagcccgccagcgagagcgtggtgggcgccctgcccgccgagcaccagttcagcttcatggagaagagaaaccagtggctggtgagccagctgagcgccgccagccccgacaccggccacgacagcgacaagagcgaccagagcctgcccaacgccagcgccgacagcctgggcggcagccaggagatggtgcagagaccccagccccacagaaacagagccggcctggacctgcccaccatcgacaccggctacgacagccagccccaggacgtgctgggcatcagacagctggagagacccctgcccctgaccagcgtgtgctacccccaggacctgcccagacccctgagaagcagagagttcccccagttcgagccccagagataccccgcctgcgcccagatgctgccccccaacctgagcccccacgccccctggaactaccactaccactgccccggcagccccgaccaccaggtgccctacggccacgactaccccagagccgcctaccagcaggtgatccagcccgccctgcccggccagcccctgcccggcgccagcgtgagaggcctgcaccccgtgcagaaggtgatcctgaactaccccagcccctgggaccacgaggagagacccgcccagagagactgcagcttccccggcctgcccagacaccaggaccagccccaccaccagccccccaacagagccggcgcccccggcgagagcctggagtgccccgccgagctgagaccccaggtgccccagccccccagccccgccgccgtgcccagaccccccagcaacccccccgccagaggcaccctgaagaccagcaacctgcccgaggagctgagaaaggtgttcatcacctacagcatggacaccgccatggaggtggtgaagttcgtgaacttcctgctggtgaacggcttccagaccgccatcgacatcttcgaggacagaatcagaggcatcgacatcatcaagtggatggagagatacctgagagacaagaccgtgatgatcatcgtggccatcagccccaagtacaagcaggacgtggagggcgccgagagccagctggacgaggacgagcacggcctgcacaccaagtacatccacagaatgatgcagatcgagttcatcaagcagggcagcatgaacttcagattcatccccgtgctgttccccaacgccaagaaggagcacgtgcccacctggctgcagaacacccacgtgtacagctggcccaagaacaagaagaacatcctgctgagactgctgagagaggaggagtacgtggccccccccagaggccccctgcccaccctgcaggtggtgcccctgtag

SEQ ID NO: 102677 - DNA, 1695 bp, Artificial Sequence
  Description of Artificial Sequence: Synthetic coding sequence
atgaacagaagcatccccgtggaggtggacgagagcgagccctaccccagccagctgctgaagcccatccccgagtacagccccgaggaggagagcgagccccccgcccccaacatcagaaacatggcccccaacagcctgagcgcccccaccatgctgcacaacagcagcggcgacttcagccaggcccacagcaccctgaagctggccaaccaccagagacccgtgagcagacaggtgacctgcctgagaacccaggtgctggaggacagcgaggacagcttctgcagaagacaccccggcctgggcaaggccttccccagcggctgcagcgccgtgagcgagcccgccagcgagagcgtggtgggcgccctgcccgccgagcaccagttcagcttcatggagaagagaaaccagtggctggtgagccagctgagcgccgccagccccgacaccggccacgacagcgacaagagcgaccagagcctgcccaacgccagcgccgacagcctgggcggcagccaggagatggtgcagagaccccagccccacagaaacagagccggcctggacctgcccaccatcgacaccggctacgacagccagccccaggacgtgctgggcatcagacagctggagagacccctgcccctgaccagcgtgtgctacccccaggacctgcccagacccctgagaagcagagagttcccccagttcgagccccagagataccccgcctgcgcccagatgctgccccccaacctgagcccccacgccccctggaactaccactaccactgccccggcagccccgaccaccaggtgccctacggccacgactaccccagagccgcctaccagcaggtgatccagcccgccctgcccggccagcccctgcccggcgccagcgtgagaggcctgcaccccgtgcagaaggtgatcctgaactaccccagcccctgggaccacgaggagagacccgcccagagagactgcagcttccccggcctgcccagacaccaggaccagccccaccaccagccccccaacagagccggcgcccccggcgagagcctggagtgccccgccgagctgagaccccaggtgccccagccccccagccccgccgccgtgcccagaccccccagcaacccccccgccagaggcaccctgaagaccagcaacctgcccgaggagctgagaaaggtgttcatcacctacagcatggacaccgccatggaggtggtgaagttcgtgaacttcctgctggtgaacggcttccagaccgccatcgacatcttcgaggacagaatcagaggcatcgacatcatcaagtggatggagagatacctgagagacaccgtgatgatcatcgtggccatcagccccaagtacaagcaggacgtggagggcgccgagagccagctggacgaggacgagcacggcctgcacaccaagtacatccacagaatgatgcagatcgagttcatcaagcagggcagcatgaacttcagattcatccccgtgctgttccccaacgccaagaaggagcacgtgcccacctggctgcagaacacccacgtgtacagctggcccaagaacaagaagaacatcctgctgagactgctgagagaggaggagtacgtggccccccccagaggccccctgcccaccctgcaggtggtgcccctgtag

SEQ ID NO: 102678 - DNA, 1698 bp, Artificial Sequence
  Description of Artificial Sequence: Synthetic coding sequence
atgaacagaagcatccccgtggaggtggacgagagcgagccctaccccagccagctgctgaagcccatccccgagtacagccccgaggaggagagcgagccccccgcccccaacatcagaaacatggcccccaacagcctgagcgcccccaccatgctgcacaacagcagcggcgacttcagccaggcccacagcaccctgaagctggccaaccaccagagacccgtgagcagacaggtgacctgcctgagaacccaggtgctggaggacagcgaggacagcttctgcagaagacaccccggcctgggcaaggccttccccagcggctgcagcgccgtgagcgagcccgccagcgagagcgtggtgggcgccctgcccgccgagcaccagttcagcttcatggagaagagaaaccagtggctggtgagccagctgagcgccgccagccccgacaccggccacgacagcgacaagagcgaccagagcctgcccaacgccagcgccgacagcctgggcggcagccaggagatggtgcagagaccccagccccacagaaacagagccggcctggacctgcccaccatcgacaccggctacgacagccagccccaggacgtgctgggcatcagacagctggagagacccctgcccctgaccagcgtgtgctacccccaggacctgcccagacccctgagaagcagagagttcccccagttcgagccccagagataccccgcctgcgcccagatgctgccccccaacctgagcccccacgccccctggaactaccactaccactgccccggcagccccgaccaccaggtgccctacggccacgactaccccagagccgcctaccagcaggtgatccagcccgccctgcccggccagcccctgcccggcgccagcgtgagaggcctgcaccccgtgcagaaggtgatcctgaactaccccagcccctgggaccacgaggagagacccgcccagagagactgcagcttccccggcctgcccagacaccaggaccagccccaccaccagccccccaacagagccggcgcccccggcgagagcctggagtgccccgccgagctgagaccccaggtgccccagccccccagccccgccgccgtgcccagaccccccagcaacccccccgccagaggcaccctgaagaccagcaacctgcccgaggagctgagaaaggtgttcatcacctacagcatggacaccgccatggaggtggtgaagttcgtgaacttcctgctggtgaacggcttccagaccgccatcgacatcttcgaggacagaatcagaggcatcgacatcatcaagtggatggagagatacctgagagacaagaccgtgatgatcatcgtggccatcagccccaagtacaagcaggacgtggagggcgccgagagccagctggacgaggacgagcacggcctgcacaccaagtacatccacagaatgatgcagatcgagttcatcaagcagggcagcatgaacttcagattcatccccgtgctgttccccaacgccaagaaggagcacgtgcccacctggctgcagaacacccacgtgtacagctggcccaagaacaagaagaacatcctgctgagactgctgagagaggaggagtacgtggccccccccagaggccccctgcccaccctgcaggtggtgcccctgtag

SEQ ID NO: 102679 - DNA, 1725 bp, Artificial Sequence
  Description of Artificial Sequence: Synthetic coding sequence
atggccccccagctggaggagaccagaatgaacagaagcatccccgtggaggtggacgagagcgagccctaccccagccagctgctgaagcccatccccgagtacagccccgaggaggagagcgagccccccgcccccaacatcagaaacatggcccccaacagcctgagcgcccccaccatgctgcacaacagcagcggcgacttcagccaggcccacagcaccctgaagctggccaaccaccagagacccgtgagcagacaggtgacctgcctgagaacccaggtgctggaggacagcgaggacagcttctgcagaagacaccccggcctgggcaaggccttccccagcggctgcagcgccgtgagcgagcccgccagcgagagcgtggtgggcgccctgcccgccgagcaccagttcagcttcatggagaagagaaaccagtggctggtgagccagctgagcgccgccagccccgacaccggccacgacagcgacaagagcgaccagagcctgcccaacgccagcgccgacagcctgggcggcagccaggagatggtgcagagaccccagccccacagaaacagagccggcctggacctgcccaccatcgacaccggctacgacagccagccccaggacgtgctgggcatcagacagctggagagacccctgcccctgaccagcgtgtgctacccccaggacctgcccagacccctgagaagcagagagttcccccagttcgagccccagagataccccgcctgcgcccagatgctgccccccaacctgagcccccacgccccctggaactaccactaccactgccccggcagccccgaccaccaggtgccctacggccacgactaccccagagccgcctaccagcaggtgatccagcccgccctgcccggccagcccctgcccggcgccagcgtgagaggcctgcaccccgtgcagaaggtgatcctgaactaccccagcccctgggaccacgaggagagacccgcccagagagactgcagcttccccggcctgcccagacaccaggaccagccccaccaccagccccccaacagagccggcgcccccggcgagagcctggagtgccccgccgagctgagaccccaggtgccccagccccccagccccgccgccgtgcccagaccccccagcaacccccccgccagaggcaccctgaagaccagcaacctgcccgaggagctgagaaaggtgttcatcacctacagcatggacaccgccatggaggtggtgaagttcgtgaacttcctgctggtgaacggcttccagaccgccatcgacatcttcgaggacagaatcagaggcatcgacatcatcaagtggatggagagatacctgagagacaagaccgtgatgatcatcgtggccatcagccccaagtacaagcaggacgtggagggcgccgagagccagctggacgaggacgagcacggcctgcacaccaagtacatccacagaatgatgcagatcgagttcatcaagcagggcagcatgaacttcagattcatccccgtgctgttccccaacgccaagaaggagcacgtgcccacctggctgcagaacacccacgtgtacagctggcccaagaacaagaagaacatcctgctgagactgctgagagaggaggagtacgtggccccccccagaggccccctgcccaccctgcaggtggtgcccctgtag

SEQ ID NO: 102680 - DNA, 462 bp, Artificial Sequence
  Description of Artificial Sequence: Synthetic coding sequence
atggaggtggtgaagttcgtgaacttcctgctggtgaacggcttccagaccgccatcgacatcttcgaggacagaatcagaggcatcgacatcatcaagtggatggagagatacctgagagacaagaccgtgatgatcatcgtggccatcagccccaagtacaagcaggacgtggagggcgccgagagccagctggacgaggacgagcacggcctgcacaccaagtacatccacagaatgatgcagatcgagttcatcaagcagggcagcatgaacttcagattcatccccgtgctgttccccaacgccaagaaggagcacgtgcccacctggctgcagaacacccacgtgtacagctggcccaagaacaagaagaacatcctgctgagactgctgagagaggaggagtacgtggccccccccagaggccccctgcccaccctgcaggtggtgcccctgtag

SEQ ID NO: 102681 - DNA, 330 bp, Artificial Sequence
  Description of Artificial Sequence: Synthetic coding sequence
atgatcatcgtggccatcagccccaagtacaagcaggacgtggagggcgccgagagccagctggacgaggacgagcacggcctgcacaccaagtacatccacagaatgatgcagatcgagttcatcaagcagggcagcatgaacttcagattcatccccgtgctgttccccaacgccaagaaggagcacgtgcccacctggctgcagaacacccacgtgtacagctggcccaagaacaagaagaacatcctgctgagactgctgagagaggaggagtacgtggccccccccagaggccccctgcccaccctgcaggtggtgcccctgtag

SEQ ID NO: 102682 - DNA, 1596 bp, Artificial Sequence
  Description of Artificial Sequence: Synthetic coding sequence
atgatcagccccgaccccagacccagccccggcctggccagatgggccgagagctacgaggccaagtgcgagagaagacaggagatcagagagagcagaagatgcagacccaacgtgaccacctgcagacaggtgggcaagaccctgagaatccagcagagagagcagctgcagagagccagactgcagcagttcttcagaagaagaaacctggagctggaggagaagggcaaggcccagcacccccaggccagagagcagggccccagcagaagacccggccaggtgaccggcaccagcagcgaggtgttccccgcccagcaccccccccccagcggcatctgcagagacctgagcgaccacctgagcagccaggccggcggcctgcccccccaggacacccccatcaagaagccccccaagcaccacagaggcacccagaccaaggccgagggccccaccatcaagaacgacgccagccagcagaccaactacggcgtggccgtgctggacaaggagatcatccagctgagcgactacctgaaggaggccctgcagagagagctggtgctgaagcagaagatggtgatcctgcaggacctgctgagcaccctgatccaggccagcgacagcagctggaagggccagctgaacgaggacaagctgaagggcaagctgagaagcctggagaaccagctgtacacctgcacccagaagtacagcccctggggcatgaagaaggtgctgctggagatggaggaccagaagaacagctacgagcagaaggccaaggagagcctgcagaaggtgctggaggagaagatgaacgccgagcagcagctgcagagcacccagagaagcctggccctggccgagcagaagtgcgaggagtggagaagccagtacgaggccctgaaggaggactggagaaccctgggcacccagcacagagagctggagagccagctgcacgtgctgcagagcaagctgcagggcgccgacagcagagacctgcagatgaaccaggccctgagattcctggagaacgagcaccagcagctgcaggccaagatcgagtgcctgcagggcgacagagacctgtgcagcctggacacccaggacctgcaggaccagctgaagagaagcgaggccgagaagctgaccctggtgaccagagtgcagcagctgcagggcctgctgcagaaccagagcctgcagctgcaggagcaggagaagctgctgaccaagaaggaccaggccctgcccgtgtggagccccaagagcttccccaacgaggtggagcccgagggcaccggcaaggagaaggactgggacctgagagaccagctgcagaagaagaccctgcagctgcaggccaaggagaaggagtgcagagagctgcacagcgagctggacaacctgagcgacgagtacctgagctgcctgagaaagctgcagcactgcagagaggagctgaaccagagccagcagctgccccccagaagacagtgcggcagatggctgcccgtgctgatggtggtgatcgccgccgccctggccgtgttcctggccaacaaggacaacctgatgatctag

SEQ ID NO: 102683 - DNA, 549 bp, Artificial Sequence
  Description of Artificial Sequence: Synthetic coding sequence
atgaagaaggtgctgctggagatggaggaccagaagaacagctacgagcagaaggccaaggagagcctgcagaaggtgctggaggagaagatgaacgccgagcagcagctgcagagcacccagagaagcctggccctggccgagcagaagtgcgaggagtggagaagccagtacgaggccctgaaggaggactggagaaccctgggcacccagcacagagagctggagagccagctgcacgtgctgcagagcaagctgcagggcgccgacagcagagacctgcagatgaaccaggccctgagattcctggagaacgagcaccagcagctgcaggccaagatcgagtgcctgcagggcgacagagacctgtgcagcctggacacccaggacctgcaggaccagctgaagagaagcgaggccgagaagctgaccctggtgaccagagtgcagcagctgcagggcctgctgcagaaccagagcctgcagctgcaggagcaggagaagctgctgaccaagaagggccagcagatctactaccacaagttctag

SEQ ID NO: 102684 - DNA, 1656 bp, Artificial Sequence
  Description of Artificial Sequence: Synthetic coding sequence
atgatcagccccgaccccagacccagccccggcctggccagatgggccgagagctacgaggccaagtgcgagagaagacaggagatcagagagagcagaagatgcagacccaacgtgaccacctgcagacaggtgggcaagaccctgagaatccagcagagagagcagctgcagagagccagactgcagcagttcttcagaagaagaaacctggagctggaggagaagggcaaggcccagcacccccaggccagagagcagggccccagcagaagacccggccaggtgaccgtgctgaaggagcccctgagctgcgccagaagaatcagcagccccagagagcaggtgaccggcaccagcagcgaggtgttccccgcccagcaccccccccccagcggcatctgcagagacctgagcgaccacctgagcagccaggccggcggcctgcccccccaggacacccccatcaagaagccccccaagcaccacagaggcacccagaccaaggccgagggccccaccatcaagaacgacgccagccagcagaccaactacggcgtggccgtgctggacaaggagatcatccagctgagcgactacctgaaggaggccctgcagagagagctggtgctgaagcagaagatggtgatcctgcaggacctgctgagcaccctgatccaggccagcgacagcagctggaagggccagctgaacgaggacaagctgaagggcaagctgagaagcctggagaaccagctgtacacctgcacccagaagtacagcccctggggcatgaagaaggtgctgctggagatggaggaccagaagaacagctacgagcagaaggccaaggagagcctgcagaaggtgctggaggagaagatgaacgccgagcagcagctgcagagcacccagagaagcctggccctggccgagcagaagtgcgaggagtggagaagccagtacgaggccctgaaggaggactggagaaccctgggcacccagcacagagagctggagagccagctgcacgtgctgcagagcaagctgcagggcgccgacagcagagacctgcagatgaaccaggccctgagattcctggagaacgagcaccagcagctgcaggccaagatcgagtgcctgcagggcgacagagacctgtgcagcctggacacccaggacctgcaggaccagctgaagagaagcgaggccgagaagctgaccctggtgaccagagtgcagcagctgcagggcctgctgcagaaccagagcctgcagctgcaggagcaggagaagctgctgaccaagaaggaccaggccctgcccgtgtggagccccaagagcttccccaacgaggtggagcccgagggcaccggcaaggagaaggactgggacctgagagaccagctgcagaagaagaccctgcagctgcaggccaaggagaaggagtgcagagagctgcacagcgagctggacaacctgagcgacgagtacctgagctgcctgagaaagctgcagcactgcagagaggagctgaaccagagccagcagctgccccccagaagacagtgcggcagatggctgcccgtgctgatggtggtgatcgccgccgccctggccgtgttcctggccaacaaggacaacctgatgatctag

SEQ ID NO: 102685 - DNA, 1656 bp, Artificial Sequence; identical to SEQ ID NO: 102684
  Description of Artificial Sequence: Synthetic coding sequence

SEQ ID NO: 102686 - DNA, 1596 bp, Artificial Sequence; identical to SEQ ID NO: 102682
  Description of Artificial Sequence: Synthetic coding sequence

SEQ ID NO: 102687 - DNA, 1215 bp, Artificial Sequence
  Description of Artificial Sequence: Synthetic coding sequence
atgatcagccccgaccccagacccagccccggcctggccagatgggccgagagctacgaggccaagtgcgagagaagacaggagatcagagagagcagaagatgcagacccaacgtgaccacctgcagacaggtgggcaagaccctgagaatccagcagagagagcagctgcagagagccagactgcagcagttcttcagaagaagaaacctggagctggaggagaagggcaaggcccagcacccccaggccagagagcagggccccagcagaagacccggccaggtgaccggcaccagcagcgaggtgttccccgcccagcaccccccccccagcggcatctgcagagacctgagcgaccacctgagcagccaggccggcggcctgcccccccaggacacccccatcaagaagccccccaagcaccacagaggcacccagaccaaggccgagggccccaccatcaagaacgacgccagccagcagaccaactacggcgtggccgtgctggacaaggagatcatccagctgagcgactacctgaaggaggccctgcagagagagctggtgctgaagcagaagatggtgatcctgcaggacctgctgagcaccctgatccaggccagcgacagcagctggaagggccagctgaacgaggacaagctgaagggcaagctgagaagcctggagaaccagctgtacacctgcacccagaagtacagcccctggggcatgaagaaggtgctgctggagatggaggaccagaagaacagctacgagcagaaggccaaggagagcctgcagaaggtgctggaggagaagatgaacgccgagcagcagctgcagagcacccagagaagcctggccctggccgagcagaagtgcgaggagtggagaagccagtacgaggccctgaaggaggactggagaaccctgggcacccagcacagagagctggagagccagctgcacgtgctgcagagcaagctgcagggcgccgacagcagagacctgcagatgaaccaggccctgagattcctggagaacgagcaccagcagctgcaggccaagatcgagtgcctgcagggcgacagagacctgtgcagcctggacacccaggacctgcaggaccagctgaagagaagcgaggccgagaagctgaccctggtgaccagagtgcagcagctgcaggaggccgccggctggaccacctag

SEQ ID NO: 102688 - DNA, 963 bp, Artificial Sequence
  Description of Artificial Sequence: Synthetic coding sequence
atgatcagccccgaccccagacccagccccggcctggccagatgggccgagagctacgaggccaagtgcgagagaagacaggagatcagagagagcagaagatgcagacccaacgtgaccacctgcagacaggtgggcaagaccctgagaatccagcagagagagctggaggagaagggcaaggcccagcacccccaggccagagagcagggccccagcagaagacccggccaggtgaccgtgctgaaggagcccctgagctgcgccagaagaatcagcagccccagagagcaggtgaccggcaccagcagcgaggtgttccccgcccagcaccccccccccagcggcatctgcagagacctgagcgaccacctgagcagccaggccggcggcctgcccccccaggacacccccatcaagaagccccccaagcaccacagaggcacccagaccaaggccgagggccccaccatcaagaacgacgccagccagcagaccaactacggcgtggccgtgctggacaaggagatcatccagctgagcgactacctgaaggaggccctgcagagagagctggtgctgaagcagaagatggtgatcctgcaggacctgctgagcaccctgatccaggccagcgacagcagctggaagggccagctgaacgaggacaagctgaagggcaagctgagaagcctggagaaccagctgtacacctgcacccagaagtacagcccctggggcatgaagaaggtgctgctggagatggaggaccagaagaacagctacgagcagaaggccaaggagagcctgcagaaggtgctggaggagaagatgaacgccgagcagcagctgcagagcacccaggtgtggggctgccacatcgacatgggcctgggcacccccggcagcctgggcaacaagggcagccagctgcacaacagcctggagcccagccccctgtag

SEQ ID NO: 102689 - DNA, 81 bp, Artificial Sequence
  Description of Artificial Sequence: Synthetic coding sequence
atgatcagccccgaccccagacccagccccggcctggccagatgggccgagagctacgaggccaagtgcgagagaagatag

SEQ ID NO: 102690 - DNA, 1671 bp, Artificial Sequence
  Description of Artificial Sequence: Synthetic coding sequence
atgcagaagttcatcgaggccgactactacgagctggactggtactacgaggagtgcagcgacgtgctgtgcgccgagagagtgggccagatgaccaagacctacaacgacatcgacgccgtgaccagactgctggaggagaaggagagagacctggagctggccgccagaatcggccagagcctgctgaagaagaacaagaccctgaccgagagaaacgagctgctggaggagcaggtggagcacatcagagaggaggtgagccagctgagacacgagctgagcatgaaggacgagctgctgcagttctacaccagcgccgccgaggagagcgagcccgagagcgtgtgcagcacccccctgaagagaaacgagagcagcagcagcgtgcagaactacttccacctggacagcctgcagaagaagctgaaggacctggaggaggagaacgtggtgctgagaagcgaggccagccagctgaagaccgagaccatcacctacgaggagaaggagcagcagctggtgaacgactgcgtgaaggagctgagagacgccaacgtgcagatcgccagcatcagcgaggagctggccaagaagaccgaggacgccgccagacagcaggaggagatcacccacctgctgagccagatcgtggacctgcagaagaaggccaaggcctgcgccgtggagaacgaggagctggtgcagcacctgggcgccgccaaggacgcccagagacagctgaccgccgagctgagagagctggaggacaagtacgccgagtgcatggagatgctgcacgaggcccaggaggagctgaagaacctgagaaacaagaccatgcccaacaccaccagcagaagataccacagcctgggcctgttccccatggacagcctggccgccgagatcgagggcaccatgagaaaggagctgcagctggaggaggccgagagccccgacatcacccaccagaagagagtgttcgagaccgtgagaaacatcaaccaggtggtgaagcagagaagcctgacccccagccccatgaacatccccggcagcaaccagagcagcgccatgaacagcctgctgagcagctgcgtgagcacccccagaagcagcttctacggcagcgacatcggcaacgtggtgctggacaacaagaccaacagcatcatcctggagaccgaggccgccgacctgggcaacgacgagagaagcaagaagcccggcacccccggcacccccggcagccacgacctggagaccgccctgagaagactgagcctgagaagagagaactacctgagcgagagaagattcttcgaggaggagcaggagagaaagctgcaggagctggccgagaagggcgagctgagaagcggcagcctgacccccaccgagagcatcatgagcctgggcacccacagcagattcagcgagttcaccggcttcagcggcatgagcttcagcagcagaagctacctgcccgagaagctgcagatcgtgaagcccctggagggcgaccacgccggccccagacccctgagcgtgctgctgggcgacagcctgtggagcctgatccacctgagaaaggccggccacctgtgccacgcctacagcttcttcttcagagacagccaccccagatgctggttcgagttcctgtag

SEQ ID NO: 102691 - DNA, 438 bp, Artificial Sequence
  Description of Artificial Sequence: Synthetic coding sequence
atgaccgtgcacaacctgtacctgttcgacagaaacggcgtgtgcctgcactacagcgagtggcacagaaagaagcaggccggcatccccaaggaggaggagtacaagctgatgtacggcatgctgttcagcatcagaagcttcgtgagcaagatgagccccctggacatgaaggacggcttcctggccttccagaccagcagatacaagctgcactactacgagacccccaccggcatcaaggtggtgatgaacaccgacctgggcgtgggccccatcagagacgtgctgcaccacatctacagcgccctgtacgtggagctggtggtgaagaaccccctgtgccccctgggccagaccgtgcagagcgagctgttcagaagcagactggacagctacgtgagaagcctgcccttcttcagcgccagagccggctag

SEQ ID NO: 102692 - DNA, 438 bp, Artificial Sequence; identical to SEQ ID NO: 102691
  Description of Artificial Sequence: Synthetic coding sequence

SEQ ID NO: 102693 - DNA, 3402 bp, Artificial Sequence
  Description of Artificial Sequence: Synthetic coding sequence
atgagccccacccagtgggacttccccgtggagctgtgctgcagacccatggccttcgtgaccctgaccggcctggacgtggtgtacaacgccgtgcacagagccgtgtgggacgccttctgcgccaacagaagagccgacagagtgcccatcagcttcaaggtgctgcccggcgaccacgagtaccccaagtgcagacccaagagaaccagctacgagtggtacatccccaagggcatcctgaagaccggctggatgaacaagcacctgaacctggtgcccgccctggtggtggtgttctacgagctggactgggacgagccccagtggaaggagaagcagagcgagtgcgccaccagagtggagatcgtgagacagagcctgcagggcagaaacaccaaggtggccgtggtgctgatccagaagaagacccccctgccccccggcgaggacgtgatcgccagcgagagagccgccgccctgtgcaacgcctgcgagctgagcggcaagagcctgttcgtgctgccccacaccgaccacctggtgggctacatcatcagactggagaacgccttctacgagcacgcccagacctactactacaccgagatcagaagagtgaagagccacaaggagttcctgaacaagaccacccaccagctgctgttcgtgagacaccagttcaagatcgccttcttcagcgagctgaagcaggacacccagaacgccctgaagaactacagaaccgcctacaacctggtgcacgagctgagagcccacgagaccaacatcctggagatcaagaccatggccggcttcatcaactacaagatctgcagactgtgcttccagcacaacacccccctggacgccatcgcccagttcagaaagcacatcgacctgtgcaagaagaagatcggcagcgccgagctgagcttcgagcacgacgcctggatgagcaagcagttccaggccttcggcgacctgttcgacgaggccatcaagctgggcctgaccgccatccagacccagaaccccggcttctactaccagcaggccgcctactacgcccaggagagaaagcagctggccaagaccctgtgcaaccacgaggccagcgtgatgtaccccaaccccgaccccctggagacccagaccggcgtgctggacttctacggccagagaagctggagacagggcatcctgagcttcgacctgagcgaccccgagaaggagaaggtgggcatcctggccatccagctgaaggagagaaacgtggtgcacagcgagatcatcatcaccctgctgagcaacgccgtggcccagttcaagaagtacaagtgccccagaatgaagagccacctgatggtgcagatgggcgaggagtactactacgccaaggactacaccaaggccctgaagctgctggactacgtgatgtgcgactacagaagcgagggctggtggaccctgctgaccagcgtgctgaccaccgccctgaagtgcagctacctgatggcccagctgaaggactacatcacctacagcctggagctgctgggcagagccagcaccctgaaggacgaccagaagagcagaatcgagaagaacctgatcaacgtgctgatgaacgagagccccgaccccgagcccgactgcgacatcctggccgtgaagaccgcccagaagctgtgggccgacagaatcagcctggccggcagcaacatcttcaccatcggcgtgcaggacttcgtgcccttcgtgcagtgcaaggccaagttccacgcccccagcttccacgtggacgtgcccgtgcagttcgacatctacctgaaggccgactgcccccaccccatcagattcagcaagctgtgcgtgagcttcaacaaccaggagtacaaccagttctgcgtgatcgaggaggccagcaaggccaacgaggtgctggagaacctgacccagggcaagatgtgcctggtgcccggcaagaccagaaagctgctgttcaagttcgtggccaagaccgaggacgtgggcaagaagatcgagatcaccagcgtggacctggccctgggcaacgagaccggcagatgcgtggtgctgaactggcagggcggcggcggcgacgccgccagcagccaggaggccctgcaggccgccagaagcttcaagagaagacccaagctgcccgacaacgaggtgcactgggacagcatcatcatccaggccagcaccatgatcatcagcagagtgcccaacatcagcgtgcacctgctgcacgagccccccgccctgaccaacgagatgtactgcctggtggtgaccgtgcagagccacgagaagacccagatcagagacgtgaagctgaccgccggcctgaagcccggccaggacgccaacctgacccagaagacccacgtgaccctgcacggcaccgagctgtgcgacgagagctaccccgccctgctgaccgacatccccgtgggcgacctgcaccccggcgagcagctggagaagatgctgtacgtgagatgcggcaccgtgggcagcagaatgttcctggtgtacgtgagctacctgatcaacaccaccgtggaggagaaggagatcgtgtgcaagtgccacaaggacgagaccgtgaccatcgagaccgtgttccccttcgacgtggccgtgaagttcgtgagcaccaagttcgagcacctggagagagtgtacgccgacatccccttcctgctgatgaccgacctgctgagcgccagcccctgggccctgaccatcgtgagcagcgagctgcagctggcccccagcatgaccaccgtggaccagctggagagccaggtggacaacgtgatcctgcagaccggcgagagcgccagcgagtgcttctgcctgcagtgccccagcctgggcaacatcgagggcggcgtggccaccggccactacatcatcagctggaagagaaccagcgccatggagaacatccccatcatcaccaccgtgatcaccctgccccacgtgatcgtggagaacatccccctgcacgtgaacgccgacctgcccagcttcggcagagtgagagagagcctgcccgtgaagtaccacctgcagaacaagaccgacctggtgcaggacgtggagatcagcgtggagcccagcgacgccttcatgttcagcggcctgaagcagatcagactgagaatcctgcccggcaccgagcaggagatgctgtacaacttctaccccctgatggccggctaccagcagctgcccagcctgaacatcaacctgctgagattccccaacttcaccaaccagctgctgagaagattcatccccaccagcatcttcgtgaagccccagggcagactgatggacgacaccagcatcgccgccgcctag

SEQ ID NO: 102694 - DNA, 3261 bp, Artificial Sequence
  Description of Artificial Sequence: Synthetic coding sequence
atgagccccacccagtgggacttccccgtggagctgtgctgcagacccatggccttcgtgaccctgaccggcctggacgtggtgtacaacgccgtgcacagagccgtgtgggacgccttctgcgccaacagaagagccgacagagtgcccatcagcttcaaggtgctgcccggcgaccacgagtaccccaagtgcagacccaagagaaccagctacgagtggtacatccccaagggcatcctgaagaccggctggatgaacaagcacctgaacctggtgcccgccctggtggtggtgttctacgagctggactgggacgagccccagtggaaggagaagcagagcgagtgcgccaccagagtggagatcgtgagacagagcctgcagggcagaaacaccaaggtggccgtggtgctgatccagaagaagacccccctgccccccggcgaggacgtgatcgccagcgagagagccgccgccctgtgcaacgcctgcgagctgagcggcaagagcctgttcgtgctgccccacaccgaccacctggtgggctacatcatcagactggagaacgccttctacgagcacgcccagacctactactacaccgagatcagaagagtgaagagccacaaggagttcctgaacaagaccacccaccagctgctgttcgtgagacaccagttcaagatcgccttcttcagcgagctgaagcaggacacccagaacgccctgaagaactacagaaccgcctacaacctggtgcacgagctgagagcccacgagaccaacatcctggagatcaagaccatggccggcttcatcaactacaagatctgcagactgtgcttccagcacaacacccccctggacgccatcgcccagttcagaaagcacatcgacctgtgcaagaagaagatcggcagcgccgagctgagcttcgagcacgacgcctggatgagcaagcagttccaggccttcggcgacctgttcgacgaggccatcaagctgggcctgaccgccatccagacccagaaccccggcttctactaccagcaggccgcctactacgcccaggagagaaagcagctggccaagaccctgtgcaaccacgaggccagcgtgatgtaccccaaccccgaccccctggagacccagaccggcgtgctggacttctacggccagagaagctggagacagggcatcctgagcttcgacctgagcgaccccgagaaggagaaggtgggcatcctggccatccagctgaaggagagaaacgtggtgcacagcgagatcatcatcaccctgctgagcaacgccgtggcccagttcaagaagtacaagtgccccagaatgaagagccacctgatggtgcagatgggcgaggagtactactacgccaaggactacaccaaggccctgaagctgctggactacgtgatgtgcgactacagaagcgagggctggtggaccctgctgaccagcgtgctgaccaccgccctgaagtgcagctacctgatggcccagctgaaggactacatcacctacagcctggagctgctgggcagagccagcaccctgaaggacgaccagaagagcagaatcgagaagaacctgatcaacgtgctgatgaacgagagccccgaccccgagcccgactgcgacatcctggccgtgaagaccgcccagaagctgtgggccgacagaatcagcctggccggcagcaacatcttcaccatcggcgtgcaggacttcgtgcccttcgtgcagtgcaaggccaagttccacgcccccagcttccacgtggacgtgcccgtgcagttcgacatctacctgaaggccgactgcccccaccccatcagattcagcaagctgtgcgtgagcttcaacaaccaggagtacaaccagttctgcgtgatcgaggaggccagcaaggccaacgaggtgctggagaacctgacccagggcaagatgtgcctggtgcccggcaagaccagaaagctgctgttcaagttcgtggccaagaccgaggacgtgggcaagaagatcgagatcaccagcgtggacctggccctgggcaacgagaccggcagatgcgtggtgctgaactggcagggcggcggcggcgacgccgccagcagccaggaggccctgcaggccgccagaagcttcaagagaagacccaagctgcccgacaacgaggtgcactgggacagcatcatcatccaggccagcaccatgatcatcagcagagtgcccaacatcagcgtgcacctgctgcacgagccccccgccctgaccaacgagatgtactgcctggtggtgaccgtgcagagccacgagaagacccagatcagagacgtgaagctgaccgccggcctgaagcccggccaggacgccaacctgacccagaagacccacgtgaccctgcacggcaccgagctgtgcgacgagagctaccccgccctgctgaccgacatccccgtgggcgacctgcaccccggcgagcagctggagaagatgctgtacgtgagatgcggcaccgtgggcagcagaatgttcctggtgtacgtgagctacctgatcaacaccaccgtggaggagaaggagatcgtgtgcaagtgccacaaggacgagaccgtgaccatcgagaccgtgttccccttcgacgtggccgtgaagttcgtgagcaccaagttcgagcacctggagagagtgtacgccgacatccccttcctgctgatgaccgacctgctgagcgccagcccctgggccctgaccatcgtgagcagcgagctgcagctggcccccagcatgaccaccgtggaccagctggagagccaggtggacaacgtgatcctgcagaccggcgagagcgccagcgagtgcttctgcctgcagtgccccagcctgggcaacatcgagggcggcgtggccaccggccactacatcatcagctggaagagaaccagcgccatggagaacatccccatcatcaccaccgtgatcaccctgccccacgtgatcgtggagaacatccccctgcacgtgaacgccgacctgcccagcttcggcagagtgagagagagcctgcccgtgaagtaccacctgcagaacaagaccgacctggtgcaggacgtggagatcagcgtggagcccagcgacgccttcatgttcagcggcctgaagcagatcagactgcccgcccaggccttctacacctaccagtacttctgccaggccaccggcagcacccacggctag

SEQ ID NO: 102695 - DNA, 3057 bp, Artificial Sequence
  Description of Artificial Sequence: Synthetic coding sequence
atgagccccacccagtgggacttccccgtggagctgtgctgcagacccatggccttcgtgaccctgaccggcctggacgtggtgtacaacgccgtgcacagagccgtgtgggacgccttctgcgccaacagaagagccgacagagtgcccatcagcttcaaggtgctgcccggcgaccacgagtaccccaagtgcagacccaagagaaccagctacgagtggtacatccccaagggcatcctgaagaccggctggatgaacaagcacctgaacctggtgcccgccctggtggtggtgttctacgagctggactgggacgagccccagtggaaggagaagcagagcgagtgcgccaccagagtggagatcgtgagacagagcctgcagggcagaaacaccaaggtggccgtggtgctgatccagaagaagacccccctgccccccggcgaggacgtgatcgccagcgagagagccgccgccctgtgcaacgcctgcgagctgagcggcaagagcctgttcgtgctgccccacaccgaccacctggtgggctacatcatcagactggagaacgccttctacgagcacgcccagacctactactacaccgagatcagaagagtgaagagccacaaggagttcctgaacaagaccacccaccagctgctgttcgtgagacaccagttcaagatcgccttcttcagcgagctgaagcaggacacccagaacgccctgaagaactacagaaccgcctacaacctggtgcacgagctgagagcccacgagaccaacatcctggagatcaagaccatggccggcttcatcaactacaagatctgcagactgtgcttccagcacaacacccccctggacgccatcgcccagttcagaaagcacatcgacctgtgcaagaagaagatcggcagcgccgagctgagcttcgagcacgacgcctggatgagcaagcagttccaggccttcggcgacctgttcgacgaggccatcaagctgggcctgaccgccatccagacccagaaccccggcttctactaccagcaggccgcctactacgcccaggagagaaagcagctggccaagaccctgtgcaaccacgaggccagcgtgatgtaccccaaccccgaccccctggagacccagaccggcgtgctggacttctacggccagagaagctggagacagggcatcctgagcttcgacctgagcgaccccgagaaggagaaggtgggcatcctggccatccagctgaaggagagaaacgtggtgcacagcgagatcatcatcaccctgctgagcaacgccgtggcccagttcaagaagtacaagtgccccagaatgaagagccacctgatggtgcagatgggcgaggagtactactacgccaaggactacaccaaggccctgaagctgctggactacgtgatgtgcgactacagaagcgagggctggtggaccctgctgaccagcgtgctgaccaccgccctgaagtgcagctacctgatggcccagctgaaggactacatcacctacagcctggagctgctgggcagagccagcaccctgaaggacgaccagaagagcagaatcgagaagaacctgatcaacgtgctgatgaacgagagccccgaccccgagcccgactgcgacatcctggccgtgaagaccgcccagaagctgtgggccgacagaatcagcctggccggcagcaacatcttcaccatcggcgtgcaggacttcgtgcccttcgtgcagtgcaaggccaagttccacgcccccagcttccacgtggacgtgcccgtgcagttcgacatctacctgaaggccgactgcccccaccccatcagattcagcaagctgtgcgtgagcttcaacaaccaggagtacaaccagttctgcgtgatcgaggaggccagcaaggccaacgaggtgctggagaacctgacccagggcaagatgtgcctggtgcccggcaagaccagaaagctgctgttcaagttcgtggccaagaccgaggacgtgggcaagaagatcgagatcaccagcgtggacctggccctgggcaacgagaccggcagatgcgtggtgctgaactggcagggcggcggcggcgacgccgccagcagccaggaggccctgcaggccgccagaagcttcaagagaagacccaagctgcccgacaacgaggtgcactgggacagcatcatcatccaggccagcaccatgatcatcagcagagtgcccaacatcagcgtgcacctgctgcacgagccccccgccctgaccaacgagatgtactgcctggtggtgaccgtgcagagccacgagaagacccagatcagagacgtgaagctgaccgccggcctgaagcccggccaggacgccaacctgacccagaagacccacgtgaccctgcacggcaccgagctgtgcgacgagagctaccccgccctgctgaccgacatccccgtgggcgacctgcaccccggcgagcagctggagaagatgctgtacgtgagatgcggcaccgtgggcagcagaatgttcctggtgtacgtgagctacctgatcaacaccaccgtggaggagaaggagatcgtgtgcaagtgccacaaggacgagaccgtgaccatcgagaccgtgttccccttcgacgtggccgtgaagttcgtgagcaccaagttcgagcacctggagagagtgtacgccgacatccccttcctgctgatgaccgacctgctgagcgccagcccctgggccctgaccatcgtgagcagcgagctgcagctggcccccagcatgaccaccgtggaccagctggagagccaggtggacaacgtgatcctgcagaccggcgagagcgccagcgccctgtactacctgctggagaaggacctgagcaacggcgagtacccccaccaccacaactgccaccacagcgccgccagagactgcggcgagtaccccagcccctgcgagtgcagaagcgccgtgatctgggcctgccagagagtggtgacctgccaggtgagccccaccgagtag

SEQ ID NO: 102696 - DNA, 2091 bp, Artificial Sequence
  Description of Artificial Sequence: Synthetic coding sequence
atggaggacgccggcggcggcgaggagcagggcctgctgttccaggaggagaccatcgacctgggcggcgacgagttcggcagcgaggagaacgagaccgccagcgagggcagcagccccctggccgacaagctgaacgagcacatgatggagagcgtgctgatcagcgacagccccaacagcgagggcgacgccggcgacctgggcagagtgagagacgaggccgagcccggcggcgagggcgaccccggccccgagcccgccggcacccccagccccagcggcgaggccgacggcgactgcgcccccgaggacgccgcccccagcagcggcggcgcccccagacaggacgccgccagagaggtgcccggcagcgaggccgccagacccgagcaggagccccccgtggccgagcccgtgcccgtgtgcaccatcttcagccagagagccccccccgccagcggcgacggcttcgagccccagatggtgaagagccccagcttcggcggcgccagcgaggccagcgccagaacccccccccaggtggtgcagcccagccccagcctgagcaccttcttcggcgacaccgccgccagccacagcctggccagcgacttcttcgacagcttcaccaccagcgccttcatcagcgtgagcaaccccggcgccggcagccccgcccccgccagccccccccccctggccgtgcccggcaccgagggcagacccgagcccgtggccatgagaggcccccaggccgccgccccccccgccagccccgagcccttcgcccacatccaggccgtgttcgccggcagcgacgaccccttcgccaccgccctgagcatgagcgagatggacagaagaaacgacgcctggctgcccggcgaggccaccagaggcgtgctgagagccgtggccacccagcagagaggcgccgtgttcgtggacaaggagaacctgaccatgcccggcctgagattcgacaacatccagggcgacgccgtgaaggacctgatgctgagattcctgggcgagaaggccgccgccaagagacaggtgctgaacgccgacagcgtggagcagagcttcgtgggcctgaagcagctgatcagctgcagaaactggagagccgccgtggacctgtgcggcagactgctgaccgcccacggccagggctacggcaagagcggcctgctgaccagccacaccaccgacagcctgcagctgtggttcgtgagactggccctgctggtgaagctgggcctgttccagaacgccgagatggagttcgagcccttcggcaacctggaccagcccgacctgtactacgagtactacccccacgtgtaccccggcagaagaggcagcatggtgcccttcagcatgagaatcctgcacgccgagctgcagcagtacctgggcaacccccaggagagcctggacagactgcacaaggtgaagaccgtgtgcagcaagatcctggccaacctggagcagggcctggccgaggacggcggcatgagcagcgtgacccaggagggcagacagggctgcagctacctggtggccagcatcagactgtggagaagcagactgggcagagtgatgtacagcatggccaactgcctgctgctgatgaaggactacgtgctggccgtggaggcctaccacagcgtgatcaagtactaccccgagcaggagccccagctgctgagcggcatcggcagaatcagcctgcagatcggcgacatcaagaccgccgagaagtacttccaggacgtggagaaggtgacccagaagctggacggcctgcagggcaagatcatggtgctgatgaacagcgccttcctgcacctgggccagaacaacttcgccgaggcccacagattcttcaccgagatcctgagaatggaccccagaaacgccgtgcagatgctgagcgccagccaccccaccggcaaggagcccagccccaaggacgccgaggagcaccccgagggccacagagacagcgccgagcccggccccgccagacccatggtgccccagagagccccccccggccccgccctgtgcgcccagccctag

SEQ ID NO: 102697 - DNA, 2208 bp, Artificial Sequence
  Description of Artificial Sequence: Synthetic coding sequence
atggaggacgccggcggcggcgaggagacccccgcccccgaggccccccaccccccccagctggccccccccgaggagcagggcctgctgttccaggaggagaccatcgacctgggcggcgacgagttcggcagcgaggagaacgagaccgccagcgagggcagcagccccctggccgacaagctgaacgagcacatgatggagagcgtgctgatcagcgacagccccaacagcgagggcgacgccggcgacctgggcagagtgagagacgaggccgagcccggcggcgagggcgaccccggccccgagcccgccggcacccccagccccagcggcgaggccgacggcgactgcgcccccgaggacgccgcccccagcagcggcggcgcccccagacaggacgccgccagagaggtgcccggcagcgaggccgccagacccgagcaggagccccccgtggccgagcccgtgcccgtgtgcaccatcttcagccagagagccccccccgccagcggcgacggcttcgagccccagatggtgaagagccccagcttcggcggcgccagcgaggccagcgccagaacccccccccaggtggtgcagcccagccccagcctgagcaccttcttcggcgacaccgccgccagccacagcctggccagcgacttcttcgacagcttcaccaccagcgccttcatcagcgtgagcaaccccggcgccggcagccccgcccccgccagccccccccccctggccgtgcccggcaccgagggcagacccgagcccgtggccatgagaggcccccaggccgccgccccccccgccagccccgagcccttcgcccacatccaggccgtgttcgccggcagcgacgaccccttcgccaccgccctgagcatgagcgagatggacagaagaaacgacgcctggctgcccggcgaggccaccagaggcgtgctgagagccgtggccacccagcagagaggcgccgtgttcgtggacaaggagaacctgaccatgcccggcctgagattcgacaacatccagggcgacgccgtgaaggacctgatgctgagattcctgggcgagaaggccgccgccaagagacaggtgctgaacgccgacagcgtggagcagagcttcgtgggcctgaagcagctgatcagctgcagaaactggagagccgccgtggacctgtgcggcagactgctgaccgcccacggccagggctacggcaagagcggcctgctgaccagccacaccaccgacagcctgcagctgtggttcgtgagactggccctgctggtgaagctgggcctgttccagaacgccgagatggagttcgagcccttcggcaacctggaccagcccgacctgtactacgagtactacccccacgtgtaccccggcagaagaggcagcatggtgcccttcagcatgagaatcctgcacgccgagctgcagcagtacctgggcaacccccaggagagcctggacagactgcacaaggtgaagaccgtgtgcagcaagatcctggccaacctggagcagggcctggccgaggacggcggcatgagcagcgtgacccaggagggcagacaggccagcatcagactgtggagaagcagactgggcagagtgatgtacagcatggccaactgcctgctgctgatgaaggactacgtgctggccgtggaggcctaccacagcgtgatcaagtactaccccgagcaggagccccagctgctgagcggcatcggcagaatcagcctgcagatcggcgacatcaagaccgccgagaagtacttccaggacgtggagaaggtgacccagaagctggacggcctgcagggcaagatcatggtgctgatgaacagcgccttcctgcacctgggccagaacaacttcgccgaggcccacagattcttcaccgagatcctgagaatggaccccagaaacgccgtggccaacaacaacgccgccgtgtgcctgctgtacctgggcaagctgaaggacagcctgagacagctggaggccatggtgcagcaggaccccagacactacctgcacgagagcgtgctgttcaacctgaccaccatgtacgagctggagagcagcagaagcatgcagaagaagcaggccctgctggaggccgtggccggcaaggagggcgacagcttcaacacccagtgcctgaagctggcctag

SEQ ID NO: 102698 - DNA, 2208 bp, Artificial Sequence; identical to SEQ ID NO: 102697
  Description of Artificial Sequence: Synthetic coding sequence

SEQ ID NO: 102699 - DNA, 423 bp, Artificial Sequence
  Description of Artificial Sequence: Synthetic coding sequence
atgagcggcagcttctacttcgtgatcgtgggccaccacgacaaccccgtgttcgagatggagttcctgcccgccggcaaggccgagagcaaggacgaccacagacacctgaaccagttcatcgcccacgccgccctggacctggtggacgagaacatgtggctgagcaacaacatgtacctgaagaccgtggacaagttcaacgagtggttcgtgagcgccttcgtgaccgccggccacatgagattcatcatgctgcacgacatcagacaggaggacggcatcaagaacttcttcaccgacgtgtacgacctgtacatcaagttcagcatgaaccccttctacgagcccaacagccccatcagaagcagcgccttcgacagaaaggtgcagttcctgggcaagaagcacctgctgagctag

SEQ ID NO: 102700 - DNA, 423 bp, Artificial Sequence; identical to SEQ ID NO: 102699
  Description of Artificial Sequence: Synthetic coding sequence

SEQ ID NO: 102701 - DNA, 423 bp, Artificial Sequence; identical to SEQ ID NO: 102699
  Description of Artificial Sequence: Synthetic coding sequence

SEQ ID NO: 102702 - DNA, 423 bp, Artificial Sequence; identical to SEQ ID NO: 102699
  Description of Artificial Sequence: Synthetic coding sequence

SEQ ID NO: 102703 - DNA, 444 bp, Artificial Sequence
  Description of Artificial Sequence: Synthetic coding sequence
atgagcggcagcttctacttcgtgatcgtgggccaccacgacaaccccgtgttcgagatggagttcctgcccgccggcaaggccgagagcaaggacgaccacagacacctgaaccagttcatcgcccacgccgccctggacctggtggacgagaacatgtggctgagcaacaacatgtacctgaagaccgtggacaagttcaacgagtggttcgtgagcgccttcgtgaccgccggccacatcctgaccttcctggtgaagatgagattcatcatgctgcacgacatcagacaggaggacggcatcaagaacttcttcaccgacgtgtacgacctgtacatcaagttcagcatgaaccccttctacgagcccaacagccccatcagaagcagcgccttcgacagaaaggtgcagttcctgggcaagaagcacctgctgagctag

SEQ ID NO: 102704 - DNA, 525 bp, Artificial Sequence
  Description of Artificial Sequence: Synthetic coding sequence
atgagcagctggaagcaggacagaagcggcctgagaagcaccgagctgaacgtgctggagtaccagcccctgtgcgccgtgagaagccacatcctgaagaccatgagcggcagcttctacttcgtgatcgtgggccaccacgacaaccccgtgttcgagatggagttcctgcccgccggcaaggccgagagcaaggacgaccacagacacctgaaccagttcatcgcccacgccgccctggacctggtggacgagaacatgtggctgagcaacaacatgtacctgaagaccgtggacaagttcaacgagtggttcgtgagcgccttcgtgaccgccggccacatgagattcatcatgctgcacgacatcagacaggaggacggcatcaagaacttcttcaccgacgtgtacgacctgtacatcaagttcagcatgaaccccttctacgagcccaacagccccatcagaagcagcgccttcgacagaaaggtgcagttcctgggcaagaagcacctgctgagctag

SEQ ID NO: 102705 - DNA, 225 bp, Artificial Sequence
  Description of Artificial Sequence: Synthetic coding sequence
atgagcggcagcttctacttcgtgatcgtgggccaccacgacaaccccgtgttcgagatggagttcctgcccgccggcaaggccgagagcaaggacgaccacagacacctgaaccagttcatcgcccacgccgccctggacctggtggacgagaacatgtggctgagcaacaacatgtacctgaagaccgtggacaagttcaacgagtggttcgtgagcgcctag

SEQ ID NO: 102706 - DNA, 423 bp, Artificial Sequence
  Description of Artificial Sequence: Synthetic coding sequence
atggccgtgtgcatcgccgtgatcgccaaggagaactaccccctgtacatcagaagcacccccaccgagaacgagctgaagttccactacatggtgcacaccagcctggacgtggtggacgagaagatcagcgccatgggcaaggccctggtggaccagagagagctgtacctgggcctgctgtaccccaccgaggactacaaggtgtacggctacgtgaccaacagcaaggtgaagttcgtgatggtggtggacagcagcaacaccgccctgagagacaacgagatcagaagcatgttcagaaagctgcacaacagctacaccgacgtgatgtgcaaccccttctacaaccccggcgacagaatccagagcagcagagccttcgacaacatggtgaccagcatgatgatccaggtgtgctag

SEQ ID NO: 102707 - DNA, 357 bp, Artificial Sequence
  Description of Artificial Sequence: Synthetic coding sequence
atgagcagacaggccaacagaggcaccgagagcaagaagatgagcagcgagctgttcaccctgacctacggcgccctggtgacccagctgtgcaaggactacgagaacgacgaggacgtgaacaagcagctggacaagatgggcttcaacatcggcgtgagactgatcgaggacttcctggccagaagcaacgtgggcagatgccacgacttcagagagaccgccgacgtgatcgccaaggagagaaagatgttcctgggcaagcagaacaagaccaagagacaggccaagctgtacgacgccgtgaaggagagaggcgccgccagctgcaccgacgccagccccctgctgagctag

SEQ ID NO: 102708 - DNA, 405 bp, Artificial Sequence
  Description of Artificial Sequence: Synthetic coding sequence
atgggcttcaacatcggcgtgagactgatcgaggacttcctggccagaagcaacgtgggcagatgccacgacttcagagagaccgccgacgtgatcgccaaggtggccttcaagatgtacctgggcatcacccccagcatcaccaactggagccccgccggcgacgagttcagcctgatcctggagaacaaccccctggtggacttcgtggagctgcccgacaaccacagcagcctgatctacagcaacctgctgtgcggcgtgctgagaggcgccctggagatggtgcagatggccgtggaggccaagttcgtgcaggacaccctgaagggcgacggcgtgaccgagatcagaatgagattcatcagaagaatcgaggacaacctgcccgccggcgaggagtag

SEQ ID NO: 102709 - DNA, 405 bp, Artificial Sequence; identical to SEQ ID NO: 102708
  Description of Artificial Sequence: Synthetic coding sequence

SEQ ID NO: 102710 - DNA, 543 bp, Artificial Sequence
  Description of Artificial Sequence: Synthetic coding sequence
atgagcagacaggccaacagaggcaccgagagcaagaagatgagcagcgagctgttcaccctgacctacggcgccctggtgacccagctgtgcaaggactacgagaacgacgaggacgtgaacaagcagctggacaagatgggcttcaacatcggcgtgagactgatcgaggacttcctggccagaagcaacgtgggcagatgccacgacttcagagagaccgccgacgtgatcgccaaggtggccttcaagatgtacctgggcatcacccccagcatcaccaactggagccccgccggcgacgagttcagcctgatcctggagaacaaccccctggtggacttcgtggagctgcccgacaaccacagcagcctgatctacagcaacctgctgtgcggcgtgctgagaggcgccctggagatggtgcagatggccgtggaggccaagttcgtgcaggacaccctgaagggcgacggcgtgaccgagatcagaatgagattcatcagaagaatcgaggacaacctgcccgccggcgaggagtag

SEQ ID NO: 102711 - DNA, 498 bp, Artificial Sequence
  Description of Artificial Sequence: Synthetic coding sequence
atggccatcttcagcgtgtacgtggtgaacaaggccggcggcctgatctaccagctggacagctacgcccccagagccgaggccgagaagaccttcagctaccccctggacctgctgctgaagctgcacgacgagagagtgctggtggccttcggccagagagacggcatcagagtgggccacgccgtgctggccatcaacggcatggacgtgaacggcagatacaccgccgacggcaaggagatgctggagaccgacaccttcaagctgcactgctaccagaccctgaccggcatcaagttcgtggtgctggccgaccccagacaggccggcatcgacagcctgctgagaaagatctacgagatctacagcgacttcgccctgaagaaccccttctacagcctggagatgcccatcagatgcgagctgttcgaccagaacctgaagctggccctggaggtggccgagaaggccggcaccttcggccccggcagctag

SEQ ID NO: 102712 - DNA, 660 bp, Artificial Sequence
  Description of Artificial Sequence: Synthetic coding sequence
atggccatcttcagcgtgtacgtggtgaacaaggccggcggcctgatctaccagctggacagctacgcccccagagccgaggccgagaagaccttcagctaccccctggacctgctgctgaagctgcacgacgagagagtgctggtggccttcggccagagagacggcatcagagtgggccacgccgtgctggccatcaacggcatggacgtgaacggcagatacaccgccgacggcaaggaggtgctggagtacctgggcaaccccgccaactaccccgtgagcatcagattcggcagacccagactgaccagcaacgagaagctgatgctggccagcatgttccacagcctgttcgccatcggcagccagctgagccccgagcagggcagcagcggcatcgagatgctggagaccgacaccttcaagctgcactgctaccagaccctgaccggcatcaagttcgtggtgctggccgaccccagacaggccggcatcgacagcctgctgagaaagatctacgagatctacagcgacttcgccctgaagaaccccttctacagcctggagatgcccatcagatgcgagctgttcgaccagaacctgaagctggccctggaggtggccgagaaggccggcaccttcggccccggcagctag

SEQ ID NO: 102713 - DNA, 4308 bp, Artificial Sequence
  Description of Artificial Sequence: Synthetic coding sequence
atggcccagtgcgtgcagagcgtgcaggagctgatccccgacagcttcgtgccctgcgtggccgccctgtgcagcgacgaggccgagagactgaccagactgaaccacctgagcttcgccgagctgctgaagcccttcagcagactgaccagcgaggtgcacatgagagaccccaacaaccagctgcacgtgatcaagaacctgaagatcgccgtgagcaacatcgtgacccagcccccccagcccggcgccatcagaaagctgctgaacgacgtggtgagcggcagccagcccgccgagggcctggtggccaacgtgatcaccgccggcgactacgacctgaacatcagcgccaccaccccctggttcgagagctacagagagaccttcctgcagagcatgcccgccctggaccacgagttcctgaaccactacctggcctgcatgctggtggccagcagcagcgaggccgagcccgtggagcagttcagcaagctgagccaggagcagcacagaatccagcacaacagcgactacagctaccccaagtggttcatccccaacaccctgaagtactacgtgctgctgcacgacgtgagcgccggcgacgagcagagagccgagagcatctacgaggagatgaagcagaagtacggcacccagggctgctacctgctgaagatcaacagcagaaccagcaacagagccagcgacgagcagatccccgacccctggagccagtacctgcagaagaacagcatccagaaccaggagagctacgaggacggcccctgcaccatcaccagcaacaagaacagcgacaacaacctgctgagcctggacggcctggacaacgaggtgaaggacggcctgcccaacaacttcagagcccaccccctgcagctggagcagagcagcgaccccagcaacagcatcgacggccccgaccacctgagaagcgccagcagcctgcacgagaccaagaagggcaacaccggcatcatccacggcgcctgcctgaccctgaccgaccacgacagaatcagacagttcatccaggagttcaccttcagaggcctgctgccccacatcgagaagaccatcagacagctgaacgaccagctgatcagcagaaagggcctgagcagaagcctgttcagcgccaccaagaagtggttcagcggcagcaaggtgcccgagaagagcatcaacgacctgaagaacaccagcggcctgctgtacccccccgaggcccccgagctgcagatcagaaagatggccgacctgtgcttcctggtgcagcactacgacctggcctacagctgctaccacaccgccaagaaggacttcctgaacgaccaggccatgctgtacgccgccggcgccctggagatggccgccgtgagcgccttcctgcagcccggcgcccccagaccctaccccgcccactacatggacaccgccatccagacctacagagacatctgcaagaacatggtgctggccgagagatgcgtgctgctgagcgccgagctgctgaagagccagagcaagtacagcgaggccgccgccctgctgatcagactgaccagcgaggacagcgacctgagaagcgccctgctgctggagcaggccgcccactgcttcatcaacatgaagagccccatggtgagaaagtacgccttccacatgatcctggccggccacagattcagcaaggccggccagaagaagcacgccctgagatgctactgccaggccatgcaggtgtacaagggcaagggctggagcctggccgaggaccacatcaacttcaccatcggcagacagagctacaccctgagacagctggacaacgccgtgagcgccttcagacacatcctgatcaacgagagcaagcagagcgccgcccagcagggcgccttcctgagagagtacctgtacgtgtacaagaacgtgagccagctgagccccgacggccccctgccccagctgcccctgccctacatcaacagcagcgccaccagagtgttcttcggccacgacagaagacccgccgacggcgagaagcaggccgccacccacgtgagcctggaccaggagtacgacagcgagagcagccagcagtggagagagctggaggagcaggtggtgagcgtggtgaacaagggcgtgatccccagcaacttccaccccacccagtactgcctgaacagctacagcgacaacagcagattccccctggccgtggtggaggagcccatcaccgtggaggtggccttcagaaaccccctgaaggtgctgctgctgctgaccgacctgagcctgctgtggaagttccaccccaaggacttcagcggcaaggacaacgaggaggtgaagcagctggtgaccagcgagcccgagatgatcggcgccgaggtgatcagcgagttcctgatcaacggcgaggagagcaaggtggccagactgaagctgttcccccaccacatcggcgagctgcacatcctgggcgtggtgtacaacctgggcaccatccagggcagcatgaccgtggacggcatcggcgccctgcccggctgccacaccggcaagtacagcctgagcatgagcgtgagaggcaagcaggacctggagatccagggccccagactgaacaacaccaaggaggagaagaccagcgtgaagtacggccccgacagaagactggaccccatcatcaccgaggagatgcccctgctggaggtgttcttcatccacttccccaccggcctgctgtgcggcgagatcagaaaggcctacgtggagttcgtgaacgtgagcaagtgccccctgaccggcctgaaggtggtgagcaagagacccgagttcttcaccttcggcggcaacaccgccgtgctgacccccctgagccccagcgccagcgagaactgcagcgcctacaagaccgtggtgaccgacgccaccagcgtgtgcaccgccctgatcagcagcgccagcagcgtggacttcggcatcggcaccggcagccagcccgaggtgatccccgtgcccctgcccgacaccgtgctgctgcccggcgccagcgtgcagctgcccatgtggctgagaggccccgacgaggagggcgtgcacgagatcaacttcctgttctactacgagagcgtgaagaagcagcccaagatcagacacagaatcctgagacacaccgccatcatctgcaccagcagaagcctgaacgtgagagccaccgtgtgcagaagcaacagcctggagaacgaggagggcagaggcggcaacatgctggtgttcgtggacgtggagaacaccaacaccagcgaggccggcgtgaaggagttccacatcgtgcaggtgagcagcagcagcaagcactggaagctgcagaagagcgtgaacctgagcgagaacaaggacaccaagctggccagcagagagaagggcaagttctgcttcaaggccatcagatgcgagaaggaggaggccgccacccagagcagcgagaagtacaccttcgccgacatcatcttcggcaacgagcagatcatcagcagcgccagcccctgcgccgacttcttctacagaagcctgagcagcgagctgaagaagccccaggcccacctgcccgtgcacaccgagaagcagagcaccgaggacgccgtgagactgatccagaagtgcagcgaggtggacctgaacatcgtgatcctgtggaaggcctacgtggtggaggacagcaagcagctgatcctggagggccagcaccacgtgatcctgagaaccatcggcaaggaggccttcagctacccccagaagcaggagccccccgagatggagctgctgaagttcttcagacccgagaacatcaccgtgagcagcagacccagcgtggagcagctgagcagcctgatcaagaccagcctgcactaccccgagagcttcaaccaccccttccaccagaagagcctgtgcctggtgcccgtgaccctgctgctgagcaactgcagcaaggccgacgtggacgtgatcgtggacctgagacacaagaccaccagccccgaggccctggagatccacggcagcttcacctggctgggccagacccagtacaagctgcagctgaagagccaggagatccacagcctgcagctgaaggcctgcttcgtgcacaccggcgtgtacaacctgggcacccccagagtgttcgccaagctgagcgaccaggtgaccgtgttcgagaccagccagcagaacagcatgcccgccctgatcatcatcagcaacgtgtag

SEQ ID NO: 102714 - DNA, 3420 bp, Artificial Sequence
  Description of Artificial Sequence: Synthetic coding sequence
atgagcgtgcccgactacatgcagtgcgccgaggaccaccagaccctgctggtggtggtgcagcccgtgggcatcgtgagcgaggagaacttcttcagaatctacaagagaatctgcagcgtgagccagatcagcgtgagagacagccagagagtgctgtacatcagatacagacaccactacccccccgagaacaacgagtggggcgacttccagacccacagaaaggtggtgggcctgatcaccatcaccgactgcttcagcgccaaggactggccccagaccttcgagaagttccacgtgcagaaggagatctacggcagcaccctgtacgacagcagactgttcgtgttcggcctgcagggcgagatcgtggagcagcccagaaccgacgtggccttctaccccaactacgaggactgccagaccgtggagaagagaatcgaggacttcatcgagagcctgttcatcgtgctggagagcaagagactggacagagccaccgacaagagcggcgacaagatccccctgctgtgcgtgcccttcgagaagaaggacttcgtgggcctggacaccgacagcagacactacaagaagagatgccagggcagaatgagaaagcacgtgggcgacctgtgcctgcaggccggcatgctgcaggacagcctggtgcactaccacatgagcgtggagctgctgagaagcgtgaacgacttcctgtggctgggcgccgccctggagggcctgtgcagcgccagcgtgatctaccactaccccggcggcaccggcggcaagagcggcgccagaagattccagggcagcaccctgcccgccgaggccgccaacagacacagacccggcgccctgaccaccaacggcatcaaccccgacaccagcaccgagatcggcagagccaagaactgcctgagccccgaggacatcatcgacaagtacaaggaggccatcagctactacagcaagtacaagaacgccggcgtgatcgagctggaggcctgcatcaaggccgtgagagtgctggccatccagaagagaagcatggaggccagcgagttcctgcagaacgccgtgtacatcaacctgagacagctgagcgaggaggagaagatccagagatacagcatcctgagcgagctgtacgagctgatcggcttccacagaaagagcgccttcttcaagagagtggccgccatgcagtgcgtggcccccagcatcgccgagcccggctggagagcctgctacaagctgctgctggagaccctgcccggctacagcctgagcctggaccccaaggacttcagcagaggcacccacagaggctgggccgccgtgcagatgagactgctgcacgagctggtgtacgccagcagaagaatgggcaaccccgccctgagcgtgagacacctgagcttcctgctgcagaccatgctggacttcctgagcgaccaggagaagaaggacgtggcccagagcctggagaactacaccagcaagtgccccggcaccatggagcccatcgccctgcccggcggcctgaccctgccccccgtgcccttcaccaagctgcccatcgtgagacacgtgaagctgctgaacctgcccgccagcctgagaccccacaagatgaagagcctgctgggccagaacgtgagcaccaagagccccttcatctacagccccatcatcgcccacaacagaggcgaggagagaaacaagaagatcgacttccagtgggtgcagggcgacgtgtgcgaggtgcagctgatggtgtacaaccccatgcccttcgagctgagagtggagaacatgggcctgctgaccagcggcgtggagttcgagagcctgcccgccgccctgagcctgcccgccgagagcggcctgtaccccgtgaccctggtgggcgtgccccagaccaccggcaccatcaccgtgaacggctaccacaccaccgtgttcggcgtgttcagcgactgcctgctggacaacctgcccggcatcaagaccagcggcagcaccgtggaggtgatccccgccctgcccagactgcagatcagcaccagcctgcccagaagcgcccacagcctgcagcccagcagcggcgacgagatcagcaccaacgtgagcgtgcagctgtacaacggcgagagccagcagctgatcatcaagctggagaacatcggcatggagcccctggagaagctggaggtgaccagcaaggtgctgaccaccaaggagaagctgtacggcgacttcctgagctggaagctggaggagaccctggcccagttccccctgcagcccggcaaggtggccaccttcaccatcaacatcaaggtgaagctggacttcagctgccaggagaacctgctgcaggacctgagcgacgacggcatcagcgtgagcggcttccccctgagcagccccttcagacaggtggtgagacccagagtggagggcaagcccgtgaacccccccgagagcaacaaggccggcgactacagccacgtgaagaccctggaggccgtgctgaacttcaagtacagcggcggccccggccacaccgagggctactacagaaacctgagcctgggcctgcacgtggaggtggagcccagcgtgttcttcaccagagtgagcaccctgcccgccaccagcaccagacagtgccacctgctgctggacgtgttcaacagcaccgagcacgagctgaccgtgagcaccagaagcagcgaggccctgatcctgcacgccggcgagtgccagagaatggccatccaggtggacaagttcaacttcgagagcttccccgagagccccggcgagaagggccagttcgccaaccccaagcagctggaggaggagagaagagaggccagaggcctggagatccacagcaagctgggcatctgctggagaatccccagcctgaagagaagcggcgaggccagcgtggagggcctgctgaaccagctggtgctggagcacctgcagctggcccccctgcagtgggacgtgctggtggacggccagccctgcgacagagaggccgtggccgcctgccaggtgggcgaccccgtgagactggaggtgagactgaccaacagaagccccagaagcgtgggccccttcgccctgaccgtggtgcccttccaggaccaccagaacggcgtgcacaactacgacctgcacgacaccgtgagcttcgtgggcagcagcaccttctacctggacgccgtgcagcccagcggccagagcgcctgcctgggcgccctgctgttcctgtacaccggcgacttcttcctgcacatcagattccacgaggacagcaccagcaaggagctgccccccagctggttctgcctgcccagcgtgcacgtgtgcgccctggaggcccaggcctag

SEQ ID NO: 102715 - DNA, 3741 bp, Artificial Sequence
  Description of Artificial Sequence: Synthetic coding sequence
atggtgcccgccggcgaccaggacagagccccccacagaggcaagcccgcccaggccggcgccagaaccagcagagccagcagagccctgagaagctggagaagaagccaggccgccagagccaccgtgacccaccccagaggcggccacgacagaggcagccacggcggctacagagagggccacagaggctgcagaagagacccccagtgggccagcgccggccccccccccctgagcttcaccgaggaggtgaagttcgagctgagagccctgaaggactgggacttcaagatgagcgtgcccgactacatgcagtgcgccgaggaccaccagaccctgctggtggtggtgcagcccgtgggcatcgtgagcgaggagaacttcttcagaatctacaagagaatctgcagcgtgagccagatcagcgtgagagacagccagagagtgctgtacatcagatacagacaccactacccccccgagaacaacgagtggggcgacttccagacccacagaaaggtggtgggcctgatcaccatcaccgactgcttcagcgccaaggactggccccagaccttcgagaagttccacgtgcagaaggagatctacggcagcaccctgtacgacagcagactgttcgtgttcggcctgcagggcgagatcgtggagcagcccagaaccgacgtggccttctaccccaactacgaggactgccagaccgtggagaagagaatcgaggacttcatcgagagcctgttcatcgtgctggagagcaagagactggacagagccaccgacaagagcggcgacaagatccccctgctgtgcgtgcccttcgagaagaaggacttcgtgggcctggacaccgacagcagacactacaagaagagatgccagggcagaatgagaaagcacgtgggcgacctgtgcctgcaggccggcatgctgcaggacagcctggtgcactaccacatgagcgtggagctgctgagaagcgtgaacgacttcctgtggctgggcgccgccctggagggcctgtgcagcgccagcgtgatctaccactaccccggcggcaccggcggcaagagcggcgccagaagattccagggcagcaccctgcccgccgaggccgccaacagacacagacccggcgcccaggaggtgctgatcgaccccggcgccctgaccaccaacggcatcaaccccgacaccagcaccgagatcggcagagccaagaactgcctgagccccgaggacatcatcgacaagtacaaggaggccatcagctactacagcaagtacaagaacgccggcgtgatcgagctggaggcctgcatcaaggccgtgagagtgctggccatccagaagagaagcatggaggccagcgagttcctgcagaacgccgtgtacatcaacctgagacagctgagcgaggaggagaagatccagagatacagcatcctgagcgagctgtacgagctgatcggcttccacagaaagagcgccttcttcaagagagtggccgccatgcagtgcgtggcccccagcatcgccgagcccggctggagagcctgctacaagctgctgctggagaccctgcccggctacagcctgagcctggaccccaaggacttcagcagaggcacccacagaggctgggccgccgtgcagatgagactgctgcacgagctggtgtacgccagcagaagaatgggcaaccccgccctgagcgtgagacacctgagcttcctgctgcagaccatgctggacttcctgagcgaccaggagaagaaggacgtggcccagagcctggagaactacaccagcaagtgccccggcaccatggagcccatcgccctgcccggcggcctgaccctgccccccgtgcccttcaccaagctgcccatcgtgagacacgtgaagctgctgaacctgcccgccagcctgagaccccacaagatgaagagcctgctgggccagaacgtgagcaccaagagccccttcatctacagccccatcatcgcccacaacagaggcgaggagagaaacaagaagatcgacttccagtgggtgcagggcgacgtgtgcgaggtgcagctgatggtgtacaaccccatgcccttcgagctgagagtggagaacatgggcctgctgaccagcggcgtggagttcgagagcctgcccgccgccctgagcctgcccgccgagagcggcctgtaccccgtgaccctggtgggcgtgccccagaccaccggcaccatcaccgtgaacggctaccacaccaccgtgttcggcgtgttcagcgactgcctgctggacaacctgcccggcatcaagaccagcggcagcaccgtggaggtgatccccgccctgcccagactgcagatcagcaccagcctgcccagaagcgcccacagcctgcagcccagcagcggcgacgagatcagcaccaacgtgagcgtgcagctgtacaacggcgagagccagcagctgatcatcaagctggagaacatcggcatggagcccctggagaagctggaggtgaccagcaaggtgctgaccaccaaggagaagctgtacggcgacttcctgagctggaagctggaggagaccctggcccagttccccctgcagcccggcaaggtggccaccttcaccatcaacatcaaggtgaagctggacttcagctgccaggagaacctgctgcaggacctgagcgacgacggcatcagcgtgagcggcttccccctgagcagccccttcagacaggtggtgagacccagagtggagggcaagcccgtgaacccccccgagagcaacaaggccggcgactacagccacgtgaagaccctggaggccgtgctgaacttcaagtacagcggcggccccggccacaccgagggctactacagaaacctgagcctgggcctgcacgtggaggtggagcccagcgtgttcttcaccagagtgagcaccctgcccgccaccagcaccagacagtgccacctgctgctggacgtgttcaacagcaccgagcacgagctgaccgtgagcaccagaagcagcgaggccctgatcctgcacgccggcgagtgccagagaatggccatccaggtggacaagttcaacttcgagagcttccccgagagccccggcgagaagggccagttcgccaaccccaagcagctggaggaggagagaagagaggccagaggcctggagatccacagcaagctgggcatctgctggagaatccccagcctgaagagaagcggcgaggccagcgtggagggcctgctgaaccagctggtgctggagcacctgcagctggcccccctgcagtgggacgtgctggtggacggccagccctgcgacagagaggccgtggccgcctgccaggtgggcgaccccgtgagactggaggtgagactgaccaacagaagccccagaagcgtgggccccttcgccctgaccgtggtgcccttccaggaccaccagaacggcgtgcacaactacgacctgcacgacaccgtgagcttcgtgggcagcagcaccttctacctggacgccgtgcagcccagcggccagagcgcctgcctgggcgccctgctgttcctgtacaccggcgacttcttcctgcacatcagattccacgaggacagcaccagcaaggagctgccccccagctggttctgcctgcccagcgtgcacgtgtgcgccctggaggcccaggcctag

SEQ ID NO: 102716 - DNA, 3447 bp, Artificial Sequence
  Description of Artificial Sequence: Synthetic coding sequence
atgagcgtgcccgactacatgcagtgcgccgaggaccaccagaccctgctggtggtggtgcagcccgtgggcatcgtgagcgaggagaacttcttcagaatctacaagagaatctgcagcgtgagccagatcagcgtgagagacagccagagagtgctgtacatcagatacagacaccactacccccccgagaacaacgagtggggcgacttccagacccacagaaaggtggtgggcctgatcaccatcaccgactgcttcagcgccaaggactggccccagaccttcgagaagttccacgtgcagaaggagatctacggcagcaccctgtacgacagcagactgttcgtgttcggcctgcagggcgagatcgtggagcagcccagaaccgacgtggccttctaccccaactacgaggactgccagaccgtggagaagagaatcgaggacttcatcgagagcctgttcatcgtgctggagagcaagagactggacagagccaccgacaagagcggcgacaagatccccctgctgtgcgtgcccttcgagaagaaggacttcgtgggcctggacaccgacagcagacactacaagaagagatgccagggcagaatgagaaagcacgtgggcgacctgtgcctgcaggccggcatgctgcaggacagcctggtgcactaccacatgagcgtggagctgctgagaagcgtgaacgacttcctgtggctgggcgccgccctggagggcctgtgcagcgccagcgtgatctaccactaccccggcggcaccggcggcaagagcggcgccagaagattccagggcagcaccctgcccgccgaggccgccaacagacacagacccggcgcccaggaggtgctgatcgaccccggcgccctgaccaccaacggcatcaaccccgacaccagcaccgagatcggcagagccaagaactgcctgagccccgaggacatcatcgacaagtacaaggaggccatcagctactacagcaagtacaagaacgccggcgtgatcgagctggaggcctgcatcaaggccgtgagagtgctggccatccagaagagaagcatggaggccagcgagttcctgcagaacgccgtgtacatcaacctgagacagctgagcgaggaggagaagatccagagatacagcatcctgagcgagctgtacgagctgatcggcttccacagaaagagcgccttcttcaagagagtggccgccatgcagtgcgtggcccccagcatcgccgagcccggctggagagcctgctacaagctgctgctggagaccctgcccggctacagcctgagcctggaccccaaggacttcagcagaggcacccacagaggctgggccgccgtgcagatgagactgctgcacgagctggtgtacgccagcagaagaatgggcaaccccgccctgagcgtgagacacctgagcttcctgctgcagaccatgctggacttcctgagcgaccaggagaagaaggacgtggcccagagcctggagaactacaccagcaagtgccccggcaccatggagcccatcgccctgcccggcggcctgaccctgccccccgtgcccttcaccaagctgcccatcgtgagacacgtgaagctgctgaacctgcccgccagcctgagaccccacaagatgaagagcctgctgggccagaacgtgagcaccaagagccccttcatctacagccccatcatcgcccacaacagaggcgaggagagaaacaagaagatcgacttccagtgggtgcagggcgacgtgtgcgaggtgcagctgatggtgtacaaccccatgcccttcgagctgagagtggagaacatgggcctgctgaccagcggcgtggagttcgagagcctgcccgccgccctgagcctgcccgccgagagcggcctgtaccccgtgaccctggtgggcgtgccccagaccaccggcaccatcaccgtgaacggctaccacaccaccgtgttcggcgtgttcagcgactgcctgctggacaacctgcccggcatcaagaccagcggcagcaccgtggaggtgatccccgccctgcccagactgcagatcagcaccagcctgcccagaagcgcccacagcctgcagcccagcagcggcgacgagatcagcaccaacgtgagcgtgcagctgtacaacggcgagagccagcagctgatcatcaagctggagaacatcggcatggagcccctggagaagctggaggtgaccagcaaggtgctgaccaccaaggagaagctgtacggcgacttcctgagctggaagctggaggagaccctggcccagttccccctgcagcccggcaaggtggccaccttcaccatcaacatcaaggtgaagctggacttcagctgccaggagaacctgctgcaggacctgagcgacgacggcatcagcgtgagcggcttccccctgagcagccccttcagacaggtggtgagacccagagtggagggcaagcccgtgaacccccccgagagcaacaaggccggcgactacagccacgtgaagaccctggaggccgtgctgaacttcaagtacagcggcggccccggccacaccgagggctactacagaaacctgagcctgggcctgcacgtggaggtggagcccagcgtgttcttcaccagagtgagcaccctgcccgccaccagcaccagacagtgccacctgctgctggacgtgttcaacagcaccgagcacgagctgaccgtgagcaccagaagcagcgaggccctgatcctgcacgccggcgagtgccagagaatggccatccaggtggacaagttcaacttcgagagcttccccgagagccccggcgagaagggccagttcgccaaccccaagcagctggaggaggagagaagagaggccagaggcctggagatccacagcaagctgggcatctgctggagaatccccagcctgaagagaagcggcgaggccagcgtggagggcctgctgaaccagctggtgctggagcacctgcagctggcccccctgcagtgggacgtgctggtggacggccagccctgcgacagagaggccgtggccgcctgccaggtgggcgaccccgtgagactggaggtgagactgaccaacagaagccccagaagcgtgggccccttcgccctgaccgtggtgcccttccaggaccaccagaacggcgtgcacaactacgacctgcacgacaccgtgagcttcgtgggcagcagcaccttctacctggacgccgtgcagcccagcggccagagcgcctgcctgggcgccctgctgttcctgtacaccggcgacttcttcctgcacatcagattccacgaggacagcaccagcaaggagctgccccccagctggttctgcctgcccagcgtgcacgtgtgcgccctggaggcccaggcctag

SEQ ID NO: 102717 - DNA, 2862 bp, Artificial Sequence
  Description of Artificial Sequence: Synthetic coding sequence
atggccctggtgttccagttcggccagcccgtgagagcccagcccctgcccggcctgtgccacggcaagctgatcagaaccaacgcctgcgacgtgtgcaacagcaccgacctgcccgaggtggagatcatcagcctgctggaggagcagctgccccactacaagctgagagccgacaccatctacggctacgaccacgacgactggctgcacacccccctgatcagccccgacgccaacatcgacctgaccaccgagcagatcgaggagaccctgaagtacttcctgctgtgcgccgagagagtgggccagatgaccaagacctacaacgacatcgacgccgtgaccagactgctggaggagaaggagagagacctggagctggccgccagaatcggccagagcctgctgaagaagaacaagaccctgaccgagagaaacgagctgctggaggagcaggtggagcacatcagagaggaggtgagccagctgagacacgagctgagcatgaaggacgagctgctgcagttctacaccagcgccgccgaggagagcgagcccgagagcgtgtgcagcacccccctgaagagaaacgagagcagcagcagcgtgcagaactacttccacctggacagcctgcagaagaagctgaaggacctggaggaggagaacgtggtgctgagaagcgaggccagccagctgaagaccgagaccatcacctacgaggagaaggagcagcagctggtgaacgactgcgtgaaggagctgagagacgccaacgtgcagatcgccagcatcagcgaggagctggccaagaagaccgaggacgccgccagacagcaggaggagatcacccacctgctgagccagatcgtggacctgcagaagaaggccaaggcctgcgccgtggagaacgaggagctggtgcagcacctgggcgccgccaaggacgcccagagacagctgaccgccgagctgagagagctggaggacaagtacgccgagtgcatggagatgctgcacgaggcccaggaggagctgaagaacctgagaaacaagaccatgcccaacaccaccagcagaagataccacagcctgggcctgttccccatggacagcctggccgccgagatcgagggcaccatgagaaaggagctgcagctggaggaggccgagagccccgacatcacccaccagaagagagtgttcgagaccgtgagaaacatcaaccaggtggtgaagcagagaagcctgacccccagccccatgaacatccccggcagcaaccagagcagcgccatgaacagcctgctgagcagctgcgtgagcacccccagaagcagcttctacggcagcgacatcggcaacgtggtgctggacaacaagaccaacagcatcatcctggagaccgaggccgccgacctgggcaacgacgagagaagcaagaagcccggcacccccggcacccccggcagccacgacctggagaccgccctgagaagactgagcctgagaagagagaactacctgagcgagagaagattcttcgaggaggagcaggagagaaagctgcaggagctggccgagaagggcgagctgagaagcggcagcctgacccccaccgagagcatcatgagcctgggcacccacagcagattcagcgagttcaccggcttcagcggcatgagcttcagcagcagaagctacctgcccgagaagctgcagatcgtgaagcccctggagggcagcgccaccctgcaccactggcagcagctggcccagccccacctgggcggcatcctggaccccagacccggcgtggtgaccaagggcttcagaaccctggacgtggacctggacgaggtgtactgcctgaacgacttcgaggaggacgacaccggcgaccacatcagcctgcccagactggccaccagcacccccgtgcagcaccccgagaccagcgcccaccaccccggcaagtgcatgagccagaccaacagcaccttcaccttcaccacctgcagaatcctgcaccccagcgacgagctgaccagagtgacccccagcctgaacagcgcccccacccccgcctgcggcagcaccagccacctgaagagcacccccgtggccaccccctgcacccccagaagactgagcctggccgagagcttcaccaacaccagagagagcaccaccaccatgagcaccagcctgggcctggtgtggctgctgaaggagagaggcatcagcgccgccgtgtacgacccccagagctgggacagagccggcagaggcagcctgctgcacagctacacccccaagatggccgtgatccccagcaccccccccaacagccccatgcagacccccaccagcagcccccccagcttcgagttcaagtgcaccagccccccctacgacaacttcctggccagcaagcccgccagcagcatcctgagagaggtgagagagaagaacgtgagaagcagcgagagccagaccgacgtgagcgtgagcaacctgaacctggtggacaaggtgagaagattcggcgtggccaaggtggtgaacagcggcagagcccacgtgcccaccctgaccgaggagcagggccccctgctgtgcggcccccccggccccgcccccgccctggtgcccagaggcctggtgcccgagggcctgcccctgagatgccccaccgtgaccagcgccatcggcggcctgcagctgaacagcggcatcagaagaaacagaagcttccccaccatggtgggcagcagcatgcagatgaaggcccccgtgaccctgaccagcggcatcctgatgggcgccaagctgagcaagcagaccagcctgagatag

SEQ ID NO: 102718 - DNA, 2061 bp, Artificial Sequence
  Description of Artificial Sequence: Synthetic coding sequence
atgagcctgagagacaagggcggcgaggaggagtgcttcgagtacgactgccaggacgaggagagaaagcccacccacagacagcacgacacccaggacctgctggaggaggtgctgtgcgccgagagagtgggccagatgaccaagacctacaacgacatcgacgccgtgaccagactgctggaggagaaggagagagacctggagctggccgccagaatcggccagagcctgctgaagaagaacaagaccctgaccgagagaaacgagctgctggaggagcaggtggagcacatcagagaggaggtgagccagctgagacacgagctgagcatgaaggacgagctgctgcagttctacaccagcgccgccgaggagagcgagcccgagagcgtgtgcagcacccccctgaagagaaacgagagcagcagcagcgtgcagaactacttccacctggacagcctgcagaagaagctgaaggacctggaggaggagaacgtggtgctgagaagcgaggccagccagctgaagaccgagaccatcacctacgaggagaaggagcagcagctggtgaacgactgcgtgaaggagctgagagacgccaacgtgcagatcgccagcatcagcgaggagctggccaagaagaccgaggacgccgccagacagcaggaggagatcacccacctgctgagccagatcgtggacctgcagaagaaggccaaggcctgcgccgtggagaacgaggagctggtgcagcacctgggcgccgccaaggacgcccagagacagctgaccgccgagctgagagagctggaggacaagtacgccgagtgcatggagatgctgcacgaggcccaggaggagctgaagaacctgagaaacaagaccatgcccaacaccaccagcagaagataccacagcctgggcctgttccccatggacagcctggccgccgagatcgagggcaccatgagaaaggagctgcagctggaggaggccgagagccccgacatcacccaccagaagagagtgttcgagaccgtgagaaacatcaaccaggtggtgaagcagagaagcctgacccccagccccatgaacatccccggcagcaaccagagcagcgccatgaacagcctgctgagcagctgcgtgagcacccccagaagcagcttctacggcagcgacatcggcaacgtggtgctggacaacaagaccaacagcatcatcctggagaccgaggccgccgacctgggcaacgacgagagaagcaagaagcccggcacccccggcacccccggcagccacgacctggagaccgccctgagaagactgagcctgagaagagagaactacctgagcgagagaagattcttcgaggaggagcaggagagaaagctgcaggagctggccgagaagggcgagctgagaagcggcagcctgacccccaccgagagcatcatgagcctgggcacccacagcagattcagcgagttcaccggcttcagcggcatgagcttcagcagcagaagctacctgcccgagaagctgcagatcgtgaagcccctggagggcagcgccaccctgcaccactggcagcagctggcccagccccacctgggcggcatcctggaccccagacccggcgtggtgaccaagggcttcagaaccctggacgtggacctggacgaggtgtactgcctgaacgacttcgaggaggacgacaccggcgaccacatcagcctgcccagactggccaccagcacccccgtgcagcaccccgagaccagcggcgagagaagccaggccagagtgaccgtgagcggcagcagaagctaccccagcagaccccaggccagccccgaggagatgcaggagccccccgccgccaccgaggaggaggaggaggaggaggaggaggagggcagcggcgagggcaccaccatcagccccgtgaacctggcccccttccccgaggccgagttctgggccatcctgaccagcgtgcccggcaccatcagaagcggcagcctgagcgtggccagcgccagactgtgcggctag

SEQ ID NO: 102719 - DNA, 2688 bp, Artificial Sequence
  Description of Artificial Sequence: Synthetic coding sequence
atgagcctgagagacaagggcggcgaggaggagtgcttcgagtacgactgccaggacgaggagagaaagcccacccacagacagcacgacacccaggacctgctggaggaggtgctgtgcgccgagagagtgggccagatgaccaagacctacaacgacatcgacgccgtgaccagactgctggaggagaaggagagagacctggagctggccgccagaatcggccagagcctgctgaagaagaacaagaccctgaccgagagaaacgagctgctggaggagcaggtggagcacatcagagaggaggtgagccagctgagacacgagctgagcatgaaggacgagctgctgcagttctacaccagcgccgccgaggagagcgagcccgagagcgtgtgcagcacccccctgaagagaaacgagagcagcagcagcgtgcagaactacttccacctggacagcctgcagaagaagctgaaggacctggaggaggagaacgtggtgctgagaagcgaggccagccagctgaagaccgagaccatcacctacgaggagaaggagcagcagctggtgaacgactgcgtgaaggagctgagagacgccaacgtgcagatcgccagcatcagcgaggagctggccaagaagaccgaggacgccgccagacagcaggaggagatcacccacctgctgagccagatcgtggacctgcagaagaaggccaaggcctgcgccgtggagaacgaggagctggtgcagcacctgggcgccgccaaggacgcccagagacagctgaccgccgagctgagagagctggaggacaagtacgccgagtgcatggagatgctgcacgaggcccaggaggagctgaagaacctgagaaacaagaccatgcccaacaccaccagcagaagataccacagcctgggcctgttccccatggacagcctggccgccgagatcgagggcaccatgagaaaggagctgcagctggaggaggccgagagccccgacatcacccaccagaagagagtgttcgagaccgtgagaaacatcaaccaggtggtgaagcagagaagcctgacccccagccccatgaacatccccggcagcaaccagagcagcgccatgaacagcctgctgagcagctgcgtgagcacccccagaagcagcttctacggcagcgacatcggcaacgtggtgctggacaacaagaccaacagcatcatcctggagaccgaggccgccgacctgggcaacgacgagagaagcaagaagcccggcacccccggcacccccggcagccacgacctggagaccgccctgagaagactgagcctgagaagagagaactacctgagcgagagaagattcttcgaggaggagcaggagagaaagctgcaggagctggccgagaagggcgagctgagaagcggcagcctgacccccaccgagagcatcatgagcctgggcacccacagcagattcagcgagttcaccggcttcagcggcatgagcttcagcagcagaagctacctgcccgagaagctgcagatcgtgaagcccctggagggcagcgccaccctgcaccactggcagcagctggcccagccccacctgggcggcatcctggaccccagacccggcgtggtgaccaagggcttcagaaccctggacgtggacctggacgaggtgtactgcctgaacgacttcgaggaggacgacaccggcgaccacatcagcctgcccagactggccaccagcacccccgtgcagcaccccgagaccagcgcccaccaccccggcaagtgcatgagccagaccaacagcaccttcaccttcaccacctgcagaatcctgcaccccagcgacgagctgaccagagtgacccccagcctgaacagcgcccccacccccgcctgcggcagcaccagccacctgaagagcacccccgtggccaccccctgcacccccagaagactgagcctggccgagagcttcaccaacaccagagagagcaccaccaccatgagcaccagcctgggcctggtgtggctgctgaaggagagaggcatcagcgccgccgtgtacgacccccagagctgggacagagccggcagaggcagcctgctgcacagctacacccccaagatggccgtgatccccagcaccccccccaacagccccatgcagacccccaccagcagcccccccagcttcgagttcaagtgcaccagccccccctacgacaacttcctggccagcaagcccgccagcagcatcctgagagaggtgagagagaagaacgtgagaagcagcgagagccagaccgacgtgagcgtgagcaacctgaacctggtggacaaggtgagaagattcggcgtggccaaggtggtgaacagcggcagagcccacgtgcccaccctgaccgaggagcagggccccctgctgtgcggcccccccggccccgcccccgccctggtgcccagaggcctggtgcccgagggcctgcccctgagatgccccaccgtgaccagcgccatcggcggcctgcagctgaacagcggcatcagaagaaacagaagcttccccaccatggtgggcagcagcatgcagatgaaggcccccgtgaccctgaccagcggcatcctgatgggcgccaagctgagcaagcagaccagcctgagatag

SEQ ID NO: 102720 - DNA, 2361 bp, Artificial Sequence
  Description of Artificial Sequence: Synthetic coding sequence
atggccctggtgttccagttcggccagcccgtgagagcccagcccctgcccggcctgtgccacggcaagctgatcagaaccaacgcctgcgacgtgtgcaacagcaccgacctgcccgaggtggagatcatcagcctgctggaggagcagctgccccactacaagctgagagccgacaccatctacggctacgaccacgacgactggctgcacacccccctgatcagccccgacgccaacatcgacctgaccaccgagcagatcgaggagaccctgaagtacttcctgctgtgcgccgagagagtgggccagatgaccaagacctacaacgacatcgacgccgtgaccagactgctggaggagaaggagagagacctggagctggccgccagaatcggccagagcctgctgaagaagaacaagaccctgaccgagagaaacgagctgctggaggagcaggtggagcacatcagagaggaggtgagccagctgagacacgagctgagcatgaaggacgagctgctgcagttctacaccagcgccgccgaggagagcgagcccgagagcgtgtgcagcacccccctgaagagaaacgagagcagcagcagcgtgcagaactacttccacctggacagcctgcagaagaagctgaaggacctggaggaggagaacgtggtgctgagaagcgaggccagccagctgaagaccgagaccatcacctacgaggagaaggagcagcagctggtgaacgactgcgtgaaggagctgagagacgccaacgtgcagatcgccagcatcagcgaggagctggccaagaagaccgaggacgccgccagacagcaggaggagatcacccacctgctgagccagatcgtggacctgcagaagaaggccaaggcctgcgccgtggagaacgaggagctggtgcagcacctgggcgccgccaaggacgcccagagacagctgaccgccgagctgagagagctggaggacaagtacgccgagtgcatggagatgctgcacgaggcccaggaggagctgaagaacctgagaaacaagaccatgcccaacaccaccagcagaagataccacagcctgggcctgttccccatggacagcctggccgccgagatcgagggcaccatgagaaaggagctgcagctggaggaggccgagagccccgacatcacccaccagaagagagtgttcgagaccgtgagaaacatcaaccaggtggtgaagcagagaagcctgacccccagccccatgaacatccccggcagcaaccagagcagcgccatgaacagcctgctgagcagctgcgtgagcacccccagaagcagcttctacggcagcgacatcggcaacgtggtgctggacaacaagaccaacagcatcatcctggagaccgaggccgccgacctgggcaacgacgagagaagcaagaagcccggcacccccggcacccccggcagccacgacctggagaccgccctgagaagactgagcctgagaagagagaactacctgagcgagagaagattcttcgaggaggagcaggagagaaagctgcaggagctggccgagaagggcgagctgagaagcggcagcctgacccccaccgagagcatcatgagcctgggcacccacagcagattcagcgagttcaccggcttcagcggcatgagcttcagcagcagaagctacctgcccgagaagctgcagatcgtgaagcccctggagggcagcgccaccctgcaccactggcagcagctggcccagccccacctgggcggcatcctggaccccagacccggcgtggtgaccaagggcttcagaaccctggacgtggacctggacgaggtgtactgcctgaacgacttcgaggaggacgacaccgcccaccaccccggcaagtgcatgagccagaccaacagcaccttcaccttcaccacctgcagaatcctgcaccccagcgacgagctgaccagagtgacccccagcctgaacagcgcccccacccccgcctgcggcagcaccagccacctgaagagcacccccgtggccaccccctgcacccccagaagactgagcctggccgagagcttcaccaacaccagagagagcaccaccaccatgagcaccagcctgggcctggtgtggctgctgaaggagagaggcatcagcgccgccgtgtacgacccccagagctgggacagagccggcagaggcagcctgctgcacagccacgaggacgtgacctgcgccaacctgggcgagggcggcgtgctgagcagcttcctgctgagaagcaccgagacccccaagtgcgtgctgatcccctggatcggcaaccagtag

SEQ ID NO: 102721 - DNA, 2745 bp, Artificial Sequence
  Description of Artificial Sequence: Synthetic coding sequence
atgagccagagccagaacgccatcttcaccagccccaccggcgaggagaacctgatgaacagcaaccacagagacagcgagagcatcaccgacgtgtgcagcaacgaggacctgcccgaggtggagctggtgagcctgctggaggagcagctgccccagtacagactgaaggtggacaccctgttcctgtacgagaaccaggactggacccagagcccccaccagagacagcacgccagcgacgccctgagccccgtgctggccgaggagaccttcagatacatgatcctgggcaccgacagagtggagcagatgaccaagacctacaacgacatcgacatggtgacccacctgctggccgagagagacagagacctggagctggccgccagaatcggccaggccctgctgaagagaaaccacgtgctgagcgagcagaacgagagcctggaggagcagctgggccaggccttcgaccaggtgaaccagctgcagcacgagctgtgcaagaaggacgagctgctgagaatcgtgagcatcgccagcgaggagagcgagaccgacagcagctgcagcacccccctgagattcaacgagagcttcagcctgagccagggcctgctgcagctggagatgctgcaggagaagctgaaggagctggaggaggagaacatggccctgagaagcaaggcctgccacatcaagaccgagaccgtgacctacgaggagaaggagcagcagctggtgagcgactgcgtgaaggagctgagagagaccaacgcccagatgagcagaatgaccgaggagctgagcggcaagagcgacgagctgatcagataccaggaggagctgagcagcctgctgagccagatcgtggacctgcagcacaagctgaaggagcacgtgatcgagaaggaggagctgaagctgcacctgcaggccagcaaggacgcccagagacagctgaccatggagctgcacgagctgcaggacagaaacatggagtgcctgggcatgctgcacgagagccaggaggagatcaaggagctgagaagcagaagcggccccaccgcccacctgtacttcagccagagctacggcgccttcaccggcgagagcctggccgccgagatcgagggcaccatgagaaagaagctgagcctggacgaggagagcagcctgttcaagcagaaggcccagcagaagagagtgttcgacaccgtgagaatcgccaacgacaccagaggcagaagcatcagcttccccgccctgctgcccatccccggcagcaacagaagcagcgtgatcatgaccgccaagcccttcgagagcggcctgcagcagaccgaggacaagagcctgctgaaccagggcagcagcagcgaggaggtggccggcagcagccagaagatgggccagcccggccccagcggcgacagcgacctggccaccgccctgcacagactgagcctgagaagacagaactacctgagcgagaagcagttcttcgccgaggagtggcagagaaagatccaggtgctggccgaccagaaggagggcgtgagcggctgcgtgacccccaccgagagcctggccagcctgtgcaccacccagagcgagatcaccgacctgagcagcgccagctgcctgagaggcttcatgcccgagaagctgcagatcgtgaagcccctggagggcagccagaccctgtaccactggcagcagctggcccagcccaacctgggcaccatcctggaccccagacccggcgtgatcaccaagggcttcacccagctgcccggcgacgccatctaccacatcagcgacctggaggaggacgaggaggagggcatcaccttccaggtgcagcagcccctggaggtggaggagaagctgagcaccagcaagcccgtgaccggcatcttcctgccccccatcaccagcgccggcggccccgtgaccgtggccaccgccaaccccggcaagtgcctgagctgcaccaacagcaccttcaccttcaccacctgcagaatcctgcaccccagcgacatcacccaggtgacccccagcagcggcttccccagcctgagctgcggcagcagcggcagcagcagcagcaacaccgccgtgaacagccccgccctgagctacagactgagcatcggcgagagcatcaccaacagaagagacagcaccaccaccttcagcagcaccatgagcctggccaagctgctgcaggagagaggcatcagcgccaaggtgtaccacagccccatcagcgagaaccccctgcagcccctgcccaagagcctggccatccccagcaccccccccaacagccccagccacagcccctgccccagccccctgcccttcgagcccagagtgcacctgagcgagaacttcctggccagcagacccgccgagaccttcctgcaggagatgtacggcctgagacccagcagaaacccccccgacgtgggccagctgaagatgaacctggtggacagactgaagagactgggcatcgccagagtggtgaagaaccccggcgcccaggagaacggcagatgccaggaggccgagatcggcccccagaagcccgacagcgccgtgtacctgaacagcggcagcagcctgctgggcggcctgagaagaaaccagagcctgcccgtgatcatgggcagcttcgccgcccccgtgtgcaccagcagccccaagatgggcgtgctgaaggaggactag

SEQ ID NO: 102722 - DNA, 936 bp, Artificial Sequence
  Description of Artificial Sequence: Synthetic coding sequence
atgagccagagccagaacgccatcttcaccagccccaccggcgaggagaacctgatgaacagcaaccacagagacagcgagagcatcaccgacgtgtgcagcaacgaggacctgcccgaggtggagctggtgagcctgctggaggagcagctgccccagtacagactgaaggtggacaccctgttcctgtacgagaaccaggactggacccagagcccccaccagagacagcacgccagcgacgccctgagccccgtgctggccgaggagaccttcagatacatgatcctgggcaccgacagagtggagcagatgaccaagacctacaacgacatcgacatggtgacccacctgctggccgagagagacagagacctggagctggccgccagaatcggccaggccctgctgaagagaaaccacgtgctgagcgagcagaacgagagcctggaggagcagctgggccaggccttcgaccaggtgaaccagctgcagcacgagctgtgcaagaaggacgagctgctgagaatcgtgagcatcgccagcgaggagagcgagaccgacagcagctgcagcacccccctgagattcaacgagagcttcagcctgagccagggcctgctgcagctggagatgctgcaggagaagctgaaggagctggaggaggagaacatggccctgagaagcaaggcctgccacatcaagaccgagaccgtgacctacgaggagaaggagcagcagctggtgagcgactgcgtgaaggagctgagagagaccaacgcccagatgagcagaatgaccgaggagctgagcggcaagagcgacgagctgatcagataccaggaggagctgagcagcctgctgagccagatcgtggacctgcagcacaagctgaaggaggtgggcctgttcatccacagcaccgacatctgctag

SEQ ID NO: 102723 - DNA, 93 bp, Artificial Sequence
  Description of Artificial Sequence: Synthetic coding sequence
atgagccagagccagaacgccatcttcaccagccccaccggcgaggagaacctgatgaacagcaaccacagagacagcgagagcatcacctag

SEQ ID NO: 102724 - DNA, 2340 bp, Artificial Sequence
  Description of Artificial Sequence: Synthetic coding sequence
atgatcctgggcaccgacagagtggagcagatgaccaagacctacaacgacatcgacatggtgacccacctgctggccgagagagacagagacctggagctggccgccagaatcggccaggccctgctgaagagaaaccacgtgctgagcgagcagaacgagagcctggaggagcagctgggccaggccttcgaccaggtgaaccagctgcagcacgagctgtgcaagaaggacgagctgctgagaatcgtgagcatcgccagcgaggagagcgagaccgacagcagctgcagcacccccctgagattcaacgagagcttcagcctgagccagggcctgctgcagctggagatgctgcaggagaagctgaaggagctggaggaggagaacatggccctgagaagcaaggcctgccacatcaagaccgagaccgtgacctacgaggagaaggagcagcagctggtgagcgactgcgtgaaggagctgagagagaccaacgcccagatgagcagaatgaccgaggagctgagcggcaagagcgacgagctgatcagataccaggaggagctgagcagcctgctgagccagatcgtggacctgcagcacaagctgaaggagcacgtgatcgagaaggaggagctgaagctgcacctgcaggccagcaaggacgcccagagacagctgaccatggagctgcacgagctgcaggacagaaacatggagtgcctgggcatgctgcacgagagccaggaggagatcaaggagctgagaagcagaagcggccccaccgcccacctgtacttcagccagagctacggcgccttcaccggcgagagcctggccgccgagatcgagggcaccatgagaaagaagctgagcctggacgaggagagcagcctgttcaagcagaaggcccagcagaagagagtgttcgacaccgtgagaatcgccaacgacaccagaggcagaagcatcagcttccccgccctgctgcccatccccggcagcaacagaagcagcgtgatcatgaccgccaagcccttcgagagcggcctgcagcagaccgaggacaagagcctgctgaaccagggcagcagcagcgaggaggtggccggcagcagccagaagatgggccagcccggccccagcggcgacagcgacctggccaccgccctgcacagactgagcctgagaagacagaactacctgagcgagaagcagttcttcgccgaggagtggcagagaaagatccaggtgctggccgaccagaaggagggcgtgagcggctgcgtgacccccaccgagagcctggccagcctgtgcaccacccagagcgagatcaccgacctgagcagcgccagctgcctgagaggcttcatgcccgagaagctgcagatcgtgaagcccctggagggcagccagaccctgtaccactggcagcagctggcccagcccaacctgggcaccatcctggaccccagacccggcgtgatcaccaagggcttcacccagctgcccggcgacgccatctaccacatcagcgacctggaggaggacgaggaggagggcatcaccttccaggtgcagcagcccctggaggtggaggagaagctgagcaccagcaagcccgtgaccggcatcttcctgccccccatcaccagcgccggcggccccgtgaccgtggccaccgccaaccccggcaagtgcctgagctgcaccaacagcaccttcaccttcaccacctgcagaatcctgcaccccagcgacatcacccaggtgacccccagcagcggcttccccagcctgagctgcggcagcagcggcagcagcagcagcaacaccgccgtgaacagccccgccctgagctacagactgagcatcggcgagagcatcaccaacagaagagacagcaccaccaccttcagcagcaccatgagcctggccaagctgctgcaggagagaggcatcagcgccaaggtgtaccacagccccatcagcgagaaccccctgcagcccctgcccaagagcctggccatccccagcaccccccccaacagccccagccacagcccctgccccagccccctgcccttcgagcccagagtgcacctgagcgagaacttcctggccagcagacccgccgagaccttcctgcaggagatgtacggcctgagacccagcagaaacccccccgacgtgggccagctgaagatgaacctggtggacagactgaagagactgggcatcgccagagtggtgaagaaccccgtgcccaagagaatggaggacgccagaagacagaagctggtgctgaagaaccagatcctgctgttcatctag

SEQ ID NO: 102725 - DNA, 486 bp, Artificial Sequence
  Description of Artificial Sequence: Synthetic coding sequence
atggagaagcccctgaccgtgctgagagtgagcctgtaccaccccaccctgggccccagcgccttcgccaacgtgccccccagactgcagcacgacaccagccccctgctgctgggcagaggccaggacgcccacctgcagctgcagctgcccagactgagcagaagacacctgagcctggagccctacctggagaagggcagcgccctgctggccttctgcctgaaggccctgagcagaaagggctgcgtgtgggtgaacggcctgaccctgagatacctggagcaggtgcccctgagcaccgtgaacagagtgagcttcagcggcatccagatgctggtgagagtggaggagggcaccagcctggaggccttcgtgtgctacttccacgtgagccccagccccctgatctacagacccgaggccgaggagaccgacgagtgggagggcatcagccagggccagcccccccccggcagcggctag

SEQ ID NO: 102726 - DNA, 1749 bp, Artificial Sequence
  Description of Artificial Sequence: Synthetic coding sequence
atggccgagttcctggacgaccaggagaccagactgtgcgacaactgcaagaaggagatccccgtgttcaacttcaccatccacgagatccactgccagagaaacatcggcatgtgccccacctgcaaggagcccttccccaagagcgacatggagacccacatggccgccgagcactgccaggtgacctgcaagtgcaacaagaagctggagaagagactgctgaagaagcacgaggagaccgagtgccccctgagactggccgtgtgccagcactgcgacctggagctgagcatcctgaagctgaaggagcacgaggactactgcggcgccagaaccgagctgtgcggcaactgcggcagaaacgtgctggtgaaggacctgaagacccaccccgaggtgtgcggcagagagggcgaggagaagagaaacgaggtggccatcccccccaacgcctacgacgagagctggggccaggacggcatctggatcgccagccagctgctgagacagatcgaggccctggacccccccatgagactgcccagaagacccctgagagccttcgagagcgacgtgttccacaacagaaccaccaaccagagaaacatcaccgcccaggtgagcatccagaacaacctgttcgaggagcaggagagacaggagagaaacagaggccagcagccccccaaggagggcggcgaggagagcgccaacctggacttcatgctggccctgagcctgcagaacgagggccaggccagcagcgtggccgagcaggacttctggagagccgtgtgcgaggccgaccagagccacggcggccccagaagcctgagcgacatcaagggcgccgccgacgagatcatgctgccctgcgagttctgcgaggagctgtaccccgaggagctgctgatcgaccaccagaccagctgcaaccccagcagagccctgcccagcctgaacaccggcagcagcagccccagaggcgtggaggagcccgacgtgatcttccagaacttcctgcagcaggccgccagcaaccagctggacagcctgatgggcctgagcaacagccaccccgtggaggagagcatcatcatcccctgcgagttctgcggcgtgcagctggaggaggaggtgctgttccaccaccaggaccagtgcgaccagagacccgccaccgccaccaaccacgtgaccgagggcatccccagactggacagccagccccaggagaccagccccgagctgcccagaagaagagtgagacaccagggcgacctgagcagcggctacctggacgacaccaagcaggagaccgccaacggccccaccagctgcctgccccccagcagacccatcaacaacatgaccgccacctacaaccagctgagcagaagcaccagcggccccagacccggctgccagcccagcagcccctgcgtgcccaagctgagcaacagcgacagccaggacatccagggcagaaacagagacagccagaacggcgccatcgcccccggccacgtgagcgtgatcagacccccccagaacctgtaccccgagaacatcgtgcccagcttcagccccggccccagcggcagatacggcgccagcggcagaagcgagggcggcagaaacagcagagtgacccccgccgccgccaactacagaagcagaaccgccaaggccaagcccagcaagcagcagggcgccggcgacgccgaggaggaggaggaggagtag

SEQ ID NO: 102727 - DNA, 1749 bp, Artificial Sequence; identical to SEQ ID NO: 102726
  Description of Artificial Sequence: Synthetic coding sequence

SEQ ID NO: 102728 - DNA, 408 bp, Artificial Sequence
  Description of Artificial Sequence: Synthetic coding sequence
atggccgagttcctggacgaccaggagaccagactgtgcgacaactgcaagaaggagatccccgtgttcaacttcaccatccacgagatccactgccagagaaacatcggcatgtgccccacctgcaaggagcccttccccaagagcgacatggagacccacatggccgccgagcactgccaggtgacctgcaagtgcaacaagaagctggagaagagactgctgaagaagcacgaggagaccgagtgccccctgagactggccgtgtgccagcactgcgacctggagctgagcatcctgaagctgaaggagcacgaggactactgcggcgccagaaccgagctgtgcggcaactgcggcagaaacgtgctggtgaaggacctgaagacccaccccgaggtgtgctag

SEQ ID NO: 102729 - DNA, 495 bp, Artificial Sequence
  Description of Artificial Sequence: Synthetic coding sequence
atggccgagttcctggacgaccaggagaccagactgtgcgacaactgcaagaaggagatccccgtgttcaacttcaccatccacgagatccactgccagagaaacatcggcatgtgccccacctgcaaggagcccttccccaagagcgacatggagacccacatggccgccgagcactgccaggtgacctgcaagtgcaacaagaagctggagaagagactgctgaagaagcacgaggagaccgagtgccccctgagactggccgtgtgccagcactgcgacctggagctgagcatcctgaagctgaaggagcacgaggactactgcggcgccagaaccgagctgtgcggcaactgcggcagaaacgtgctggtgaaggacctgaagacccaccccgagctgaagaacaagagaggcagaaagggcatcgaggccaacagcccccccaagagagtggtgaagagagtgcagacctggaccagctgctggccctag

SEQ ID NO: 102730 - DNA, 852 bp, Artificial Sequence
  Description of Artificial Sequence: Synthetic coding sequence
atggccgagttcctggacgaccaggagaccagactgtgcgacaactgcaagaaggagatccccgtgttcaacttcaccatccacgagatccactgccagagaaacatcggcatgtgccccacctgcaaggagcccttccccaagagcgacatggagacccacatggccgccgagcactgccaggtgacctgcaagtgcaacaagaagctggagaagagactgctgaagaagcacgaggagaccgagtgccccctgagactggccgtgtgccagcactgcgacctggagctgagcatcctgaagctgaaggagcacgaggactactgcggcgccagaaccgagctgtgcggcaactgcggcagaaacgtgctggtgaaggacctgaagacccaccccgaggtgtgcggcagagagggcgaggagaagagaaacgaggtggccatcccccccaacgcctacgacgagagctggggccaggacggcatctggatcgccagccagctgctgagacagatcgaggccctggacccccccatgagactgcccagaagacccctgagagccttcgagagcgacgtgttccacaacagaaccaccaaccagagaaacatcaccgcccaggtgagcatccagaacaacctgttcgaggagcaggagagacaggagagaaacagaggccagcagccccccaaggagggcggcgaggagagcgccaacctggacttcatgctggccctgagcctgcagaacgagggccaggccagcagcgtggccgagcaggacttctggagagccgtgtgcgaggccgaccagagccacggcggccccagaagcctgagcgacatcaagtag

SEQ ID NO: 102731 - DNA, 414 bp, Artificial Sequence
  Description of Artificial Sequence: Synthetic coding sequence
atgggcgcccacctggtgagaagatacctgggcgacgccagcgtggagcccgaccccctgcagatgcccaccttcccccccgactacggcttccccgagagaaaggagagagagatggtggccacccagcaggagatgatggacgcccagctgagactgcagctgagagactactgcgcccaccacctgatcagactgctgaagtgcaagagagacagcttccccaacttcctggcctgcaagcaggagagacacgactgggactactgcgagcacagagactacgtgatgagaatgaaggagttcgagagagagagaagactgctgcagagaaagaagagaagagagaagaaggccgccgagctggccaagggccagggccccggcgaggtggaccccaaggtggccctgtag

SEQ ID NO: 102732 - DNA, 972 bp, Artificial Sequence
  Description of Artificial Sequence: Synthetic coding sequence
atgatcctgcaggagaccaaggccgcctgcggcatccccgccatcccccactgcagcagagtggagatcctggacgccaagaccagagagaagctgtgcttcctggacaaggtggagccccacgccaccatcgccgagatcaagaacctgttcaccaagacccacccccagtggtaccccgccagacagagcctgagactggaccccaagggcaagagcctgaaggacgaggacgtgctgcagaagctgcccgtgggcaccaccgccaccctgtacttcagagacctgggcgcccagatcagctgggtgaccgtgttcctgaccgagtacgccggccccctgttcatctacctgctgttctacttcagagtgcccttcatctacggccacaagtacgacttcaccagcagcagacacaccgtggtgcacctggcctgcatctgccacagcttccactacatcaagagactgctggagaccctgttcgtgcacagattcagccacggcaccatgcccctgagaaacatcttcaagaactgcacctactactggggcttcgccgcctggatggcctactacatcaaccaccccctgtacaccccccccacctacggcgcccagcaggtgaagctggccctggccatcttcgtgatctgccagctgggcaacttcagcatccacatggccctgagagacctgagacccgccggcagcaagaccagaaagatcccctaccccaccaagaaccccttcacctggctgttcctgctggtgagctgccccaactacacctacgaggtgggcagctggatcggcttcgccatcatgacccagtgcctgcccgtggccctgttcagcctggtgggcttcacccagatgaccatctgggccaagggcaagcacagaagctacctgaaggagttcagagactacccccccctgagaatgcccatcatccccttcctgctgtag

SEQ ID NO: 102733 - DNA, 1014 bp, Artificial Sequence
  Description of Artificial Sequence: Synthetic coding sequence
atgagcagcagccccgtgaagagacagagaatggagagcgccctggaccagctgaagcagttcaccaccgtggtggccgacaccggcgacttccacgccatcgacgagtacaagccccaggacgccaccaccaaccccagcctgatcctggccgccgcccagatgcccgcctaccaggagctggtggaggaggccatcgcctacggcagaaagctgggcggcagccaggaggaccagatcaagaacgccatcgacaagctgttcgtgctgttcggcgccgagatcctgaagaagatccccggcagagtgagcaccgaggtggacgccagactgagcttcgacaaggacgccatggtggccagagccagaagactgatcgagctgtacaaggaggccggcatcagcaaggacagaatcctgatcaagctgagcagcacctgggagggcatccaggccggcaaggagctggaggagcagcacggcatccactgcaacatgaccctgctgttcagcttcgcccaggccgtggcctgcgccgaggccggcgtgaccctgatcagccccttcgtgggcagaatcctggactggcacgtggccaacaccgacaagaagagctacgagcccctggaggaccccggcgtgaagagcgtgaccaagatctacaactactacaagaagttcagctacaagaccatcgtgatgggcgccagcttcagaaacaccggcgagatcaaggccctggccggctgcgacttcctgaccatcagccccaagctgctgggcgagctgctgcaggacaacgccaagctggtgcccgtgctgagcgccaaggccgcccaggccagcgacctggagaagatccacctggacgagaagagcttcagatggctgcacaacgaggaccagatggccgtggagaagctgagcgacggcatcagaaagttcgccgccgacgccgtgaagctggagagaatgctgaccgagagaatgttcaacgccgagaacggcaagtag

SEQ ID NO: 102734 - DNA, 957 bp, Artificial Sequence
  Description of Artificial Sequence: Synthetic coding sequence
atgagcagcagccccgtgaagagacagagaatggagagcgccctggaccagctgaagcagttcaccaccgtggtggccgacaccggcgacttccacgccatcgacgagtacaagccccaggacgccaccaccaaccccagcctgatcctggccgccgcccagatgcccgcctaccaggagctggtggaggaggccatcgcctacggcagaaagctgggcggcagccaggaggaccagatcaagaacgccatcgacaagctgttcgtgctgttcggcgccgagatcctgaagaagatccccggcagagtgagcaccgaggtggacgccagactgagcttcgacaaggacgccatggtggccagagccagaagactgatcgagctgtacaaggaggccggcatcagcaaggacagaatcctgatcaagctgagcagcacctgggagggcatccaggccggcaaggagctggaggagcagcacggcatccactgcaacatgaccctgctgttcagcttcgcccaggccgtggcctgcgccgaggccggcgtgaccctgatcagccccttcgtgggcagaatcctggactggcacgtggccaacaccgacaagaagagctacgagcccctggaggaccccggcgtgaagagcgtgaccaagatctacaactactacaagaagttcagctacaagaccatcgtgatgggcgccagcttcagaaacaccggcgagatcaaggccctggccggctgcgacttcctgaccatcagccccaagctgctgggcgagctgctgcaggacaacgccaagctggtgcccgtgctgagcgccaagcccaagcccgtgacctggaagaagagcacctggatgagaagcctgagcgtgggctgcaccaccagaaccagatggctgtggagaagcagcctgaccggcagcgccagcctgcccctgatgcagtag

SEQ ID NO: 102735 - DNA, 1302 bp, Artificial Sequence
  Description of Artificial Sequence: Synthetic coding sequence
atgagacagagccaccagctgcccctggtgggcctgctgctgttcagcttcatccccagccagctgtgcgagatctgcgaggtgagcgaggagaactacatcagactgaagcccctgctgaacaccatgatccagagcaactacaacagaggcaccagcgccgtgaacgtggtgctgagcctgaagctggtgggcatccagatccagaccctgatgcagaagatgatccagcagatcaagtacaacgtgaagagcagactgagcgacgtgagcagcggcgagctggccctgatcatcctggccctgggcgtgtgcagaaacgccgaggagaacctgatctacgactaccacctgatcgacaagctggagaacaagttccaggccgagatcgagaacatggaggcccacaacggcacccccctgaccaactactaccagctgagcctggacgtgctggccctgtgcctgttcaacggcaactacagcaccgccgaggtggtgaaccacttcacccccgagaacaagaactactacttcggcagccagttcagcgtggacaccggcgccatggccgtgctggccctgacctgcgtgaagaagagcctgatcaacggccagatcaaggccgacgagggcagcctgaagaacatcagcatctacaccaagagcctggtggagaagatcctgagcgagaagaaggagaacggcctgatcggcaacaccttcagcaccggcgaggccatgcaggccctgttcgtgagcagcgactactacaacgagaacgactggaactgccagcagaccctgaacaccgtgctgaccgagatcagccagggcgccttcagcaaccccaacgccgccgcccaggtgctgcccgccctgatgggcaagaccttcctggacatcaacaaggacagcagctgcgtgagcgccagcggcaacttcaacatcagcgccgacgagcccatcaccgtgaccccccccgacagccagagctacatcagcgtgaactacagcgtgagaatcaacgagacctacttcaccaacgtgaccgtgctgaacggcagcgtgttcctgagcgtgatggagaaggcccagaagatgaacgacaccatcttcggcttcaccatggaggagagaagctggggcccctacatcacctgcatccagggcctgtgcgccaacaacaacgacagaacctactgggagctgctgagcggcggcgagcccctgagccagggcgccggcagctacgtggtgagaaacggcgagaacctggaggtgagatggagcaagtactag

SEQ ID NO: 102736 - DNA, 1083 bp, Artificial Sequence
  Description of Artificial Sequence: Synthetic coding sequence
atggccgccgccgccgccgccggcgccggccccgagatggtgagaggccaggtgttcgacgtgggccccagatacaccaacctgagctacatcggcgagggcgcctacggcatggtgtgcagcgcctacgacaacgtgaacaaggtgagagtggccatcaagaagatcagccccttcgagcaccagacctactgccagagaaccctgagagagatcaagatcctgctgagattcagacacgagaacatcatcggcatcaacgacatcatcagagcccccaccatcgagcagatgaaggacgtgtacatcgtgcaggacctgatggagaccgacctgtacaagctgctgaagacccagcacctgagcaacgaccacatctgctacttcctgtaccagatcctgagaggcctgaagtacatccacagcgccaacgtgctgcacagagacctgaagcccagcaacctgctgctgaacaccacctgcgacctgaagatctgcgacttcggcctggccagagtggccgaccccgaccacgaccacaccggcttcctgaccgagtacgtggccaccagatggtacagagcccccgagatcatgctgaacagcaagggctacaccaagagcatcgacatctggagcgtgggctgcatcctggccgagatgctgagcaacagacccatcttccccggcaagcactacctggaccagctgaaccacatcctgggcatcctgggcagccccagccaggaggacctgaactgcatcatcaacctgaaggccagaaactacctgctgagcctgccccacaagaacaaggtgccctggaacagactgttccccaacgccgacagcaaggccctggacctgctggacaagatgctgaccttcaacccccacaagagaatcgaggtggagcaggccctggcccacccctacctggagcagtactacgaccccagcgacgagcccatcgccgaggcccccttcaagttcgacatggagctggacgacctgcccaaggagaagctgaaggagctgatcttcgaggagaccgccagattccagcccggctacagaagctag

SEQ ID NO: 102737 - DNA, 1203 bp, Artificial Sequence
  Description of Artificial Sequence: Synthetic coding sequence
atgagacacctgggcgccttcctgttcctgctgggcgtgctgggcgccctgaccgagatgtgcgagatccccgagatggacagccacctggtggagaagctgggccagcacctgctgccctggatggacagactgagcctggagcacctgaaccccagcatctacgtgggcctgagactgagcagcctgcaggccggcaccaaggaggacctgtacctgcacagcctgaagctgggctaccagcagtgcctgctgggcagcgccttcagcgaggacgacggcgactgccagggcaagcccagcatgggccagctggccctgtacctgctggccctgagagccaactggcacgaccacaagggccacccccacaccagctactaccagtacggcctgggcatcctggccctgtgcctgcaccagaagagagtgcacgacagcgtggtggacaagctgctgtacgccgtggagcccttccaccagggccaccacagcgtggacaccgccgccatggccggcctggccttcacctgcctgaagagaagcaacttcaaccccggcagaagacagagaatcaccatggccatcagaaccgtgagagaggagatcctgaaggcccagacccccgagggccacttcggcaacgtgtacagcacccccctggccctgcagttcctgatgaccagccccatgagaggcgccgagctgggcaccgcctgcctgaaggccagagtggccctgctggccagcctgcaggacggcgccttccagaacgccctgatgatcagccagctgctgcccgtgctgaaccacaagacctacatcgacctgatcttccccgactgcctggcccccagagtgatgctggagcccgccgccgagaccatcccccagacccaggagatcatcagcgtgaccctgcaggtgctgagcctgctgcccccctacagacagagcatcagcgtgctggccggcagcaccgtggaggacgtgctgaagaaggcccacgagctgggcggcttcacctacgagacccaggccagcctgagcggcccctacctgaccagcgtgatgggcaaggccgccggcgagagagagttctggcagctgctgagagaccccaacacccccctgctgcagggcatcgccgactacagacccaaggacggcgagaccatcgagctgagactggtgagctggtag

SEQ ID NO: 102738 - DNA, 843 bp, Artificial Sequence
  Description of Artificial Sequence: Synthetic coding sequence
atggaggacgaggtggtgagattcgccaagaagatggacaagatggtgcagaagaagaacgccagcaccagaatcggcatgagcgtgaacgccatcagaaagcagagcaccgacgaggaggtgaccagcctggccaagagcctgatcaagagctggaagaagctgctggacggccccagcaccgagaaggacctggacgagaagaagaaggagcccgccatcaccagccagaacagccccgaggccagagaggagagcaccagcagcggcaacgtgagcaacagaaaggacgagaccaacgccagagacacctacgtgagcagcttccccagagcccccagcaccagcgacagcgtgagactgaagtgcagagagatgctggccgccgccctgagaaccggcgacgactacatcgccatcggcgccgacgaggaggagctgggcagccagatcgaggaggccatctaccaggagatcagaaacaccgacatgaagtacaagaacagagtgagaagcagaatcagcaacctgaaggacgccaagaaccccaacctgagaaagaacgtgctgtgcggcaacatcccccccgacctgttcgccagaatgaccgccgaggagatggccagcgacgagctgaaggagatgagaaagaacctgaccaaggaggccatcagagagcaccagatggccaagaccggcggcacccagaccgacctgttcacctgcggcaagtgcaagaagaagaactgcacctacacccaggtgcagaccagaagcgccgacgagcccatgaccaccttcgtggtgtgcaacgagtgcggcaacagatggaagttctgctag

SEQ ID NO: 102739 - DNA, 906 bp, Artificial Sequence
  Description of Artificial Sequence: Synthetic coding sequence
atggaggacgaggtggtgagattcgccaagaagatggacaagatggtgcagaagaagaacgccgccggcgccctggacctgctgaaggagctgaagaacatccccatgaccctggagctgctgcagagcaccagaatcggcatgagcgtgaacgccatcagaaagcagagcaccgacgaggaggtgaccagcctggccaagagcctgatcaagagctggaagaagctgctggacggccccagcaccgagaaggacctggacgagaagaagaaggagcccgccatcaccagccagaacagccccgaggccagagaggagagcaccagcagcggcaacgtgagcaacagaaaggacgagaccaacgccagagacacctacgtgagcagcttccccagagcccccagcaccagcgacagcgtgagactgaagtgcagagagatgctggccgccgccctgagaaccggcgacgactacatcgccatcggcgccgacgaggaggagctgggcagccagatcgaggaggccatctaccaggagatcagaaacaccgacatgaagtacaagaacagagtgagaagcagaatcagcaacctgaaggacgccaagaaccccaacctgagaaagaacgtgctgtgcggcaacatcccccccgacctgttcgccagaatgaccgccgaggagatggccagcgacgagctgaaggagatgagaaagaacctgaccaaggaggccatcagagagcaccagatggccaagaccggcggcacccagaccgacctgttcacctgcggcaagtgcaagaagaagaactgcacctacacccaggtgcagaccagaagcgccgacgagcccatgaccaccttcgtggtgtgcaacgagtgcggcaacagatggaagttctgctag

SEQ ID NO: 102740 - DNA, 354 bp, Artificial Sequence
  Description of Artificial Sequence: Synthetic coding sequence
atggaggacgaggtggtgagattcgccaagaagatggacaagatggtgcagaagaagaacgccgccggcgccctggacctgctgaaggagctgaagaacatccccatgaccctggagctgctgcaggagatggccagcgacgagctgaaggagatgagaaagaacctgaccaaggaggccatcagagagcaccagatggccaagaccggcggcacccagaccgacctgttcacctgcggcaagtgcaagaagaagaactgcacctacacccaggtgcagaccagaagcgccgacgagcccatgaccaccttcgtggtgtgcaacgagtgcggcaacagatggaagttctgctag

SEQ ID NO: 102741 - DNA, 480 bp, Artificial Sequence
  Description of Artificial Sequence: Synthetic coding sequence
atggacaagcccagaaaggagaacgaggaggagccccagagcgcccccaagaccgacgaggagagaccccccgtggagcacagccccgagaagcagagccccgaggagcagagcagcgaggagcagagcagcgaggaggagttcttccccgaggagctgctgcccgagctgctgcccgagatgctgctgagcgaggagagacccccccaggagggcctgagcagaaaggacctgttcgagggcagaccccccatggagcagcccccctgcggcgtgggcaagcacaagctggaggagggcagcttcaaggagagactggccagaagcagaccccagttcagaggcgacatccacggcagaaacctgagcaacgaggagatgatccaggccgccgacgagctggaggagatgaagagagtgagaaacaagctgatgatcatgcactggaaggccaagagaagcagaccctaccccatctag

SEQ ID NO: 102742 - DNA, 480 bp, Artificial Sequence; identical to SEQ ID NO: 102741
  Description of Artificial Sequence: Synthetic coding sequence

SEQ ID NO: 102743 - DNA, 480 bp, Artificial Sequence; identical to SEQ ID NO: 102741
  Description of Artificial Sequence: Synthetic coding sequence

SEQ ID NO: 102744 - DNA, 471 bp, Artificial Sequence
  Description of Artificial Sequence: Synthetic coding sequence
atggacaagcccagaaaggagaacgaggaggagccccagagacccagacccatgagaagaggcctgagatggagcaccctgcccaagagcagcccccccagaagcagcctgagaagaagcagccccagaagaagaagcagcttcctgagaagcagctgcctgagcagctgcctgagatgcagcagcagaagaagcccccaggagggcctgagcagaaaggacctgttcgagggcagaccccccatggagcagcccccctgcggcgtgggcaagcacaagctggaggagggcagcttcaaggagagactggccagaagcagaccccagttcagaggcgacatccacggcagaaacctgagcaacgaggagatgatccaggccgccgacgagctggaggagatgaagagagtgagaaacaagctgatgatcatgcactggaaggccaagagaagcagaccctaccccatctag

SEQ ID NO: 102745 - DNA, 303 bp, Artificial Sequence
  Description of Artificial Sequence: Synthetic coding sequence
atgcagaagccctgcaaggagaacgagggcaagcccaagtgcagcgtgcccaagagagaggagaagagaccctacggcgagttcgagagacagcagaccgagggcaacttcagacagagactgctgcagagcctggaggagttcaaggaggacatcgactacagacacttcaaggacgaggagatgaccagagagggcgacgagatggagagatgcctggaggagatcagaggcctgagaaagaagttcagagccctgcacagcaaccacagacacagcagagacagaccctaccccatctag

SEQ ID NO: 102746 - DNA, 303 bp, Artificial Sequence; identical to SEQ ID NO: 102745
  Description of Artificial Sequence: Synthetic coding sequence

SEQ ID NO: 102747 - DNA, 291 bp, Artificial Sequence
  Description of Artificial Sequence: Synthetic coding sequence
atgtacgtgaagctgatcagcagcgacggccacgagttcatcgtgaagagagagcacgccctgaccagcggcaccatcaaggccatgctgagcggccccggccagttcgccgagaacgagaccaacgaggtgaacttcagagagatccccagccacgtgctgagcaaggtgtgcatgtacttcacctacaaggtgagatacaccaacagcagcaccgagatccccgagttccccatcgcccccgagatcgccctggagctgctgatggccgccaacttcctggactgctag

SEQ ID NO: 102748 - DNA, 339 bp, Artificial Sequence
  Description of Artificial Sequence: Synthetic coding sequence
atggacggcgaggagaagacctacggcggctgcgagggccccgacgccatgtacgtgaagctgatcagcagcgacggccacgagttcatcgtgaagagagagcacgccctgaccagcggcaccatcaaggccatgctgagcggccccggccagttcgccgagaacgagaccaacgaggtgaacttcagagagatccccagccacgtgctgagcaaggtgtgcatgtacttcacctacaaggtgagatacaccaacagcagcaccgagatccccgagttccccatcgcccccgagatcgccctggagctgctgatggccgccaacttcctggactgctag

SEQ ID NO: 102749 - DNA, 339 bp, Artificial Sequence; identical to SEQ ID NO: 102748
  Description of Artificial Sequence: Synthetic coding sequence

SEQ ID NO: 102750 - DNA, 339 bp, Artificial Sequence; identical to SEQ ID NO: 102748
  Description of Artificial Sequence: Synthetic coding sequence

SEQ ID NO: 102751 - DNA, 339 bp, Artificial Sequence; identical to SEQ ID NO: 102748
  Description of Artificial Sequence: Synthetic coding sequence

SEQ ID NO: 102752 - DNA, 339 bp, Artificial Sequence; identical to SEQ ID NO: 102748
  Description of Artificial Sequence: Synthetic coding sequence

SEQ ID NO: 102753 - DNA, 339 bp, Artificial Sequence; identical to SEQ ID NO: 102748
  Description of Artificial Sequence: Synthetic coding sequence

SEQ ID NO: 102754 - DNA, 2397 bp, Artificial Sequence
  Description of Artificial Sequence: Synthetic coding sequence
atgcacggcggcagaagctgcggccccagaaccagaagagagcccagcagcggcgaggaggccgcccccgtgaccgccatggccgccgagagcgccctgcaggtggtggagaagctgcaggccagactggccgccaaccccgaccccaagaagctgctgaagtacctgaagaagctgagcaccctgcccatcaccgtggacatcctggccgagaccggcgtgggcaagaccgtgaacagcctgagaaagcacgagcacgtgggcagcttcgccagagacctggtggcccagtggaagaagctggtgcccgtggagagaaacgccgagcccgacgagcaggacttcgagaagagcaacagcagaaagagacccagagacgccctgcagaaggaggaggagatggagggcgactaccaggagacctggaaggccaccggcagcagaagctacagccccgaccacagacagaagaagcacagaaagctgagcgagctggagagaccccacaaggtgagccacggccacgagagaagagacgagagaaagagatgccacagaatgagccccacctacagcagcgaccccgagagcagcgactacggccacgtgcagagcccccccagctgcaccagcccccaccagatgtacgtggaccactacagaagcctggaggaggaccaggagcccatcgtgagccaccagaagcccggcaagggccacagcaacgccttccaggacagactgggcgccagccaggagagacacctgggcgagccccacggcaagggcgtggtgagccagaacaaggagcacaagagcagccacaaggacaagagacccgtggacgccaagagcgacgagaaggccagcgtggtgagcagagagaagagccacaaggccctgagcaaggaggagaacagaagaccccccagcggcgacaacgccagagagaagccccccagcagcggcgtgaagaaggagaaggacagagagggcagcagcctgaagaagaagtgcctgccccccagcgaggccgccagcgacaaccacctgaagaagcccaagcacagagaccccgagaaggccaagctggacaagagcaagcagggcctggacagcttcgacaccggcaagggcgccggcgacctgctgcccaaggtgaaggagaagggcagcaacaacctgaagacccccgagggcaaggtgaagaccaacctggacagaaagagcctgggcagcctgcccaaggtggaggagaccgacatggaggacgagttcgagcagcccaccatgagcttcgagagctacctgagctacgaccagcccagaaagaagaagaagaagatcgtgaagaccagcgccaccgccctgggcgacaagggcctgaagaagaacgacagcaagagcaccggcaagaacctggacagcgtgcagaagctgcccaaggtgaacaagaccaagagcgagaagcccgccggcgccgacctggccaagctgagaaaggtgcccgacgtgctgcccgtgctgcccgacctgcccctgcccgccatccaggccaactacagacccctgcccagcctggagctgatcagcagcttccagcccaagagaaaggccttcagcagcccccaggaggaggaggaggccggcttcaccggcagaagaatgaacagcaagatgcaggtgtacagcggcagcaagtgcgcctacctgcccaagatgatgaccctgcaccagcagtgcatcagagtgctgaagaacaacatcgacagcatcttcgaggtgggcggcgtgccctacagcgtgctggagcccgtgctggagagatgcacccccgaccagctgtacagaatcgaggagtacaaccacgtgctgatcgaggagaccgaccagctgtggaaggtgcactgccacagagacttcaaggaggagagacccgaggagtacgagagctggagagagatgtacctgagactgcaggacgccagagagcagagactgagagtgctgaccaagaacatccagttcgcccacgccaacaagcccaagggcagacaggccaagatggccttcgtgaacagcgtggccaagccccccagagacgtgagaagaagacaggagaagttcggcaccggcggcgccgccgtgcccgagaagatcaagatcaagcccgccccctaccccatgggcagcagccacgccagcgccagcagcatcagcttcaaccccagccccgaggagcccgcctacgacggccccagcaccagcagcgcccacctggcccccgtggtgagcagcaccgtgagctacgaccccagaaagcccaccgtgaagaagatcgcccccatgatggccaagaccatcaaggccttcaagaacagattcagcagaagatag

SEQ ID NO: 102755 - DNA, 3297 bp, Artificial Sequence
  Description of Artificial Sequence: Synthetic coding sequence
atggccgagagaggcggcgacggcggcgagagcgagagattcaaccccggcgagctgagaatggcccagcagcaggccctgagattcagaggccccgcccccccccccaacgccgtgatgagaggccccccccccctgatgagaccccccccccccttcggcatgatgagaggccccccccccccccccagaccccccttcggcagaccccccttcgaccccaacatgccccccatgcccccccccggcggcatccccccccccatgggccccccccacctgcagagaccccccttcatgcccccccccatgagcagcatgccccccccccccggcatgatgttcccccccggcatgccccccgtgaccgcccccggcacccccgccctgccccccaccgaggagatctgggtggagaacaagacccccgacggcaaggtgtactactacaacgccagaaccagagagagcgcctggaccaagcccgacggcgtgaaggtgatccagcagagcgagctgacccccatgctggccgcccaggcccaggtgcaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggtgcaggcccaggtgcaggcccaggtgcaggcccaggccgtgggcgccagcacccccaccaccagcagccccgcccccgccgtgagcaccagcaccagcagcagcacccccagcagcaccaccagcaccaccaccaccgccaccagcgtggcccagaccgtgagcacccccaccacccaggaccagacccccagcagcgccgtgagcgtggccacccccaccgtgagcgtgagcacccccgcccccaccgccacccccgtgcagaccgtgccccagccccacccccagaccctgccccccgccgtgccccacagcgtgccccagcccaccaccgccatccccgccttcccccccgtgatggtgccccccttcagagtgcccctgcccggcatgcccatccccctgcccggcgtggccatgatgcagatcgtgagctgcccctacgtgaagaccgtggccaccaccaagaccggcgtgctgcccggcatggccccccccatcgtgcccatgatccacccccaggtggccatcgccgccagccccgccaccctggccggcgccaccgccgtgagcgagtggaccgagtacaagaccgccgacggcaagacctactactacaacaacagaaccctggagagcacctgggagaagccccaggagctgaaggagaaggagaagctggaggagaagatcaaggagcccatcaaggagcccagcgaggagcccctgcccatggagaccgaggaggaggaccccaaggaggagcccatcaaggagatcaaggaggagcccaaggaggaggagatgaccgaggaggagaaggccgcccagaaggccaagcccgtggccaccgcccccatccccggcaccccctggtgcgtggtgtggaccggcgacgagagagtgttcttctacaaccccaccaccagactgagcatgtgggacagacccgacgacctgatcggcagagccgacgtggacaagatcatccaggagcccccccacaagaagggcatggaggagctgaagaagctgagacaccccacccccaccatgctgagcatccagaagtggcagttcagcatgagcgccatcaaggaggagcaggagctgatggaggagatcaacgaggacgagcccgtgaaggccaagaagagaaagagagacgacaacaaggacatcgacagcgagaaggaggccgccatggaggccgagatcaaggccgccagagagagagccatcgtgcccctggaggccagaatgaagcagttcaaggacatgctgctggagagaggcgtgagcgccttcagcacctgggagaaggagctgcacaagatcgtgttcgaccccagatacctgctgctgaaccccaaggagagaaagcaggtgttcgaccagtacgtgaagaccagagccgaggaggagagaagagagaagaagaacaagatcatgcaggccaaggaggacttcaagaagatgatggaggaggccaagttcaaccccagagccaccttcagcgagttcgccgccaagcacgccaaggacagcagattcaaggccatcgagaagatgaaggacagagaggccctgttcaacgagttcgtggccgccgccagaaagaaggagaaggaggacagcaagaccagaggcgagaagatcaagagcgacttcttcgagctgctgagcaaccaccacctggacagccagagcagatggagcaaggtgaaggacaaggtggagagcgaccccagatacaaggccgtggacagcagcagcatgagagaggacctgttcaagcagtacatcgagaagatcgccaagaacctggacagcgagaaggagaaggagctggagagacaggccagaatcgaggccagcctgagagagagagagagagaggtgcagaaggccagaagcgagcagaccaaggagatcgacagagagagagagcagcacaagagagaggaggccatccagaacttcaaggccctgctgagcgacatggtgagaagcagcgacgtgagctggagcgacaccagaagaaccctgagaaaggaccacagatgggagagcggcagcctgctggagagagaggagaaggagaagctgttcaacgagcacatcgaggccctgaccaagaagaagagagagcacttcagacagctgctggacgagaccagcgccatcaccctgaccagcacctggaaggaggtgaagaagatcatcaaggaggaccccagatgcatcaagttcagcagcagcgacagaaagaagcagagagagttcgaggagtacatcagagacaagtacatcaccgccaaggccgacttcagaaccctgctgaaggagaccaagttcatcacctacagaagcaagaagctgatccaggagagcgaccagcacctgaaggacgtggagaagatcctgcagaacgacaagagatacctggtgctggactgcgtgcccgaggagagaagaaagctgatcgtggcctacgtggacgacctggacagaagaggccccccccccccccccaccgccagcgagcccaccagaagaagcaccaagtag

SEQ ID NO: 102756 - DNA, 3234 bp, Artificial Sequence
  Description of Artificial Sequence: Synthetic coding sequence
atggccgagagaggcggcgacggcggcgagagcgagagattcaaccccggcgagctgagaatggcccagcagcaggccctgagattcagaggccccgcccccccccccaacgccgtgatgagaggccccccccccctgatgagaccccccccccccttcggcatgatgagaggccccccccccccccccagaccccccttcggcagaccccccttcgaccccaacatgccccccatgcccccccccggcggcatccccccccccatgggccccccccacctgcagagaccccccttcatgcccccccccatgagcagcatgccccccccccccggcatgatgttcccccccggcatgccccccgtgaccgcccccggcacccccgccctgccccccaccgaggagatctgggtggagaacaagacccccgacggcaaggtgtactactacaacgccagaaccagagagagcgcctggaccaagcccgacggcgtgaaggtgatccagcagagcgagctgacccccatgctggccgcccaggcccaggtgcaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggtgcaggcccaggtgcaggcccaggtgcaggcccaggccgtgggcgccagcacccccaccaccagcagccccgcccccgccgtgagcaccagcaccagcagcagcacccccagcagcaccaccagcaccaccaccaccgccaccagcgtggcccagaccgtgagcacccccaccacccaggaccagacccccagcagcgccgtgagcgtggccacccccaccgtgagcgtgagcacccccgcccccaccgccacccccgtgcagaccgtgccccagccccacccccagaccctgccccccgccgtgccccacagcgtgccccagcccaccaccgccatccccgccttcccccccgtgatggtgccccccttcagagtgcccctgcccggcatgcccatccccctgcccggcgtgctgcccggcatggccccccccatcgtgcccatgatccacccccaggtggccatcgccgccagccccgccaccctggccggcgccaccgccgtgagcgagtggaccgagtacaagaccgccgacggcaagacctactactacaacaacagaaccctggagagcacctgggagaagccccaggagctgaaggagaaggagaagctggaggagaagatcaaggagcccatcaaggagcccagcgaggagcccctgcccatggagaccgaggaggaggaccccaaggaggagcccatcaaggagatcaaggaggagcccaaggaggaggagatgaccgaggaggagaaggccgcccagaaggccaagcccgtggccaccgcccccatccccggcaccccctggtgcgtggtgtggaccggcgacgagagagtgttcttctacaaccccaccaccagactgagcatgtgggacagacccgacgacctgatcggcagagccgacgtggacaagatcatccaggagcccccccacaagaagggcatggaggagctgaagaagctgagacaccccacccccaccatgctgagcatccagaagtggcagttcagcatgagcgccatcaaggaggagcaggagctgatggaggagatcaacgaggacgagcccgtgaaggccaagaagagaaagagagacgacaacaaggacatcgacagcgagaaggaggccgccatggaggccgagatcaaggccgccagagagagagccatcgtgcccctggaggccagaatgaagcagttcaaggacatgctgctggagagaggcgtgagcgccttcagcacctgggagaaggagctgcacaagatcgtgttcgaccccagatacctgctgctgaaccccaaggagagaaagcaggtgttcgaccagtacgtgaagaccagagccgaggaggagagaagagagaagaagaacaagatcatgcaggccaaggaggacttcaagaagatgatggaggaggccaagttcaaccccagagccaccttcagcgagttcgccgccaagcacgccaaggacagcagattcaaggccatcgagaagatgaaggacagagaggccctgttcaacgagttcgtggccgccgccagaaagaaggagaaggaggacagcaagaccagaggcgagaagatcaagagcgacttcttcgagctgctgagcaaccaccacctggacagccagagcagatggagcaaggtgaaggacaaggtggagagcgaccccagatacaaggccgtggacagcagcagcatgagagaggacctgttcaagcagtacatcgagaagatcgccaagaacctggacagcgagaaggagaaggagctggagagacaggccagaatcgaggccagcctgagagagagagagagagaggtgcagaaggccagaagcgagcagaccaaggagatcgacagagagagagagcagcacaagagagaggaggccatccagaacttcaaggccctgctgagcgacatggtgagaagcagcgacgtgagctggagcgacaccagaagaaccctgagaaaggaccacagatgggagagcggcagcctgctggagagagaggagaaggagaagctgttcaacgagcacatcgaggccctgaccaagaagaagagagagcacttcagacagctgctggacgagaccagcgccatcaccctgaccagcacctggaaggaggtgaagaagatcatcaaggaggaccccagatgcatcaagttcagcagcagcgacagaaagaagcagagagagttcgaggagtacatcagagacaagtacatcaccgccaaggccgacttcagaaccctgctgaaggagaccaagttcatcacctacagaagcaagaagctgatccaggagagcgaccagcacctgaaggacgtggagaagatcctgcagaacgacaagagatacctggtgctggactgcgtgcccgaggagagaagaaagctgatcgtggcctacgtggacgacctggacagaagaggccccccccccccccccaccgccagcgagcccaccagaagaagcaccaagtag

SEQ ID NO: 102757 - DNA, 2049 bp, Artificial Sequence
  Description of Artificial Sequence: Synthetic coding sequence
atgaacccccagcagcagagaatggccgccatcggcaccgacaaggagctgagcgacctgctggacttcagcgccatgttcagcccccccgtgaacagcggcaagaccagacccaccaccctgggcagcagccagttcagcggcagcggcatcgacgagagaggcggcaccaccagctggggcaccagcggccagcccagccccagctacgacagcagcagaggcttcaccgacagcccccactacagcgaccacctgaacgacagcagactgggcgcccacgagggcctgagccccacccccttcatgaacagcaacctgatgggcaagaccagcgagagaggcagcttcagcctgtacagcagagacaccggcctgcccggctgccagagcagcctgctgagacaggacctgggcctgggcagccccgcccagctgagcagcagcggcaagcccggcaccgcctactacagcttcagcgccaccagcagcagaagaagacccctgcacgacagcgccgccctggaccccctgcaggccaagaaggtgagaaaggtgccccccggcctgcccagcagcgtgtacgcccccagccccaacagcgacgacttcaacagagagagccccagctaccccagccccaagccccccaccagcatgttcgccagcaccttcttcatgcaggacggcacccacaacagcagcgacctgtggagcagcagcaacggcatgagccagcccggcttcggcggcatcctgggcaccagcaccagccacatgagccagagcagcagctacggcaacctgcacagccacgacagactgagctaccccccccacagcgtgagccccaccgacatcaacaccagcctgccccccatgagcagcttccacagaggcagcaccagcagcagcccctacgtggccgccagccacaccccccccatcaacggcagcgacagcatcctgggcaccagaggcaacgccgccggcagcagccagaccggcgacgccctgggcaaggccctggccagcatctacagccccgaccacaccagcagcagcttccccagcaaccccagcacccccgtgggcagccccagccccctgaccggcaccagccagtggcccagacccggcggccaggcccccagcagccccagctacgagaacagcctgcacagcctgcagagcagaatggaggacagactggacagactggacgacgccatccacgtgctgagaaaccacgccgtgggccccagcaccagcctgcccgccggccacagcgacatccacagcctgctgggccccagccacaacgcccccatcggcagcctgaacagcaactacggcggcagcagcctggtggccagcagcagaagcgccagcatggtgggcacccacagagaggacagcgtgagcctgaacggcaaccacagcgtgctgagcagcaccgtgaccaccagcagcaccgacctgaaccacaagacccaggagaactacagaggcggcctgcagagccagagcggcaccgtggtgaccaccgagatcaagaccgagaacaaggagaaggacgagaacctgcacgagccccccagcagcgacgacatgaagagcgacgacgagagcagccagaaggacatcaaggtgagcagcagaggcagaaccagcagcaccaacgaggacgaggacctgaaccccgagcagaagatcgagagagagaaggagagaagaatggccaacaacgccagagagagactgagagtgagagacatcaacgaggccttcaaggagctgggcagaatgtgccagctgcacctgaagagcgagaagccccagaccaagctgctgatcctgcaccaggccgtggccgtgatcctgagcctggagcagcaggtgagagagagaaacctgaaccccaaggccgcctgcctgaagagaagagaggaggagaaggtgagcgccgtgagcgccgagccccccaccaccctgcccggcacccaccccggcctgagcgagaccaccaaccccatgggccacatgtag

SEQ ID NO: 102758 - DNA, 2121 bp, Artificial Sequence
  Description of Artificial Sequence: Synthetic coding sequence
atgaacccccagcagcagagaatggccgccatcggcaccgacaaggagctgagcgacctgctggacttcagcgccatgttcagcccccccgtgaacagcggcaagaccagacccaccaccctgggcagcagccagttcagcggcagcggcatcgacgagagaggcggcaccaccagctggggcaccagcggccagcccagccccagctacgacagcagcagaggcttcaccgacagcccccactacagcgaccacctgaacgacagcagactgggcgcccacgagggcctgagccccacccccttcatgaacagcaacctgatgggcaagaccagcgagagaggcagcttcagcctgtacagcagagacaccggcctgcccggctgccagagcagcctgctgagacaggacctgggcctgggcagccccgcccagctgagcagcagcggcaagcccggcaccgcctactacagcttcagcgccaccagcagcagaagaagacccctgcacgacagcgccgccctggaccccctgcaggccaagaaggtgagaaaggtgccccccggcctgcccagcagcgtgtacgcccccagccccaacagcgacgacttcaacagagagagccccagctaccccagccccaagccccccaccagcatgttcgccagcaccttcttcatgcaggacggcacccacaacagcagcgacctgtggagcagcagcaacggcatgagccagcccggcttcggcggcatcctgggcaccagcaccagccacatgagccagagcagcagctacggcaacctgcacagccacgacagactgagctaccccccccacagcgtgagccccaccgacatcaacaccagcctgccccccatgagcagcttccacagaggcagcaccagcagcagcccctacgtggccgccagccacaccccccccatcaacggcagcgacagcatcctgggcaccagaggcaacgccgccggcagcagccagaccggcgacgccctgggcaaggccctggccagcatctacagccccgaccacaccagcagcagcttccccagcaaccccagcacccccgtgggcagccccagccccctgaccggcaccagccagtggcccagacccggcggccaggcccccagcagccccagctacgagaacagcctgcacagcctgaagaacagagtggagcagcagctgcacgagcacctgcaggacgccatgagcttcctgaaggacgtgtgcgagcagagcagaatggaggacagactggacagactggacgacgccatccacgtgctgagaaaccacgccgtgggccccagcaccagcctgcccgccggccacagcgacatccacagcctgctgggccccagccacaacgcccccatcggcagcctgaacagcaactacggcggcagcagcctggtggccagcagcagaagcgccagcatggtgggcacccacagagaggacagcgtgagcctgaacggcaaccacagcgtgctgagcagcaccgtgaccaccagcagcaccgacctgaaccacaagacccaggagaactacagaggcggcctgcagagccagagcggcaccgtggtgaccaccgagatcaagaccgagaacaaggagaaggacgagaacctgcacgagccccccagcagcgacgacatgaagagcgacgacgagagcagccagaaggacatcaaggtgagcagcagaggcagaaccagcagcaccaacgaggacgaggacctgaaccccgagcagaagatcgagagagagaaggagagaagaatggccaacaacgccagagagagactgagagtgagagacatcaacgaggccttcaaggagctgggcagaatgtgccagctgcacctgaagagcgagaagccccagaccaagctgctgatcctgcaccaggccgtggccgtgatcctgagcctggagcagcaggtgagagagagaaacctgaaccccaaggccgcctgcctgaagagaagagaggaggagaaggtgagcgccgtgagcgccgagccccccaccaccctgcccggcacccaccccggcctgagcgagaccaccaaccccatgggccacatgtag

SEQ ID NO: 102759 - DNA, 2109 bp, Artificial Sequence
  Description of Artificial Sequence: Synthetic coding sequence
atgaacccccagcagcagagaatggccgccatcggcaccgacaaggagctgagcgacctgctggacttcagcgccatgttcagcccccccgtgaacagcggcaagaccagacccaccaccctgggcagcagccagttcagcggcagcggcaccatccacgagatgaagcagctgaacagcaaggccagacagaagggccagagaatcaagggcttcaccgacagcccccactacagcgaccacctgaacgacagcagactgggcgcccacgagggcctgagccccacccccttcatgaacagcaacctgatgggcaagaccagcgagagaggcagcttcagcctgtacagcagagacaccggcctgcccggctgccagagcagcctgctgagacaggacctgggcctgggcagccccgcccagctgagcagcagcggcaagcccggcaccgcctactacagcttcagcgccaccagcagcagaagaagacccctgcacgacagcgccgccctggaccccctgcaggccaagaaggtgagaaaggtgccccccggcctgcccagcagcgtgtacgcccccagccccaacagcgacgacttcaacagagagagccccagctaccccagccccaagccccccaccagcatgttcgccagcaccttcttcatgcaggacggcacccacaacagcagcgacctgtggagcagcagcaacggcatgagccagcccggcttcggcggcatcctgggcaccagcaccagccacatgagccagagcagcagctacggcaacctgcacagccacgacagactgagctaccccccccacagcgtgagccccaccgacatcaacaccagcctgccccccatgagcagcttccacagaggcagcaccagcagcagcccctacgtggccgccagccacaccccccccatcaacggcagcgacagcatcctgggcaccagaggcaacgccgccggcagcagccagaccggcgacgccctgggcaaggccctggccagcatctacagccccgaccacaccagcagcagcttccccagcaaccccagcacccccgtgggcagccccagccccctgaccggcaccagccagtggcccagacccggcggccaggcccccagcagccccagctacgagaacagcctgcacagcctgaagaacagagtggagcagcagctgcacgagcacctgcaggacgccatgagcttcctgaaggacgtgtgcgagcagagcagaatggaggacagactggacagactggacgacgccatccacgtgctgagaaaccacgccgtgggccccagcaccagcctgcccgccggccacagcgacatccacagcctgctgggccccagccacaacgcccccatcggcagcctgaacagcaactacggcggcagcagcctggtggccagcagcagaagcgccagcatggtgggcacccacagagaggacagcgtgagcctgaacggcaaccacagcgtgctgagcagcaccgtgaccaccagcagcaccgacctgaaccacaagacccaggagaactacagaggcggcctgcagagccagagcggcaccgtggtgaccaccgagatcaagaccgagaacaaggagaaggacgagaacctgcacgagccccccagcagcgacgacatgaagagcgacgacgagagcagccagaaggacatcaaggtgagcagcagaggcagaaccagcagcaccaacgaggacgaggacctgaaccccgagcagaagatcgagagagagaaggagagaagaatggccaacaacgccagagagagactgagagtgagagacatcaacgaggccttcaaggagctgggcagaatgtgccagctgcacctgaagagcgagaagccccagaccaagctgctgatcctgcaccaggccgtggccgtgatcctgagcctggagcagcaggtgagagagagaaacctgaaccccaaggccgcctgcctgaagagaagagaggaggagaaggtgagcgccgtgagcgccgagccccccaccaccctgcccggcacccaccccggcctgagcgagaccaccaaccccatgggccacatgtag

SEQ ID NO: 102760 - DNA, 1341 bp, Artificial Sequence
  Description of Artificial Sequence: Synthetic coding sequence
atgggcaagagatacatgcaccacccccagatccagatgatcagcaccgtgaacctgctggtgatccacctgctgagccaccagcccgtgtgcagcctggccctgagcctgtgcaagagctaccccccccacagcgtgagccccaccgacatcaacaccagcctgccccccatgagcagcttccacagaggcagcaccagcagcagcccctacgtggccgccagccacaccccccccatcaacggcagcgacagcatcctgggcaccagaggcaacgccgccggcagcagccagaccggcgacgccctgggcaaggccctggccagcatctacagccccgaccacaccagcagcagcttccccagcaaccccagcacccccgtgggcagccccagccccctgaccggcaccagccagtggcccagacccggcggccaggcccccagcagccccagctacgagaacagcctgcacagcctgcagagcagaatggaggacagactggacagactggacgacgccatccacgtgctgagaaaccacgccgtgggccccagcaccagcctgcccgccggccacagcgacatccacagcctgctgggccccagccacaacgcccccatcggcagcctgaacagcaactacggcggcagcagcctggtggccagcagcagaagcgccagcatggtgggcacccacagagaggacagcgtgagcctgaacggcaaccacagcgtgctgagcagcaccgtgaccaccagcagcaccgacctgaaccacaagacccaggagaactacagaggcggcctgcagagccagagcggcaccgtggtgaccaccgagatcaagaccgagaacaaggagaaggacgagaacctgcacgagccccccagcagcgacgacatgaagagcgacgacgagagcagccagaaggacatcaaggtgagcagcagaggcagaaccagcagcaccaacgaggacgaggacctgaaccccgagcagaagatcgagagagagaaggagagaagaatggccaacaacgccagagagagactgagagtgagagacatcaacgaggccttcaaggagctgggcagaatgtgccagctgcacctgaagagcgagaagccccagaccaagctgctgatcctgcaccaggccgtggccgtgatcctgagcctggagcagcaggtgagagagagaaacctgaaccccaaggccgcctgcctgaagagaagagaggaggagaaggtgagcgccgtgagcgccgagccccccaccaccctgcccggcacccaccccggcctgagcgagaccaccaaccccatgggccacatgtag

SEQ ID NO: 102761 - DNA, 2046 bp, Artificial Sequence
  Description of Artificial Sequence: Synthetic coding sequence
atggccgccttcagcgtgctgagacccagagtgcccggcagcagcggcacctgggccgccgaccccgacgccagcaccgccgtgagccccagcctgagattcggcggcagagagcccgccagacccaccagaggcggcgccaccaagtggcccaagatgaacccccagcagcagagaatggccgccatcggcaccgacaaggagctgagcgacctgctggacttcagcgccatgttcagcccccccgtgaacagcggcaagaccagacccaccaccctgggcagcagccagttcagcggcagcggcatcgacgagagaggcggcaccaccagctggggcaccagcggccagcccagccccagctacgacagcagcagaggcttcaccgacagcccccactacagcgaccacctgaacgacagcagactgggcgcccacgagggcctgagccccacccccttcatgaacagcaacctgatgggcaagaccagcgagagaggcagcttcagcctgtacagcagagacaccggcctgcccggctgccagagcagcctgctgagacaggacctgggcctgggcagccccgcccagctgagcagcagcggcaagcccggcaccgcctactacagcttcagcgccaccagcagcagaagaagacccctgcacgacagcgccgccctggaccccctgcaggccaagaaggtgagaaaggtgccccccggcctgcccagcagcgtgtacgcccccagccccaacagcgacgacttcaacagagagagccccagctaccccagccccaagccccccaccagcatgttcgccagcaccttcttcatgcaggacggcacccacaacagcagcgacctgtggagcagcagcaacggcatgagccagcccggcttcggcggcatcctgggcaccagcaccagccacatgagccagagcagcagctacggcaacctgcacagccacgacagactgagctaccccccccacagcgtgagccccaccgacatcaacaccagcctgccccccatgagcagcttccacagaggcagcaccagcagcagcccctacgtggccgccagccacaccccccccatcaacggcagcgacagcatcctgggcaccagaggcaacgccgccggcagcagccagaccggcgacgccctgggcaaggccctggccagcatctacagccccgaccacaccagcagcagcttccccagcaaccccagcacccccgtgggcagccccagccccctgaccggcaccagccagtggcccagacccggcggccaggcccccagcagccccagctacgagaacagcctgcacagcctgcagagcagaatggaggacagactggacagactggacgacgccatccacgtgctgagaaaccacgccgtgggccccagcaccagcctgcccgccggccacagcgacatccacagcctgctgggccccagccacaacgcccccatcggcagcctgaacagcaactacggcggcagcagcctggtggccagcagcagaagcgccagcatggtgggcacccacagagaggacagcgtgagcctgaacggcaaccacagcgtgctgagcagcaccgtgaccaccagcagcaccgacctgaaccacaagacccaggagaactacagaggcggcctgcagagccagagcggcaccgtggtgaccaccgagatcaagaccgagaacaaggagaaggacgagaacctgcacgagccccccagcagcgacgacatgaagagcgacgacgagagcagccagaaggacatcaaggtgagcagcagaggcagaaccagcagcaccaacgaggacgaggacctgaaccccgagcagaagatcgagagagagaaggagagaagaatggccaacaacgccagagagagactgagagtgagagacatcaacgaggccttcaaggagctgggcagaatgtgccagctgcacctgaagagcgagaagccccagaccaagctgctgatcctgcaccaggccgtgaccaccatcggcccctag

SEQ ID NO: 102762 - DNA, 885 bp, Artificial Sequence
  Description of Artificial Sequence: Synthetic coding sequence
atgagcttcctgaaggacgtgtgcgagcagagcagaatggaggacagactggacagactggacgacgccatccacgtgctgagaaaccacgccgtgggccccagcaccagcctgcccgccggccacagcgacatccacagcctgctgggccccagccacaacgcccccatcggcagcctgaacagcaactacggcggcagcagcctggtggccagcagcagaagcgccagcatggtgggcacccacagagaggacagcgtgagcctgaacggcaaccacagcgtgctgagcagcaccgtgaccaccagcagcaccgacctgaaccacaagacccaggagaactacagaggcggcctgcagagccagagcggcaccgtggtgaccaccgagatcaagaccgagaacaaggagaaggacgagaacctgcacgagccccccagcagcgacgacatgaagagcgacgacgagagcagccagaaggacatcaaggtgagcagcagaggcagaaccagcaccaacgaggacgaggacctgaaccccgagcagaagatcgagagagagaaggagagaagaatggccaacaacgccagagagagactgagagtgagagacatcaacgaggccttcaaggagctgggcagaatgtgccagctgcacctgaagagcgagaagccccagaccaagctgctgatcctgcaccaggccgtggccgtgatcctgagcctggagcagcaggtgagagagagaaacctgaaccccaaggccgcctgcctgaagagaagagaggaggagaaggtgagcgccgtgagcgccgagccccccaccaccctgcccggcacccaccccggcctgagcgagaccaccaaccccatgggccacatgtag

SEQ ID NO: 102763 - DNA, 1611 bp, Artificial Sequence
  Description of Artificial Sequence: Synthetic coding sequence
atgtactgcgcctaccccgtgcccggcatgggcagcaacagcctgatgtactactacaacggcaagaccgtgtacgcccccagccccaacagcgacgacttcaacagagagagccccagctaccccagccccaagccccccaccagcatgttcgccagcaccttcttcatgcaggacggcacccacaacagcagcgacctgtggagcagcagcaacggcatgagccagcccggcttcggcggcatcctgggcaccagcaccagccacatgagccagagcagcagctacggcaacctgcacagccacgacagactgagctaccccccccacagcgtgagccccaccgacatcaacaccagcctgccccccatgagcagcttccacagaggcagcaccagcagcagcccctacgtggccgccagccacaccccccccatcaacggcagcgacagcatcctgggcaccagaggcaacgccgccggcagcagccagaccggcgacgccctgggcaaggccctggccagcatctacagccccgaccacaccagcagcagcttccccagcaaccccagcacccccgtgggcagccccagccccctgaccggcaccagccagtggcccagacccggcggccaggcccccagcagccccagctacgagaacagcctgcacagcctgaagaacagagtggagcagcagctgcacgagcacctgcaggacgccatgagcttcctgaaggacgtgtgcgagcagagcagaatggaggacagactggacagactggacgacgccatccacgtgctgagaaaccacgccgtgggccccagcaccagcctgcccgccggccacagcgacatccacagcctgctgggccccagccacaacgcccccatcggcagcctgaacagcaactacggcggcagcagcctggtggccagcagcagaagcgccagcatggtgggcacccacagagaggacagcgtgagcctgaacggcaaccacagcgtgctgagcagcaccgtgaccaccagcagcaccgacctgaaccacaagacccaggagaactacagaggcggcctgcagagccagagcggcaccgtggtgaccaccgagatcaagaccgagaacaaggagaaggacgagaacctgcacgagccccccagcagcgacgacatgaagagcgacgacgagagcagccagaaggacatcaaggtgagcagcagaggcagaaccagcagcaccaacgaggacgaggacctgaaccccgagcagaagatcgagagagagaaggagagaagaatggccaacaacgccagagagagactgagagtgagagacatcaacgaggccttcaaggagctgggcagaatgtgccagctgcacctgaagagcgagaagccccagaccaagctgctgatcctgcaccaggccgtggccgtgatcctgagcctggagcagcaggtgagagagagaaacctgaaccccaaggccgcctgcctgaagagaagagaggaggagaaggtgagcgccgtgagcgccgagccccccaccaccctgcccggcacccaccccggcctgagcgagaccaccaaccccatgggccacatgtag

SEQ ID NO: 102764 - DNA, 2049 bp, Artificial Sequence; identical to SEQ ID NO: 102757
  Description of Artificial Sequence: Synthetic coding sequence

SEQ ID NO: 102765 - DNA, 1020 bp, Artificial Sequence
  Description of Artificial Sequence: Synthetic coding sequence
atgagcagcaacagcagcaccagccagtggcccagacccggcggccaggcccccagcagccccagctacgagaacagcctgcacagcctgaagaacagagtggagcagcagctgcacgagcacctgcaggacgccatgagcttcctgaaggacgtgtgcgagcagagcagaatggaggacagactggacagactggacgacgccatccacgtgctgagaaaccacgccgtgggccccagcaccagcctgcccgccggccacagcgacatccacagcctgctgggccccagccacaacgcccccatcggcagcctgaacagcaactacggcggcagcagcctggtggccagcagcagaagcgccagcatggtgggcacccacagagaggacagcgtgagcctgaacggcaaccacagcgtgctgagcagcaccgtgaccaccagcagcaccgacctgaaccacaagacccaggagaactacagaggcggcctgcagagccagagcggcaccgtggtgaccaccgagatcaagaccgagaacaaggagaaggacgagaacctgcacgagccccccagcagcgacgacatgaagagcgacgacgagagcagccagaaggacatcaaggtgagcagcagaggcagaaccagcaccaacgaggacgaggacctgaaccccgagcagaagatcgagagagagaaggagagaagaatggccaacaacgccagagagagactgagagtgagagacatcaacgaggccttcaaggagctgggcagaatgtgccagctgcacctgaagagcgagaagccccagaccaagctgctgatcctgcaccaggccgtggccgtgatcctgagcctggagcagcaggtgagagagagaaacctgaaccccaaggccgcctgcctgaagagaagagaggaggagaaggtgagcgccgtgagcgccgagccccccaccaccctgcccggcacccaccccggcctgagcgagaccaccaaccccatgggccacatgtag

SEQ ID NO: 102766 - DNA, 1341 bp, Artificial Sequence; identical to SEQ ID NO: 102760
  Description of Artificial Sequence: Synthetic coding sequence

SEQ ID NO: 102767 - DNA, 1539 bp, Artificial Sequence
  Description of Artificial Sequence: Synthetic coding sequence
atgtactgcgcctaccccgtgcccggcatgggcagcaacagcctgatgtactactacaacggcaagaccgtgtacgcccccagccccaacagcgacgacttcaacagagagagccccagctaccccagccccaagccccccaccagcatgttcgccagcaccttcttcatgcaggacggcacccacaacagcagcgacctgtggagcagcagcaacggcatgagccagcccggcttcggcggcatcctgggcaccagcaccagccacatgagccagagcagcagctacggcaacctgcacagccacgacagactgagctaccccccccacagcgtgagccccaccgacatcaacaccagcctgccccccatgagcagcttccacagaggcagcaccagcagcagcccctacgtggccgccagccacaccccccccatcaacggcagcgacagcatcctgggcaccagaggcaacgccgccggcagcagccagaccggcgacgccctgggcaaggccctggccagcatctacagccccgaccacaccagcagcagcttccccagcaaccccagcacccccgtgggcagccccagccccctgaccggcaccagccagtggcccagacccggcggccaggcccccagcagccccagctacgagaacagcctgcacagcctgcagagcagaatggaggacagactggacagactggacgacgccatccacgtgctgagaaaccacgccgtgggccccagcaccagcctgcccgccggccacagcgacatccacagcctgctgggccccagccacaacgcccccatcggcagcctgaacagcaactacggcggcagcagcctggtggccagcagcagaagcgccagcatggtgggcacccacagagaggacagcgtgagcctgaacggcaaccacagcgtgctgagcagcaccgtgaccaccagcagcaccgacctgaaccacaagacccaggagaactacagaggcggcctgcagagccagagcggcaccgtggtgaccaccgagatcaagaccgagaacaaggagaaggacgagaacctgcacgagccccccagcagcgacgacatgaagagcgacgacgagagcagccagaaggacatcaaggtgagcagcagaggcagaaccagcagcaccaacgaggacgaggacctgaaccccgagcagaagatcgagagagagaaggagagaagaatggccaacaacgccagagagagactgagagtgagagacatcaacgaggccttcaaggagctgggcagaatgtgccagctgcacctgaagagcgagaagccccagaccaagctgctgatcctgcaccaggccgtggccgtgatcctgagcctggagcagcaggtgagagagagaaacctgaaccccaaggccgcctgcctgaagagaagagaggaggagaaggtgagcgccgtgagcgccgagccccccaccaccctgcccggcacccaccccggcctgagcgagaccaccaaccccatgggccacatgtag

SEQ ID NO: 102768 - DNA, 600 bp, Artificial Sequence
  Description of Artificial Sequence: Synthetic coding sequence
atggccttcgccctgctgagacccgtgggcgcccacgtgctgtaccccgacgtgagactgctgagcgaggacgaggagaacagaagcgagagcgacgccagcgaccagagcttcggctgctgcgagggccccgaggccgccagaagaggccccggccccggcggcggcagaagagccggcggcggcggcggcgccggccccgtggtggtggtgagacagagacaggccgccaacgccagagagagagacagaacccagagcgtgaacaccgccttcaccgccctgagaaccctgatccccaccgagcccgtggacagaaagctgagcaagatcgagaccgtgagactggccagcagctacatcgcccacctggccaacgtgctgctgctgggcgacagcgccgacgacggccagccctgcttcagagccgccggcagcgccaagggcgccgtgcccgccgccgccgacggcggcagacagcccagaagcatctgcaccttctgcctgagcaaccagagaaagggcggcggcagaagagacctgggcggcagctgcctgaaggtgagaggcgtggcccccctgagaggccccagaagatag

SEQ ID NO: 102769 - DNA, 1038 bp, Artificial Sequence
  Description of Artificial Sequence: Synthetic coding sequence
atgctgccctgcttccagctgctgagaatcggcggcggcagaggcggcgacctgtacaccttccacccccccgccggcgccggctgcacctacagactgggccacagagccgacctgtgcgacgtggccctgagaccccagcaggagcccggcctgatcagcggcatccacgccgagctgcacgccgagcccagaggcgacgactggagagtgagcctggaggaccacagcagccagggcaccctggtgaacaacgtgagactgcccagaggccacagactggagctgagcgacggcgacctgctgaccttcggccccgagggcccccccggcaccagccccagcgagttctacttcatgttccagcaggtgagagtgaagccccaggacttcgccgccatcaccatccccagaagcagaggcgaggccagagtgggcgccggcttcagacccatgctgcccagccagggcgccccccagagacccctgagcaccttcagccccgcccccaaggccaccctgatcctgaacagcatcggcagcctgagcaagctgagaccccagcccctgaccttcagccccagctggggcggccccaagagcctgcccgtgcccgccccccccggcgagatgggcaccacccccagcgcccccccccagagaaacagaagaaagagcgtgcacagagtgctggccgagctggacgacgagagcgagccccccgagaaccccccccccgtgctgatggagcccagaaagaagctgagagtggacaaggcccccctgacccccaccggcaacagaagaggcagacccagaaagtaccccgtgagcgcccccatggccccccccgccgtgggcggcggcgagccctgcgccgccccctgctgctgcctgccccaggaggagaccgtggcctgggtgcagtgcgacggctgcgacgtgtggttccacgtggcctgcgtgggctgcagcatccaggccgccagagaggccgacttcagatgccccggctgcagagccggcatccagacctag

SEQ ID NO: 102770 - DNA, 1038 bp, Artificial Sequence; identical to SEQ ID NO: 102769
  Description of Artificial Sequence: Synthetic coding sequence

SEQ ID NO: 102771 - DNA, 1038 bp, Artificial Sequence
  Description of Artificial Sequence: Synthetic coding sequence
atgctgccctgcttccagctgctgagaatcggcggcggcagaggcggcgacctgtacaccttccacccccccgccggcgccggctgcacctacagactgggccacagagccgacctgtgcgacgtggccctgagaccccagcaggagcccggcctgatcagcggcatccacgccgagctgcacgccgagcccagaggcgacgactggagagtgagcctggaggaccacagcagccagggcaccctggtgaacaacgtgagactgcccagaggccacagactggagctgagcgacggcgacctgctgaccttcggccccgagggcccccccggcaccagccccagcgagttctacttcatgttccagcaggtgagagtgaagccccaggacttcgccgccatcaccatccccagaagcagaggcgaggccagagtgggcgccggcttcagacccatgctgcccagccagggcgccccccagagacccctgagcaccttcagccccgcccccaaggccaccctgatcctgaacagcatcggcagcctgagcaagctgagaccccagcccctgaccttcagccccagctggggcggccccaagagcctgcccgtgcccgccccccccggcgaggtgggcaccacccccagcgcccccccccagagaaacagaagaaagagcgtgcacagagtgctggccgagctggacgacgagagcgagccccccgagaaccccccccccgtgctgatggagcccagaaagaagctgagagtggacaaggcccccctgacccccaccggcaacagaagaggcagacccagaaagtaccccgtgagcgcccccatggccccccccgccgtgggcggcggcgagccctgcgccgccccctgctgctgcctgccccaggaggagaccgtggcctgggtgcagtgcgacggctgcgacgtgtggttccacgtggcctgcgtgggctgcagcatccaggccgccagagaggccgacttcagatgccccggctgcagagccggcatccagacctag

SEQ ID NO: 102772 - DNA, 1038 bp, Artificial Sequence; identical to SEQ ID NO: 102771
  Description of Artificial Sequence: Synthetic coding sequence

SEQ ID NO: 102773 - DNA, 1038 bp, Artificial Sequence; identical to SEQ ID NO: 102771
  Description of Artificial Sequence: Synthetic coding sequence

SEQ ID NO: 102774 - DNA, 1038 bp, Artificial Sequence; identical to SEQ ID NO: 102771
  Description of Artificial Sequence: Synthetic coding sequence

SEQ ID NO: 102775 - DNA, 1038 bp, Artificial Sequence; identical to SEQ ID NO: 102771
  Description of Artificial Sequence: Synthetic coding sequence

SEQ ID NO: 102776 - DNA, 1038 bp, Artificial Sequence
  Description of Artificial Sequence: Synthetic coding sequence
atgctgccctgcttccagctgctgagaatcggcggcggcagaggcggcgacctgtacaccttccacccccccgccggcgccggctgcacctacagactgggccacagagccgacctgtgcgacgtggccctgagaccccagcaggagcccggcctgatcagcggcatccacgccgagctgcacgccgagcccagaggcgacgactggagagtgagcctggaggaccacagcagccagggcaccctggtgaacaacgtgagactgcccagaggccacagactggagctgagcgacggcgacctgctgaccttcggccccgagggcagccccggcaccagccccagcgagttctacttcatgttccagcaggtgagagtgaagccccaggacttcgccgccatcaccatccccagaagcagaggcgaggccagagtgggcgccggcttcagacccatgctgcccagccagggcgccccccagagacccctgagcaccttcagccccgcccccaaggccaccctgatcctgaacagcatcggcagcctgagcaagctgagaccccagcccctgaccttcagccccagctggggcggccccaagagcctgcccgtgcccgccccccccggcgaggtgggcaccacccccagcgcccccccccagagaaacagaagaaagagcgtgcacagagtgctggccgagctggacgacgagagcgagccccccgagaaccccccccccgtgctgatggagcccagaaagaagctgagagtggacaaggcccccctgacccccaccggcaacagaagaggcagacccagaaagtaccccgtgagcgcccccatggccccccccgccgtgggcggcggcgagccctgcgccgccccctgctgctgcctgccccaggaggagaccgtggcctgggtgcagtgcgacggctgcgacgtgtggttccacgtggcctgcgtgggctgcagcatccaggccgccagagaggccgacttcagatgccccggctgcagagccggcatccagacctag

SEQ ID NO: 102777 - DNA, 1038 bp, Artificial Sequence; identical to SEQ ID NO: 102771
  Description of Artificial Sequence: Synthetic coding sequence

SEQ ID NO: 102778 - DNA, 1038 bp, Artificial Sequence; identical to SEQ ID NO: 102771
  Description of Artificial Sequence: Synthetic coding sequence

SEQ ID NO: 102779 - DNA, 1038 bp, Artificial Sequence; identical to SEQ ID NO: 102771
  Description of Artificial Sequence: Synthetic coding sequence

SEQ ID NO: 102780 - DNA, 1038 bp, Artificial Sequence; identical to SEQ ID NO: 102771
  Description of Artificial Sequence: Synthetic coding sequence

SEQ ID NO: 102781 - DNA, 1038 bp, Artificial Sequence; identical to SEQ ID NO: 102771
  Description of Artificial Sequence: Synthetic coding sequence

SEQ ID NO: 102782 - DNA, 1038 bp, Artificial Sequence; identical to SEQ ID NO: 102776
  Description of Artificial Sequence: Synthetic coding sequence

SEQ ID NO: 102783 - DNA, 654 bp, Artificial Sequence
  Description of Artificial Sequence: Synthetic coding sequence
accctggtgaacaacgtgagactgcccagaggccacagactggagctgagcgacggcgacctgctgaccttcggccccgagggcccccccggcaccagccccagcgagttctacttcatgttccagcaggtgagagtgaagccccaggacttcgccgccatcaccatccccagaagcagaggcgaggccagagtgggcgccggcttcagacccatgctgcccagccagggcgccccccagagacccctgagcaccttcagccccgcccccaaggccaccctgatcctgaacagcatcggcagcctgagcaagctgagaccccagcccctgaccttcagccccagctggggcggccccaagagcctgcccgtgcccgccccccccggcgagatgggcaccacccccagcgcccccccccagagaaacagaagaaagagcgtgcacagagtgctggccgagctggacgacgagagcgagccccccgagaaccccccccccgtgctgatggagcccagaaagaagctgagagtggacaaggcccccctgacccccaccggcaactggcacatccagggcatgcagagcatcgtgaagggccagaaggagagaccctggcccagagagcacctgagcggctacgaggaggccagctag

SEQ ID NO: 102784 - DNA, 645 bp, Artificial Sequence
  Description of Artificial Sequence: Synthetic coding sequence
atgagccagagaaaggccagaggcccccccgccatgcccggcgtgggccacagccagacccaggccaaggccagactgctgcccggcgccgacagaaagagaagcagactgagcagaaccagacaggacccctgggaggagagaagctggagcaaccagagatggagcagagccacccccggccccagaggcaccagagccggcggcctggccctgggcagaagcgaggccagccccgagaacgccgccagagagagaagcagagtgagaaccctgagacaggccttcctggccctgcaggccgccctgcccgccgtgccccccgacaccaagctgagcaagctggacgtgctggtgctggccgccagctacatcgcccacctgaccagaaccctgggccacgagctgcccggccccgcctggccccccttcctgagaggcctgagatacctgcaccccctgaagaagtggcccatgagaagcagactgtacgccggcggcctgggctacagcgacctggacagcaccaccgccagcacccccagccagagaaccagagacgccgaggtgggcagccaggtgcccggcgaggccgacgccctgctgagcaccacccccctgagccccgccctgggcgacaagtag

SEQ ID NO: 102785 - DNA, 2031 bp, Artificial Sequence
  Description of Artificial Sequence: Synthetic coding sequence
atgagcagaagagccctgagaagactgagaggcgagcagagaggccaggagcccctgggccccggcgccctgcacttcgacctgagagacgacgacgacgccgaggaggagggccccaagagagagctgggcgtgagaagacccggcggcgccggcaaggagggcgtgagagtgaacaacagattcgagctgatcaacatcgacgacctggaggacgaccccgtggtgaacggcgagagaagcggctgcgccctgaccgacgccgtggcccccggcaacaagggcagaggccagagaggcaacaccgagagcaagaccgacggcgacgacaccgagaccgtgcccagcgagcagagccacgccagcggcaagctgagaaagaagaagaagaagcagaagaacaagaagagcagcaccggcgaggccagcgagaacggcctggaggacatcgacagaatcctggagagaatcgaggacagcaccggcctgaacagacccggccccgcccccctgagcagcagaaagcacgtgctgtacgtggagcacagacacctgaaccccgacaccgagctgaagagatacttcggcgccagagccatcctgggcgagcagagacccagacagagacagagagtgtaccccaagtgcacctggctgaccacccccaagagcacctggcccagatacagcaagcccggcctgagcatgagactgctggagagcaagaagggcctgagcttcttcgccttcgagcacagcgaggagtaccagcaggcccagcacaagttcctggtggccgtggagagcatggagcccaacaacatcgtggtgctgctgcagaccagcccctaccacgtggacagcctgctgcagctgagcgacgcctgcagattccaggaggaccaggagatggccagagacctggtggagagagccctgtacagcatggagtgcgccttccaccccctgttcagcctgaccagcggcgcctgcagactggactacagaagacccgagaacagaagcttctacctggccctgtacaagcagatgagcttcctggagaagagaggctgccccagaaccgccctggagtactgcaagctgatcctgagcctggagcccgacgaggaccccctgtgcatgctgctgctgatcgaccacctggccctgagagccagaaactacgagtacctgatcagactgttccaggagtgggaggcccacagaaacctgagccagctgcccaacttcgccttcagcgtgcccctggcctacttcctgctgagccagcagaccgacctgcccgagtgcgagcagagcagcgccagacagaaggccagcctgctgatccagcaggccctgaccatgttccccggcgtgctgctgcccctgctggagagctgcagcgtgagacccgacgccagcgtgagcagccacagattcttcggccccaacgccgagatcagccagccccccgccctgagccagctggtgaacctgtacctgggcagaagccacttcctgtggaaggagcccgccaccatgagctggctggaggagaacgtgcacgaggtgctgcaggccgtggacgccggcgaccccgccgtggaggcctgcgagaacagaagaaaggtgctgtaccagagagcccccagaaacatccacagacacgtgatcctgagcgagatcaaggaggccgtggccgccctgccccccgacgtgaccacccagagcgtgatgggcttcgaccccctgccccccagcgacaccatctacagctacgtgagacccgagagactgagccccatcagccacggcaacaccatcgccctgttcttcagaagcctgctgcccaactacaccatggagggcgagagacccgaggagggcgtggccggcggcctgaacagaaaccagggcctgaacagactgatgctggccgtgagagacatgatggccaacttccacctgaacgacctggaggccccccacgaggacgacgccgagggcgagggcgagtgggactag

SEQ ID NO: 102786 - DNA, 1422 bp, Artificial Sequence
  Description of Artificial Sequence: Synthetic coding sequence
atgagactgctggagagcaagaagggcctgagcttcttcgccttcgagcacagcgaggagtaccagcaggcccagcacaagttcctggtggccgtggagagcatggagcccaacaacatcgtggtgctgctgcagaccagcccctaccacgtggacagcctgctgcagctgagcgacgcctgcagattccaggaggaccaggagatggccagagacctggtggagagagccctgtacagcatggagtgcgccttccaccccctgttcagcctgaccagcggcgcctgcagactggactacagaagacccgagaacagaagcttctacctggccctgtacaagcagatgagcttcctggagaagagaggctgccccagaaccgccctggagtactgcaagctgatcctgagcctggagcccgacgaggaccccctgtgcatgctgctgctgatcgaccacctggccctgagagccagaaactacgagtacctgatcagactgttccaggagtgggaggcccacagaaacctgagccagctgcccaacttcgccttcagcgtgcccctggcctacttcctgctgagccagcagaccgacctgcccgagtgcgagcagagcagcgccagacagaaggccagcctgctgatccagcaggccctgaccatgttccccggcgtgctgctgcccctgctggagagctgcagcgtgagacccgacgccagcgtgagcagccacagattcttcggccccaacgccgagatcagccagccccccgccctgagccagctggtgaacctgtacctgggcagaagccacttcctgtggaaggagcccgccaccatgagctggctggaggagaacgtgcacgaggtgctgcaggccgtggacgccggcgaccccgccgtggaggcctgcgagaacagaagaaaggtgctgtaccagagagcccccagaaacatccacagacacgtgatcctgagcgagatcaaggaggccgtggccgccctgccccccgacgtgaccacccagagcgtgatgggcttcgaccccctgccccccagcgacaccatctacagctacgtgagacccgagagaaagggcgaggaggagagaaacagcgtgatctggggcagccagctgtgcgtgtgcagacccagaagcttccccagcccccccaacgtgcaggccctggcctgcagacccctgtggcaggccaagagctaccagccctggaagcaccactgcagcctgctgcccgtgaccgtggccaagctgtaccacggcggcggcgaggccagaggcagaagcggctggggcagcgagccccagcccggccccgagcaggccgacgccggctgcgccagacacgacggccagctgcccccccagagacccggcggcgccgccagaggcagaagatag

SEQ ID NO: 102787 - DNA, 651 bp, Artificial Sequence
  Description of Artificial Sequence: Synthetic coding sequence
atgagcagaagagccctgagaagactgagaggcgagcagagaggccaggagcccctgggccccggcgccctgcacttcgacctgagagacgacgacgacgccgaggaggagggccccaagagagagctgggcgtgagaagacccggcggcgccggcaaggagggcgtgagagtgaacaacagattcgagctgatcaacatcgacgacctggaggacgaccccgtggtgaacggcgagagaagcggctgcgccctgaccgacgccgtggcccccggcaacaagggcagaggccagagaggcaacaccgagagcaagaccgacggcgacgacaccgagaccgtgcccagcgagcagagccacgccagcggcaagctgagaaagaagaagaagaagcagaagaacaagaagagcagcaccggcgaggccagcgagaacggcctggaggacatcgacagaatcctggagagaatcgaggacagcaccggcctgaacagacccggccccgcccccctgagcagcagaaagcacgtgctgtacgtggagcacagacacctgaaccccgacaccgagctgaagagatacttcggcgccagagccatcctgggcgagcagagagacagagtgctgctgggctgccccgtgtggttctag

SEQ ID NO: 102788 - DNA, 624 bp, Artificial Sequence
  Description of Artificial Sequence: Synthetic coding sequence
ctgaccgtgaacgccagcatgagcagattccccccccacatggtgcccccccaccacaccctgcacaccaccggcatcccccaccccgccatcgtgacccccaccgtgaagcaggagagcagccagagcgacgtgggcagcctgcacagcagcaagcaccaggacagcaagaaggaggaggagaagaagaagccccacatcaagaagcccctgaacgccttcatgctgtacatgaaggagatgagagccaaggtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagacaagcagcccggcgagaccaacgacctgagcgcccccaagaagtgcagagccagattcggcctggaccagcagaacaactggtgcggcccctgcagaagaaagaagaagtgcgtgagatacatccagggcgagggcagctgcctgagcccccccagcagcgacggcagcctgctgtag

SEQ ID NO: 102789 - DNA, 669 bp, Artificial Sequence
  Description of Artificial Sequence: Synthetic coding sequence
accaaccagaacagcagcagcgacagcgaggccgagagaagacccccccccagaagcgagagcttcagagacaagagcagagagagcctggaggaggccgccaagagacaggacggcggcctgttcaagggccccccctaccccggctaccccttcatcatgatccccgacctgaccagcccctacctgcccaacggcagcctgagccccaccgccagaaccctgcacttccagagcggcagcacccactacagcgcctacaagaccatcgagcaccagatcgccgtgcagtacctgcagatgaagtggcccctgctggacgtgcaggccggcagcctgcagagcagacaggccctgaaggacgccagaagccccagccccgcccacatcgtgagccccctgccctgctgcacccagggccacgactgccagcacttctacccccccagcgacttcaccgtgagcacccaggtgttcagagacatgaagagaagccacagcctgcagaaggtgggcgagccctggtgcatcgagagcaacaaggtgcccgtggtgcagcacccccaccacgtgcaccccctgacccccctgatcacctacagcaacgagcacttcacccccggcaacccccccccccacctgcccgccgacgtggaccccaagacctag

SEQ ID NO: 102790 - DNA, 867 bp, Artificial Sequence
  Description of Artificial Sequence: Synthetic coding sequence
atgccccagctgaacggcggcggcggcgacgacctgggcgccaacgacgagctgatcagcttcaaggacgagggcgagcaggaggagaagagcagcgagaacagcagcgccgagagagacctggccgacgtgaagagcagcctggtgaacgagagcgagaccaaccagaacagcagcagcgacagcgaggccgagagaagacccccccccagaagcgagagcttcagagacaagagcagagagagcctggaggaggccgccaagagacaggacggcggcctgttcaagggccccccctaccccggctaccccttcatcatgatccccgacctgaccagcccctacctgcccaacggcagcctgagccccaccgccagaaccctgcacttccagagcggcagcacccactacagcgcctacaagaccatcgagcaccagatcgccgtgcagtacctgcagatgaagtggcccctgctggacgtgcaggccggcagcctgcagagcagacaggccctgaaggacgccagaagccccagccccgcccacatcgtgagcaacaaggtgcccgtggtgcagcacccccaccacgtgcaccccctgacccccctgatcacctacagcaacgagcacttcacccccggcaacccccccccccacctgcccgccgacgtggaccccaagaccggcatccccagacccccccacccccccgacatcagcccctactaccccctgagccccggcaccgtgggccagatcccccaccccctgggctggcagggccagcccgtgtaccccatcaccaccggcggcttcagacacccctaccccaccgccctgaccgtgaacgccagcatgagcagatag

SEQ ID NO: 102791 - DNA, 1380 bp, Artificial Sequence
  Description of Artificial Sequence: Synthetic coding sequence
atgccccagctgaacggcggcggcggcgacgacctgggcgccaacgacgagctgatcagcttcaaggacgagggcgagcaggaggagaagagcagcgagaacagcagcgccgagagagacctggccgacgtgaagagcagcctggtgaacgagagcgagaccaaccagaacagcagcagcgacagcgaggccgagagaagacccccccccagaagcgagagcttcagagacaagagcagagagagcctggaggaggccgccaagagacaggacggcggcctgttcaagggccccccctaccccggctaccccttcatcatgatccccgacctgaccagcccctacctgcccaacggcagcctgagccccaccgccagaacctacctgcagatgaagtggcccctgctggacgtgcaggccggcagcctgcagagcagacaggccctgaaggacgccagaagccccagccccgcccacatcgtgagcaacaaggtgcccgtggtgcagcacccccaccacgtgcaccccctgacccccctgatcacctacagcaacgagcacttcacccccggcaacccccccccccacctgcccgccgacgtggaccccaagaccggcatccccagacccccccacccccccgacatcagcccctactaccccctgagccccggcaccgtgggccagatcccccaccccctgggctggctggtgccccagcagggccagcccgtgtaccccatcaccaccggcggcttcagacacccctaccccaccgccctgaccgtgaacgccagcatgagcagattccccccccacatggtgcccccccaccacaccctgcacaccaccggcatcccccaccccgccatcgtgacccccaccgtgaagcaggagagcagccagagcgacgtgggcagcctgcacagcagcaagcaccaggacagcaagaaggaggaggagaagaagaagccccacatcaagaagcccctgaacgccttcatgctgtacatgaaggagatgagagccaaggtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagacaagcagcccggcgagaccaacgagcacagcgagtgcttcctgaacccctgcctgagcctgccccccatcaccgacctgagcgcccccaagaagtgcagagccagattcggcctggaccagcagaacaactggtgcggcccctgcagcctgtag

SEQ ID NO: 102792 - DNA, 1470 bp, Artificial Sequence
  Description of Artificial Sequence: Synthetic coding sequence
atgccccagctgaacggcggcggcggcgacgacctgggcgccaacgacgagctgatcagcttcaaggacgagggcgagcaggaggagaagagcagcgagaacagcagcgccgagagagacctggccgacgtgaagagcagcctggtgaacgagagcgagaccaaccagaacagcagcagcgacagcgaggccgagagaagacccccccccagaagcgagagcttcagagacaagagcagagagagcctggaggaggccgccaagagacaggacggcggcctgttcaagggccccccctaccccggctaccccttcatcatgatccccgacctgaccagcccctacctgcccaacggcagcctgagccccaccgccagaacctacctgcagatgaagtggcccctgctggacgtgcaggccggcagcctgcagagcagacaggccctgaaggacgccagaagccccagccccgcccacatcgtgagccccctgccctgctgcacccagggccacgactgccagcacttctacccccccagcgacttcaccgtgagcacccaggtgttcagagacatgaagagaagccacagcctgcagaaggtgggcgagccctggtgcatcgagagcaacaaggtgcccgtggtgcagcacccccaccacgtgcaccccctgacccccctgatcacctacagcaacgagcacttcacccccggcaacccccccccccacctgcccgccgacgtggaccccaagaccggcatccccagacccccccacccccccgacatcagcccctactaccccctgagccccggcaccgtgggccagatcccccaccccctgggctggctggtgccccagcagggccagcccgtgtaccccatcaccaccggcggcttcagacacccctaccccaccgccctgaccgtgaacgccagcatgagcagattccccccccacatggtgcccccccaccacaccctgcacaccaccggcatcccccaccccgccatcgtgacccccaccgtgaagcaggagagcagccagagcgacgtgggcagcctgcacagcagcaagcaccaggacagcaagaaggaggaggagaagaagaagccccacatcaagaagcccctgaacgccttcatgctgtacatgaaggagatgagagccaaggtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagacaagcagcccggcgagaccaacggcgagaagaagagcgccttcgccacctacaaggtgaaggccgccgccagcgcccaccccctgcagatggaggcctactag

SEQ ID NO: 102793 - DNA, 1860 bp, Artificial Sequence
  Description of Artificial Sequence: Synthetic coding sequence
atgccccagctgaacggcggcggcggcgacgacctgggcgccaacgacgagctgatcagcttcaaggacgagggcgagcaggaggagaagagcagcgagaacagcagcgccgagagagacctggccgacgtgaagagcagcctggtgaacgagagcgagaccaaccagaacagcagcagcgacagcgaggccgagagaagacccccccccagaagcgagagcttcagagacaagagcagagagagcctggaggaggccgccaagagacaggacggcggcctgttcaagggccccccctaccccggctaccccttcatcatgatccccgacctgaccagcccctacctgcccaacggcagcctgagccccaccgccagaaccctgcacttccagagcggcagcacccactacagcgcctacaagaccatcgagcaccagatcgccgtgcagtacctgcagatgaagtggcccctgctggacgtgcaggccggcagcctgcagagcagacaggccctgaaggacgccagaagccccagccccgcccacatcgtgagcaacaaggtgcccgtggtgcagcacccccaccacgtgcaccccctgacccccctgatcacctacagcaacgagcacttcacccccggcaacccccccccccacctgcccgccgacgtggaccccaagaccggcatccccagacccccccacccccccgacatcagcccctactaccccctgagccccggcaccgtgggccagatcccccaccccctgggctggctggtgccccagcagggccagcccgtgtaccccatcaccaccggcggcttcagacacccctaccccaccgccctgaccgtgaacgccagcatgagcagattccccccccacatggtgcccccccaccacaccctgcacaccaccggcatcccccaccccgccatcgtgacccccaccgtgaagcaggagagcagccagagcgacgtgggcagcctgcacagcagcaagcaccaggacagcaagaaggaggaggagaagaagaagccccacatcaagaagcccctgaacgccttcatgctgtacatgaaggagatgagagccaaggtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagacaagcagcccggcgagaccaacgagcacagcgagtgcttcctgaacccctgcctgagcctgccccccatcaccgacctgagcgcccccaagaagtgcagagccagattcggcctggaccagcagaacaactggtgcggcccctgcagaagaaagaagaagtgcgtgagatacatccagggcgagggcagctgcctgagcccccccagcagcgacggcagcctgctggacagccccccccccagccccaacctgctgggcagcccccccagagacgccaagagccagaccgagcagacccagcccctgagcctgagcctgaagcccgaccccctggcccacctgagcatgatgccccccccccccgccctgctgctggccgaggccacccacaaggccagcgccctgtgccccaacggcgccctggacctgccccccgccgccctgcagcccgccgcccccagcagcagcatcgcccagcccagcaccagcagcctgcacagccacagcagcctggccggcacccagccccagcccctgagcctggtgaccaagagcctggagtag

SEQ ID NO: 102794 - DNA, 363 bp, Artificial Sequence
  Description of Artificial Sequence: Synthetic coding sequence
atgctgtacatgaaggagatgagagccaaggtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagacaagcagcccggcgagaccaacgacctgagcgcccccaagaagtgcagagccagattcggcctggaccagcagaacaactggtgcggcccctgcagatgcaagtacagcaaggaggtgagcggcaccgtgagagcctag

SEQ ID NO: 102795 - DNA, 531 bp, Artificial Sequence
  Description of Artificial Sequence: Synthetic coding sequence
atgagcagattccccccccacatggtgcccccccaccacaccctgcacaccaccggcatcccccaccccgccatcgtgacccccaccgtgaagcaggagagcagccagagcgacgtgggcagcctgcacagcagcaagcaccaggacagcaagaaggaggaggagaagaagaagccccacatcaagaagcccctgaacgccttcatgctgtacatgaaggagatgagagccaaggtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagacaagcagcccggcgagaccaacggcgagaagaagagcgccttcgccacctacaaggtgaaggccgccgccagcgcccaccccctgcagatggaggcctactag

SEQ ID NO: 102796 - DNA, 954 bp, Artificial Sequence
  Description of Artificial Sequence: Synthetic coding sequence
atgccccagctgaacggcggcggcggcgacgacctgggcgccaacgacgagctgatcagcttcaaggacgagggcgagcaggaggagaagagcagcgagaacagcagcgccgagagagacctggccgacgtgaagagcagcctggtgaacgagagcgagaccaaccagaacagcagcagcgacagcgaggccgagagaagacccccccccagaagcgagagcttcagagacaagagcagagagagcctggaggaggccgccaagagacaggacggcggcctgttcaagggccccccctaccccggctaccccttcatcatgatccccgacctgaccagcccctacctgcccaacggcagcctgagccccaccgccagaacctacctgcagatgaagtggcccctgctggacgtgcaggccggcagcctgcagagcagacaggccctgaaggacgccagaagccccagccccgcccacatcgtgcagagccccctgccctgctgcacccagggccacgactgccagcacttctacccccccagcgacttcaccgtgagcacccaggtgttcagagacatgaagagaagccacagcctgcagaaggtgggcgagccctggtgcatcgagagcaacaaggtgcccgtggtgcagcacccccaccacgtgcaccccctgacccccctgatcacctacagcaacgagcacttcacccccggcaacccccccccccacctgcccgccgacgtggaccccaagaccggcatccccagacccccccacccccccgacatcagcccctactaccccctgagccccggcaccgtgggccagatcccccaccccctgggctggctggtgccccagcagggccagcccgtgtaccccatcaccaccggcggcttcagacacccctaccccaccgccctgaccgtgaacgccagcatgagcagatag

SEQ ID NO: 102797 - DNA, 1791 bp, Artificial Sequence
  Description of Artificial Sequence: Synthetic coding sequence
atgccccagctgaacggcggcggcggcgacgacctgggcgccaacgacgagctgatcagcttcaaggacgagggcgagcaggaggagaagagcagcgagaacagcagcgccgagagagacctggccgacgtgaagagcagcctggtgaacgagagcgagaccaaccagaacagcagcagcgacagcgaggccgagagaagacccccccccagaagcgagagcttcagagacaagagcagagagagcctggaggaggccgccaagagacaggacggcggcctgttcaagggccccccctaccccggctaccccttcatcatgatccccgacctgaccagcccctacctgcccaacggcagcctgagccccaccgccagaacctacctgcagatgaagtggcccctgctggacgtgcaggccggcagcctgcagagcagacaggccctgaaggacgccagaagccccagccccgcccacatcgtgagcaacaaggtgcccgtggtgcagcacccccaccacgtgcaccccctgacccccctgatcacctacagcaacgagcacttcacccccggcaacccccccccccacctgcccgccgacgtggaccccaagaccggcatccccagacccccccacccccccgacatcagcccctactaccccctgagccccggcaccgtgggccagatcccccaccccctgggctggctggtgccccagcagggccagcccgtgtaccccatcaccaccggcggcttcagacacccctaccccaccgccctgaccgtgaacgccagcatgagcagattccccccccacatggtgcccccccaccacaccctgcacaccaccggcatcccccaccccgccatcgtgacccccaccgtgaagcaggagagcagccagagcgacgtgggcagcctgcacagcagcaagcaccaggacagcaagaaggaggaggagaagaagaagccccacatcaagaagcccctgaacgccttcatgctgtacatgaaggagatgagagccaaggtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagacaagcagcccggcgagaccaacgagcacagcgagtgcttcctgaacccctgcctgagcctgccccccatcaccgacctgagcgcccccaagaagtgcagagccagattcggcctggaccagcagaacaactggtgcggcccctgcagaagaaagaagaagtgcgtgagatacatccagggcgagggcagctgcctgagcccccccagcagcgacggcagcctgctggacagccccccccccagccccaacctgctgggcagcccccccagagacgccaagagccagaccgagcagacccagcccctgagcctgagcctgaagcccgaccccctggcccacctgagcatgatgccccccccccccgccctgctgctggccgaggccacccacaaggccagcgccctgtgccccaacggcgccctggacctgccccccgccgccctgcagcccgccgcccccagcagcagcatcgcccagcccagcaccagcagcctgcacagccacagcagcctggccggcacccagccccagcccctgagcctggtgaccaagagcctggagtag

SEQ ID NO: 102798 - DNA, 1485 bp, Artificial Sequence
  Description of Artificial Sequence: Synthetic coding sequence
atgccccagctgaacggcggcggcggcgacgacctgggcgccaacgacgagctgatcagcttcaaggacgagggcgagcaggaggagaagagcagcgagaacagcagcgccgagagagacctggccgacgtgaagagcagcctggtgaacgagagcgagaccaaccagaacagcagcagcgacagcgaggccgagagaagacccccccccagaagcgagagcttcagagacaagagcagagagagcctggaggaggccgccaagagacaggacggcggcctgttcaagggccccccctaccccggctaccccttcatcatgatccccgacctgaccagcccctacctgcccaacggcagcctgagccccaccgccagaaccctgcacttccagagcggcagcacccactacagcgcctacaagaccatcgagcaccagatcgccgtgcagtacctgcagatgaagtggcccctgctggacgtgcaggccggcagcctgcagagcagacaggccctgaaggacgccagaagccccagccccgcccacatcgtgagcaacaaggtgcccgtggtgcagcacccccaccacgtgcaccccctgacccccctgatcacctacagcaacgagcacttcacccccggcaacccccccccccacctgcccgccgacgtggaccccaagaccggcatccccagacccccccacccccccgacatcagcccctactaccccctgagccccggcaccgtgggccagatcccccaccccctgggctggctggtgccccagcagggccagcccgtgtaccccatcaccaccggcggcttcagacacccctaccccaccgccctgaccgtgaacgccagcatgagcagattccccccccacatggtgcccccccaccacaccctgcacaccaccggcatcccccaccccgccatcgtgacccccaccgtgaagcaggagagcagccagagcgacgtgggcagcctgcacagcagcaagcaccaggacagcaagaaggaggaggagaagaagaagccccacatcaagaagcccctgaacgccttcatgctgtacatgaaggagatgagagccaaggtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagacaagcagcccggcgagaccaacgagcacagcgagtgcttcctgaacccctgcctgagcctgccccccatcaccgacctgagcgcccccaagaagtgcagagccagattcggcctggaccagcagaacaactggtgcggcccctgcagatgcaagtacagcaaggaggtgagcggcaccgtgagagcctag

SEQ ID NO: 102799 - DNA, 1809 bp, Artificial Sequence
  Description of Artificial Sequence: Synthetic coding sequence
atgccccagctgaacggcggcggcggcgacgacctgggcgccaacgacgagctgatcagcttcaaggacgagggcgagcaggaggagaagagcagcgagaacagcagcgccgagagagacctggccgacgtgaagagcagcctggtgaacgagagcgagaccaaccagaacagcagcagcgacagcgaggccgagagaagacccccccccagaagcgagagcttcagagacaagagcagagagagcctggaggaggccgccaagagacaggacggcggcctgttcaagggccccccctaccccggctaccccttcatcatgatccccgacctgaccagcccctacctgcccaacggcagcctgagccccaccgccagaaccctgcacttccagagcggcagcacccactacagcgcctacaagaccatcgagcaccagatcgccgtgcagtacctgcagatgaagtggcccctgctggacgtgcaggccggcagcctgcagagcagacaggccctgaaggacgccagaagccccagccccgcccacatcgtgagcaacaaggtgcccgtggtgcagcacccccaccacgtgcaccccctgacccccctgatcacctacagcaacgagcacttcacccccggcaacccccccccccacctgcccgccgacgtggaccccaagaccggcatccccagacccccccacccccccgacatcagcccctactaccccctgagccccggcaccgtgggccagatcccccaccccctgggctggctggtgccccagcagggccagcccgtgtaccccatcaccaccggcggcttcagacacccctaccccaccgccctgaccgtgaacgccagcatgagcagattccccccccacatggtgcccccccaccacaccctgcacaccaccggcatcccccaccccgccatcgtgacccccaccgtgaagcaggagagcagccagagcgacgtgggcagcctgcacagcagcaagcaccaggacagcaagaaggaggaggagaagaagaagccccacatcaagaagcccctgaacgccttcatgctgtacatgaaggagatgagagccaaggtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagacaagcagcccggcgagaccaacgacctgagcgcccccaagaagtgcagagccagattcggcctggaccagcagaacaactggtgcggcccctgcagaagaaagaagaagtgcgtgagatacatccagggcgagggcagctgcctgagcccccccagcagcgacggcagcctgctggacagccccccccccagccccaacctgctgggcagcccccccagagacgccaagagccagaccgagcagacccagcccctgagcctgagcctgaagcccgaccccctggcccacctgagcatgatgccccccccccccgccctgctgctggccgaggccacccacaaggccagcgccctgtgccccaacggcgccctggacctgccccccgccgccctgcagcccgccgcccccagcagcagcatcgcccagcccagcaccagcagcctgcacagccacagcagcctggccggcacccagccccagcccctgagcctggtgaccaagagcctggagtag

SEQ ID NO: 102800 - DNA, 1449 bp, Artificial Sequence
  Description of Artificial Sequence: Synthetic coding sequence
atgccccagctgaacggcggcggcggcgacgacctgggcgccaacgacgagctgatcagcttcaaggacgagggcgagcaggaggagaagagcagcgagaacagcagcgccgagagagacctggccgacgtgaagagcagcctggtgaacgagagcgagaccaaccagaacagcagcagcgacagcgaggccgagagaagacccccccccagaagcgagagcttcagagacaagagcagagagagcctggaggaggccgccaagagacaggacggcggcctgttcaagggccccccctaccccggctaccccttcatcatgatccccgacctgaccagcccctacctgcccaacggcagcctgagccccaccgccagaaccctgcacttccagagcggcagcacccactacagcgcctacaagaccatcgagcaccagatcgccgtgcagtacctgcagatgaagtggcccctgctggacgtgcaggccggcagcctgcagagcagacaggccctgaaggacgccagaagccccagccccgcccacatcgtgagcaacaaggtgcccgtggtgcagcacccccaccacgtgcaccccctgacccccctgatcacctacagcaacgagcacttcacccccggcaacccccccccccacctgcccgccgacgtggaccccaagaccggcatccccagacccccccacccccccgacatcagcccctactaccccctgagccccggcaccgtgggccagatcccccaccccctgggctggctggtgccccagcagggccagcccgtgtaccccatcaccaccggcggcttcagacacccctaccccaccgccctgaccgtgaacgccagcatgagcagattccccccccacatggtgcccccccaccacaccctgcacaccaccggcatcccccaccccgccatcgtgacccccaccgtgaagcaggagagcagccagagcgacgtgggcagcctgcacagcagcaagcaccaggacagcaagaaggaggaggagaagaagaagccccacatcaagaagcccctgaacgccttcatgctgtacatgaaggagatgagagccaaggtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagacaagcagcccggcgagaccaacgagcacagcgagtgcttcctgaacccctgcctgagcctgccccccatcaccggcgagaagaagagcgccttcgccacctacaaggtgaaggccgccgccagcgcccaccccctgcagatggaggcctactag

SEQ ID NO: 102801 - DNA, 1008 bp, Artificial Sequence
  Description of Artificial Sequence: Synthetic coding sequence
atgagcagcttcctgagcagcagattccccccccacatggtgcccccccaccacaccctgcacaccaccggcatcccccaccccgccatcgtgacccccaccgtgaagcaggagagcagccagagcgacgtgggcagcctgcacagcagcaagcaccaggacagcaagaaggaggaggagaagaagaagccccacatcaagaagcccctgaacgccttcatgctgtacatgaaggagatgagagccaaggtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagacaagcagcccggcgagaccaacgagcacagcgagtgcttcctgaacccctgcctgagcctgccccccatcaccgacctgagcgcccccaagaagtgcagagccagattcggcctggaccagcagaacaactggtgcggcccctgcagaagaaagaagaagtgcgtgagatacatccagggcgagggcagctgcctgagcccccccagcagcgacggcagcctgctggacagccccccccccagccccaacctgctgggcagcccccccagagacgccaagagccagaccgagcagacccagcccctgagcctgagcctgaagcccgaccccctggcccacctgagcatgatgccccccccccccgccctgctgctggccgaggccacccacaaggccagcgccctgtgccccaacggcgccctggacctgccccccgccgccctgcagcccgccgcccccagcagcagcatcgcccagcccagcaccagcagcctgcacagccacagcagcctggccggcacccagccccagcccctgagcctggtgaccaagagcctggagtag

SEQ ID NO: 102802 - DNA, 1809 bp, Artificial Sequence
  Description of Artificial Sequence: Synthetic coding sequence
atgccccagctgaacggcggcggcggcgacgacctgggcgccaacgacgagctgatcagcttcaaggacgagggcgagcaggaggagaagagcagcgagaacagcagcgccgagagagacctggccgacgtgaagagcagcctggtgaacgagagcgagaccaaccagaacagcagcagcgacagcgaggccgagagaagacccccccccagaagcgagagcttcagagacaagagcagagagagcctggaggaggccgccaagagacaggacggcggcctgttcaagggccccccctaccccggctaccccttcatcatgatccccgacctgaccagcccctacctgcccaacggcagcctgagccccaccgccagaaccctgcacttccagagcggcagcacccactacagcgcctacaagaccatcgagcaccagatcgccgtgcagtacctgcagatgaagtggcccctgctggacgtgcaggccggcagcctgcagagcagacaggccctgaaggacgccagaagccccagccccgcccacatcgtgagcaacaaggtgcccgtggtgcagcacccccaccacgtgcaccccctgacccccctgatcacctacagcaacgagcacttcacccccggcaacccccccccccacctgcccgccgacgtggaccccaagaccggcatccccagacccccccacccccccgacatcagcccctactaccccctgagccccggcaccgtgggccagatcccccaccccctgggctggctggtgccccagcagggccagcccgtgtaccccatcaccaccggcggcttcagacacccctaccccaccgccctgaccgtgaacgccagcatgagcagattccccccccacatggtgcccccccaccacaccctgcacaccaccggcatcccccaccccgccatcgtgacccccaccgtgaagcaggagagcagccagagcgacgtgggcagcctgcacagcagcaagcaccaggacagcaagaaggaggaggagaagaagaagccccacatcaagaagcccctgaacgccttcatgctgtacatgaaggagatgagagccaaggtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagacaagcagcccggcgagaccaacgacgccaacacccccaagaagtgcagagccctgttcggcctggacagacagaccctgtggtgcaagccctgcagaagaaagaagaagtgcgtgagatacatccagggcgagggcagctgcctgagcccccccagcagcgacggcagcctgctggacagccccccccccagccccaacctgctgggcagcccccccagagacgccaagagccagaccgagcagacccagcccctgagcctgagcctgaagcccgaccccctggcccacctgagcatgatgccccccccccccgccctgctgctggccgaggccacccacaaggccagcgccctgtgccccaacggcgccctggacctgccccccgccgccctgcagcccgccgcccccagcagcagcatcgcccagcccagcaccagcagcctgcacagccacagcagcctggccggcacccagccccagcccctgagcctggtgaccaagagcctggagtag

SEQ ID NO: 102803 - DNA, 1860 bp, Artificial Sequence
  Description of Artificial Sequence: Synthetic coding sequence
atgccccagctgaacggcggcggcggcgacgacctgggcgccaacgacgagctgatcagcttcaaggacgagggcgagcaggaggagaagagcagcgagaacagcagcgccgagagagacctggccgacgtgaagagcagcctggtgaacgagagcgagaccaaccagaacagcagcagcgacagcgaggccgagagaagacccccccccagaagcgagagcttcagagacaagagcagagagagcctggaggaggccgccaagagacaggacggcggcctgttcaagggccccccctaccccggctaccccttcatcatgatccccgacctgaccagcccctacctgcccaacggcagcctgagccccaccgccagaaccctgcacttccagagcggcagcacccactacagcgcctacaagaccatcgagcaccagatcgccgtgcagtacctgcagatgaagtggcccctgctggacgtgcaggccggcagcctgcagagcagacaggccctgaaggacgccagaagccccagccccgcccacatcgtgagcaacaaggtgcccgtggtgcagcacccccaccacgtgcaccccctgacccccctgatcacctacagcaacgagcacttcacccccggcaacccccccccccacctgcccgccgacgtggaccccaagaccggcatccccagacccccccacccccccgacatcagcccctactaccccctgagccccggcaccgtgggccagatcccccaccccctgggctggctggtgccccagcagggccagcccgtgtaccccatcaccaccggcggcttcagacacccctaccccaccgccctgaccgtgaacgccagcatgagcagattccccccccacatggtgcccccccaccacaccctgcacaccaccggcatcccccaccccgccatcgtgacccccaccgtgaagcaggagagcagccagagcgacgtgggcagcctgcacagcagcaagcaccaggacagcaagaaggaggaggagaagaagaagccccacatcaagaagcccctgaacgccttcatgctgtacatgaaggagatgagagccaaggtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagacaagcagcccggcgagaccaacgagcacagcgagtgcttcctgaacccctgcctgagcctgccccccatcaccgacgccaacacccccaagaagtgcagagccctgttcggcctggacagacagaccctgtggtgcaagccctgcagaagaaagaagaagtgcgtgagatacatccagggcgagggcagctgcctgagcccccccagcagcgacggcagcctgctggacagccccccccccagccccaacctgctgggcagcccccccagagacgccaagagccagaccgagcagacccagcccctgagcctgagcctgaagcccgaccccctggcccacctgagcatgatgccccccccccccgccctgctgctggccgaggccacccacaaggccagcgccctgtgccccaacggcgccctggacctgccccccgccgccctgcagcccgccgcccccagcagcagcatcgcccagcccagcaccagcagcctgcacagccacagcagcctggccggcacccagccccagcccctgagcctggtgaccaagagcctggagtag

SEQ ID NO: 102804 - DNA, 645 bp, Artificial Sequence
  Description of Artificial Sequence: Synthetic coding sequence
atggccttcctgagaagcatgtggggcgtgctgagcgccctgggcagaagcggcgccgagctgtgcaccggctgcggcagcagactgagaagccccttcagcttcgtgtacctgcccagatggttcagcagcgtgctggccagctgccccaagaagcccgtgagcagctacctgagattcagcaaggagcagctgcccatcttcaaggcccagaaccccgacgccaagaccaccgagctgatcagaagaatcgcccagagatggagagagctgcccgacagcaagaagaagatctaccaggacgcctacagagccgagtggcaggtgtacaaggaggagatcagcagattcaaggagcagctgacccccagccagatcatgagcctggagaaggagatcatggacaagcacctgaagagaaaggccatgaccaagaagaaggagaagctgaagaccgtgaaggagaactggaagaacctgagcgacagcgagaaggagctgtacatccagcacgccaaggaggacgagaccagataccacaacgagatgaagagctgggaggagcagatgatcgaggtgggcagaaaggacctgctgagaagaaccatcaagaagcagagaaagtacggcgccgaggagtgctag

SEQ ID NO: 102805 - DNA, 660 bp, Artificial Sequence
  Description of Artificial Sequence: Synthetic coding sequence
tgagagctgtgcaccggctgcggcagcagactgagaagccccttcagcttcgtgtacctgcccagatggttcagcagcgtgctggccagctgccccaagaagcccgtgagcagctacctgagattcagcaaggagcagctgcccatcttcaaggcccagaaccccgacgccaagaccaccgagctgatcagaagaatcgcccagagatggagagagctgcccgacagcaagaagaagatctaccaggacgcctacagagccgagtggcaggtgtacaaggaggagatcagcagattcaaggagcagctgacccccagccagatcatgagcctggagaaggagatcatggacaagcacctgaagagaaaggccatgaccaagaagaaggagctgaccctgctgggcaagcccaagagacccagaagcgcctacaacgtgtacgtggccgagagattccaggaggccaagggcgacagcccccaggagaagctgaagaccgtgaaggagaactggaagaacctgagcgacagcgagaaggaggtgagcatcaccgtggtgagcctgaagtgcctgctgagaatcagcgtgagagagtgcatcagagccagactggacagctgcgaggacaacctggtgctgctgatcatccaggtgttctag

SEQ ID NO: 102806 - DNA, 741 bp, Artificial Sequence
  Description of Artificial Sequence: Synthetic coding sequence
atggccttcctgagaagcatgtggggcgtgctgagcgccctgggcagaagcggcgccgagctgtgcaccggctgcggcagcagactgagaagccccttcagcttcgtgtacctgcccagatggttcagcagcgtgctggccagctgccccaagaagcccgtgagcagctacctgagattcagcaaggagcagctgcccatcttcaaggcccagaaccccgacgccaagaccaccgagctgatcagaagaatcgcccagagatggagagagctgcccgacagcaagaagaagatctaccaggacgcctacagagccgagtggcaggtgtacaaggaggagatcagcagattcaaggagcagctgacccccagccagatcatgagcctggagaaggagatcatggacaagcacctgaagagaaaggccatgaccaagaagaaggagctgaccctgctgggcaagcccaagagacccagaagcgcctacaacgtgtacgtggccgagagattccaggaggccaagggcgacagcccccaggagaagctgaagaccgtgaaggagaactggaagaacctgagcgacagcgagaaggagctgtacatccagcacgccaaggaggacgagaccagataccacaacgagatgaagagctgggaggagcagatgatcgaggtgggcagaaaggacctgctgagaagaaccatcaagaagcagagaaagtacggcgccgaggagtgctag

SEQ ID NO: 102807 - DNA, 1302 bp, Artificial Sequence
  Description of Artificial Sequence: Synthetic coding sequence
atgagcatcctggccaagatgggcgactggcaggacagacacgacggcaccagcaacggcaccgccagactgccccagctgggcaccgtgggccagagcccctacaccagcgccccccccctgagccacacccccaacgccgacttccagcccccctacttcccccccccctaccagcccatctacccccagagccaggacccctacagccacgtgaacgacccctacagcctgaaccccctgcacgcccagccccagccccagcaccccggctggcccggccagagacagagccaggagagcggcctgctgcacacccacagaggcctgccccaccagctgagcggcctggaccccagaagagactacagaagacacgaggacctgctgcacggcccccacgccctgagcagcggcctgggcgacctgagcatccacagcctgccccacgccatcgaggaggtgccccacgtggaggaccccggcatcaacatccccgaccagaccgtgatcaagaagggccccgtgagcctgagcaagagcaacagcaacgccgtgagcgccatccccatcaacaaggacaacctgttcggcggcgtggtgaaccccaacgaggtgttctgcagcgtgcccggcagactgagcctgctgagcagcaccagcaagtacaaggtgaccgtggccgaggtgcagagaagactgagcccccccgagtgcctgaacgccagcctgctgggcggcgtgctgagaagagccaagagcaagaacggcggcagaagcctgagagagaagctggacaagatcggcctgaacctgcccgccggcagaagaaaggccgccaacgtgaccctgctgaccagcctggtggagggcgaggccgtgcacctggccagagacttcggctacgtgtgcgagaccgagttccccgccaaggccgtggccgagttcctgaacagacagcacagcgaccccaacgagcaggtgaccagaaagaacatgctgctggccaccaagcagatctgcaaggagttcaccgacctgctggcccaggacagaagccccctgggcaacagcagacccaaccccatcctggagcccggcatccagagctgcctgacccacttcaacctgatcagccacggcttcggcagccccgccgtgtgcgccgccgtgaccgccctgcagaactacctgaccgaggccctgaaggccatggacaagatgtacctgagcaacaaccccaacagccacaccgacaacaacgccaagagcagcgacaaggaggagaagcacagaaagtag

SEQ ID NO: 102808 - DNA, 1314 bp, Artificial Sequence
  Description of Artificial Sequence: Synthetic coding sequence
atgctgtggaagctgaccgacaacatcaagtacgaggactgcgaggacagacacgacggcaccagcaacggcaccgccagactgccccagctgggcaccgtgggccagagcccctacaccagcgccccccccctgagccacacccccaacgccgacttccagcccccctacttcccccccccctaccagcccatctacccccagagccaggacccctacagccacgtgaacgacccctacagcctgaaccccctgcacgcccagccccagccccagcaccccggctggcccggccagagacagagccaggagagcggcctgctgcacacccacagaggcctgccccaccagctgagcggcctggaccccagaagagactacagaagacacgaggacctgctgcacggcccccacgccctgagcagcggcctgggcgacctgagcatccacagcctgccccacgccatcgaggaggtgccccacgtggaggaccccggcatcaacatccccgaccagaccgtgatcaagaagggccccgtgagcctgagcaagagcaacagcaacgccgtgagcgccatccccatcaacaaggacaacctgttcggcggcgtggtgaaccccaacgaggtgttctgcagcgtgcccggcagactgagcctgctgagcagcaccagcaagtacaaggtgaccgtggccgaggtgcagagaagactgagcccccccgagtgcctgaacgccagcctgctgggcggcgtgctgagaagagccaagagcaagaacggcggcagaagcctgagagagaagctggacaagatcggcctgaacctgcccgccggcagaagaaaggccgccaacgtgaccctgctgaccagcctggtggagggcgaggccgtgcacctggccagagacttcggctacgtgtgcgagaccgagttccccgccaaggccgtggccgagttcctgaacagacagcacagcgaccccaacgagcaggtgaccagaaagaacatgctgctggccaccaagcagatctgcaaggagttcaccgacctgctggcccaggacagaagccccctgggcaacagcagacccaaccccatcctggagcccggcatccagagctgcctgacccacttcaacctgatcagccacggcttcggcagccccgccgtgtgcgccgccgtgaccgccctgcagaactacctgaccgaggccctgaaggccatggacaagatgtacctgagcaacaaccccaacagccacaccgacaacaacgccaagagcagcgacaaggaggagaagcacagaaagtag

SEQ ID NO: 102809 - DNA, 1296 bp, Artificial Sequence
  Description of Artificial Sequence: Synthetic coding sequence
atgctggtgcacagcttcagcgccatggacagacacgacggcaccagcaacggcaccgccagactgccccagctgggcaccgtgggccagagcccctacaccagcgccccccccctgagccacacccccaacgccgacttccagcccccctacttcccccccccctaccagcccatctacccccagagccaggacccctacagccacgtgaacgacccctacagcctgaaccccctgcacgcccagccccagccccagcaccccggctggcccggccagagacagagccaggagagcggcctgctgcacacccacagaggcctgccccaccagctgagcggcctggaccccagaagagactacagaagacacgaggacctgctgcacggcccccacgccctgagcagcggcctgggcgacctgagcatccacagcctgccccacgccatcgaggaggtgccccacgtggaggaccccggcatcaacatccccgaccagaccgtgatcaagaagggccccgtgagcctgagcaagagcaacagcaacgccgtgagcgccatccccatcaacaaggacaacctgttcggcggcgtggtgaaccccaacgaggtgttctgcagcgtgcccggcagactgagcctgctgagcagcaccagcaagtacaaggtgaccgtggccgaggtgcagagaagactgagcccccccgagtgcctgaacgccagcctgctgggcggcgtgctgagaagagccaagagcaagaacggcggcagaagcctgagagagaagctggacaagatcggcctgaacctgcccgccggcagaagaaaggccgccaacgtgaccctgctgaccagcctggtggagggcgaggccgtgcacctggccagagacttcggctacgtgtgcgagaccgagttccccgccaaggccgtggccgagttcctgaacagacagcacagcgaccccaacgagcaggtgaccagaaagaacatgctgctggccaccaagcagatctgcaaggagttcaccgacctgctggcccaggacagaagccccctgggcaacagcagacccaaccccatcctggagcccggcatccagagctgcctgacccacttcaacctgatcagccacggcttcggcagccccgccgtgtgcgccgccgtgaccgccctgcagaactacctgaccgaggccctgaaggccatggacaagatgtacctgagcaacaaccccaacagccacaccgacaacaacgccaagagcagcgacaaggaggagaagcacagaaagtag

SEQ ID NO: 102810 - DNA, 1320 bp, Artificial Sequence
  Description of Artificial Sequence: Synthetic coding sequence
atgaagatgctgtggaagctgaccgacaacatcaagtacgaggactgcgaggacagacacgacggcaccagcaacggcaccgccagactgccccagctgggcaccgtgggccagagcccctacaccagcgccccccccctgagccacacccccaacgccgacttccagcccccctacttcccccccccctaccagcccatctacccccagagccaggacccctacagccacgtgaacgacccctacagcctgaaccccctgcacgcccagccccagccccagcaccccggctggcccggccagagacagagccaggagagcggcctgctgcacacccacagaggcctgccccaccagctgagcggcctggaccccagaagagactacagaagacacgaggacctgctgcacggcccccacgccctgagcagcggcctgggcgacctgagcatccacagcctgccccacgccatcgaggaggtgccccacgtggaggaccccggcatcaacatccccgaccagaccgtgatcaagaagggccccgtgagcctgagcaagagcaacagcaacgccgtgagcgccatccccatcaacaaggacaacctgttcggcggcgtggtgaaccccaacgaggtgttctgcagcgtgcccggcagactgagcctgctgagcagcaccagcaagtacaaggtgaccgtggccgaggtgcagagaagactgagcccccccgagtgcctgaacgccagcctgctgggcggcgtgctgagaagagccaagagcaagaacggcggcagaagcctgagagagaagctggacaagatcggcctgaacctgcccgccggcagaagaaaggccgccaacgtgaccctgctgaccagcctggtggagggcgaggccgtgcacctggccagagacttcggctacgtgtgcgagaccgagttccccgccaaggccgtggccgagttcctgaacagacagcacagcgaccccaacgagcaggtgaccagaaagaacatgctgctggccaccaagcagatctgcaaggagttcaccgacctgctggcccaggacagaagccccctgggcaacagcagacccaaccccatcctggagcccggcatccagagctgcctgacccacttcaacctgatcagccacggcttcggcagccccgccgtgtgcgccgccgtgaccgccctgcagaactacctgaccgaggccctgaaggccatggacaagatgtacctgagcaacaaccccaacagccacaccgacaacaacgccaagagcagcgacaaggaggagaagcacagaaagtag

SEQ ID NO: 102811 - DNA, 987 bp, Artificial Sequence
  Description of Artificial Sequence: Synthetic coding sequence
atgctgtggaagctgaccgacaacatcaagtacgaggactgcgaggacagacacgacggcaccagcaacggcaccgccagactgccccagctgggcaccgtgggccagagcccctacaccagcgccccccccctgagccacacccccaacgccgacttccagcccccctacttcccccccccctaccagcccatctacccccagagccaggacccctacagccacgtgaacgacccctacagcctgaaccccctgcacgcccagccccagccccagcaccccggctggcccggccagagacagagccaggagagcggcctgctgcacacccacagaggcctgccccaccagctgagcggcctggaccccagaagagactacagaagacacgaggacctgctgcacggcccccacgccctgagcagcggcctgggcgacctgagcatccacagcctgccccacgccatcgaggaggtgccccacgtggaggaccccggcatcaacatccccgaccagaccgtgatcaagaagggccccgtgagcctgagcaagagcaacagcaacgccgtgagcgccatccccatcaacaaggacaacctgttcggcggcgtggtgaaccccaacgaggtgttctgcagcgtgcccggcagactgagcctgctgagcagcaccagcaagtacaaggtgaccgtggccgaggtgcagagaagactgagcccccccgagtgcctgaacgccagcctgctgggcggcgtgctgagaagagccaagagcaagaacggcggcagaagcctgagagagaagctggacaagatcggcctgaacctgcccgccggcagaagaaaggccgccaacgtgaccctgctgaccagcctggtggaggacagatacgccaagagcagccccacctgctggctgagaaccgacctgccctggggcacccacggccccacccccagctggagccccgccagcagagccgcctag

SEQ ID NO: 102812 - DNA, 1314 bp, Artificial Sequence; identical to SEQ ID NO: 102808
  Description of Artificial Sequence: Synthetic coding sequence

SEQ ID NO: 102813 - DNA, 1410 bp, Artificial Sequence
  Description of Artificial Sequence: Synthetic coding sequence
atgcacagcccccccagagaccaggccgccatcatgctgtggaagctggtggagaacgtgaagtacgaggacatctacgagatgctggtgcacacctacagcagcatggacagacacgacggcgtgcccagccacagcagcagactgagccagctgggcagcgtgagccagggcccctacagcagcgccccccccctgagccacacccccagcagcgacttccagcccccctacttcccccccccctaccagcccctgccctaccaccagagccaggacccctacagccacgtgaacgacccctacagcctgaaccccctgcaccagccccagcagcacccctggggccagagacagagacaggaggtgggcagcgaggccggcagcctgctgccccagcccagagccgccctgccccagctgagcggcctggaccccagaagagactaccacagcgtgagaagacccgacgtgctgctgcacagcgcccaccacggcctggacgccggcatgggcgacagcctgagcctgcacggcctgggccaccccggcatggaggacgtgcagagcgtggaggacgccaacaacagcggcatgaacctgctggaccagagcgtgatcaagaaggtgcccgtgccccccaagagcgtgaccagcctgatgatgaacaaggacggcttcctgggcggcatgagcgtgaacaccggcgaggtgttctgcagcgtgcccggcagactgagcctgctgagcagcaccagcaagtacaaggtgaccgtgggcgaggtgcagagaagactgagcccccccgagtgcctgaacgccagcctgctgggcggcgtgctgagaagagccaagagcaagaacggcggcagaagcctgagagagagactggagaagatcggcctgaacctgcccgccggcagaagaaaggccgccaacgtgaccctgctgaccagcctggtggagggcgaggccgtgcacctggccagagacttcggctacatctgcgagaccgagttccccgccaaggccgtgagcgagtacctgaacagacagcacaccgaccccagcgacctgcacagcagaaagaacatgctgctggccaccaagcagctgtgcaaggagttcaccgacctgctggcccaggacagaacccccatcggcaacagcagacccagccccatcctggagcccggcatccagagctgcctgacccacttcagcctgatcacccacggcttcggcgcccccgccatctgcgccgccctgaccgccctgcagaactacctgaccgaggccctgaagggcatggacaagatgttcctgaacaacaccaccaccaacagacacaccagcggcgagggccccggcagcaagaccggcgacaaggaggagaagcacagaaagtag

SEQ ID NO: 102814 - DNA, 597 bp, Artificial Sequence
  Description of Artificial Sequence: Synthetic coding sequence
atgctgtggaagctggtggagaacgtgaagtacgaggacatctacgagatgctggtgcacacctacagcagcatggacagacacgacggcgtgcccagccacagcagcagactgagccagctgggcagcgtgagccagggcccctacagcagcgccccccccctgagccacacccccagcagcgacttccagcccccctacttcccccccccctaccagcccctgccctaccaccagagccaggacccctacagccacgtgaacgacccctacagcctgaaccccctgcaccagccccagcagcacccctggggccagagacagagacaggaggtgggcagcgaggccggcagcctgctgccccagcccagagccgccctgccccagctgagcggcctggaccccagaagagactaccacagcgtgagaagacccgacgtgctgctgcacagcgcccaccacggcctggacgccggcatgggcgacagcctgagcctgcacggcctgggccaccccggcatggaggacgtgcagagcgtggaggacgccaacaacagcggcatgaacctgctggaccagagcgtgatcaagaagtag

SEQ ID NO: 102815 - DNA, 1383 bp, Artificial Sequence
  Description of Artificial Sequence: Synthetic coding sequence
atgcacagcccccccagagaccaggccgccatcatgctgtggaagctggtggagaacgtgaagtacgaggacatctacgaggacagacacgacggcgtgcccagccacagcagcagactgagccagctgggcagcgtgagccagggcccctacagcagcgccccccccctgagccacacccccagcagcgacttccagcccccctacttcccccccccctaccagcccctgccctaccaccagagccaggacccctacagccacgtgaacgacccctacagcctgaaccccctgcaccagccccagcagcacccctggggccagagacagagacaggaggtgggcagcgaggccggcagcctgctgccccagcccagagccgccctgccccagctgagcggcctggaccccagaagagactaccacagcgtgagaagacccgacgtgctgctgcacagcgcccaccacggcctggacgccggcatgggcgacagcctgagcctgcacggcctgggccaccccggcatggaggacgtgcagagcgtggaggacgccaacaacagcggcatgaacctgctggaccagagcgtgatcaagaaggtgcccgtgccccccaagagcgtgaccagcctgatgatgaacaaggacggcttcctgggcggcatgagcgtgaacaccggcgaggtgttctgcagcgtgcccggcagactgagcctgctgagcagcaccagcaagtacaaggtgaccgtgggcgaggtgcagagaagactgagcccccccgagtgcctgaacgccagcctgctgggcggcgtgctgagaagagccaagagcaagaacggcggcagaagcctgagagagagactggagaagatcggcctgaacctgcccgccggcagaagaaaggccgccaacgtgaccctgctgaccagcctggtggagggcgaggccgtgcacctggccagagacttcggctacatctgcgagaccgagttccccgccaaggccgtgagcgagtacctgaacagacagcacaccgaccccagcgacctgcacagcagaaagaacatgctgctggccaccaagcagctgtgcaaggagttcaccgacctgctggcccaggacagaacccccatcggcaacagcagacccagccccatcctggagcccggcatccagagctgcctgacccacttcagcctgatcacccacggcttcggcgcccccgccatctgcgccgccctgaccgccctgcagaactacctgaccgaggccctgaagggcatggacaagatgttcctgaacaacaccaccaccaacagacacaccagcggcgagggccccggcagcaagaccggcgacaaggaggagaagcacagaaagtag

SEQ ID NO: 102816 - DNA, 1359 bp, Artificial Sequence
  Description of Artificial Sequence: Synthetic coding sequence
atgagcaccaccttccccggcctggtgcacgacgccgagatcagacacgacggcagcaacagctacagactgatgcagctgggctgcctggagagcgtggccaacagcaccgtggcctacagcagcagcagccccctgacctacagcaccaccggcaccgagttcgccagcccctacttcagcaccaaccaccagtacacccccctgcaccaccagagcttccactacgagttccagcacagccaccccgccgtgacccccgacgcctacagcctgaacagcctgcaccacagccagcagtactaccagcagatccaccacggcgagcccaccgacttcatcaacctgcacaacgccagagccctgaagagcagctgcctggacgagcagagaagagagctgggctgcctggacgcctacagaagacacgacctgagcctgatgagccacggcagccagtacggcatgcaccccgaccagagactgctgcccggccccagcctgggcctggccgccgccggcgccgacgacctgcagggcagcgtggaggcccagtgcggcctggtgctgaacggccagggcggcgtgatcagaagaggcggcacctgcgtggtgaaccccaccgacctgttctgcagcgtgcccggcagactgagcctgctgagcagcaccagcaagtacaaggtgaccatcgccgaggtgaagagaagactgagcccccccgagtgcctgaacgccagcctgctgggcggcatcctgagaagagccaagagcaagaacggcggcagatgcctgagagagaagctggacagactgggcctgaacctgcccgccggcagaagaaaggccgccaacgtgaccctgctgaccagcctggtggagggcgaggccctgcacctggccagagacttcggctacacctgcgagaccgagttccccgccaaggccgtgggcgagcacctggccagacagcacatggagcagaaggagcagaccgccagaaagaagatgatcctggccaccaagcagatctgcaaggagttccaggacctgctgagccaggacagaagccccctgggcagcagcagacccacccccatcctggacctggacatccagagacacctgacccacttcagcctgatcacccacggcttcggcacccccgccatctgcgccgccctgagcaccttccagaccgtgctgagcgagatgctgaactacctggagaagcacaccacccacaagaacggcggcgccgccgacagcggccagggccacgccaacagcgagaaggcccccctgagaaagaccagcgaggccgccgtgaaggagggcaagaccgagaagaccgactag

SEQ ID NO: 102817 - DNA, 1329 bp, Artificial Sequence
  Description of Artificial Sequence: Synthetic coding sequence
atgctggtgcacacctacagcgccatggagagacccgacggcctgggcgccgccgccggcggcgccagactgagcagcctgccccaggccgcctacggccccgccccccccctgtgccacacccccgccgccaccgccgccgccgagttccagcccccctacttcccccccccctacccccagccccccctgccctacggccaggcccccgacgccgccgccgccttcccccacctggccggcgacccctacggcggcctggcccccctggcccagccccagcccccccaggccgcctgggccgcccccagagccgccgccagagcccacgaggagccccccggcctgctggccccccccgccagagccctgggcctggaccccagaagagactacgccaccgccgtgcccagactgctgcacggcctggccgacggcgcccacggcctggccgacgcccccctgggcctgcccggcctggccgccgcccccggcctggaggacctgcaggccatggacgagcccggcatgagcctgctggaccagagcgtgatcaagaaggtgcccatccccagcaaggccagcagcctgagcgccctgagcctggccaaggacagcctggtgggcggcatcaccaaccccggcgaggtgttctgcagcgtgcccggcagactgagcctgctgagcagcaccagcaagtacaaggtgaccgtgggcgaggtgcagagaagactgagcccccccgagtgcctgaacgccagcctgctgggcggcgtgctgagaagagccaagagcaagaacggcggcagatgcctgagagagagactggagaagatcggcctgaacctgcccgccggcagaagaaaggccgccaacgtgaccctgctgaccagcctggtggagggcgaggccgtgcacctggccagagacttcggctacgtgtgcgagaccgagttccccgccaaggccgccgccgagtacctgtgcagacagcacgccgaccccggcgagctgcacagcagaaagagcatgctgctggccgccaagcagatctgcaaggagttcgccgacctgatggcccaggacagaagccccctgggcaacagcagacccgccctgatcctggagcccggcgtgcagagctgcctgacccacttcagcctgatcacccacggcttcggcggccccgccatctgcgccgccctgaccgccttccagaactacctgctggagagcctgaagggcctggacaagatgttcctgagcagcgtgggcagcggccacggcgagaccaaggccagcgagaaggacgccaagcacagaaagtag

SEQ ID NO: 102818 - DNA, 1353 bp, Artificial Sequence
  Description of Artificial Sequence: Synthetic coding sequence
atgctgtggaagatcaccgacaacgtgaagtacgaggaggactgcgaggacagacacgacggcagcagcaacggcaaccccagagtgccccacctgagcagcgccggccagcacctgtacagccccgccccccccctgagccacaccggcgtggccgagtaccagccccccccctacttcccccccccctaccagcagctggcctacagccagagcgccgacccctacagccacctgggcgaggcctacgccgccgccatcaaccccctgcaccagcccgcccccaccggcagccagcagcaggcctggcccggcagacagagccaggagggcgccggcctgcccagccaccacggcagacccgccggcctgctgccccacctgagcggcctggaggccggcgccgtgagcgccagaagagacgcctacagaagaagcgacctgctgctgccccacgcccacgccctggacgccgccggcctggccgagaacctgggcctgcacgacatgccccaccagatggacgaggtgcagaacgtggacgaccagcacctgctgctgcacgaccagaccgtgatcagaaagggccccatcagcatgaccaagaaccccctgaacctgccctgccagaaggagctggtgggcgccgtgatgaaccccaccgaggtgttctgcagcgtgcccggcagactgagcctgctgagcagcaccagcaagtacaaggtgaccgtggccgaggtgcagagaagactgagcccccccgagtgcctgaacgccagcctgctgggcggcgtgctgagaagagccaagagcaagaacggcggcagaagcctgagagagaagctggacaagatcggcctgaacctgcccgccggcagaagaaaggccgcccacgtgaccctgctgaccagcctggtggagggcgaggccgtgcacctggccagagacttcgcctacgtgtgcgaggccgagttccccagcaagcccgtggccgagtacctgaccagaccccacctgggcggcagaaacgagatggccgccagaaagaacatgctgctggccgcccagcagctgtgcaaggagttcaccgagctgctgagccaggacagaaccccccacggcaccagcagactggcccccgtgctggagaccaacatccagaactgcctgagccacttcagcctgatcacccacggcttcggcagccaggccatctgcgccgccgtgagcgccctgcagaactacatcaaggaggccctgatcgtgatcgacaagagctacatgaaccccggcgaccagagccccgccgacagcaacaagaccctggagaagatggagaagcacagaaagtag

SEQ ID NO: 102819 - DNA, 357 bp, Artificial Sequence
  Description of Artificial Sequence: Synthetic coding sequence
atgttcctgcaggacagacacgacggcagcagcaacggcaaccccagagtgccccacctgagcagcgccggccagcacctgtacagccccgccccccccctgagccacaccggcgtggccgagtaccagccccccccctacttcccccccccctaccagcagctggcctacagccagagcgccgacccctacagccacctgggcgaggcctacgccgccgccatcaaccccctgcaccagcccgcccccaccggcagccagcagcaggcctggcccggcagacagagccaggagggcgccggcctgcccagccaccacggcagacccgccggcctgctgccccacctgagcggctag

SEQ ID NO: 102820 - DNA, 846 bp, Artificial Sequence
  Description of Artificial Sequence: Synthetic coding sequence
atgccccaccagatggacgaggtgcagaacgtggacgaccagcacctgctgctgcacgaccagaccgtgatcagaaagggccccatcagcatgaccaagaaccccctgaacctgccctgccagaaggagctggtgggcgccgtgatgaaccccaccgaggtgttctgcagcgtgcccggcagactgagcctgctgagcagcaccagcaagtacaaggtgaccgtggccgaggtgcagagaagactgagcccccccgagtgcctgaacgccagcctgctgggcggcgtgctgagaagagccaagagcaagaacggcggcagaagcctgagagagaagctggacaagatcggcctgaacctgcccgccggcagaagaaaggccgcccacgtgaccctgctgaccagcctggtggagggcgaggccgtgcacctggccagagacttcgcctacgtgtgcgaggccgagttccccagcaagcccgtggccgagtacctgaccagaccccacctgggcggcagaaacgagatggccgccagaaagaacatgctgctggccgcccagcagctgtgcaaggagttcaccgagctgctgagccaggacagaaccccccacggcaccagcagactggcccccgtgctggagaccaacatccagaactgcctgagccacttcagcctgatcacccacggcttcggcagccaggccatctgcgccgccgtgagcgccctgcagaactacatcaaggaggccctgatcgtgatcgacaagagctacatgaaccccggcgaccagagccccgccgacagcaacaagaccctggagaagatggagaagcacagaaagtag

SEQ ID NO: 102821 - DNA, 1041 bp, Artificial Sequence
  Description of Artificial Sequence: Synthetic coding sequence
atggccgccagcggcaagctgagcacctgcagactgccccccctgcccaccatcagagagatcatcaagctgctgagactgcaggccgccaagcagctgagccagaacttcctgctggacctgagactgaccgacaagatcgtgagaaaggccggcaacctgaccaacgcctacgtgtacgaggtgggccccggccccggcggcatcaccagaagcatcctgaacgccgacgtggccgagctgctggtggtggagaaggacaccagattcatccccggcctgcagatgctgagcgacgccgcccccggcaagctgagaatcgtgcacggcgacgtgctgaccttcaaggtggagaaggccttcagcgagagcctgaagagaccctgggaggacgacccccccaacgtgcacatcatcggcaacctgcccttcagcgtgagcacccccctgatcatcaagtggctggagaacatcagctgcagagacggccccttcgtgtacggcagaacccagatgaccctgaccttccagaaggaggtggccgagagactggccgccaacaccggcagcaagcagagaagcagactgagcgtgatggcccagtacctgtgcaacgtgagacacatcttcaccatccccggccaggccttcgtgcccaagcccgaggtggacgtgggcgtggtgcacttcacccccctgatccagcccaagatcgagcagcccttcaagctggtggagaaggtggtgcagaacgtgttccagttcagaagaaagtactgccacagaggcctgagaatgctgttccccgaggcccagagactggagagcaccggcagactgctggagctggccgacatcgaccccaccctgagacccagacagctgagcatcagccacttcaagagcctgtgcgacgtgtacagaaagatgtgcgacgaggacccccagctgttcgcctacaacttcagagaggagctgaagagaagaaagagcaagaacgaggagaaggaggaggacgacgccgagaactacagactgtag

SEQ ID NO: 102822 - DNA, 1728 bp, Artificial Sequence
  Description of Artificial Sequence: Synthetic coding sequence
atgagccacgccgccgagcccgccagagacggcgtggaggccagcgccgagggccccagagccgtgttcgtgctgctggaggagagaagacccgccgacagcgcccagctgctgagcctgaacagcctgctgcccgagagcggcatcgtggccgacatcgagctggagaacgtgctggaccccgacagcttctacgagctgaagagccagcccctgcccctgagaagcagcctgcccatcagcctgcaggccacccccgccacccccgccaccctgagcgccagcagcagcgccggcggcagcagaacccccgccatgagcagcagcagcagcagcagagtgctgctgagacagcagctgatgagagcccaggcccaggagcaggagagaagagagagaagagagcaggccgccgccgcccccttccccagccccgcccccgccagccccgccatcagcgtggtgggcgtgagcgccggcggccacaccctgagcagacccccccccgcccaggtgcccagagaggtgctgaaggtgcagacccacctggagaaccccaccagataccacctgcagcaggccagaagacagcaggtgaagcagtacctgagcaccaccctgggccccaagctggccagccaggccctgacccccccccccggccccgccagcgcccagcccctgcccgcccccgaggccgcccacaccaccggccccaccggcagcgcccccaacagccccatggccctgctgaccatcggcagcagcagcgagaaggagatcgacgacgtgatcgacgagatcatcagcctggagagcagctacaacgacgagatgctgagctacctgcccggcggcaccaccggcctgcagctgcccagcaccctgcccgtgagcggcaacctgctggacgtgtacagcagccagggcgtggccacccccgccatcaccgtgagcaacagctgccccgccgagctgcccaacatcaagagagagatcagcgagaccgaggccaaggccctgctgaaggagagacagaagaaggacaaccacaacctgatcgagagaagaagaagattcaacatcaacgacagaatcaaggagctgggcaccctgatccccaagagcagcgaccccgagatgagatggaacaagggcaccatcctgaaggccagcgtggactacatcagaaagctgcagaaggagcagcagagaagcaaggacctggagagcagacagagaagcctggagcaggccaacagaagcctgcagctgagaatccaggagctggagctgcaggcccagatccacggcctgcccgtgccccccacccccggcctgctgagcctggccaccaccagcgccagcgacagcctgaagcccgagcagctggacatcgaggaggagggcagacccggcgccgccaccttccacgtgggcggcggccccgcccagaacgccccccaccagcagccccccgccccccccagcgacgccctgctggacctgcacttccccagcgaccacctgggcgacctgggcgaccccttccacctgggcctggaggacatcctgatggaggaggaggagggcgtggtgggcggcctgagcggcggcgccctgagccccctgagagccgccagcgaccccctgctgagcagcgtgagccccgccgtgagcaaggccagcagcagaagaagcagcttcagcatggaggaggagagctag

SEQ ID NO: 102823 - DNA, 1509 bp, Artificial Sequence
  Description of Artificial Sequence: Synthetic coding sequence
atggcctgggccctgaagctgcccctggccgacgaggtgatcgagagcggcctggtgcaggacttcgacgccagcctgagcggcatcggccaggagctgggcgccggcgcctacagcatgagcgacgtgctggccctgcccatcttcaagcaggaggagagcagcctgccccccgacaacgagaacaagatcctgcccttccagtacgtgctgtgcgccgccaccagccccgccgtgaagctgcacgacgagaccctgacctacctgaaccagggccagagctacgagatcagaatgctggacaacagaaagctgggcgagctgcccgagatcaacggcaagctggtgaagagcatcttcagagtggtgttccacgacagaagactgcagtacaccgagcaccagcagctggagggctggagatggaacagacccggcgacagaatcctggacatcgacatccccatgagcgtgggcatcatcgaccccagagccaaccccacccagctgaacaccgtggagttcctgtgggaccccgccaagagaaccagcgtgttcatccaggtgcactgcatcagcaccgagttcaccatgagaaagcacggcggcgagaagggcgtgcccttcagagtgcagatcgacaccttcaaggagaacgagaacggcgagtacaccgagcacctgcacagcgccagctgccagatcaaggtgttcaagcccaagggcgccgacagaaagcagaagaccgacagagagaagatggagaagagaaccccccacgagaaggagaagtaccagcccagctacgagaccaccatcctgaccgagtgcagcccctggcccgagatcacctacgtgaacaacagccccagccccggcttcaacagcagccacagcagcttcagcctgggcgagggcaacggcagccccaaccaccagcccgagccccccccccccgtgaccgacaacctgctgcccaccaccaccccccaggaggcccagcagtggctgcacagaaacagattcagcaccttcaccagactgttcaccaacttcagcggcgccgacctgctgaagctgaccagagacgacgtgatccagatctgcggccccgccgacggcatcagactgttcaacgccctgaagggcagaatggtgagacccagactgaccatctacgtgtgccaggagagcctgcagctgagagagcagcagcagcagcagcagcagcagcagcagaagcacgaggacggcgacagcaacggcaccttcttcgtgtaccacgccatctacctggaggagctgaccgccgtggagctgaccgagaagatcgcccagctgttcagcatcagcccctgccagatcagccagatctacaagcagggccccaccggcatccacgtgctgatcagcgacgagatgatccagaacttccaggaggaggcctgcttcatcctggacaccatgaaggccgagaccaacgacagctaccacatcatcctgaagtag

SEQ ID NO: 102824 - DNA, 1356 bp, Artificial Sequence
  Description of Artificial Sequence: Synthetic coding sequence
atggcctgggccctgaagctgcccctggccgacgaggtgatcgagagcggcctggtgcaggacttcgacgccagcctgagcggcatcggccaggagctgggcgccggcgcctacagcatgagcgacgtgctggccctgcccatcttcaagcaggaggagagcagcctgccccccgacaacgagaacaagatcctgcccttccagtacgtgctgtgcgccgccaccagccccgccgtgaagctgcacgacgagaccctgacctacctgaaccagggccagagctacgagatcagaatgctggacaacagaaagctgggcgagctgcccgagatcaacggcaagctggtgaagagcatcttcagagtggtgttccacgacagaagactgcagtacaccgagcaccagcagctggagggctggagatggaacagacccggcgacagaatcctggacatcgacatccccatgagcgtgggcatcatcgaccccagagccaaccccacccagctgaacaccgtggagttcctgtgggaccccgccaagagaaccagcgtgttcatccagcccaagggcgccgacagaaagcagaagaccgacagagagaagatggagaagagaaccccccacgagaaggagaagtaccagcccagctacgagaccaccatcctgaccgagtgcagcccctggcccgagatcacctacgtgaacaacagccccagccccggcttcaacagcagccacagcagcttcagcctgggcgagggcaacggcagccccaaccaccagcccgagccccccccccccgtgaccgacaacctgctgcccaccaccaccccccaggaggcccagcagtggctgcacagaaacagattcagcaccttcaccagactgttcaccaacttcagcggcgccgacctgctgaagctgaccagagacgacgtgatccagatctgcggccccgccgacggcatcagactgttcaacgccctgaagggcagaatggtgagacccagactgaccatctacgtgtgccaggagagcctgcagctgagagagcagcagcagcagcagcagcagcagcagcagaagcacgaggacggcgacagcaacggcaccttcttcgtgtaccacgccatctacctggaggagctgaccgccgtggagctgaccgagaagatcgcccagctgttcagcatcagcccctgccagatcagccagatctacaagcagggccccaccggcatccacgtgctgatcagcgacgagatgatccagaacttccaggaggaggcctgcttcatcctggacaccatgaaggccgagaccaacgacagctaccacatcatcctgaagtag

SEQ ID NO: 102825 - DNA, 1353 bp, Artificial Sequence
  Description of Artificial Sequence: Synthetic coding sequence
atggcctgggccctgaagctgcccctggccgacgaggtgatcgagagcggcctggtgcaggacttcgacgccagcctgagcggcatcggccaggagctgggcgccggcgcctacagcatgagcgacgtgctggccctgcccatcttcaagcaggaggagagcagcctgccccccgacaacgagaacaagatcctgcccttccagtacgtgctgtgcgccgccaccagccccgccgtgaagctgcacgacgagaccctgacctacctgaaccagggccagagctacgagatcagaatgctggacaacagaaagctgggcgagctgcccgagatcaacggcaagctggtgaagagcatcttcagagtggtgttccacgacagaagactgcagtacaccgagcaccagcagctggagggctggagatggaacagacccggcgacagaatcctggacatcgacatccccatgagcgtgggcatcatcgaccccagagccaaccccacccagctgaacaccgtggagttcctgtgggaccccgccaagagaaccagcgtgttcatccagcccaagggcgccgacagaaagcagaagaccgacagagagaagatggagaagagaaccccccacgagaaggagaagtaccagcccagctacgagaccaccatcctgaccgagtgcagcccctggcccgagatcacctacgtgaacaacagccccagccccggcttcaacagcagccacagcagcttcagcctgggcgagggcaacggcagccccaaccaccagcccgagccccccccccccgtgaccgacaacctgctgcccaccaccaccccccaggaggcccagcagtggctgcacagaaacagattcagcaccttcaccagactgttcaccaacttcagcggcgccgacctgctgaagctgaccagagacgacgtgatccagatctgcggccccgccgacggcatcagactgttcaacgccctgaagggcagaatggtgagacccagactgaccatctacgtgtgccaggagagcctgcagctgagagagcagcagcagcagcagcagcagcagcagcagaagcacgaggacggcgacagcaacggcaccttcttcgtgtaccacgccatctacctggaggagctgaccgccgtggagctgaccgagaagatcgcccagctgttcagcatcagcccctgccagatcagccagatctacaagcagggccccaccggcatccacgtgctgatcagcgacgagatgatccagaacttccaggaggaggcctgcttcatcctggacaccatgaaggagaccaacgacagctaccacatcatcctgaagtag

SEQ ID NO: 102826 - DNA, 1440 bp, Artificial Sequence
  Description of Artificial Sequence: Synthetic coding sequence
atgctgttctggcacacccagcccgagcactacaaccagcacaacagcggcagctacctgagagacgtgctggccctgcccatcttcaagcaggaggagccccagctgagccccgagaacgaggccagactgccccccctgcagtacgtgctgtgcgccgccaccagccccgccgtgaagctgcacgaggagaccctgacctacctgaaccagggccagagctacgagatcagactgctggagaacagaaagctgggcgacttccaggacctgaacaccaagtacgtgaagagcatcatcagagtggtgttccacgacagaagactgcagtacaccgagcaccagcagctggagggctggagatggagcagacccggcgacagaatcctggacatcgacatccccctgagcgtgggcatcctggaccccagagccagccccacccagctgaacgccgtggagttcctgtgggaccccgccaagagagccagcgccttcatccaggtgcactgcatcagcaccgagttcacccccagaaagcacggcggcgagaagggcgtgcccttcagagtgcagatcgacaccttcaagcagaacgagaacggcgagtacaccgagcacctgcacagcgccagctgccagatcaaggtgttcaagcccaagggcgccgacagaaagcagaagaccgacagagagaagatggagaagagaaccgcccaggagaaggagaagtaccagcccagctacgagaccaccatcctgaccgagtgcagcccctggcccgacgtggcctaccaggtgaacagcgcccccagccccagctacaacggcagccccaacagcttcggcctgggcgagggcaacgccagccccacccaccccgtggaggccctgcccgtgggcagcgaccacctgctgcccagcgccagcatccaggacgcccagcagtggctgcacagaaacagattcagccagttctgcagactgttcgccagcttcagcggcgccgacctgctgaagatgagcagagacgacctggtgcagatctgcggccccgccgacggcatcagactgttcaacgccatcaagggcagaaacgtgagacccaagatgaccatctacgtgtgccaggagctggagcagaacagagtgcccctgcagcagaagagagacggcagcggcgacagcaacctgagcgtgtaccacgccatcttcctggaggagctgaccaccctggagctgatcgagaagatcgccaacctgtacagcatcagcccccagcacatccacagagtgtacagacagggccccaccggcatccacgtggtggtgagcaacgagatggtgcagaacttccaggacgagagctgcttcgtgctgagcaccatcaaggccgagagcaacgacggctaccacatcatcctgaagtgcggcctgtag

SEQ ID NO: 102827 - DNA, 99 bp, Artificial Sequence
  Description of Artificial Sequence: Synthetic coding sequence
atggtgcagaacttccaggacgagagctgcttcgtgctgagcaccatcaaggccgagagcaacgacggctaccacatcatcctgaagtgcggcctgtag

SEQ ID NO: 102828 - DNA, 1218 bp, Artificial Sequence
  Description of Artificial Sequence: Synthetic coding sequence
atggccaagtacgtgagcctgaccgaggccaacgaggagctgaaggtgctgatggacgagaaccagaccagcagacccgtggccgtgcacaccagcaccgtgaaccccctgggcaagcagctgctgcccaagaccttcggccagagcagcgtgaacatcgaccagcaggtggtgatcggcatgccccagagacccgccgccagcaacatccccgtggtgggcagccccaacccccccagcacccacttcgccagccagaaccagcacagctacagcagccccccctgggccggccagcacaacagaaagggcgagaagaacggcatgggcctgtgcagactgagcatgaaggtgtgggagaccgtgcagagaaagggcaccaccagctgccaggaggtggtgggcgagctggtggccaagttcagagccgccagcaaccacgccagccccaacgagagcgcctacgacgtgaagaacatcaagagaagaacctacgacgccctgaacgtgctgatggccatgaacatcatcagcagagagaagaagaagatcaagtggatcggcctgaccaccaacagcgcccagaactgccagaacctgagagtggagagacagaagagactggagagaatcaagcagaagcagagcgagctgcagcagctgatcctgcagcagatcgccttcaagaacctggtgctgagaaaccagtacgtggaggagcaggtgagccagagacccctgcccaacagcgtgatccacgtgcccttcatcatcatcagcagcagcaagaagaccgtgatcaactgcagcatcagcgacgacaagagcgagtacctgttcaagttcaacagcagcttcgagatccacgacgacaccgaggtgctgatgtggatgggcatgaccttcggcctggagagcggcagctgcagcgccgaggacctgaagatggccagaaacctggtgcccaaggccctggagccctacgtgaccgagatggcccagggcaccttcggcggcgtgttcaccaccgccggcagcagaagcaacggcacctggctgagcgccagcgacctgaccaacatcgccatcggcatgctggccaccagcagcggcggcagccagtacagcggcagcagagtggagacccccgccgtggaggaggaggaggaggaggacaacaacgacgacgacctgagcgagaacgacgaggacgactag

SEQ ID NO: 102829 - DNA, 2649 bp, Artificial Sequence
  Description of Artificial Sequence: Synthetic coding sequence
atggagggcgagagcagcagattcgagatccacacccccgtgagcgacaagaagaagaagaagtgcagcatccacaaggagagaccccagaagcacagccacgagatcttcagagacagcagcctggtgaacgagcagagccagatcaccagaagaaagaagagaaagaaggacttccagcacctgatcagcagccccctgaagaagagcagaatctgcgacgagaccgccaacgccaccagcaccctgaagaagagaaagaagagaagatacagcgccctggaggtggacgaggaggccggcgtgaccgtggtgctggtggacaaggagaacatcaacaacacccccaagcacttcagaaaggacgtggacgtggtgtgcgtggacatgagcatcgagcagaagctgcccagaaagcccaagaccgacaagttccaggtgctggccaagagccacgcccacaagagcgaggccctgcacagcaaggtgagagagaagaagaacaagaagcaccagagaaaggccgccagctgggagagccagagagccagagacaccctgccccagagcgagagccaccaggaggagagctggctgagcgtgggccccggcggcgagatcaccgagctgcccgccagcgcccacaagaacaagagcaagaagaagaagaagaagagcagcaacagagagtacgagaccctggccatgcccgagggcagccaggccggcagagaggccggcaccgacatgcaggagagccagcccaccgtgggcctggacgacgagaccccccagctgctgggccccacccacaagaagaagagcaagaagaagaagaagaagaagagcaaccaccaggagttcgaggccctggccatgcccgagggcagccaggtgggcagcgaggtgggcgccgacatgcaggagagcagacccgccgtgggcctgcacggcgagaccgccggcatccccgcccccgcctacaagaacaagagcaagaagaagaagaagaagagcaaccaccaggagttcgaggccgtggccatgcccgagagcctggagagcgcctaccccgagggcagccaggtgggcagcgaggtgggcaccgtggagggcagcaccgccctgaagggcttcaaggagagcaacagcaccaagaagaagagcaagaagagaaagctgaccagcgtgaagagagccagagtgagcggcgacgacttcagcgtgcccagcaagaacagcgagagcaccctgttcgacagcgtggagggcgacggcgccatgatggaggagggcgtgaagagcagacccagacagaagaagacccaggcctgcctggccagcaagcacgtgcaggaggcccccagactggagcccgccaacgaggagcacaacgtggagaccgccgaggacagcgagatcagatacctgagcgccgacagcggcgacgccgacgacagcgacgccgacctgggcagcgccgtgaagcagctgcaggagttcatccccaacatcaaggacagagccaccagcaccatcaagagaatgtacagagacgacctggagagattcaaggagttcaaggcccagggcgtggccatcaagttcggcaagttcagcgtgaaggagaacaagcagctggagaagaacgtggaggacttcctggccctgaccggcatcgagagcgccgacaagctgctgtacaccgacagataccccgaggagaagagcgtgatcaccaacctgaagagaagatacagcttcagactgcacatcggcagaaacatcgccagaccctggaagctgatctactacagagccaagaagatgttcgacgtgaacaactacaagggcagatacagcgagggcgacaccgagaagctgaagatgtaccacagcctgctgggcaacgactggaagaccatcggcgagatggtggccagaagcagcctgagcgtggccctgaagttcagccagatcagcagccagagaaacagaggcgcctggagcaagagcgagaccagaaagctgatcaaggccgtggaggaggtgatcctgaagaagatgagcccccaggagctgaaggaggtggacagcaagctgcaggagaaccccgagagctgcctgagcatcgtgagagagaagctgtacaagggcatcagctgggtggaggtggaggccaaggtgcagaccagaaactggatgcagtgcaagagcaagtggaccgagatcctgaccaagagaatgaccaacggcagaagaatctactacggcatgaacgccctgagagccaaggtgagcctgatcgagagactgtacgagatcaacgtggaggacaccaacgagatcgactgggaggacctggccagcgccatcggcgacgtgccccccagctacgtgcagaccaagttcagcagactgaaggccgtgtacgtgcccttctggcagaagaagaccttccccgagatcatcgactacctgtacgagaccaccctgcccctgctgaaggagaagctggagaagatgatggagaagaagggcaccaagatccagacccccgccgcccccaagcaggtgttccccttcagagacatcttctactacgaggacgacagcgagggcggccacagaaagagaaagagaagatag

SEQ ID NO: 102830 - DNA, 2718 bp, Artificial Sequence
  Description of Artificial Sequence: Synthetic coding sequence
atggagggcgagagcagcagattcgagatccacacccccgtgagcgacaagaagaagaagaagtgcagcatccacaaggagagaccccagaagcacagccacgagatcttcagagacagcagcctggtgaacgagcagagccagatcaccagaagaaagaagagaaagaaggacttccagcacctgatcagcagccccctgaagaagagcagaatctgcgacgagaccgccaacgccaccagcaccctgaagaagagaaagaagagaagatacagcgccctggaggtggacgaggaggccggcgtgaccgtggtgctggtggacaaggagaacatcaacaacacccccaagcacttcagaaaggacgtggacgtggtgtgcgtggacatgagcatcgagcagaagctgcccagaaagcccaagaccgacaagttccaggtgctggccaagagccacgcccacaagagcgaggccctgcacagcaaggtgagagagaagaagaacaagaagcaccagagaaaggccgccagctgggagagccagagagccagagacaccctgccccagagcgagagccaccaggaggagagctggctgagcgtgggccccggcggcgagatcaccgagctgcccgccagcgcccacaagaacaagagcaagaagaagaagaagaagagcagcaacagagagtacgagaccctggccatgcccgagggcagccaggccggcagagaggccggcaccgacatgcaggagagccagcccaccgtgggcctggacgacgagaccccccagctgctgggccccacccacaagaagaagagcaagaagaagaagaagaagaagagcaaccaccaggagttcgaggccctggccatgcccgagggcagccaggtgggcagcgaggtgggcgccgacatgcaggagagcagacccgccgtgggcctgcacggcgagaccgccggcatccccgcccccgcctacaagaacaagagcaagaagaagaagaagaagagcaaccaccaggagttcgaggccgtggccatgcccgagagcctggagagcgcctaccccgagggcagccaggtgggcagcgaggtgggcaccgtggagggcagcaccgccctgaagggcttcaaggagagcaacagcaccaagaagaagagcaagaagagaaagctgaccagcgtgaagagagccagagtgagcggcgacgacttcagcgtgcccagcaagaacagcgagagcaccctgttcgacagcgtggagggcgacggcgccatgatggaggagggcgtgaagagcagacccagacagaagaagacccaggcctgcctggccagcaagcacgtgcaggaggcccccagactggagcccgccaacgaggagcacaacgtggagaccgccgaggacagcgagatcagatacctgagcgccgacagcggcgacgccgacgacagcgacgccgacctgggcagcgccgtgaagcagctgcaggagttcatccccaacatcaaggacagagccaccagcaccatcaagagaatgtacagagacgacctggagagattcaaggagttcaaggcccagggcgtggccatcaagttcggcaagttcagcgtgaaggagaacaagcagctggagaagaacgtggaggacttcctggccctgaccggcatcgagagcgccgacaagctgctgtacaccgacagataccccgaggagaagagcgtgatcaccaacctgaagagaagatacagcttcagactgcacatcggcagaaacatcgccagaccctggaagctgatctactacagagccaagaagatgttcgacgtgaacaactacaagggcagatacagcgagggcgacaccgagaagctgaagatgtaccacagcctgctgggcaacgactggaagaccatcggcgagatggtggccagaagcagcctgagcgtggccctgaagttcagccagatcagcagccagagaaacagaggcgcctggagcaagagcgagaccagaaagctgatcaaggccgtggaggaggtgatcctgaagaagatgagcccccaggagctgaaggaggtggacagcaagctgcaggagaaccccgagagctgcctgagcatcgtgagagagaagctgtacaagggcatcagctgggtggaggtggaggccaaggtgcagaccagaaactggatgcagtgcaagagcaagtggaccgagatcctgaccaagagaatgaccaacggcagaagaatctactacggcatgaacgccctgagagccaaggtgagcctgatcgagagactgtacgagatcaacgtggaggacaccaacgagatcgactgggaggacctggccagcgccatcggcgacgtgccccccagctacgtgcagaccaagttcagcagactgaaggccgtgtacgtgcccttctggcagaagaagaccttccccgagatcatcgactacctgtacgagaccaccctgcccctgctgaaggagaagctggagaagatgatggagaagaagggcaccaagatccagacccccgccgcccccaagcaggtgttccccttcagagacatcttctactacgaggacgacagcgagggcgaggacatcgagaaggagagcgagggccaggccccctgcatggcccacgcctgcaacagcagcaccctgggcggccagggcagatggatcatctag

SEQ ID NO: 102831 - DNA, 3489 bp, Artificial Sequence
  Description of Artificial Sequence: Synthetic coding sequence
atggaggaggtgagatgccccgagcacggcaccttctgcttcctgaagaccggcgtgagagacggccccaacaagggcaagagcttctacgtgtgcagagccgacacctgcagcttcgtgagagccaccgacatccccgtgagccactgcctgctgcacgaggacttcgtggtggagctgcagggcctgctgctgccccaggacaagaaggagtacagactgttcttcagatgcatcagaagcaaggccgagggcaagagatggtgcggcagcatcccctggcaggaccccgacagcaaggagcacagcgtgagcaacaagagccagcacgccagcgagaccttccaccacagcagcaactggctgagaaaccccttcaaggtgctggacaagaaccaggagcccgccctgtggaagcagctgatcaagggcgagggcgaggagaagaaggccgacaagaagcagagagagaagggcgaccagctgttcgaccagaagaaggagcagaagcccgagatgatggagaaggacctgagcagcggcctggtgcccaagaagaagcagagcgtggtgcaggagaagaagcaggaggagggcgccgagatccagtgcgaggccgagaccggcggcacccacaagagagacttcagcgagatcaagagccagcagtgccagggcaacgagctgaccagacccagcgccagcagccaggagaagagcagcggcaagagccaggacgtgcagagagagagcgagcccctgagagagaaggtgacccagctgctgccccagaacgtgcacagccacaacagcatcagcaagccccagaagggcggccccctgaacaaggagtacaccaactgggaggccaaggagaccaaggccaaggacggccccagcatccaggccacccagaagagcctgccccagggccacttccaggagagacccgagacccacagcgtgcccgcccccggcggccccgccgcccaggccgcccccgccgcccccggcctgagcctgggcgagggcagagaggccgccaccagcagcgacgacgaggaggaggacgacgtggtgttcgtgagcagcaagcccggcagccccctgctgttcgacagcaccctggacctggagaccaaggagaacctgcagttccccgacagaagcgtgcagagaaaggtgagccccgccagcggcgtgagcaagaaggtggagcccagcgaccccgtggccagaagagtgtacctgaccacccagctgaagcagaagaagagcaccctggccagcgtgaacatccaggccctgcccgacaagggccagaagctgatcaagcagatccaggagctggaggaggtgctgagcggcctgaccctgagccccgagcagggcaccaacgagaagagcaacagccaggtgccccagcagagccacttcaccaagaccaccaccggccccccccacctggtgcccccccagcccctgcccagaagaggcacccagcccgtgggcagcctggagctgaagagcgcctgccaggtgaccgccggcggcagcagccagtgctacagaggccacaccaaccaggaccacgtgcacgccgtgtggaagatcaccagcgaggccatcggccagctgcacagaagcctggagagctgccccggcgagaccgtggtggccgaggaccccgccggcctgaaggtgcccctgctgctgcaccagaagcaggccctggcctggctgctgtggagagagagccagaagccccagggcggcatcctggccgacgacatgggcctgggcaagaccctgaccatgatcgccctgatcctgacccagaagaaccaggagaagaaggaggagaaggagaagagcaccgccctgacctggctgagcaaggacgacagctgcgacttcaccagccacggcaccctgatcatctgccccgccagcctgatccaccactggaagaacgaggtggagaagagagtgaacagcaacaagctgagagtgtacctgtaccacggccccaacagagacagcagagccagagtgctgagcacctacgacatcgtgatcaccacctacagcctggtggccaaggagatccccaccaacaagcaggaggccgagatccccggcgccaacctgaacgtggagggcaccagcacccccctgctgagaatcgcctgggccagaatcatcctggacgaggcccacaacgtgaagaaccccagagtgcagaccagcatcgccgtgtgcaagctgcaggcctgcgccagatgggccgtgaccggcacccccatccagaacaacctgctggacatgtacagcctgctgaagttcctgagatgcagccccttcgacgagttcaacctgtggagaagccaggtggacaacggcagcaagaagggcggcgagagactgagcatcctgaccaagagcctgctgctgagaagaaccaaggaccagctggacagcaccggcagacccctggtgatcctgccccagagaaagttccagctgcaccacctgaagctgagcgaggacgaggagaccgtgtacaacgtgttcttcgccagaagcagaagcgccctgcagagctacctgaagagacacgagagcagaggcaaccagagcggcagaagccccaacaaccccttcagcagagtggccctggagttcggcagcgaggagcccagacacagcgaggccgccgacagccccagaagcagcaccgtgcacatcctgagccagctgctgagactgagacagtgctgctgccacctgagcctgctgaagagcgccctggaccccatggagctgaagggcgagggcctggtgctgagcctggaggagcagctgagcgccctgaccctgagcgagctgagagacagcgagcccagcagcaccgtgagcctgaacggcaccttcttcaagatggagctgttcgagggcatgagagagagcaccaagatcagcagcctgctggccgagctggaggccatccagagaaacagcgccagccagaagagcgtgatcgtgagccagtggaccaacatgctgaaggtggtggccctgcacctgaagaagcacggcctgacctacgccaccatcgacggcagcgtgaaccccaagcagagaatggacctggtggaggccttcaaccacagcagaggcccccaggtgatgctgatcagcctgctggccggcggcgtgggcctgaacctgaccggcggcaaccacctgttcctgctggacatgcactggaaccccagcctggaggaccaggcctgcgacagaatctacagagtgggccagcagaaggacgtggtgatccacagattcgtgtgcgagggcaccgtggaggagaagatcctgcagctgcaggagaagaagaaggacctggccaagcaggtgctgagcggcagcggcgagagcgtgaccaagctgaccctggccgacctgagagtgctgttcggcatctag

SEQ ID NO: 102832 - DNA, 432 bp, Artificial Sequence
  Description of Artificial Sequence: Synthetic coding sequence
aacatgctgaaggtggtggccctgcacctgaagaagcacggcctgacctacgccaccatcgacggcagcgtgaaccccaagcagagaatggacctggtggaggccttcaaccacagcagaggcccccaggtgatgctgatcagcctgctggccggcggcgtgggcctgaacctgaccggcggcaaccacctgttcctgctggacatgcactggaaccccagcctggaggaccaggcctgcgacagaatctacagagtgggccagcagaaggacgtggtgatccacagattcgtgtgcgagggcaccgtggaggagaagatcctgcagctgcaggagaagaagaaggacctggccaagcaggtgctgagcggcagcggcgagagcgtgaccaagctgaccctggccgacctgagagtgctgttcggcatctag

SEQ ID NO: 102833 - DNA, 1263 bp, Artificial Sequence
  Description of Artificial Sequence: Synthetic coding sequence
atggccgagctgggcaagaagtactgcgtgtactgcctggccgaggtgagccccctgagattcagatgcaccgagtgccaggacatcgagctgtgccccgagtgcttcagcgccggcgccgagatcggccaccacagaagataccacggctaccagctggtggacggcggcagattcaccctgtggggccccgaggccgagggcggctggaccagcagagaggagcagctgctgctggacgccatcgagcagttcggcttcggcaactgggaggacatggccgcccacgtgggcgccagcagaaccccccaggaggtgatggagcactacgtgagcatgtacatccacggcaacctgggcaaggcctgcatccccgacaccatccccaacagagtgaccgaccacacctgccccagcggcggccccctgagccccagcctgaccacccccctgccccccctggacatcagcgtggccgagcagcagcagctgggctacatgcccctgagagacgactacgagatcgagtacgaccaggacgccgagaccctgatcagcggcctgagcgtgaactacgacgacgacgacgtggagatcgagctgaagagagcccacgtggacatgtacgtgagaaagctgaaggagagacagagaagaaagaacatcgccagagactacaacctggtgcccgccttcctgggcaaggacaagaaggagaaggagaaggccctgaagagaaagatcaccaaggaggagaaggagctgagactgaagctgagacccctgtaccagttcatgagctgcaaggagttcgacgacctgttcgagaacatgcacaaggagaagatgctgagagccaagatcagagagctgcagagatacagaagaaacggcatcaccaagatggaggagagcgccgagtacgaggccgccagacacaagagagagaagagaaaggagaacaagaacctggccggcagcaagagaggcaaggaggacggcaaggacagcgagttcgccgccatcgagaacctgcccggcttcgagctgctgagcgacagagagaaggtgctgtgcagcagcctgaacctgagccccgccagatacgtgaccgtgaagaccatcatcatcaaggaccacctgcagaagagacagggcatccccagcaagagcagactgcccagctacctggacaaggtgctgaagaagagaatcctgaacttcctgaccgagagcggctggatcagcagagacgccagctag

SEQ ID NO: 102834 - DNA, 366 bp, Artificial Sequence
  Description of Artificial Sequence: Synthetic coding sequence
atggccgcccacgtgggcgccagcagaaccccccaggaggtgatggagcactacgtgagcatgtacatccacggcaacctgggcaaggcctgcatccccgacaccatccccaacagagtgaccgaccacacctgccccagcggcggccccctgagccccagcctgaccacccccctgccccccctggacatcagcgtggccgagcagcagcagctgggctacatgcccctgagagacgactacgagatcgagtacgaccaggacgccgagaccctgatcagcggcctgagcgtgaactacgacgacgacgacgtggagatcgagctgaagagagcccacgtggacatgtacgtgagaaagctgtag

SEQ ID NO: 102835 - DNA, 390 bp, Artificial Sequence
  Description of Artificial Sequence: Synthetic coding sequence
atggccgcccacgtgggcgccagcagaaccccccaggaggtgatggagcactacgtgagcatgtacatccacggcaacctgggcaaggcctgcatccccgacaccatccccaacagagtgaccgaccacacctgccccagcggcggccccctgagccccagcctgaccacccccctgccccccctggacatcagcgtggccgagcagcagcagctgggctacatgcccctgagagacgactacgagatcgagtacgaccaggacgccgagaccctgatcagcggcctgagcgtgaactacgacgacgacgacgtggagatcgagctgaagagagcccacgtggacatgtacgtgagaaagctgaaggagagacagagaagaaagaactag

SEQ ID NO: 102836 - DNA, 1038 bp, Artificial Sequence
  Description of Artificial Sequence: Synthetic coding sequence
atggccgagctgggcaagaagtactgcgtgtactgcctggccgaggaggacatggccgcccacgtgggcgccagcagaaccccccaggaggtgatggagcactacgtgagcatgtacatccacggcaacctgggcaaggcctgcatccccgacaccatccccaacagagtgaccgaccacacctgccccagcggcggccccctgagccccagcctgaccacccccctgccccccctggacatcagcgtggccgagcagcagcagctgggctacatgcccctgagagacgactacgagatcgagtacgaccaggacgccgagaccctgatcagcggcctgagcgtgaactacgacgacgacgacgtggagatcgagctgaagagagcccacgtggacatgtacgtgagaaagctgaaggagagacagagaagaaagaacatcgccagagactacaacctggtgcccgccttcctgggcaaggacaagaaggagaaggagaaggccctgaagagaaagatcaccaaggaggagaaggagctgagactgaagctgagacccctgtaccagttcatgagctgcaaggagttcgacgacctgttcgagaacatgcacaaggagaagatgctgagagccaagatcagagagctgcagagatacagaagaaacggcatcaccaagatggaggagagcgccgagtacgaggccgccagacacaagagagagaagagaaaggagaacaagaacctggccggcagcaagagaggcaaggaggacggcaaggacagcgagttcgccgccatcgagaacctgcccggcttcgagctgctgagcgacagagagaaggtgctgtgcagcagcctgaacctgagccccgccagatacgtgaccgtgaagaccatcatcatcaaggaccacctgcagaagagacagggcatccccagcaagagcagactgcccagctacctggacaaggtgctgaagaagagaatcctgaacttcctgaccgagagcggctggatcagcagagacgccagctag

SEQ ID NO: 102837 - DNA, 987 bp, Artificial Sequence
  Description of Artificial Sequence: Synthetic coding sequence
atggccgcccacgtgggcgccagcagaaccccccaggaggtgatggagcactacgtgagcatgtacatccacggcaacctgggcaaggcctgcatccccgacaccatccccaacagagtgaccgaccacacctgccccagcggcggccccctgagccccagcctgaccacccccctgccccccctggacatcagcgtggccgagcagcagcagctgggctacatgcccctgagagacgactacgagatcgagtacgaccaggacgccgagaccctgatcagcggcctgagcgtgaactacgacgacgacgacgtggagatcgagctgaagagagcccacgtggacatgtacgtgagaaagctgaaggagagacagagaagaaagaacatcgccagagactacaacctggtgcccgccttcctgggcaaggacaagaaggagaaggagaaggccctgaagagaaagatcaccaaggaggagaaggagctgagactgaagctgagacccctgtaccagttcatgagctgcaaggagttcgacgacctgttcgagaacatgcacaaggagaagatgctgagagccaagatcagagagctgcagagatacagaagaaacggcatcaccaagatggaggagagcgccgagtacgaggccgccagacacaagagagagaagagaaaggagaacaagaacctggccggcagcaagagaggcaaggaggacggcaaggacagcgagttcgccgccatcgagaacctgcccggcttcgagctgctgagcgacagagagaaggtgctgtgcagcagcctgaacctgagccccgccagatacgtgaccgtgaagaccatcatcatcaaggaccacctgcagaagagacagggcatccccagcaagagcagactgcccagctacctggacaaggtgctgaagaagagaatcctgaacttcctgaccgagagcggctggatcagcagagacgccagctag

SEQ ID NO: 102838 - DNA, 1299 bp, Artificial Sequence
  Description of Artificial Sequence: Synthetic coding sequence
atgagcgagctgaaggactgccccctgcagttccacgacttcaagagcgtggaccacctgaaggtgtgccccagatacaccgccgtgctggccagaagcgaggacgacggcatcggcatcgaggagctggacaccctgcagctggagctggagaccctgctgagcagcgccagcagaagactgagagtgctggaggccgagacccagatcctgaccgactggcaggacaagaagggcgacagaagattcctgaagctgggcagagaccacgagctgggcgccccccccaagcacggcaagcccaagaagcagaagctggagggcaaggccggccacggccccggccccggccccggcagacccaagagcaagaacctgcagcccaagatccaggagtacgagttcaccgacgaccccatcgacgtgcccagaatccccaagaacgacgcccccaacagattctgggccagcgtggagccctactgcgccgacatcaccagcgaggaggtgagaaccctggaggagctgctgaagccccccgaggacgaggccgagcactacaagatcccccccctgggcaagcactacagccagagatgggcccaggaggacctgctggaggagcagaaggacggcgccagagccgccgccgtggccgacaagaagaagggcctgatgggccccctgaccgagctggacaccaaggacgtggacgccctgctgaagaagagcgaggcccagcacgagcagcccgaggacggctgccccttcggcgccctgacccagagactgctgcaggccctggtggaggagaacatcatcagccccatggaggacagccccatccccgacatgagcggcaaggagagcggcgccgacggcgccagcaccagccccagaaaccagaacaagcccttcagcgtgccccacaccaagagcctggagagcagaatcaaggaggagctgatcgcccagggcctgctggagagcgaggacagacccgccgaggacagcgaggacgaggtgctggccgagctgagaaagagacaggccgagctgaaggccctgagcgcccacaacagaaccaagaagcacgacctgctgagactggccaaggaggaggtgagcagacaggagctgagacagagagtgagaatggccgacaacgaggtgatggacgccttcagaaagatcatggccgccagacagaagaagagaacccccaccaagaaggagaaggaccaggcctggaagaccctgaaggagagagagagcatcctgaagctgctggacggctag

SEQ ID NO: 102839 - DNA, 1110 bp, Artificial Sequence
  Description of Artificial Sequence: Synthetic coding sequence
atgagcgagctgaaggactgccccctgcagttccacgacttcaagagcgtggaccacctgaaggtgtgccccagatacaccgccgtgctggccagaagcgaggacgacggcatcggcatcgaggagctggacaccctgcagctggagctggagaccctgctgagcagcgccagcagaagactgagagtgctggaggccgagacccagatcctgaccgactggcaggacaagaagggcgacagaagattcctgaagctgggcagagaccacgagctgggcgccccccccaagcacggcaagcccaagaagcagaagctggagggcaaggccggccacggccccggccccggccccggcagacccaagagcaagaacctgcagcccaagatccaggagtacgagttcaccgacgaccccatcgacgtgcccagaatccccaagaacgacgcccccaacagattctgggccagcgtggagccctactgcgccgacatcaccagcgaggaggtgagaaccctggaggagctgctgaagccccccgaggacgaggccgagcactacaagatcccccccctgggcaagcactacagccagagatgggcccaggaggacctgctggaggagcagaaggacggcgccagagccgccgccgtggccgacaagaagaagggcctgatgggccccctgaccgagctggacaccaaggacgtggacgccctgctgaagaagagcgaggcccagcacgagcagcccgaggacggctgccccttcggcgccctgacccagagactgctgcaggccctggtggaggagaacatcatcagccccatggaggacagccccatccccgacatgagcggcaaggagagcggcgccgacggcgccagcaccagccccagaaaccagaacaagcccttcagcgtgccccacaccaagagcctggagagcagaatcaaggaggagctgatcgcccagggcctgctggagagcgaggacagacccgccgaggacagcgaggacgaggtgctggccgagctgagaaagagacaggccgagctgaaggccctgagcgcccacaacagaaccaagaagcacgacctgctgagatag

SEQ ID NO: 102840 - DNA, 288 bp, Artificial Sequence
  Description of Artificial Sequence: Synthetic coding sequence
atgagcgagctgaaggactgccccctgcagttccacgacttcaagagcgtggaccacctgaaggtgtgccccagatacaccgccgtgctggccagaagcgaggacgacggcatcggcatcgaggagctggacaccctgcagctggagctggagaccctgctgagcagcgccagcagaagactgagagtgctggaggccgagacccagatcctgaccgactggcaggacaagaagggcgacagaagattcctgaagctgggcagagaccacgagctgggcgccccctag

SEQ ID NO: 102841 - DNA, 1299 bp, Artificial Sequence; identical to SEQ ID NO: 102838
  Description of Artificial Sequence: Synthetic coding sequence

SEQ ID NO: 102842 - DNA, 1038 bp, Artificial Sequence
  Description of Artificial Sequence: Synthetic coding sequence
atgcagctggagatccaggtggccctgaacttcatcatcagctacctgtacaacaagctgcccagaagaagagtgaacatcttcggcgaggagctggagagactgctgaagaagaagtacgagggccactggtaccccgagaagccctacaagggcagcggcttcagatgcatccacatcggcgagaaggtggaccccgtgatcgagcaggccagcaaggagagcggcctggacatcgacgacgtgagaggcaacctgccccaggacctgagcgtgtggatcgaccccttcgaggtgagctaccagatcggcgagaagggccccgtgaaggtgctgtacgtggacgacaacaacgagaacggctgcgagctggacaaggagatcaagaacagcttcaaccccgaggcccaggtgttcatgcccatcagcgaccccgccagcagcgtgagcagcagccccagcccccccttcggccacagcgccgccgtgagccccaccttcatgcccagaagcacccagcccctgaccttcaccaccgccaccttcgccgccaccaagttcggcagcaccaagatgaagaacagcggcagaagcaacaaggtggccagaaccagccccatcaacctgggcctgaacgtgaacgacctgctgaagcagaaggccatcagcagcagcatgcacagcctgtacggcctgggcctgggcagccagcagcagccccagcagcagcagcagcccgcccagcccccccccccccccccccccccccagcagcagcagcagcagaagaccagcgccctgagccccaacgccaaggagttcatcttccccaacatgcagggccagggcagcagcaccaacggcatgttccccggcgacagccccctgaacctgagccccctgcagtacagcaacgccttcgacgtgttcgccgcctacggcggcctgaacgagaagagcttcgtggacggcctgaacttcagcctgaacaacatgcagtacagcaaccagcagttccagcccgtgatggccaactag

SEQ ID NO: 102843 - DNA, 1038 bp, Artificial Sequence; identical to SEQ ID NO: 102842
  Description of Artificial Sequence: Synthetic coding sequence

SEQ ID NO: 102844 - DNA, 1035 bp, Artificial Sequence
  Description of Artificial Sequence: Synthetic coding sequence
atgcagctggagatcaaggtggccctgaacttcatcatcagctacctgtacaacaagctgcccagaagaagagccgacctgttcggcgaggagctggagagactgctgaagaagaagtacgagggccactggtaccccgagaagcccctgaagggcagcggcttcagatgcgtgcacatcggcgagatggtggaccccgtggtggagctggccgccaagagaagcggcctggccgtggaggacgtgagagccaacgtgcccgaggagctgagcgtgtggatcgaccccttcgaggtgagctaccagatcggcgagaagggcgccgtgaaggtgctgtacctggacgacagcgagggctgcggcgcccccgagctggacaaggagatcaagagcagcttcaaccccgacgcccaggtgttcgtgcccatcggcagccaggacagcagcctgagcaacagccccagccccagcttcggccagagccccagccccaccttcatccccagaagcgcccagcccatcaccttcaccaccgccagcttcgccgccaccaagttcggcagcaccaagatgaagaagggcggcggcgccgccagcggcggcggcgtggccagcagcggcgccggcggccagcagcccccccagcagcccagaatggccagaagccccaccaacagcctgctgaagcacaagagcctgagcctgagcatgcacagcctgaacttcatcaccgccaaccccgccccccagagccagctgagccccaacgccaaggagttcgtgtacaacggcggcggcagccccagcctgttcttcgacgccgccgacggccagggcagcggcacccccggccccttcggcggcagcggcgccggcacctgcaacagcagcagcttcgacatggcccaggtgttcggcggcggcgccaacagcctgttcctggagaagacccccttcgtggagggcctgagctacaacctgaacaccatgcagtaccccagccagcagttccagcccgtggtgctggccaactag

SEQ ID NO: 102845 - DNA, 306 bp, Artificial Sequence
  Description of Artificial Sequence: Synthetic coding sequence
atgcagctggagatcaaggtggccctgaacttcatcatcagctacctgtacaacaagctgcccagaagaagagccgacctgttcggcgaggagctggagagactgctgaagaagaagtacgagggccactggtaccccgagaagcccctgaagggcagcggcttcagatgcgtgcacatcggcgagatggtggaccccgtggtggagctggccgccaagagaagcggcctggccgtggaggacgtgagagccaacgtgcccgaggagctgagcgtgtggatcgaccccttcgaggtgagctactag

SEQ ID NO: 102846 - DNA, 1569 bp, Artificial Sequence
  Description of Artificial Sequence: Synthetic coding sequence
atgagcatcaccagcgacgaggtgaacttcctggtgtacagatacctgcaggagagcggcttcagccacagcgccttcaccttcggcatcgagagccacatcagccagagcaacatcaacggcaccctggtgccccccagcgccctgatcagcatcctgcagaagggcctgcagtacgtggaggccgagatcagcatcaacaaggacggcaccgtgttcgacagcagacccatcgagagcctgagcctgatcgtggccgtgatccccgacgtggtgcagatgagacagcaggccttcggcgagaagctgacccagcagcaggccagcgccgccgccaccgaggccagcgccatggccaaggccgccaccatgacccccgccgccatcagccagcagaacccccccaagaacagagaggccaccgtgaacggcgaggagaacggcgcccacgagatcaacaaccacagcaagcccatggagatcgacggcgacgtggagatcccccccaacaaggccaccgtgctgagaggccacgagagcgaggtgttcatctgcgcctggaaccccgtgagcgacctgctggccagcggcagcggcgacagcaccgccagaatctggaacctgaacgagaacagcaacggcggcagcacccagctggtgctgagacactgcatcagagagggcggccacgacgtgcccagcaacaaggacgtgaccagcctggactggaacagcgacggcaccctgctggccatgggcagctacgacggcttcgccagaatctggaccgagaacggcaacctggccagcaccctgggccagcacaagggccccatcttcgccctgaagtggaacaagaagggcaactacgtgctgagcgccggcgtggacaagaccaccatcatctgggacgcccacaccggcgaggccaagcagcagttccccttccacagcgcccccgccctggacgtggactggcagaacaacatgaccttcgccagctgcagcaccgacatgtgcatccacgtgtgcagactgggctgcgaccaccccgtgaagaccttccagggccacaccaacgaggtgaacgccatcaagtgggaccccagcggcatgctgctggccagctgcagcgacgacatgaccctgaagatctggagcatgaagcaggacgcctgcgtgcacgacctgcaggcccacagcaaggagatctacaccatcaagtggagccccaccggccccgccaccagcaaccccaacagcagcatcatgctggccagcgccagcttcgacagcaccgtgagactgtgggacgtggagcagggcgtgtgcacccacaccctgatgaagcaccaggagcccgtgtacagcgtggccttcagccccgacggcaagtacctggccagcggcagcttcgacaagtacgtgcacatctggaacacccagagcggcagcctggtgcacagctaccagggcaccggcggcatcttcgaggtgtgctggaacgccagaggcgacaaggtgggcgccagcgccagcgacggcagcgtgtgcgtgctggacctgtag

SEQ ID NO: 102847 - DNA, 1569 bp, Artificial Sequence; identical to SEQ ID NO: 102846
  Description of Artificial Sequence: Synthetic coding sequence

SEQ ID NO: 102848 - DNA, 1569 bp, Artificial Sequence; identical to SEQ ID NO: 102846
  Description of Artificial Sequence: Synthetic coding sequence

SEQ ID NO: 102849 - DNA, 1095 bp, Artificial Sequence
  Description of Artificial Sequence: Synthetic coding sequence
atggagatcgacggcgacgtggagatcccccccaacaaggccaccgtgctgagaggccacgagagcgaggtgttcatctgcgcctggaaccccgtgagcgacctgctggccagcggcagcggcgacagcaccgccagaatctggaacctgaacgagaacagcaacggcggcagcacccagctggtgctgagacactgcatcagagagggcggccacgacgtgcccagcaacaaggacgtgaccagcctggactggaacagcgacggcaccctgctggccatgggcagctacgacggcttcgccagaatctggaccgagaacggcaacctggccagcaccctgggccagcacaagggccccatcttcgccctgaagtggaacaagaagggcaactacgtgctgagcgccggcgtggacaagaccaccatcatctgggacgcccacaccggcgaggccaagcagcagttccccttccacagcgcccccgccctggacgtggactggcagaacaacatgaccttcgccagctgcagcaccgacatgtgcatccacgtgtgcagactgggctgcgaccaccccgtgaagaccttccagggccacaccaacgaggtgaacgccatcaagtgggaccccagcggcatgctgctggccagctgcagcgacgacatgaccctgaagatctggagcatgaagcaggacgcctgcgtgcacgacctgcaggcccacagcaaggagatctacaccatcaagtggagccccaccggccccgccaccagcaaccccaacagcagcatcatgctggccagcgccagcttcgacagcaccgtgagactgtgggacgtggagcagggcgtgtgcacccacaccctgatgaagcaccaggagcccgtgtacagcgtggccttcagccccgacggcaagtacctggccagcggcagcttcgacaagtacgtgcacatctggaacacccagagcggcagcctggtgcacagctaccagggcaccggcggcatcttcgaggtgtgctggaacgccagaggcgacaaggtgggcgccagcgccagcgacggcagcgtgtgcgtgctggacctgtag

SEQ ID NO: 102850 - DNA, 1752 bp, Artificial Sequence
  Description of Artificial Sequence: Synthetic coding sequence
atgcccctgagaaagatgaagatccccttcctgctgctgttcttcctgtgggaggccgagagccacgccgccagcagacccaacatcatcctggtgatggccgacgacctgggcatcggcgaccccggctgctacggcaacaagaccatcagaacccccaacatcgacagactggccagcggcggcgtgaagctgacccagcacctggccgccagccccctgtgcacccccagcagagccgccttcatgaccggcagataccccgtgagaagcggcatggccagctggagcagaaccggcgtgttcctgttcaccgccagcagcggcggcctgcccaccgacgagatcaccttcgccaagctgctgaaggaccagggctacagcaccgccctgatcggcaagtggcacctgggcatgagctgccacagcaagaccgacttctgccaccaccccctgcaccacggcttcaactacttctacggcatcagcctgaccaacctgagagactgcaagcccggcgagggcagcgtgttcaccaccggcttcaagagactggtgttcctgcccctgcagatcgtgggcgtgaccctgctgaccctggccgccctgaactgcctgggcctgctgcacgtgcccctgggcgtgttcttcagcctgctgttcctggccgccctgatcctgaccctgttcctgggcttcctgcactacttcagacccctgaactgcttcatgatgagaaactacgagatcatccagcagcccatgagctacgacaacctgacccagagactgaccgtggaggccgcccagttcatccagagaaacaccgagacccccttcctgctggtgctgagctacctgcacgtgcacaccgccctgttcagcagcaaggacttcgccggcaagagccagcacggcgtgtacggcgacgccgtggaggagatggactggagcgtgggccagatcctgaacctgctggacgagctgagactggccaacgacaccctgatctacttcaccagcgaccagggcgcccacgtggaggaggtgagcagcaagggcgagatccacggcggcagcaacggcatctacaagggcggcaaggccaacaactgggagggcggcatcagagtgcccggcatcctgagatggcccagagtgatccaggccggccagaagatcgacgagcccaccagcaacatggacatcttccccaccgtggccaagctggccggcgcccccctgcccgaggacagaatcatcgacggcagagacctgatgcccctgctggagggcaagagccagagaagcgaccacgagttcctgttccactactgcaacgcctacctgaacgccgtgagatggcacccccagaacagcaccagcatctggaaggccttcttcttcacccccaacttcaaccccgtgggcagcaacggctgcttcgccacccacgtgtgcttctgcttcggcagctacgtgacccaccacgacccccccctgctgttcgacatcagcaaggaccccagagagagaaaccccctgacccccgccagcgagcccagattctacgagatcctgaaggtgatgcaggaggccgccgacagacacacccagaccctgcccgaggtgcccgaccagttcagctggaacaacttcctgtggaagccctggctgcagctgtgctgccccagcaccggcctgagctgccagtgcgacagagagaagcaggacaagagactgagcagatag

SEQ ID NO: 102851 - DNA, 1581 bp, Artificial Sequence
  Description of Artificial Sequence: Synthetic coding sequence
atgagcatcaccagcgacgaggtgaacttcctggtgtacagatacctgcaggagagcggcttcagccacagcgccttcaccttcggcatcgagagccacatcagccagagcaacatcaacggcaccctggtgccccccgccgccctgatcagcatcctgcagaagggcctgcagtacgtggaggccgagatcagcatcaacgaggacggcaccgtgttcgacggcagacccatcgagagcctgagcctgatcgacgccgtgatgcccgacgtggtgcagaccagacagcaggccttcagagagaagctggcccagcagcaggccagcgccgccgccgccgccgccgccgccaccgccgccgccaccgccgccaccaccaccagcgccggcgtgagccaccagaaccccagcaagaacagagaggccaccgtgaacggcgaggagaacagagcccacagcgtgaacaaccacgccaagcccatggagatcgacggcgaggtggagatccccagcagcaaggccaccgtgctgagaggccacgagagcgaggtgttcatctgcgcctggaaccccgtgagcgacctgctggccagcggcagcggcgacagcaccgccagaatctggaacctgaacgagaacagcaacggcggcagcacccagctggtgctgagacactgcatcagagagggcggccacgacgtgcccagcaacaaggacgtgaccagcctggactggaacaccaacggcaccctgctggccaccggcagctacgacggcttcgccagaatctggaccgaggacggcaacctggccagcaccctgggccagcacaagggccccatcttcgccctgaagtggaacagaaagggcaactacatcctgagcgccggcgtggacaagaccaccatcatctgggacgcccacaccggcgaggccaagcagcagttccccttccacagcgcccccgccctggacgtggactggcagaacaacaccaccttcgccagctgcagcaccgacatgtgcatccacgtgtgcagactgggctgcgacagacccgtgaagaccttccagggccacaccaacgaggtgaacgccatcaagtgggaccccagcggcatgctgctggccagctgcagcgacgacatgaccctgaagatctggagcatgaagcaggaggtgtgcatccacgacctgcaggcccacaacaaggagatctacaccatcaagtggagccccaccggccccgccaccagcaaccccaacagcaacatcatgctggccagcgccagcttcgacagcaccgtgagactgtgggacatcgagagaggcgtgtgcacccacaccctgaccaagcaccaggagcccgtgtacagcgtggccttcagccccgacggcaagtacctggccagcggcagcttcgacaagtgcgtgcacatctggaacacccagagcggcaacctggtgcacagctacagaggcaccggcggcatcttcgaggtgtgctggaacgccagaggcgacaaggtgggcgccagcgccagcgacggcagcgtgtgcgtgctggacctgagaaagtag

SEQ ID NO: 102852 - DNA, 1734 bp, Artificial Sequence; identical to SEQ ID NO: 94510
  Description of Artificial Sequence: Synthetic coding sequence

SEQ ID NO: 102853 - DNA, 228 bp, Artificial Sequence
  Description of Artificial Sequence: Synthetic coding sequence
atgagcatcaccagcgacgaggtgaacttcctggtgtacagatacctgcaggagagcggcttcagccacagcgccttcaccttcggcatcgagagccacatcagccagagcaacatcaacggcaccctggtgccccccgccgccctgatcagcatcctgcagaagggcctgcagtacgtggaggccgagatcagcatcaacgaggacggcaccgtgttcgacggctag

SEQ ID NO: 102854 - DNA, 138 bp, Artificial Sequence
  Description of Artificial Sequence: Synthetic coding sequence
atgagcatcaccagcgacgaggtgaacttcctggtgtacagatacctgcaggagagcggcttcagccacagcgccttcaccttcggcatcgagagccacatcagccagagcaacatcaacggcaccctggtgccctag

SEQ ID NO: 102855 - DNA, 1581 bp, Artificial Sequence; identical to SEQ ID NO: 102851
  Description of Artificial Sequence: Synthetic coding sequence

SEQ ID NO: 102856 - DNA, 180 bp, Artificial Sequence
  Description of Artificial Sequence: Synthetic coding sequence
atgaccgagctggccggcgccagcagcagctgctgccacagacccgccggcagaggcgccatgcagagcgtgctgcaccacttccagagactgagaggcagagagggcggcagccacttcatcaacaccagcagccccagaggcgaggccaagatgagcatcaccagcgacgaggtgtag

SEQ ID NO: 102857 - DNA, 243 bp, Artificial Sequence
  Description of Artificial Sequence: Synthetic coding sequence
atgaccgagctggccggcgccagcagcagctgctgccacagacccgccggcagaggcgccatgcagagcgtgctgcaccacttccagagactgagaggcagagagggcggcagccacttcatcaacaccagcagccccagaggcgaggccaagatgagcatcaccagcgacgaggtgaacttcctggtgtacagatacctgcaggagagcggcttcagccacagcgccttcaccttcggctag

SEQ ID NO: 102858 - DNA, 1581 bp, Artificial Sequence; identical to SEQ ID NO: 102851
  Description of Artificial Sequence: Synthetic coding sequence

SEQ ID NO: 102859 - DNA, 1344 bp, Artificial Sequence
  Description of Artificial Sequence: Synthetic coding sequence
atggagctgagccagatgagcgagctgatgggcctgagcgtgctgctgggcctgctggccctgatggccaccgccgccgtggccagaggctggctgagagccggcgaggagagaagcggcagacccgcctgccagaaggccaacggcttcccccccgacaagagcagcggcagcaagaagcagaagcagtaccagagaatcagaaaggagaagccccagcagcacaacttcacccacagactgctggccgccgccctgaagagccacagcggcaacatcagctgcatggacttcagcagcaacggcaagtacctggccacctgcgccgacgacagaaccatcagaatctggagcaccaaggacttcctgcagagagagcacagaagcatgagagccaacgtggagctggaccacgccaccctggtgagattcagccccgactgcagagccttcatcgtgtggctggccaacggcgacaccctgagagtgttcaagatgaccaagagagaggacggcggctacaccttcaccgccacccccgaggacttccccaagaagcacaaggcccccgtgatcgacatcggcatcgccaacaccggcaagttcatcatgaccgccagcagcgacaccaccgtgctgatctggagcctgaagggccaggtgctgagcaccatcaacaccaaccagatgaacaacacccacgccgccgtgagcccctgcggcagattcgtggccagctgcggcttcacccccgacgtgaaggtgtgggaggtgtgcttcggcaagaagggcgagttccaggaggtggtgagagccttcgagctgaagggccacagcgccgccgtgcacagcttcgccttcagcaacgacagcagaagaatggccagcgtgagcaaggacggcacctggaagctgtgggacaccgacgtggagtacaagaagaagcaggacccctacctgctgaagaccggcagattcgaggaggccgccggcgccgccccctgcagactggccctgagccccaacgcccaggtgctggccctggccagcggcagcagcatccacctgtacaacaccagaagaggcgagaaggaggagtgcttcgagagagtgcacggcgagtgcatcgccaacctgagcttcgacatcaccggcagattcctggccagctgcggcgacagagccgtgagactgttccacaacacccccggccacagagccatggtggaggagatgcagggccacctgaagagagccagcaacgagagcaccagacagagactgcagcagcagctgacccaggcccaggagaccctgaagagcctgggcgccctgaagaagtag

SEQ ID NO: 102860 - DNA, 1341 bp, Artificial Sequence
  Description of Artificial Sequence: Synthetic coding sequence
atggagctgagccagatgagcgagctgatgggcctgagcgtgctgctgggcctgctggccctgatggccaccgccgccgtggccagaggctggctgagagccggcgaggagagaagcggcagacccgcctgccagaaggccaacggcttcccccccgacaagagcagcggcagcaagaagcagaagcagtaccagagaatcagaaaggagaagccccagcagcacaacttcacccacagactgctggccgccgccctgaagagccacagcggcaacatcagctgcatggacttcagcagcaacggcaagtacctggccacctgcgccgacgacagaaccatcagaatctggagcaccaaggacttcctgcagagagagcacagaagcatgagagccaacgtggagctggaccacgccaccctggtgagattcagccccgactgcagagccttcatcgtgtggctggccaacggcgacaccctgagagtgttcaagatgaccaagagagaggacggcggctacaccttcaccgccacccccgaggacttccccaagaagcacaaggcccccgtgatcgacatcggcatcgccaacaccggcaagttcatcatgaccgccagcagcgacaccaccgtgctgatctggagcctgaagggccaggtgctgagcaccatcaacaccaaccagatgaacaacacccacgccgccgtgagcccctgcggcagattcgtggccagctgcggcttcacccccgacgtgaaggtgtgggaggtgtgcttcggcaagaagggcgagttccaggaggtggtgagagccttcgagctgaagggccacagcgccgccgtgcacagcttcgccttcagcaacgacagcagaagaatggccagcgtgagcaaggacggcacctggaagctgtgggacaccgacgtggagtacaagaagaagcaggacccctacctgctgaagaccggcagattcgaggaggccgccggcgccgccccctgcagactggccctgagccccaacgcccaggtgctggccctggccagcggcagcagcatccacctgtacaacaccagaagaggcgagaaggaggagtgcttcgagagagtgcacggcgagtgcatcgccaacctgagcttcgacatcaccggcagattcctggccagctgcggcgacagagccgtgagactgttccacaacacccccggccacagagccatggtggaggagatgcagggccacctgaagagagccagcaacgagagcaccagacagagactgcagcagcagctgacccaggcccaggtgaccctgggcggccccggcgccgaggactag

SEQ ID NO: 102861 - DNA, 2427 bp, Artificial Sequence
  Description of Artificial Sequence: Synthetic coding sequence
atggccgagaccgccgccggcgtgggcagattcaagaccaactacgccgtggagagaaagatcgagcccttctacaagggcggcaaggcccagctggaccagaccggccagcacctgttctgcgtgtgcggcaccagagtgaacatcctggaggtggccagcggcgccgtgctgagaagcctggagcaggaggaccaggaggacatcaccgccttcgacctgagccccgacaacgaggtgctggtgaccgccagcagagccctgctgctggcccagtgggcctggcaggagggcagcgtgaccagactgtggaaggccatccacaccgcccccgtggccaccatggccttcgaccccaccagcaccctgctggccaccggcggctgcgacggcgccgtgagagtgtgggacatcgtgagacactacggcacccaccacttcagaggcagccccggcgtggtgcacctggtggccttccaccccgaccccaccagactgctgctgttcagcagcgccaccgacgccgccatcagagtgtggagcctgcaggacagaagctgcctggccgtgctgaccgcccactacagcgccgtgaccagcctggccttcagcgccgacggccacaccatgctgagcagcggcagagacaagatctgcatcatctgggacctgcagagctgccaggccaccagaaccgtgcccgtgttcgagagcgtggaggccgccgtgctgctgcccgaggagcccgtgagccagctgggcgtgaagagccccggcctgtacttcctgaccgccggcgaccagggcaccctgagagtgtgggaggccgccagcggccagtgcgtgtacacccaggcccagccccccggccccggccaggagctgacccactgcaccctggcccacaccgccggcgtggtgctgaccgccaccgccgaccacaacctgctgctgtacgaggccagaagcctgagactgcagaagcagttcgccggctacagcgaggaggtgctggacgtgagattcctgggccccgaggacagccacgtggtggtggccagcaacagcccctgcctgaaggtgttcgagctgcagaccagcgcctgccagatcctgcacggccacaccgacatcgtgctggccctggacgtgttcagaaagggctggctgttcgccagctgcgccaaggaccagagcgtgagaatctggagaatgaacaaggccggccaggtgatgtgcgtggcccagggcagcggccacacccacagcgtgggcaccgtgtgctgcagcagactgaaggagagcttcctggtgaccggcagccaggactgcaccgtgaagctgtggcccctgcccaaggccctgctgagcaagaacaccgcccccgacaacggccccatcctgctgcaggcccagaccacccagagatgccacgacaaggacatcaacagcgtggccatcgcccccaacgacaagctgctggccaccggcagccaggacagaaccgccaagctgtgggccctgccccagtgccagctgctgggcgtgttcagcggccacagaagaggcctgtggtgcgtgcagttcagccccatggaccaggtgctggccaccgccagcgccgacggcaccatcaagctgtgggccctgcaggacttcagctgcctgaagaccttcgagggccacgacgccagcgtgctgaaggtggccttcgtgagcagaggcacccagctgctgagcagcggcagcgacggcctggtgaagctgtggaccatcaagaacaacgagtgcgtgagaaccctggacgcccacgaggacaaggtgtggggcctgcactgcagcagactggacgaccacgccctgaccggcgccagcgacagcagagtgatcctgtggaaggacgtgaccgaggccgagcaggccgaggagcaggccagacaggaggagcaggtggtgagacagcaggagctggacaacctgctgcacgagaagagatacctgagagccctgggcctggccatcagcctggacagaccccacaccgtgctgaccgtgatccaggccatcagaagagaccccgaggcctgcgagaagctggaggccaccatgctgagactgagaagagaccagaaggaggccctgctgagattctgcgtgacctggaacaccaacagcagacactgccacgaggcccaggccgtgctgggcgtgctgctgagaagagaggcccccgaggagctgctggcctacgagggcgtgagagccgccctggaggccctgctgccctacaccgagagacacttccagagactgagcagaaccctgcaggccgccgccttcctggacttcctgtggcacaacatgaagctgcccgtgcccgccgccgcccccaccccctgggagacccacaagggcgccctgccctag

SEQ ID NO: 102862 - DNA, 2427 bp, Artificial Sequence; identical to SEQ ID NO: 102861
  Description of Artificial Sequence: Synthetic coding sequence

SEQ ID NO: 102863 - DNA, 729 bp, Artificial Sequence
  Description of Artificial Sequence: Synthetic coding sequence
atgttcccccagagcagacaccccaccccccaccaggccgccggccagcccttcaagttcaccatccccgagagcctggacagaatcaaggaggagttccagttcctgcaggcccagtaccacagcctgaagctggagtgcgagaagctggccagcgagaagaccgagatgcagagacactacgtgatgtactacgagatgagctacggcctgaacatcgagatgcacaagcagaccgagatcgccaagagactgaacaccatctgcgcccaggtgatccccttcctgagccaggagcaccagcagcaggtggcccaggccgtggagagagccaagcaggtgaccatggccgagctgaacgccatcatcggcgtgagaggcctgcccggcctgccccccacccagcagcagctgcaggcccagcacctgagccacggccacggcccccccgtgcccctgaccccccaccccagcggcctgcagccccccggcatcccccccctgggcggcagcgccggcctgctggccctgagcagcgccctgagcggccagagccacctggccatcaaggacgacaagaagcaccacgacgccgagcaccacagaggcgagagacccggcaagagcaacagcctgctggtgcccgacagcctgagaggcaccgacaagagaagaaacggccccgagttcagcaacgacatcaagaagagaaaggtggacgacaagtag

SEQ ID NO: 102864 - DNA, 435 bp, Artificial Sequence
  Description of Artificial Sequence: Synthetic coding sequence
atgcagagacactacgtgatgtactacgagatgagctacggcctgaacatcgagatgcacaagcagaccgagatcgccaagagactgaacaccatctgcgcccaggtgatccccttcctgagccaggagcaccagcagcaggtggcccaggccgtggagagagccaagcaggtgaccatggccgagctgaacgccatcatcggccagcagcagctgcaggcccagcacctgagccacggccacggcccccccgtgcccctgaccccccaccccagcggcctgcagccccccggcatcccccccctgggcggcagcgccggcctgctggccctgagcagcgccctgagcggccagagccacctggccatcaaggacgacaagaagcaccacgacgccgagcaccacagaggcgagagacccggcaagcccgactag

SEQ ID NO: 102865 - DNA, 384 bp, Artificial Sequence
  Description of Artificial Sequence: Synthetic coding sequence
atgcccacccccggcaccagcgccacccccggcctgagacccggcctgggcaagccccccgccatcgaccccctggtgaaccaggccgccgccggcctgagaacccccctggccgtgcccggcccctaccccgcccccttcggcatggtgccccacgccggcatgaacggcgagctgaccagccccggcgccgcctacgccagcctgcacaacatgagcccccagatgagcgccgccgccgccgccgccgccgtggtggcctacggcagaagccccatggtgggcttcgacccccccccccacatgagagtgcccaccatcccccccaacctggccggcatccccggcggcaagcccagcctggtgcccgcccccgcccactag

SEQ ID NO: 102866 - DNA, 384 bp, Artificial Sequence; identical to SEQ ID NO: 102865
  Description of Artificial Sequence: Synthetic coding sequence

SEQ ID NO: 102867 - DNA, 2313 bp, Artificial Sequence
  Description of Artificial Sequence: Synthetic coding sequence
atgttcccccagagcagacaccccaccccccaccaggccgccggccagcccttcaagttcaccatccccgagagcctggacagaatcaaggaggagttccagttcctgcaggcccagtaccacagcctgaagctggagtgcgagaagctggccagcgagaagaccgagatgcagagacactacgtgatgtactacgagatgagctacggcctgaacatcgagatgcacaagcagaccgagatcgccaagagactgaacaccatctgcgcccaggtgatccccttcctgagccaggagcaccagcagcaggtggcccaggccgtggagagagccaagcaggtgaccatggccgagctgaacgccatcatcggccagcagcagctgcaggcccagcacctgagccacggccacggcccccccgtgcccctgaccccccaccccagcggcctgcagccccccggcatcccccccctgggcggcagcgccggcctgctggccctgagcagcgccctgagcggccagagccacctggccatcaaggacgacaagaagcaccacgacgccgagcaccacagagacagagagcccggcaccagcaacagcctgctggtgcccgacagcctgagaggcaccgacaagagaagaaacggccccgagttcagcaacgacatcaagaagagaaaggtggacgacaaggacagcagccactacgacagcgacggcgacaagagcgacgacaacctggtggtggacgtgagcaacgaggaccccagcagccccagagccagccccgcccacagccccagagagaacggcatcgacaagaacagactgctgaagaaggacgccagcagcagccccgccagcaccgccagcagcgccagcagcaccagcctgaagagcaaggagatgagcctgcacgagaaggccagcacccccgtgctgaagagcagcacccccacccccagaagcgacatgcccacccccggcaccagcgccacccccggcctgagacccggcctgggcaagccccccgccatcgaccccctggtgaaccaggccgccgccggcctgagaacccccctggccgtgcccggcccctaccccgcccccttcggcatggtgccccacgccggcatgaacggcgagctgaccagccccggcgccgcctacgccagcctgcacaacatgagcccccagatgagcgccgccgccgccgccgccgccgtggtggcctacggcagaagccccatggtgggcttcgacccccccccccacatgagagtgcccaccatcccccccaacctggccggcatccccggcggcaagcccgcctacagcttccacgtgaccgccgacggccagatgcagcccgtgcccttcccccccgacgccctgatcggccccggcatccccagacacgccagacagatcaacaccctgaaccacggcgaggtggtgtgcgccgtgaccatcagcaaccccaccagacacgtgtacaccggcggcaagggctgcgtgaaggtgtgggacatcagccaccccggcaacaagagccccgtgagccagctggactgcctgaacagagacaactacatcagaagctgcaagctgctgcccgacggctgcaccctgatcgtgggcggcgaggccagcaccctgagcatctgggacctggccgcccccacccccagaatcaaggccgagctgaccagcagcgcccccgcctgctacgccctggccatcagccccgacagcaaggtgtgcttcagctgctgcagcgacggcaacatcgccgtgtgggacctgcacaaccagaccctggtgagacagttccagggccacaccgacggcgccagctgcatcgacatcagcaacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagagcagcaacgtggaggtgctgcacgtgaacaagcccgacaagtaccagctgcacctgcacgagagctgcgtgctgagcctgaagttcgcctactgcggcaagtggttcgtgagcaccggcaaggacaacctgctgaacgcctggagaaccccctacggcgccagcatcttccagagcaaggagagcagcagcgtgctgagctgcgacatcagcgtggacgacaagtacatcgtgaccggcagcggcgacaagaaggccaccgtgtacgaggtgatctactag

SEQ ID NO: 102868 - DNA, 729 bp, Artificial Sequence
  Description of Artificial Sequence: Synthetic coding sequence
atgttcccccagagcagacaccccaccccccaccaggccgccggccagcccttcaagttcaccatccccgagagcctggacagaatcaaggaggagttccagttcctgcaggcccagtaccacagcctgaagctggagtgcgagaagctggccagcgagaagaccgagatgcagagacactacgtgatgtactacgagatgagctacggcctgaacatcgagatgcacaagcagaccgagatcgccaagagactgaacaccatctgcgcccaggtgatccccttcctgagccaggagcaccagcagcaggtggcccaggccgtggagagagccaagcaggtgaccatggccgagctgaacgccatcatcggcgtgagaggcctgcccggcctgccccccacccagcagcagctgcaggcccagcacctgagccacggccacggcccccccgtgcccctgaccccccaccccagcggcctgcagccccccggcatcccccccctgggcggcagcgccggcctgctggccctgagcagcgccctgagcggccagagccacctggccatcaaggacgacaagaagcaccacgacgccgagcaccacagagacagagagcccggcaccagcaacagcctgctggtgcccgacagcctgagaggcaccgacaagagaagaaacggccccgagttcagcaacgacatcaagaagagaaaggtggacgacaagtag

SEQ ID NO: 102869 - DNA, 2121 bp, Artificial Sequence
  Description of Artificial Sequence: Synthetic coding sequence
atggtgcagagcagactgaccgccaccagcgccagccaggacagccccgccagcggcctgcagacccccctgcagagcggccagcccttcaagttcagcatcctggagatctgcgacagaatcaaggaggagttccagttcctgcaggcccagtaccacagcctgaagctggagtgcgagaagctggccagcgagaagaccgagatgcagagacactacgtgatgtactacgagatgagctacggcctgaacatcgagatgcacaagcaggccgagatcgtgaagagactgagcggcatctgcgcccagatcatccccttcctgacccaggagcaccagcagcaggtgctgcaggccgtggagagagccaagcaggtgaccgtgggcgagctgaacagcctgatcggccagcagcagctgcagcccctgagccaccacgccccccccgtgcccctgacccccagacccgccggcctggtgggcggcagcgccaccggcctgctggccctgagcggcgccctggccgcccaggcccagctggccgccgccgtgaaggaggacagagccggcgtggaggccgagggcagcagagtggagagagcccccagcagaagcgccagccccagcccccccgagagcctggtggaggaggagagacccagcggccccggcggcggcggcaagcagagagccgacgagaaggagcccagcggcccctacgagagcgacgaggacaagagcgactacaacctggtggtggacgaggaccagcccagcgagccccccagccccgccaccaccccctgcggcaaggtgcccatctgcatccccgccagaagagacctggtggacagccccgccagcctggccagcagcctgggcagccccctgcccagagccaaggagctgatcctgaacgacctgcccgccagcacccccgccagcaagagctgcgacagcagccccccccaggacgccagcacccccggccccagcagcgccagccacctgtgccagctggccgccaagcccgcccccagcaccgacagcgtggccctgagaagccccctgaccctgagcagccccttcaccaccagcttcagcctgggcagccacagcaccctgaacggcgacctgagcgtgcccagcagctacgtgagcctgcacctgagcccccaggtgagcagcagcgtggtgtacggcagaagccccgtgatggccttcgagagccacccccacctgagaggcagcagcgtgagcagcagcctgcccagcatccccggcggcaagcccgcctacagcttccacgtgagcgccgacggccagatgcagcccgtgcccttccccagcgacgccctggtgggcgccggcatccccagacacgccagacagctgcacaccctggcccacggcgaggtggtgtgcgccgtgaccatcagcggcagcacccagcacgtgtacaccggcggcaagggctgcgtgaaggtgtgggacgtgggccagcccggcgccaagacccccgtggcccagctggactgcctgaacagagacaactacatcagaagctgcaagctgctgcccgacggcagaagcctgatcgtgggcggcgaggccagcaccctgagcatctgggacctggccgcccccacccccagaatcaaggccgagctgaccagcagcgcccccgcctgctacgccctggccgtgagccccgacgccaaggtgtgcttcagctgctgcagcgacggcaacatcgtggtgtgggacctgcagaaccagaccatggtgagacagttccagggccacaccgacggcgccagctgcatcgacatcagcgactacggcaccagactgtggaccggcggcctggacaacaccgtgagatgctgggacctgagagagggcagacagctgcagcagcacgacttcagcagccagatcttcagcctgggccactgccccaaccaggactggctggccgtgggcatggagagcagcaacgtggagatcctgcacgtgagaaagcccgagaagtaccagctgcacctgcacgagagctgcgtgctgagcctgaagttcgccagctgcgtgcagggcgtggtgctgagccccgagctgtag

SEQ ID NO: 102870 - DNA, 2232 bp, Artificial Sequence
  Description of Artificial Sequence: Synthetic coding sequence
atgtacccccagggcagacaccccacccccctgcagagcggccagcccttcaagttcagcatcctggagatctgcgacagaatcaaggaggagttccagttcctgcaggcccagtaccacagcctgaagctggagtgcgagaagctggccagcgagaagaccgagatgcagagacactacgtgatgtactacgagatgagctacggcctgaacatcgagatgcacaagcaggccgagatcgtgaagagactgagcggcatctgcgcccagatcatccccttcctgacccaggagcaccagcagcaggtgctgcaggccgtggagagagccaagcaggtgaccgtgggcgagctgaacagcctgatcggccagcagctgcagcccctgagccaccacgccccccccgtgcccctgacccccagacccgccggcctggtgggcggcagcgccaccggcctgctggccctgagcggcgccctggccgcccaggcccagctggccgccgccgtgaaggaggacagagccggcgtggaggccgagggcagcagagtggagagagcccccagcagaagcgccagccccagcccccccgagagcctggtggaggaggagagacccagcggccccggcggcggcggcaagcagagagccgacgagaaggagcccagcggcccctacgagagcgacgaggacaagagcgactacaacctggtggtggacgaggaccagcccagcgagccccccagccccgccaccaccccctgcggcaaggtgcccatctgcatccccgccagaagagacctggtggacagccccgccagcctggccagcagcctgggcagccccctgcccagagccaaggagctgatcctgaacgacctgcccgccagcacccccgccagcaagagctgcgacagcagccccccccaggacgccagcacccccggccccagcagcgccagccacctgtgccagctggccgccaagcccgcccccagcaccgacagcgtggccctgagaagccccctgaccctgagcagccccttcaccaccagcttcagcctgggcagccacagcaccctgaacggcgacctgagcgtgcccagcagctacgtgagcctgcacctgagcccccaggtgagcagcagcgtggtgtacggcagaagccccgtgatggccttcgagagccacccccacctgagaggcagcagcgtgagcagcagcctgcccagcatccccggcggcaagcccgcctacagcttccacgtgagcgccgacggccagatgcagcccgtgcccttccccagcgacgccctggtgggcgccggcatccccagacacgccagacagctgcacaccctggcccacggcgaggtggtgtgcgccgtgaccatcagcggcagcacccagcacgtgtacaccggcggcaagggctgcgtgaaggtgtgggacgtgggccagcccggcgccaagacccccgtggcccagctggactgcctgaacagagacaactacatcagaagctgcaagctgctgcccgacggcagaagcctgatcgtgggcggcgaggccagcaccctgagcatctgggacctggccgcccccacccccagaatcaaggccgagctgaccagcagcgcccccgcctgctacgccctggccgtgagccccgacgccaaggtgtgcttcagctgctgcagcgacggcaacatcgtggtgtgggacctgcagaaccagaccatggtgagacagttccagggccacaccgacggcgccagctgcatcgacatcagcgactacggcaccagactgtggaccggcggcctggacaacaccgtgagatgctgggacctgagagagggcagacagctgcagcagcacgacttcagcagccagatcttcagcctgggccactgccccaaccaggactggctggccgtgggcatggagagcagcaacgtggagatcctgcacgtgagaaagcccgagaagtaccagctgcacctgcacgagagctgcgtgctgagcctgaagttcgccagctgcggcagatggttcgtgagcaccggcaaggacaacctgctgaacgcctggagaaccccctacggcgccagcatcttccagagcaaggagagcagcagcgtgctgagctgcgacatcagcagaaacaacaagtacatcgtgaccggcagcggcgacaagaaggccaccgtgtacgaggtggtgtactag

SEQ ID NO: 102871 - DNA, 879 bp, Artificial Sequence
  Description of Artificial Sequence: Synthetic coding sequence
ctggcccacggcgaggtggtgtgcgccgtgaccatcagcggcagcacccagcacgtgtacaccggcggcaagggctgcgtgaaggtgtgggacgtggacggcgccgtgttcgccggccagagaggcggcgcccaccagcccatcagaaacagagacaactacatcagaagctgcaagctgctgcccgacggcagaagcctgatcgtgggcggcgaggccagcaccctgagcatctgggacctggccgcccccacccccagaatcaaggccgagctgaccagcagcgcccccgcctgctacgccctggccgtgagccccgacgccaaggtgtgcttcagctgctgcagcgacggcaacatcgtggtgtgggacctgcagaaccagaccatggtgagacagttccagggccacaccgacggcgccagctgcatcgacatcagcgactacggcaccagactgtggaccggcggcctggacaacaccgtgagatgctgggacctgagagagggcagacagctgcagcagcacgacttcagcagccagatcttcagcctgggccactgccccaaccaggactggctggccgtgggcatggagagcagcaacgtggagatcctgcacgtgagaaagcccgagaagtaccagctgcacctgcacgagagctgcgtgctgagcctgaagttcgccagctgcggcagatggttcgtgagcaccggcaaggacaacctgctgaacgcctggagaaccccctacggcgccagcatcttccagagcaaggagagcagcagcgtgctgagctgcgacatcagcagaaacaacaagtacatcgtgaccggcagcggcgacaagaaggccaccgtgtacgaggtggtgtactag

SEQ ID NO: 102872 - DNA, 2121 bp, Artificial Sequence; identical to SEQ ID NO: 102869
  Description of Artificial Sequence: Synthetic coding sequence

SEQ ID NO: 102873 - DNA, 1083 bp, Artificial Sequence
  Description of Artificial Sequence: Synthetic coding sequence
atgtacccccagggcagacaccccacccccctgcagagcggccagcccttcaagttcagcatcctggagatctgcgacagaatcaaggaggagttccagttcctgcaggcccagtaccacagcctgaagctggagtgcgagaagctggccagcgagaagaccgagatgcagagacactacgtgatgtactacgagatgagctacggcctgaacatcgagatgcacaagcaggccgagatcgtgaagagactgagcggcatctgcgcccagatcatccccttcctgacccaggagagcgccagccccagcccccccgagagcctggtggaggaggagagacccagcggccccggcggcggcggcaagcagagagccgacgagaaggagcccagcggcccctacgagagcgacgaggacaagagcgactacaacctggtggtggacgaggaccagcccagcgagccccccagccccgccaccaccccctgcggcaaggtgcccatctgcatccccgccagaagagacctggtggacagccccgccagcctggccagcagcctgggcagccccctgcccagagccaaggagctgatcctgaacgacctgcccgccagcacccccgccagcaagagctgcgacagcagccccccccaggacgccagcacccccggccccagcagcgccagccacctgtgccagctggccgccaagcccgcccccagcaccgacagcgtggccctgagaagccccctgaccctgagcagccccttcaccaccagcttcagcctgggcagccacagcaccctgaacggcgacctgagcgtgcccagcagctacgtgagcctgcacctgagcccccaggtgagcagcagcgtggtgtacggcagaagccccgtgatggccttcgagagccacccccacctgagaggcagcagcgtgagcagcagcctgcccagcatccccggcggcaagcccgcctacagcttccacgtgagcgccgacggccagatgcagcccgtgcccttccccagcgacgccctggtgggcgccggcatccccccctggcccagcagcaccgcctag

SEQ ID NO: 102874 - DNA, 1866 bp, Artificial Sequence
  Description of Artificial Sequence: Synthetic coding sequence
atgcagagacactacgtgatgtactacgagatgagctacggcctgaacatcgagatgcacaagcaggccgagatcgtgaagagactgagcggcatctgcgcccagatcatccccttcctgacccaggagcaccagcagcaggtgctgcaggccgtggagagagccaagcaggtgaccgtgggcgagctgaacagcctgatcggcagcgccagccccagcccccccgagagcctggtggaggaggagagacccagcggccccggcggcggcggcaagcagagagccgacgagaaggagcccagcggcccctacgagagcgacgaggacaagagcgactacaacctggtggtggacgaggaccagcccagcgagccccccagccccgccaccaccccctgcggcaaggtgcccatctgcatccccgccagaagagacctggtggacagccccgccagcctggccagcagcctgggcagccccctgcccagagccaaggagctgatcctgaacgacctgcccgccagcacccccgccagcaagagctgcgacagcagccccccccaggacgccagcacccccggccccagcagcgccagccacctgtgccagctggccgccaagcccgcccccagcaccgacagcgtggccctgagaagccccctgaccctgagcagccccttcaccaccagcttcagcctgggcagccacagcaccctgaacggcgacctgagcgtgcccagcagctacgtgagcctgcacctgagcccccaggtgagcagcagcgtggtgtacggcagaagccccgtgatggccttcgagagccacccccacctgagaggcagcagcgtgagcagcagcctgcccagcatccccggcggcaagcccgcctacagcttccacgtgagcgccgacggccagatgcagcccgtgcccttccccagcgacgccctggtgggcgccggcatccccagacacgccagacagctgcacaccctggcccacggcgaggtggtgtgcgccgtgaccatcagcggcagcacccagcacgtgtacaccggcggcaagggctgcgtgaaggtgtgggacgtgggccagcccggcgccaagacccccgtggcccagctggactgcctgaacagagacaactacatcagaagctgcaagctgctgcccgacggcagaagcctgatcgtgggcggcgaggccagcaccctgagcatctgggacctggccgcccccacccccagaatcaaggccgagctgaccagcagcgcccccgcctgctacgccctggccgtgagccccgacgccaaggtgtgcttcagctgctgcagcgacggcaacatcgtggtgtgggacctgcagaaccagaccatggtgagacagttccagggccacaccgacggcgccagctgcatcgacatcagcgactacggcaccagactgtggaccggcggcctggacaacaccgtgagatgctgggacctgagagagggcagacagctgcagcagcacgacttcagcagccagatcttcagcctgggccactgccccaaccaggactggctggccgtgggcatggagagcagcaacgtggagatcctgcacgtgagaaagcccgagaagtaccagctgcacctgcacgagagctgcgtgctgagcctgaagttcgccagctgcggcagatggttcgtgagcaccggcaaggacaacctgctgaacgcctggagaaccccctacggcgccagcatcttccagagcaaggagagcagcagcgtgctgagctgcgacatcagcagaaacaacaagtacatcgtgaccggcagcggcgacaagaaggccaccgtgtacgaggtggtgtactag

SEQ ID NO: 102875 - DNA, 1233 bp, Artificial Sequence
  Description of Artificial Sequence: Synthetic coding sequence
atgaccttcccccccgccctgctgccccccaaccccgtgaccccccccagacccagaaccctgcccccccccggccccgccagacccgtgaccagcgccagcctgctgcccagccagcacctgcccagaaccgccagcgtgagcagcagcgtggtgtacggcagaagccccgtgatggccttcgagagccacccccacctgagaggcagcagcgtgagcagcagcctgcccagcatccccggcggcaagcccgcctacagcttccacgtgagcgccgacggccagatgcagcccgtgcccttccccagcgacgccctggtgggcgccggcatccccagacacgccagacagctgcacaccctggcccacggcgaggtggtgtgcgccgtgaccatcagcggcagcacccagcacgtgtacaccggcggcaagggctgcgtgaaggtgtgggacgtgggccagcccggcgccaagacccccgtggcccagctggactgcctgaacagagacaactacatcagaagctgcaagctgctgcccgacggcagaagcctgatcgtgggcggcgaggccagcaccctgagcatctgggacctggccgcccccacccccagaatcaaggccgagctgaccagcagcgcccccgcctgctacgccctggccgtgagccccgacgccaaggtgtgcttcagctgctgcagcgacggcaacatcgtggtgtgggacctgcagaaccagaccatggtgagacagttccagggccacaccgacggcgccagctgcatcgacatcagcgactacggcaccagactgtggaccggcggcctggacaacaccgtgagatgctgggacctgagagagggcagacagctgcagcagcacgacttcagcagccagatcttcagcctgggccactgccccaaccaggactggctggccgtgggcatggagagcagcaacgtggagatcctgcacgtgagaaagcccgagaagtaccagctgcacctgcacgagagctgcgtgctgagcctgaagttcgccagctgcggcagatggttcgtgagcaccggcaaggacaacctgctgaacgcctggagaaccccctacggcgccagcatcttccagagcaaggagagcagcagcgtgctgagctgcgacatcagcagaaacaacaagtacatcgtgaccggcagcggcgacaagaaggccaccgtgtacgaggtggtgtactag

SEQ ID NO: 102876 - DNA, 2061 bp, Artificial Sequence
  Description of Artificial Sequence: Synthetic coding sequence
cagacccccctgcagagcggccagcccttcaagttcagcatcctggagatctgcgacagaatcaaggaggagttccagttcctgcaggcccagtaccacagcctgaagctggagtgcgagaagctggccagcgagaagaccgagatgcagagacactacgtgatgtactacgagatgagctacggcctgaacatcgagatgcacaagcaggccgagatcgtgaagagactgagcggcatctgcgcccagatcatccccttcctgacccaggagcaccagcagcaggtgctgcaggccgtggagagagccaagcaggtgaccgtgggcgagctgaacagcctgatcggccagcagcagctgcagcccctgagccaccacgccccccccgtgcccctgacccccagacccgccggcctggtgggcggcagcgccaccggcctgctggccctgagcggcgccctggccgcccaggcccagctggccgccgccgtgaaggaggacagagccggcgtggaggccgagggcagcagagtggagagagcccccagcagaagcgccagccccagcccccccgagagcctggtggaggaggagagacccagcggccccggcggcggcggcaagcagagagccgacgagaaggagcccagcggcccctacgagagcgacgaggacaagagcgactacaacctggtggtggacgaggaccagcccagcgagccccccagccccgccaccaccccctgcggcaaggtgcccatctgcatccccgccagaagagacctggtggacagccccgccagcctggccagcagcctgggcagccccctgcccagagccaaggagctgatcctgaacgacctgcccgccagcacccccgccagcaagagctgcgacagcagccccccccaggacgccagcacccccggccccagcagcgccagccacctgtgccagctggccgccaagcccgcccccagcaccgacagcgtggccctgagaagccccctgaccctgagcagccccttcaccaccagcttcagcctgggcagccacagcaccctgaacggcgacctgagcgtgcccagcagctacgtgagcctgcacctgagcccccaggtgagcagcagcgtggtgtacggcagaagccccgtgatggccttcgagagccacccccacctgagaggcagcagcgtgagcagcagcctgcccagcatccccggcggcaagcccgcctacagcttccacgtgagcgccgacggccagatgcagcccgtgcccttccccagcgacgccctggtgggcgccggcatccccagacacgccagacagctgcacaccctggcccacggcgaggtggtgtgcgccgtgaccatcagcggcagcacccagcacgtgtacaccggcggcaagggctgcgtgaaggtgtgggacgtgggccagcccggcgccaagacccccgtggcccagctggactgcctgaacagagacaactacatcagaagctgcaagctgctgcccgacggcagaagcctgatcgtgggcggcgaggccagcaccctgagcatctgggacctggccgcccccacccccagaatcaaggccgagctgaccagcagcgcccccgcctgctacgccctggccgtgagccccgacgccaaggtgtgcttcagctgctgcagcgacggcaacatcgtggtgtgggacctgcagaaccagaccatggtgagacagttccagggccacaccgacggcgccagctgcatcgacatcagcgactacggcaccagactgtggaccggcggcctggacaacaccgtgagatgctgggacctgagagagggcagacagctgcagcagcacgacttcagcagccagatcttcagcctgggccactgccccaaccaggactggctggccgtgggcatggagagcagcaacgtggagatcctgcacgtgagaaagcccgagaagtaccagctgcacctgcacgagagctgcgtgctgagcctgaagttcgccagctgcgtgcagggcgtggtgctgagccccgagctgtag

SEQ ID NO: 102877 - DNA, 1866 bp, Artificial Sequence; identical to SEQ ID NO: 102874
  Description of Artificial Sequence: Synthetic coding sequence

SEQ ID NO: 102878 - DNA, 2283 bp, Artificial Sequence
  Description of Artificial Sequence: Synthetic coding sequence
atgtacccccagggcagacaccccgccccccaccagcccggccagcccggcttcaagttcaccgtggccgagagctgcgacagaatcaaggacgagttccagttcctgcaggcccagtaccacagcctgaaggtggagtacgacaagctggccaacgagaagaccgagatgcagagacactacgtgatgtactacgagatgagctacggcctgaacatcgagatgcacaagcagaccgagatcgccaagagactgaacaccatcctggcccagatcatgcccttcctgagccaggagcaccagcagcaggtggcccaggccgtggagagagccaagcaggtgaccatgaccgagctgaacgccatcatcggccagcagcagctgcaggcccagcacctgagccacgccacccacggcccccccgtgcagctgcccccccaccccagcggcctgcagccccccggcatcccccccgtgaccggcagcagcagcggcctgctggccctgggcgccctgggcagccaggcccacctgaccgtgaaggacgagaagaaccaccacgagctggaccacagagagagagagagcagcgccaacaacagcgtgagccccagcgagagcctgagagccagcgagaagcacagaggcagcgccgactacagcatggaggccaagaagagaaaggccgaggagaaggacagcctgagcagatacgacagcgacggcgacaagagcgacgacctggtggtggacgtgagcaacgaggaccccgccacccccagagtgagccccgcccacagcccccccgagaacggcctggacaaggccagaagcctgaagaaggacgcccccaccagccccgccagcgtggccagcagcagcagcacccccagcagcaagaccaaggacctgggccacaacgacaagagcagcacccccggcctgaagagcaacacccccacccccagaaacgacgcccccacccccggcaccagcaccacccccggcctgagaagcatgcccgccagcgccctgagaacccccatcagcatcaccagcagctacgccgcccccttcgccatgatgagccaccacgagatgaacggcagcctgaccagccccggcgcctacgccggcctgcacaacatccccccccagatgagcgccgccgccgccgccgccgccgccgcctacggcagaagccccatggtgagcttcggcgccgtgggcttcgacccccacccccccatgagagccaccggcctgcccagcagcctggccagcatccccggcggcaagcccgcctacagcttccacgtgagcgccgacggccagatgcagcccgtgcccttcccccacgacgccctggccggccccggcatccccagacacgccagacagatcaacaccctgagccacggcgaggtggtgtgcgccgtgaccatcagcaaccccaccagacacgtgtacaccggcggcaagggctgcgtgaagatctgggacatcagccagcccggcagcaagagccccatcagccagctggactgcctgaacagagacaactacatcagaagctgcaagctgctgcccgacggcagaaccctgatcgtgggcggcgaggccagcaccctgaccatctgggacctggccagccccacccccagaatcaaggccgagctgaccagcagcgcccccgcctgctacgccctggccatcagccccgacgccaaggtgtgcttcagctgctgcagcgacggcaacatcgccgtgtgggacctgcacaaccagaccctggtgagacagttccagggccacaccgacggcgccagctgcatcgacatcagccacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagagcagcaacgtggaggtgctgcaccacaccaagcccgacaagtaccagctgcacctgcacgagagctgcgtgctgagcctgaagttcgcctactgcggcaagtggttcgtgagcaccggcaaggacaacctgctgaacgcctggagaaccccctacggcgccagcatcttccagagcaaggagagcagcagcgtgctgagctgcgacatcagcgccgacgacaagtacatcgtgaccggcagcggcgacaagaaggccaccgtgtacgaggtgatctactag

SEQ ID NO: 102879 - DNA, 2289 bp, Artificial Sequence
  Description of Artificial Sequence: Synthetic coding sequence
atggccccccaccagcccggccagcccggcttcaagttcaccgtggccgagagctgcgacagaatcaaggacgagttccagttcctgcaggcccagtaccacagcctgaaggtggagtacgacaagctggccaacgagaagaccgagatgcagagacactacgtgatgtactacgagatgagctacggcctgaacatcgagatgcacaagcagaccgagatcgccaagagactgaacaccatcctggcccagatcatgcccttcctgagccaggagcaccagcagcaggtggcccaggccgtggagagagccaagcaggtgaccatgaccgagctgaacgccatcatcggccagcagcagctgcaggcccagcacctgagccacgccacccacggcccccccgtgcagctgcccccccaccccagcggcctgcagccccccggcatcccccccgtgaccggcagcagcagcggcctgctggccctgggcgccctgggcagccaggcccacctgaccgtgaaggacgagaagaaccaccacgagctggaccacagagagagagagagcagcgccaacaacagcgtgagccccagcgagagcctgagagccagcgagaagcacagaggcagcgccgactacagcatggaggccaagaagagaaaggccgaggagaaggacagcctgagcagatacgacagcgacggcgacaagagcgacgacctggtggtggacgtgagcaacgaggaccccgccacccccagagtgagccccgcccacagcccccccgagaacggcctggacaaggccagaagcctgaagaaggacgcccccaccagccccgccagcgtggccagcagcagcagcacccccagcagcaagaccaaggacctgggccacaacgacaagagcagcacccccggcctgaagagcaacacccccacccccagaaacgacgcccccacccccggcaccagcaccacccccggcctgagaagcatgcccggcaagccccccggcatggaccccatcgccagcgccctgagaacccccatcagcatcaccagcagctacgccgcccccttcgccatgatgagccaccacgagatgaacggcagcctgaccagccccggcgcctacgccggcctgcacaacatccccccccagatgagcgccgccgccgccgccgccgccgccgcctacggcagaagccccatggtgagcttcggcgccgtgggcttcgacccccacccccccatgagagccaccggcctgcccagcagcctggccagcatccccggcggcaagcccgcctacagcttccacgtgagcgccgacggccagatgcagcccgtgcccttcccccacgacgccctggccggccccggcatccccagacacgccagacagatcaacaccctgagccacggcgaggtggtgtgcgccgtgaccatcagcaaccccaccagacacgtgtacaccggcggcaagggctgcgtgaagatctgggacatcagccagcccggcagcaagagccccatcagccagctggactgcctgaacagagacaactacatcagaagctgcaagctgctgcccgacggcagaaccctgatcgtgggcggcgaggccagcaccctgaccatctgggacctggccagccccacccccagaatcaaggccgagctgaccagcagcgcccccgcctgctacgccctggccatcagccccgacgccaaggtgtgcttcagctgctgcagcgacggcaacatcgccgtgtgggacctgcacaaccagaccctggtgagacagttccagggccacaccgacggcgccagctgcatcgacatcagccacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagagcagcaacgtggaggtgctgcaccacaccaagcccgacaagtaccagctgcacctgcacgagagctgcgtgctgagcctgaagttcgcctactgcggcaagtggttcgtgagcaccggcaaggacaacctgctgaacgcctggagaaccccctacggcgccagcatcttccagagcaaggagagcagcagcgtgctgagctgcgacatcagcgccgacgacaagtacatcgtgaccggcagcggcgacaagaaggccaccgtgtacgaggtgatctactag

SEQ ID NO: 102880 - DNA, 2295 bp, Artificial Sequence
  Description of Artificial Sequence: Synthetic coding sequence
atgtacccccagggcagacaccccgccccccaccagcccggccagcccggcttcaagttcaccgtggccgagagctgcgacagaatcaaggacgagttccagttcctgcaggcccagtaccacagcctgaaggtggagtacgacaagctggccaacgagaagaccgagatgcagagacactacgtgatgtactacgagatgagctacggcctgaacatcgagatgcacaagcagaccgagatcgccaagagactgaacaccatcctggcccagatcatgcccttcctgagccaggagcaccagcagcaggtggcccaggccgtggagagagccaagcaggtgaccatgaccgagctgaacgccatcatcggccagcagcagctgcaggcccagcacctgagccacgccacccacggcccccccgtgcagctgcccccccaccccagcggcctgcagccccccggcatcccccccgtgaccggcagcagcagcggcctgctggccctgggcgccctgggcagccaggcccacctgaccgtgaaggacgagaagaaccaccacgagctggaccacagagagagaagcagcgccagcaacaacagcgtgagccccagcgagagcctgagagccagcgagaagcacagaggcagcgccgactacagcatggaggccaagaagagaaaggccgaggagaaggacagcctgagcagatacgacagcgacggcgacaagagcgacgacctggtggtggacgtgagcaacgaggaccccgccacccccagagtgagccccgcccacagcccccccgagaacggcctggacaaggccagaagcctgaagaaggacgcccccaccagccccgccagcgtggccagcagcagcagcacccccagcagcaagaccaaggacctgggccacaacgacaagagcagcacccccggcctgaagagcaacacccccacccccagaaacgacgcccccacccccggcaccagcaccacccccggcctgagaagcatgcccggcaagccccccggcatggaccccatcgccagcgccctgagaacccccatcagcatcaccagcagctacgccgcccccttcgccatgatgagccaccacgagatgaacggcagcctgaccagccccggcgcctacgccggcctgcacaacatccccccccagatgagcgccgccgccgccgccgccgccgccgcctacggcagaagccccatggtgggcttcgacccccacccccccatgagagccaccggcctgcccagcagcctggccagcatccccggcggcaagcccgcctacagcttccacgtgagcgccgacggccagatgcagcccgtgcccttcccccacgacgccctggccggccccggcatccccagacacgccagacagatcaacaccctgagccacggcgaggtggtgtgcgccgtgaccatcagcaaccccaccagacacgtgtacaccggcggcaagggctgcgtgaagatctgggacatcagccagcccggcagcaagagccccatcagccagctggactgcctgaacagagacaactacatcagaagctgcaagctgctgcccgacggcagaaccctgatcgtgggcggcgaggccagcaccctgaccatctgggacctggccagccccacccccagaatcaaggccgagctgaccagcagcgcccccgcctgctacgccctggccatcagccccgacgccaaggtgtgcttcagctgctgcagcgacggcaacatcgccgtgtgggacctgcacaaccagaccctggtgagacagttccagggccacaccgacggcgccagctgcatcgacatcagccacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagagcagcaacgtggaggtgctgcaccacaccaagcccgacaagtaccagctgcacctgcacgagagctgcgtgctgagcctgaagttcgcctactgcggcaagtggttcgtgagcaccggcaaggacaacctgctgaacgcctggagaaccccctacggcgccagcatcttccagagcaaggagagcagcagcgtgctgagctgcgacatcagcgccgacgacaagtacatcgtgaccggcagcggcgacaagaaggccaccgtgtacgaggtgatctactag

SEQ ID NO: 102881 - DNA, 2310 bp, Artificial Sequence
  Description of Artificial Sequence: Synthetic coding sequence
atgtacccccagggcagacaccccgccccccaccagcccggccagcccggcttcaagttcaccgtggccgagagctgcgacagaatcaaggacgagttccagttcctgcaggcccagtaccacagcctgaaggtggagtacgacaagctggccaacgagaagaccgagatgcagagacactacgtgatgtactacgagatgagctacggcctgaacatcgagatgcacaagcagaccgagatcgccaagagactgaacaccatcctggcccagatcatgcccttcctgagccaggagcaccagcagcaggtggcccaggccgtggagagagccaagcaggtgaccatgaccgagctgaacgccatcatcggccagcagcagctgcaggcccagcacctgagccacgccacccacggcccccccgtgcagctgcccccccaccccagcggcctgcagccccccggcatcccccccgtgaccggcagcagcagcggcctgctggccctgggcgccctgggcagccaggcccacctgaccgtgaaggacgagaagaaccaccacgagctggaccacagagagagagagagcagcgccaacaacagcgtgagccccagcgagagcctgagagccagcgagaagcacagaggcagcgccgactacagcatggaggccaagaagagaaaggccgaggagaaggacagcctgagcagatacgacagcgacggcgacaagagcgacgacctggtggtggacgtgagcaacgaggaccccgccacccccagagtgagccccgcccacagcccccccgagaacggcctggacaaggccagaagcctgaagaaggacgcccccaccagccccgccagcgtggccagcagcagcagcacccccagcagcaagaccaaggacctgggccacaacgacaagagcagcacccccggcctgaagagcaacacccccacccccagaaacgacgcccccacccccggcaccagcaccacccccggcctgagaagcatgcccggcaagccccccggcatggaccccatcgccagcgccctgagaacccccatcagcatcaccagcagctacgccgcccccttcgccatgatgagccaccacgagatgaacggcagcctgaccagccccggcgcctacgccggcctgcacaacatccccccccagatgagcgccgccgccgccgccgccgccgccgcctacggcagaagccccatggtgagcttcggcgccgtgggcttcgacccccacccccccatgagagccaccggcctgcccagcagcctggccagcatccccggcggcaagcccgcctacagcttccacgtgagcgccgacggccagatgcagcccgtgcccttcccccacgacgccctggccggccccggcatccccagacacgccagacagatcaacaccctgagccacggcgaggtggtgtgcgccgtgaccatcagcaaccccaccagacacgtgtacaccggcggcaagggctgcgtgaagatctgggacatcagccagcccggcagcaagagccccatcagccagctggactgcctgaacagagacaactacatcagaagctgcaagctgctgcccgacggcagaaccctgatcgtgggcggcgaggccagcaccctgaccatctgggacctggccagccccacccccagaatcaaggccgagctgaccagcagcgcccccgcctgctacgccctggccatcagccccgacgccaaggtgtgcttcagctgctgcagcgacggcaacatcgccgtgtgggacctgcacaaccagaccctggtgagacagttccagggccacaccgacggcgccagctgcatcgacatcagccacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagagcagcaacgtggaggtgctgcaccacaccaagcccgacaagtaccagctgcacctgcacgagagctgcgtgctgagcctgaagttcgcctactgcggcaagtggttcgtgagcaccggcaaggacaacctgctgaacgcctggagaaccccctacggcgccagcatcttccagagcaaggagagcagcagcgtgctgagctgcgacatcagcgccgacgacaagtacatcgtgaccggcagcggcgacaagaaggccaccgtgtacgaggtgatctactag

SEQ ID NO: 102882 - DNA, 2295 bp, Artificial Sequence
  Description of Artificial Sequence: Synthetic coding sequence
atgtacccccagggcagacaccccgccccccaccagcccggccagcccggcttcaagttcaccgtggccgagagctgcgacagaatcaaggacgagttccagttcctgcaggcccagtaccacagcctgaaggtggagtacgacaagctggccaacgagaagaccgagatgcagagacactacgtgatgtactacgagatgagctacggcctgaacatcgagatgcacaagcagaccgagatcgccaagagactgaacaccatcctggcccagatcatgcccttcctgagccaggagcaccagcagcaggtggcccaggccgtggagagagccaagcaggtgaccatgaccgagctgaacgccatcatcggccagcagcagctgcaggcccagcacctgagccacgccacccacggcccccccgtgcagctgcccccccaccccagcggcctgcagccccccggcatcccccccgtgaccggcagcagcagcggcctgctggccctgggcgccctgggcagccaggcccacctgaccgtgaaggacgagaagaaccaccacgagctggaccacagagagagagagagcagcgccaacaacagcgtgagccccagcgagagcctgagagccagcgagaagcacagaggcagcgccgactacagcatggaggccaagaagagaaaggccgaggagaaggacagcctgagcagatacgacagcgacggcgacaagagcgacgacctggtggtggacgtgagcaacgaggaccccgccacccccagagtgagccccgcccacagcccccccgagaacggcctggacaaggccagaagcctgaagaaggacgcccccaccagccccgccagcgtggccagcagcagcagcacccccagcagcaagaccaaggacctgggccacaacgacaagagcagcacccccggcctgaagagcaacacccccacccccagaaacgacgcccccacccccggcaccagcaccacccccggcctgagaagcatgcccggcaagccccccggcatggaccccatcgccagcgccctgagaacccccatcagcatcaccagcagctacgccgcccccttcgccatgatgagccaccacgagatgaacggcagcctgaccagccccggcgcctacgccggcctgcacaacatccccccccagatgagcgccgccgccgccgccgccgccgccgcctacggcagaagccccatggtgggcttcgacccccacccccccatgagagccaccggcctgcccagcagcctggccagcatccccggcggcaagcccgcctacagcttccacgtgagcgccgacggccagatgcagcccgtgcccttcccccacgacgccctggccggccccggcatccccagacacgccagacagatcaacaccctgagccacggcgaggtggtgtgcgccgtgaccatcagcaaccccaccagacacgtgtacaccggcggcaagggctgcgtgaagatctgggacatcagccagcccggcagcaagagccccatcagccagctggactgcctgaacagagacaactacatcagaagctgcaagctgctgcccgacggcagaaccctgatcgtgggcggcgaggccagcaccctgaccatctgggacctggccagccccacccccagaatcaaggccgagctgaccagcagcgcccccgcctgctacgccctggccatcagccccgacgccaaggtgtgcttcagctgctgcagcgacggcaacatcgccgtgtgggacctgcacaaccagaccctggtgagacagttccagggccacaccgacggcgccagctgcatcgacatcagccacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagagcagcaacgtggaggtgctgcaccacaccaagcccgacaagtaccagctgcacctgcacgagagctgcgtgctgagcctgaagttcgcctactgcggcaagtggttcgtgagcaccggcaaggacaacctgctgaacgcctggagaaccccctacggcgccagcatcttccagagcaaggagagcagcagcgtgctgagctgcgacatcagcgccgacgacaagtacatcgtgaccggcagcggcgacaagaaggccaccgtgtacgaggtgatctactag

SEQ ID NO: 102883 - DNA, 2319 bp, Artificial Sequence
  Description of Artificial Sequence: Synthetic coding sequence
atgtacccccagggcagacaccccgccccccaccagcccggccagcccggcttcaagttcaccgtggccgagagctgcgacagaatcaaggacgagttccagttcctgcaggcccagtaccacagcctgaaggtggagtacgacaagctggccaacgagaagaccgagatgcagagacactacgtgatgtactacgagatgagctacggcctgaacatcgagatgcacaagcagaccgagatcgccaagagactgaacaccatcctggcccagatcatgcccttcctgagccaggagcaccagcagcaggtggcccaggccgtggagagagccaagcaggtgaccatgaccgagctgaacgccatcatcggccagcagcagctgcaggcccagcacctgagccacgccacccacggcccccccgtgcagctgcccccccaccccagcggcctgcagccccccggcatcccccccgtgaccggcagcagcagcggcctgctggccctgggcgccctgggcagccaggcccacctgaccgtgaaggacgagaagaaccaccacgagctggaccacagagagagagagagcagcgccaacaacagcgtgagccccagcgagagcctgagagccagcgagaagcacagaggcagcgccgactacagcatggaggccaagaagagaaaggccgaggagaaggacagcctgagcagatacgacagcgacggcgacaagagcgacgacctggtggtggacgtgagcaacgaggaccccgccacccccagagtgagccccgcccacagcccccccgagaacggcctggacaaggccagaagcctgaagaaggacgcccccaccagccccgccagcgtggccagcagcagcagcacccccagcagcaagaccaaggacctgggccacaacgacaagagcagcacccccggcctgaagagcaacacccccacccccagaaacgacgcccccacccccggcaccagcaccacccccggcctgagaagcatgcccggcaagccccccggcatggaccccatcggcatcatggccagcgccctgagaacccccatcagcatcaccagcagctacgccgcccccttcgccatgatgagccaccacgagatgaacggcagcctgaccagccccggcgcctacgccggcctgcacaacatccccccccagatgagcgccgccgccgccgccgccgccgccgcctacggcagaagccccatggtgagcttcggcgccgtgggcttcgacccccacccccccatgagagccaccggcctgcccagcagcctggccagcatccccggcggcaagcccgcctacagcttccacgtgagcgccgacggccagatgcagcccgtgcccttcccccacgacgccctggccggccccggcatccccagacacgccagacagatcaacaccctgagccacggcgaggtggtgtgcgccgtgaccatcagcaaccccaccagacacgtgtacaccggcggcaagggctgcgtgaagatctgggacatcagccagcccggcagcaagagccccatcagccagctggactgcctgaacagagacaactacatcagaagctgcaagctgctgcccgacggcagaaccctgatcgtgggcggcgaggccagcaccctgaccatctgggacctggccagccccacccccagaatcaaggccgagctgaccagcagcgcccccgcctgctacgccctggccatcagccccgacgccaaggtgtgcttcagctgctgcagcgacggcaacatcgccgtgtgggacctgcacaaccagaccctggtgagacagttccagggccacaccgacggcgccagctgcatcgacatcagccacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagagcagcaacgtggaggtgctgcaccacaccaagcccgacaagtaccagctgcacctgcacgagagctgcgtgctgagcctgaagttcgcctactgcggcaagtggttcgtgagcaccggcaaggacaacctgctgaacgcctggagaaccccctacggcgccagcatcttccagagcaaggagagcagcagcgtgctgagctgcgacatcagcgccgacgacaagtacatcgtgaccggcagcggcgacaagaaggccaccgtgtacgaggtgatctactag

SEQ ID NO: 102884 - DNA, 2319 bp, Artificial Sequence
  Description of Artificial Sequence: Synthetic coding sequence
atgcccccccccccccccctgagctgcctgagaggcctgcaggccccccaccagcccggccagcccggcttcaagttcaccgtggccgagagctgcgacagaatcaaggacgagttccagttcctgcaggcccagtaccacagcctgaaggtggagtacgacaagctggccaacgagaagaccgagatgcagagacactacgtgatgtactacgagatgagctacggcctgaacatcgagatgcacaagcagaccgagatcgccaagagactgaacaccatcctggcccagatcatgcccttcctgagccaggagcaccagcagcaggtggcccaggccgtggagagagccaagcaggtgaccatgaccgagctgaacgccatcatcggccagcagctgcaggcccagcacctgagccacgccacccacggcccccccgtgcagctgcccccccaccccagcggcctgcagccccccggcatcccccccgtgaccggcagcagcagcggcctgctggccctgggcgccctgggcagccaggcccacctgaccgtgaaggacgagaagaaccaccacgagctggaccacagagagagagagagcagcgccaacaacagcgtgagccccagcgagagcctgagagccagcgagaagcacagaggcagcgccgactacagcatggaggccaagaagagaaaggccgaggagaaggacagcctgagcagatacgacagcgacggcgacaagagcgacgacctggtggtggacgtgagcaacgaggaccccgccacccccagagtgagccccgcccacagcccccccgagaacggcctggacaaggccagaagcctgaagaaggacgcccccaccagccccgccagcgtggccagcagcagcagcacccccagcagcaagaccaaggacctgggccacaacgacaagagcagcacccccggcctgaagagcaacacccccacccccagaaacgacgcccccacccccggcaccagcaccacccccggcctgagaagcatgcccggcaagccccccggcatggaccccatcggcatcatggccagcgccctgagaacccccatcagcatcaccagcagctacgccgcccccttcgccatgatgagccaccacgagatgaacggcagcctgaccagccccggcgcctacgccggcctgcacaacatccccccccagatgagcgccgccgccgccgccgccgccgccgcctacggcagaagccccatggtgggcttcgacccccacccccccatgagagccaccggcctgcccagcagcctggccagcatccccggcggcaagcccgcctacagcttccacgtgagcgccgacggccagatgcagcccgtgcccttcccccacgacgccctggccggccccggcatccccagacacgccagacagatcaacaccctgagccacggcgaggtggtgtgcgccgtgaccatcagcaaccccaccagacacgtgtacaccggcggcaagggctgcgtgaagatctgggacatcagccagcccggcagcaagagccccatcagccagctggactgcctgaacagagacaactacatcagaagctgcaagctgctgcccgacggcagaaccctgatcgtgggcggcgaggccagcaccctgaccatctgggacctggccagccccacccccagaatcaaggccgagctgaccagcagcgcccccgcctgctacgccctggccatcagccccgacgccaaggtgtgcttcagctgctgcagcgacggcaacatcgccgtgtgggacctgcacaaccagaccctggtgagacagttccagggccacaccgacggcgccagctgcatcgacatcagccacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagagcagcaacgtggaggtgctgcaccacaccaagcccgacaagtaccagctgcacctgcacgagagctgcgtgctgagcctgaagttcgcctactgcggcaagtggttcgtgagcaccggcaaggacaacctgctgaacgcctggagaaccccctacggcgccagcatcttccagagcaaggagagcagcagcgtgctgagctgcgacatcagcgccgacgacaagtacatcgtgaccggcagcggcgacaagaaggccaccgtgtacgaggtgatctactag

SEQ ID NO: 102885 - DNA, 2325 bp, Artificial Sequence
  Description of Artificial Sequence: Synthetic coding sequence
atgcccccccccccccccctgagctgcctgagaggcctgcaggccccccaccagcccggccagcccggcttcaagttcaccgtggccgagagctgcgacagaatcaaggacgagttccagttcctgcaggcccagtaccacagcctgaaggtggagtacgacaagctggccaacgagaagaccgagatgcagagacactacgtgatgtactacgagatgagctacggcctgaacatcgagatgcacaagcagaccgagatcgccaagagactgaacaccatcctggcccagatcatgcccttcctgagccaggagcaccagcagcaggtggcccaggccgtggagagagccaagcaggtgaccatgaccgagctgaacgccatcatcggccagcagctgcaggcccagcacctgagccacgccacccacggcccccccgtgcagctgcccccccaccccagcggcctgcagccccccggcatcccccccgtgaccggcagcagcagcggcctgctggccctgggcgccctgggcagccaggcccacctgaccgtgaaggacgagaagaaccaccacgagctggaccacagagagagagagagcagcgccaacaacagcgtgagccccagcgagagcctgagagccagcgagaagcacagaggcagcgccgactacagcatggaggccaagaagagaaaggccgaggagaaggacagcctgagcagatacgacagcgacggcgacaagagcgacgacctggtggtggacgtgagcaacgaggaccccgccacccccagagtgagccccgcccacagcccccccgagaacggcctggacaaggccagaagcctgaagaaggacgcccccaccagccccgccagcgtggccagcagcagcagcacccccagcagcaagaccaaggacctgggccacaacgacaagagcagcacccccggcctgaagagcaacacccccacccccagaaacgacgcccccacccccggcaccagcaccacccccggcctgagaagcatgcccggcaagccccccggcatggaccccatcgccagcgccctgagaacccccatcagcatcaccagcagctacgccgcccccttcgccatgatgagccaccacgagatgaacggcagcctgaccagccccggcgcctacgccggcctgcacaacatccccccccagatgagcgccgccgccgccgccgccgccgccgcctacggcagaagccccatggtgagcttcggcgccgtgggcttcgacccccacccccccatgagagccaccggcctgcccagcagcctggccagcatccccggcggcaagcccgcctacagcttccacgtgagcgccgacggccagatgcagcccgtgcccttcccccacgacgccctggccggccccggcatccccagacacgccagacagatcaacaccctgagccacggcgaggtggtgtgcgccgtgaccatcagcaaccccaccagacacgtgtacaccggcggcaagggctgcgtgaagatctgggacatcagccagcccggcagcaagagccccatcagccagctggactgcctgaacagagacaactacatcagaagctgcaagctgctgcccgacggcagaaccctgatcgtgggcggcgaggccagcaccctgaccatctgggacctggccagccccacccccagaatcaaggccgagctgaccagcagcgcccccgcctgctacgccctggccatcagccccgacgccaaggtgtgcttcagctgctgcagcgacggcaacatcgccgtgtgggacctgcacaaccagaccctggtgagacagttccagggccacaccgacggcgccagctgcatcgacatcagccacgacggcaccaagctgtggaccggcggcctggacaacaccgtgagaagctgggacctgagagagggcagacagctgcagcagcacgacttcaccagccagatcttcagcctgggctactgccccaccggcgagtggctggccgtgggcatggagagcagcaacgtggaggtgctgcaccacaccaagcccgacaagtaccagctgcacctgcacgagagctgcgtgctgagcctgaagttcgcctactgcggcaagtggttcgtgagcaccggcaaggacaacctgctgaacgcctggagaaccccctacggcgccagcatcttccagagcaaggagagcagcagcgtgctgagctgcgacatcagcgccgacgacaagtacatcgtgaccggcagcggcgacaagaaggccaccgtgtacgaggtgatctactag

SEQ ID NO: 102886 - DNA, 1719 bp, Artificial Sequence
  Description of Artificial Sequence: Synthetic coding sequence
atgaccagcagagaccagcccagacccaagggcccccccaagagcaccagcccctgccccggcatcagcaacagcgagagcagccccaccctgaactaccagggcatcctgaacagactgaagcagttccccagattcagcccccacttcgccgccgagctggagagcatctactacagcctgcacaagatccagcaggacgtggccgagcaccacaagcagatcggcaacgtgctgcagatcgtggagagctgcagccagctgcagggcttccagagcgaggaggtgagccccgccgagcccgccagccccggcaccccccagcaggtgaaggacaagaccctgcaggagagcagcttcgaggacatcatggccaccagaagcagcgactggctgagaagacccctgggcgaggacaaccagcccgagacccagctgttctgggacaaggagccctggttctggcacgacaccctgaccgagcagctgtggagaatcttcgccggcgtgcacgacgagaaggccaagcccagagacagacagcaggcccccggcctgggccaggagagcaaggcccccggcagctgcgaccccggcaccgacccctgccccgaggacgccagcacccccagaccccccgaggccagcagcagcccccccgagggcagccaggacagaaacaccagctggggcgtggtgcaggagccccccggcagagccagcagattcctgcagagcatcagctgggaccccgaggacttcgaggacgcctggaagagacccgacgccctgcccggccagagcaagagactggccgtgccctgcaagctggagaagatgagaatcctggcccacggcgagctggtgctggccaccgccatcagcagcttcaccagacacgtgttcacctgcggcagaagaggcatcaaggtgtggagcctgaccggccaggtggccgaggacagattccccgagagccacctgcccatccagacccccggcgccttcctgagaacctgcctgctgagcagcaacagcagaagcctgctgaccggcggctacaacctggccagcgtgagcgtgtgggacctggccgcccccagcctgcacgtgaaggagcagctgccctgcgccggcctgaactgccaggccctggacgccaacctggacgccaacctggccttcgccagcttcaccagcggcgtggtgagaatctgggacctgagagaccagagcgtggtgagagacctgaagggctaccccgacggcgtgaagagcatcgtggtgaagggctacaacatctggaccggcggccccgacgcctgcctgagatgctgggaccagagaaccatcatgaagcccctggagtaccagttcaagagccagatcatgagcctgagccacagcccccaggaggactgggtgctgctgggcatggccaacggccagcagtggctgcagagcaccagcggcagccagagacacatggtgggccagaaggacagcgtgatcctgagcgtgaagttcagccccttcggccagtggtgggccagcgtgggcatggacgacttcctgggcgtgtacagcatgcccgccggcaccaaggtgttcgaggtgcccgagatgagccccgtgacctgctgcgacgtgagcagcaacaacagactggtggtgaccggcagcggcgagcacgccagcgtgtaccagatcacctactag

SEQ ID NO: 102887 - DNA, 1251 bp, Artificial Sequence
  Description of Artificial Sequence: Synthetic coding sequence
atggccaccagaagcagcgactggctgagaagacccctgggcgaggacaaccagcccgagacccagctgttctgggacaaggagccctggttctggcacgacaccctgaccgagcagctgtggagaatcttcgccggcgtgcacgacgagaaggccaagcccagagacagacagcaggcccccggcctgggccaggagagcaaggcccccggcagctgcgaccccggcaccgacccctgccccgaggacgccagcacccccagaccccccgaggccagcagcagcccccccgagggcagccaggacagaaacaccagctggggcgtggtgcaggagccccccggcagagccagcagattcctgcagagcatcagctgggaccccgaggacttcgaggacgcctggaagagacccgacgccctgcccggccagagcaagagactggccgtgccctgcaagctggagaagatgagaatcctggcccacggcgagctggtgctggccaccgccatcagcagcttcaccagacacgtgttcacctgcggcagaagaggcatcaaggtgtggagcctgaccggccaggtggccgaggacagattccccgagagccacctgcccatccagacccccggcgccttcctgagaacctgcctgctgagcagcaacagcagaagcctgctgaccggcggctacaacctggccagcgtgagcgtgtgggacctggccgcccccagcctgcacgtgaaggagcagctgccctgcgccggcctgaactgccaggccctggacgccaacctggacgccaacctggccttcgccagcttcaccagcggcgtggtgagaatctgggacctgagagaccagagcgtggtgagagacctgaagggctaccccgacggcgtgaagagcatcgtggtgaagggctacaacatctggaccggcggccccgacgcctgcctgagatgctgggaccagagaaccatcatgaagcccctggagtaccagttcaagagccagatcatgagcctgagccacagcccccaggaggactgggtgctgctgggcatggccaacggccagcagtggctgcagagcaccagcggcagccagagacacatggtgggccagagacagagacaccccgagagacaggtgctgcccctgtggcccgtggtgggcaagagatggaacggcagactgccctggagactgcagcacgccggcggcgacaagagcgtgagaggcgcctag

SEQ ID NO: 102888 - DNA, 1719 bp, Artificial Sequence
  Description of Artificial Sequence: Synthetic coding sequence
atgaccagcagagaccagcccagacccaagggcccccccaagagcaccagcccctgccccggcatcagcaacagcgagagcagccccaccctgaactaccagggcatcctgaacagactgaagcagttccccagattcagcccccacttcgccgccgagctggagagcatctactacagcctgcacaagatccagcaggacgtggccgagcaccacaagcagatcggcaacgtgctgcagatcgtggagagctgcagccagctgcagggcttccagagcgaggaggtgagccccgccgagcccgccagccccggcaccccccagcaggtgaaggacaagaccctgcaggagagcagcttcgaggacatcatggccaccagaagcagcgactggctgagaagacccctgggcgaggacaaccagcccgagacccagctgttctgggacaaggagccctggttctggcacgacaccctgaccgagcagctgtggagaatcttcgccggcgtgcacgacgagaaggccaagcccagagacagacacttcagcatcttccagggccaggagagcaaggcccccggcagctgcgaccccggcaccgacccctgccccgaggacgccagcacccccagaccccccgaggccagcagcagcccccccgagggcagccaggacagaaacaccagctggggcgtggtgcaggagccccccggcagagccagcagattcctgcagagcatcagctgggaccccgaggacttcgaggacgcctggaagagacccgacgccctgcccggccagagcaagagactggccgtgccctgcaagctggagaagatgagaatcctggcccacggcgagctggtgctggccaccgccatcagcagcttcaccagacacgtgttcacctgcggcagaagaggcatcaaggtgtggagcctgaccggccaggtggccgaggacagattccccgagagccacctgcccatccagacccccggcgccttcctgagaacctgcctgctgagcagcaacagcagaagcctgctgaccggcggctacaacctggccagcgtgagcgtgtgggacctggccgcccccagcctgcacgtgaaggagcagctgccctgcgccggcctgaactgccaggccctggacgccaacctggacgccaacctggccttcgccagcttcaccagcggcgtggtgagaatctgggacctgagagaccagagcgtggtgagagacctgaagggctaccccgacggcgtgaagagcatcgtggtgaagggctacaacatctggaccggcggccccgacgcctgcctgagatgctgggaccagagaaccatcatgaagcccctggagtaccagttcaagagccagatcatgagcctgagccacagcccccaggaggactgggtgctgctgggcatggccaacggccagcagtggctgcagagcaccagcggcagccagagacacatggtgggccagaaggacagcgtgatcctgagcgtgaagttcagccccttcggccagtggtgggccagcgtgggcatggacgacttcctgggcgtgtacagcatgcccgccggcaccaaggtgttcgaggtgcccgagatgagccccgtgacctgctgcgacgtgagcagcaacaacagactggtggtgaccggcagcggcgagcacgccagcgtgtaccagatcacctactag

SEQ ID NO: 102889 - DNA, 1350 bp, Artificial Sequence
  Description of Artificial Sequence: Synthetic coding sequence
atggccaccagaagcagcgactggctgagaagacccctgggcgaggacaaccagcccgagacccagctgttctgggacaaggagccctggttctggcacgacaccctgaccgagcagctgtggagaatcttcgccggcgtgcacgacgagaaggccaagcccagagacagacagcaggcccccggcctgggccaggagagcaaggcccccggcagctgcgaccccggcaccgacccctgccccgaggacgccagcacccccagaccccccgaggccagcagcagcccccccgagggcagccaggacagaaacaccagctggggcgtggtgcaggagccccccggcagagccagcagattcctgcagagcatcagctgggaccccgaggacttcgaggacgcctggaagagacccgacgccctgcccggccagagcaagagactggccgtgccctgcaagctggagaagatgagaatcctggcccacggcgagctggtgctggccaccgccatcagcagcttcaccagacacgtgttcacctgcggcagaagaggcatcaaggtgtggagcctgaccggccaggtggccgaggacagattccccgagagccacctgcccatccagacccccggcgccttcctgagaacctgcctgctgagcagcaacagcagaagcctgctgaccggcggctacaacctggccagcgtgagcgtgtgggacctggccgcccccagcctgcacgtgaaggagcagctgccctgcgccggcctgaactgccaggccctggacgccaacctggacgccaacctggccttcgccagcttcaccagcggcgtggtgagaatctgggacctgagagaccagagcgtggtgagagacctgaagggctaccccgacggcgtgaagagcatcgtggtgaagggctacaacatctggaccggcggccccgacgcctgcctgagatgctgggaccagagaaccatcatgaagcccctggagtaccagttcaagagccagatcatgagcctgagccacagcccccaggaggactgggtgctgctgggcatggccaacggccagcagtggctgcagagcaccagcggcagccagagacacatggtgggccagaaggacagcgtgatcctgagcgtgaagttcagccccttcggccagtggtgggccagcgtgggcatggacgacttcctgggcgtgtacagcatgcccgccggcaccaaggtgttcgaggtgcccgagatgagccccgtgacctgctgcgacgtgagcagcaacaacagactggtggtgaccggcagcggcgagcacgccagcgtgtaccagatcacctactag

SEQ ID NO: 102890 - DNA, 1716 bp, Artificial Sequence
  Description of Artificial Sequence: Synthetic coding sequence
atgaaccagctgagaggcaagaagagctgccacaccggcctgggcagaagcgccggctggaacatccccatcggcctgctgtactgcgacctgcccgagcccagaaagcccctggagaaggccgtggccaacttcttcagcggcagctgcgccccctgcgccgacggcaccgacttcccccagctgtgccagctgtgccccggctgcggctgcagcaccctgaaccagtacttcggctacagcggcgccttcaagtgcctgaaggacggcgccggcgacgtggccttcgtgaagcacagcaccatcttcgagaacctggccaacaaggccgacagagaccagtacgagctgctgtgcctggacaacaccagaaagcccgtggacgagtacaaggactgccacctggcccaggtgcccagccacaccgtggtggccagaagcatgggcggcaaggaggacctgatctgggagctgctgaaccaggcccaggagcacttcggcaaggacaagagcaaggagttccagctgttcagcagcccccacggcaaggacctgctgttcaaggacagcgcccacggcttcctgaaggtgccccccagaatggacgccaagatgtacctgggctacgagtacgtgaccgccatcagaaacctgagagagggcacctgccccgaggcccccaccgacgagtgcaagcccgtgaagtggtgcgccctgagccaccacgagagactgaagtgcgacgagtggagcgtgaacagcgtgggcaagatcgagtgcgtgagcgccgagaccaccgaggactgcatcgccaagatcatgaacggcgaggccgacgccatgagcctggacggcggcttcgtgtacatcgccggcaagtgcggcctggtgcccgtgctggccgagaactacaacaagagcgacaactgcgaggacacccccgaggccggctacttcgccatcgccgtggtgaagaagagcgccagcgacctgacctgggacaacctgaagggcaagaagagctgccacaccgccgtgggcagaaccgccggctggaacatccccatgggcctgctgtacaacaagatcaaccactgcagattcgacgagttcttcagcgagggctgcgcccccggcagcaagaaggacagcagcctgtgcaagctgtgcatgggcagcggcctgaacctgtgcgagcccaacaacaaggagggctactacggctacaccggcgccttcagatgcctggtggagaagggcgacgtggccttcgtgaagcaccagaccgtgccccagaacaccggcggcaagaaccccgacccctgggccaagaacctgaacgagaaggactacgagctgctgtgcctggacggcaccagaaagcccgtggaggagtacgccaactgccacctggccagagcccccaaccacgccgtggtgaccagaaaggacaaggaggcctgcgtgcacaagatcctgagacagcagcagcacctgttcggcagcaacgtgaccgactgcagcggcaacttctgcctgttcagaagcgagaccaaggacctgctgttcagagacgacaccgtgtgcctggccaagctgcacgacagaaacacctacgagaagtacctgggcgaggagtacgtgaaggccgtgggcaacctgagaaagtgcagcaccagcagcctgctggaggcctgcaccttcagaagaccctag

SEQ ID NO: 102891 - DNA, 2097 bp, Artificial Sequence
  Description of Artificial Sequence: Synthetic coding sequence
atgagactggccgtgggcgccctgctggtgtgcgccgtgctgggcctgtgcctggccgtgcccgacaagaccgtgagatggtgcgccgtgagcgagcacgaggccaccaagtgccagagcttcagagaccacatgaagagcgtgatccccagcgacggccccagcgtggcctgcgtgaagaaggccagctacctggactgcatcagagccatcgccgccaacgaggccgacgccgtgaccctggacgccggcctggtgtacgacgcctacctggcccccaacaacctgaagcccgtggtggccgagttctacggcagcaaggaggacccccagaccttctactacgccgtggccgtggtgaagaaggacagcggcttccagatgaaccagctgagaggcaagaagagctgccacaccggcctgggcagaagcgccggctggaacatccccatcggcctgctgtactgcgacctgcccgagcccagaaagcccctggagaaggccgtggccaacttcttcagcggcagctgcgccccctgcgccgacggcaccgacttcccccagctgtgccagctgtgccccggctgcggctgcagcaccctgaaccagtacttcggctacagcggcgccttcaagtgcctgaaggacggcgccggcgacgtggccttcgtgaagcacagcaccatcttcgagaacctggccaacaaggccgacagagaccagtacgagctgctgtgcctggacaacaccagaaagcccgtggacgagtacaaggactgccacctggcccaggtgcccagccacaccgtggtggccagaagcatgggcggcaaggaggacctgatctgggagctgctgaaccaggcccaggagcacttcggcaaggacaagagcaaggagttccagctgttcagcagcccccacggcaaggacctgctgttcaaggacagcgcccacggcttcctgaaggtgccccccagaatggacgccaagatgtacctgggctacgagtacgtgaccgccatcagaaacctgagagagggcacctgccccgaggcccccaccgacgagtgcaagcccgtgaagtggtgcgccctgagccaccacgagagactgaagtgcgacgagtggagcgtgaacagcgtgggcaagatcgagtgcgtgagcgccgagaccaccgaggactgcatcgccaagatcatgaacggcgaggccgacgccatgagcctggacggcggcttcgtgtacatcgccggcaagtgcggcctggtgcccgtgctggccgagaactacaacaagagcgacaactgcgaggacacccccgaggccggctacttcgccatcgccgtggtgaagaagagcgccagcgacctgacctgggacaacctgaagggcaagaagagctgccacaccgccgtgggcagaaccgccggctggaacatccccatgggcctgctgtacaacaagatcaaccactgcagattcgacgagttcttcagcgagggctgcgcccccggcagcaagaaggacagcagcctgtgcaagctgtgcatgggcagcggcctgaacctgtgcgagcccaacaacaaggagggctactacggctacaccggcgccttcagatgcctggtggagaagggcgacgtggccttcgtgaagcaccagaccgtgccccagaacaccggcggcaagaaccccgacccctgggccaagaacctgaacgagaaggactacgagctgctgtgcctggacggcaccagaaagcccgtggaggagtacgccaactgccacctggccagagcccccaaccacgccgtggtgaccagaaaggacaaggaggcctgcgtgcacaagatcctgagacagcagcagcacctgttcggcagcaacgtgaccgactgcagcggcaacttctgcctgttcagaagcgagaccaaggacctgctgttcagagacgacaccgtgtgcctggccaagctgcacgacagaaacacctacgagaagtacctgggcgaggagtacgtgaaggccgtgggcaacctgagaaagtgcagcaccagcagcctgctggaggcctgcaccttcagaagaccctag

SEQ ID NO: 102892 - DNA, 2283 bp, Artificial Sequence
  Description of Artificial Sequence: Synthetic coding sequence
atgatggaccaggccagaagcgccttcagcaacctgttcggcggcgagcccctgagctacaccagattcagcctggccagacaggtggacggcgacaacagccacgtggagatgaagctggccgtggacgaggaggagaacgccgacaacaacaccaaggccaacgtgaccaagcccaagagatgcagcggcagcatctgctacggcaccatcgccgtgatcgtgttcttcctgatcggcttcatgatcggctacctgggctactgcaagggcgtggagcccaagaccgagtgcgagagactggccggcaccgagagccccgtgagagaggagcccggcgaggacttccccgccgccagaagactgtactgggacgacctgaagagaaagctgagcgagaagctggacagcaccgacttcaccggcaccatcaagctgctgaacgagaacagctacgtgcccagagaggccggcagccagaaggacgagaacctggccctgtacgtggagaaccagttcagagagttcaagctgagcaaggtgtggagagaccagcacttcgtgaagatccaggtgaaggacagcgcccagaacagcgtgatcatcgtggacaagaacggcagactggtgtacctggtggagaaccccggcggctacgtggcctacagcaaggccgccaccgtgaccggcaagctggtgcacgccaacttcggcaccaagaaggacttcgaggacctgtacacccccgtgaacggcagcatcgtgatcgtgagagccggcaagatcaccttcgccgagaaggtggccaacgccgagagcctgaacgccatcggcgtgctgatctacatggaccagaccaagttccccatcgtgaacgccgagctgagcttcttcggccacgcccacctgggcaccggcgacccctacacccccggcttccccagcttcaaccacacccagttcccccccagcagaagcagcggcctgcccaacatccccgtgcagaccatcagcagagccgccgccgagaagctgttcggcaacatggagggcgactgccccagcgactggaagaccgacagcacctgcagaatggtgaccagcgagagcaagaacgtgaagctgaccgtgagcaacgtgctgaaggagatcaagatcctgaacatcttcggcgtgatcaagggcttcgtggagcccgaccactacgtggtggtgggcgcccagagagacgcctggggccccggcgccgccaagagcggcgtgggcaccgccctgctgctgaagctggcccagatgttcagcgacatggtgctgaaggacggcttccagcccagcagaagcatcatcttcgccagctggagcgccggcgacttcggcagcgtgggcgccaccgagtggctggagggctacctgagcagcctgcacctgaaggccttcacctacatcaacctggacaaggccgtgctgggcaccagcaacttcaaggtgagcgccagccccctgctgtacaccctgatcgagaagaccatgcagaacgtgaagcaccccgtgaccggccagttcctgtaccaggacagcaactgggccagcaaggtggagaagctgaccctggacaacgccgccttccccttcctggcctacagcggcatccccgccgtgagcttctgcttctgcgaggacaccgactacccctacctgggcaccaccatggacacctacaaggagctgatcgagagaatccccgagctgaacaaggtggccagagccgccgccgaggtggccggccagttcgtgatcaagctgacccacgacgtggagctgaacctggactacgagagatacaacagccagctgctgagcttcgtgagagacctgaaccagtacagagccgacatcaaggagatgggcctgagcctgcagtggctgtacagcgccagaggcgacttcttcagagccaccagcagactgaccaccgacttcggcaacgccgagaagaccgacagattcgtgatgaagaagctgaacgacagagtgatgagagtggagtaccacttcctgagcccctacgtgagccccaaggagagccccttcagacacgtgttctggggcagcggcagccacaccctgcccgccctgctggagaacctgaagctgagaaagcagaacaacggcgccttcaacgagaccctgttcagaaaccagctggccctggccacctggaccatccagggcgccgccaacgccctgagcggcgacgtgtgggacatcgacaacgagttctag

SEQ ID NO: 102893 - DNA, 2283 bp, Artificial Sequence; identical to SEQ ID NO: 102892
  Description of Artificial Sequence: Synthetic coding sequence

SEQ ID NO: 102894 - DNA, 1437 bp, Artificial Sequence
  Description of Artificial Sequence: Synthetic coding sequence
atggaccagaccaagttccccatcgtgaacgccgagctgagcttcttcggccacgcccacctgggcaccggcgacccctacacccccggcttccccagcttcaaccacacccagttcccccccagcagaagcagcggcctgcccaacatccccgtgcagaccatcagcagagccgccgccgagaagctgttcggcaacatggagggcgactgccccagcgactggaagaccgacagcacctgcagaatggtgaccagcgagagcaagaacgtgaagctgaccgtgagcaacgtgctgaaggagatcaagatcctgaacatcttcggcgtgatcaagggcttcgtggagcccgaccactacgtggtggtgggcgcccagagagacgcctggggccccggcgccgccaagagcggcgtgggcaccgccctgctgctgaagctggcccagatgttcagcgacatggtgctgaaggacggcttccagcccagcagaagcatcatcttcgccagctggagcgccggcgacttcggcagcgtgggcgccaccgagtggctggagggctacctgagcagcctgcacctgaaggccttcacctacatcaacctggacaaggccgtgctgggcaccagcaacttcaaggtgagcgccagccccctgctgtacaccctgatcgagaagaccatgcagaacgtgaagcaccccgtgaccggccagttcctgtaccaggacagcaactgggccagcaaggtggagaagctgaccctggacaacgccgccttccccttcctggcctacagcggcatccccgccgtgagcttctgcttctgcgaggacaccgactacccctacctgggcaccaccatggacacctacaaggagctgatcgagagaatccccgagctgaacaaggtggccagagccgccgccgaggtggccggccagttcgtgatcaagctgacccacgacgtggagctgaacctggactacgagagatacaacagccagctgctgagcttcgtgagagacctgaaccagtacagagccgacatcaaggagatgggcctgagcctgcagtggctgtacagcgccagaggcgacttcttcagagccaccagcagactgaccaccgacttcggcaacgccgagaagaccgacagattcgtgatgaagaagctgaacgacagagtgatgagagtggagtaccacttcctgagcccctacgtgagccccaaggagagccccttcagacacgtgttctggggcagcggcagccacaccctgcccgccctgctggagaacctgaagctgagaaagcagaacaacggcgccttcaacgagaccctgttcagaaaccagctggccctggccacctggaccatccagggcgccgccaacgccctgagcggcgacgtgtgggacatcgacaacgagttctag

SEQ ID NO: 102895 - DNA, 42 bp, Artificial Sequence
  Description of Artificial Sequence: Synthetic coding sequence
atggaccaggccagaagcgccttcagcaacctggacctgtag

SEQ ID NO: 102896 - DNA, 11493 bp, Artificial Sequence
  Description of Artificial Sequence: Synthetic coding sequence
atggccttcgtggccacccagggcgccaccgtggtggaccagaccaccctgatgaagaagtacctgcagttcgtggccgccctgaccgacgtgaacacccccgacgagaccaagctgaagatgatgcaggaggtgagcgagaacttcgagaacgtgaccagcagcccccagtacagcaccttcctggagcacatcatccccagattcctgaccttcctgcaggacggcgaggtgcagttcctgcaggagaagcccgcccagcagctgagaaagctggtgctggagatcatccacagaatccccaccaacgagcacctgagaccccacaccaagaacgtgctgagcgtgatgttcagattcctggagaccgagaacgaggagaacgtgctgatctgcctgagaatcatcatcgagctgcacaagcagttcagaccccccatcacccaggagatccaccacttcctggacttcgtgaagcagatctacaaggagctgcccaaggtggtgaacagatacttcgagaacccccaggtgatccccgagaacaccgtgcccccccccgagatggtgggcatgatcaccaccatcgccgtgaaggtgaaccccgagagagaggacagcgagaccagaacccacagcatcatccccagaggcagcctgagcctgaaggtgctggccgagctgcccatcatcgtggtgctgatgtaccagctgtacaagctgaacatccacaacgtggtggccgagttcgtgcccctgatcatgaacaccatcgccatccaggtgagcgcccaggccagacagcacaagctgtacaacaaggagctgtacgccgacttcatcgccgcccagatcaagaccctgagcttcctggcctacatcatcagaatctaccaggagctggtgaccaagtacagccagcagatggtgaagggcatgctgcagctgctgagcaactgccccgccgagaccgcccacctgagaaaggagctgctgatcgccgccaagcacatcctgaccaccgagctgagaaaccagttcatcccctgcatggacaagctgttcgacgagagcatcctgatcggcagcggctacaccgccagagagaccctgagacccctggcctacagcaccctggccgacctggtgcaccacgtgagacagcacctgcccctgagcgacctgagcctggccgtgcagctgttcgccaagaacatcgacgacgagagcctgcccagcagcatccagaccatgagctgcaagctgctgctgaacctggtggactgcatcagaagcaagagcgagcaggagagcggcaacggcagagacgtgctgatgagaatgctggaggtgttcgtgctgaagttccacaccatcgccagataccagctgagcgccatcttcaagaagtgcaagccccagagcgagctgggcgccgtggaggccgccctgcccggcgtgcccaccgcccccgccgcccccggccccgcccccagccccgcccccgtgcccgccccccccccccccccccccccccccccccccgccacccccgtgacccccgcccccgtgccccccttcgagaagcagggcgagaaggacaaggaggacaagcagaccttccaggtgaccgactgcagaagcctggtgaagaccctggtgtgcggcgtgaagaccatcacctggggcatcaccagctgcaaggcccccggcgaggcccagttcatccccaacaagcagctgcagcccaaggagacccagatctacatcaagctggtgaagtacgccatgcaggccctggacatctaccaggtgcagatcgccggcaacggccagacctacatcagagtggccaactgccagaccgtgagaatgaaggaggagaaggaggtgctggagcacttcgccggcgtgttcaccatgatgaaccccctgaccttcaaggagatcttccagaccaccgtgccctacatggtggagagaatcagcaagaactacgccctgcagatcgtggccaacagcttcctggccaaccccaccaccagcgccctgttcgccaccatcctggtggagtacctgctggacagactgcccgagatgggcagcaacgtggagctgagcaacctgtacctgaagctgttcaagctggtgttcggcagcgtgagcctgttcgccgccgagaacgagcagatgctgaagccccacctgcacaagatcgtgaacagcagcatggagctggcccagaccgccaaggagccctacaactacttcctgctgctgagagccctgttcagaagcatcggcggcggcagccacgacctgctgtaccaggagttcctgcccctgctgcccaacctgctgcagggcctgaacatgctgcagagcggcctgcacaagcagcacatgaaggacctgttcgtggagctgtgcctgaccgtgcccgtgagactgagcagcctgctgccctacctgcccatgctgatggaccccctggtgagcgccctgaacggcagccagaccctggtgagccagggcctgagaaccctggagctgtgcgtggacaacctgcagcccgacttcctgtacgaccacatccagcccgtgagagccgagctgatgcaggccctgtggagaaccctgagaaaccccgccgacagcatcagccacgtggcctacagagtgctgggcaagttcggcggcagcaacagaaagatgctgaaggagagccagaagctgcactacgtggtgaccgaggtgcagggccccagcatcaccgtggagttcagcgactgcaaggccagcctgcagctgcccatggagaaggccatcgagaccgccctggactgcctgaagagcgccaacaccgagccctactacagaagacaggcctgggaggtgatcaagtgcttcctggtggccatgatgagcctggaggacaacaagcacgccctgtaccagctgctggcccaccccaacttcaccgagaagaccatccccaacgtgatcatcagccacagatacaaggcccaggacacccccgccagaaagaccttcgagcaggccctgaccggcgccttcatgagcgccgtgatcaaggacctgagacccagcgccctgcccttcgtggccagcctgatcagacactacaccatggtggccgtggcccagcagtgcggccccttcctgctgccctgctaccaggtgggcagccagcccagcaccgccatgttccacagcgaggagaacggcagcaagggcatggaccccctggtgctgatcgacgccatcgccatctgcatggcctacgaggagaaggagctgtgcaagatcggcgaggtggccctggccgtgatcttcgacgtggccagcatcatcctgggcagcaaggagagagcctgccagctgcccctgttcagctacatcgtggagagactgtgcgcctgctgctacgagcaggcctggtacgccaagctgggcggcgtggtgagcatcaagttcctgatggagagactgcccctgacctgggtgctgcagaaccagcagaccttcctgaaggccctgctgttcgtgatgatggacctgaccggcgaggtgagcaacggcgccgtggccatggccaagaccaccctggagcagctgctgatgagatgcgccacccccctgaaggacgaggagagagccgaggagatcgtggccgcccaggagaagagcttccaccacgtgacccacgacctggtgagagaggtgaccagccccaacagcaccgtgagaaagcaggccatgcacagcctgcaggtgctggcccaggtgaccggcaagagcgtgaccgtgatcatggagccccacaaggaggtgctgcaggacatggtgccccccaagaagcacctgctgagacaccagcccgccaacgcccagatcggcctgatggagggcaacaccttctgcaccaccctgcagcccagactgttcaccatggacctgaacgtggtggagcacaaggtgttctacaccgagctgctgaacctgtgcgaggccgaggacagcgccctgaccaagctgccctgctacaagagcctgcccagcctggtgcccctgagaatcgccgccctgaacgccctggccgcctgcaactacctgccccagagcagagagaagatcatcgccgccctgttcaaggccctgaacagcaccaacagcgagctgcaggaggccggcgaggcctgcatgagaaagttcctggagggcgccaccatcgaggtggaccagatccacacccacatgagacccctgctgatgatgctgggcgactacagaagcctgaccctgaacgtggtgaacagactgaccagcgtgaccagactgttccccaacagcttcaacgacaagttctgcgaccagatgatgcagcacctgagaaagtggatggaggtggtggtgatcacccacaagggcggccagagaagcgacggcaacgagatgaagatctgcagcgccatcatcaacctgttccacctgatccccgccgccccccagaccctggtgaagcccctgctggaggtggtgatgaagaccgagagagccatgctgatcgaggccggcagccccttcagagagcccctgatcaagttcctgaccagacaccccagccagaccgtggagctgttcatgatggaggccaccctgaacgacccccagtggagcagaatgttcatgagcttcctgaagcacaaggacgccagacccctgagagacgtgctggccgccaaccccaacagattcatcaccctgctgctgcccggcggcgcccagaccgccgtgagacccggcagccccagcaccagcaccatgagactggacctgcagttccaggccatcaagatcatcagcatcatcgtgaagaacgacgacagctggctggccagccagcacagcctggtgagccagctgagaagagtgtgggtgagcgagaacttccaggagagacacagaaaggagaacatggccgccaccaactggaaggagcccaagctgctggcctactgcctgctgaactactgcaagagaaactacggcgacatcgagctgctgttccagctgctgagagccttcaccggcagattcctgtgcaacatgaccttcctgaaggagtacatggaggaggagatccccaagaactacagcatcgcccagaagagagccctgttcttcagattcgtggacttcaacgaccccaacttcggcgacgagctgaaggccaaggtgctgcagcacatcctgaaccccgccttcctgtacagcttcgagaagggcgagggcgagcagctgctgggcccccccaaccccgagggcgacaaccccgagagcatcaccagcgtgttcatcaccaaggtgctggaccccgagaagcaggccgacatgctggacagcctgagaatctacctgctgcagtacgccaccctgctggtggagcacgccccccaccacatccacgacaacaacaagaacagaaacagcaagctgagaagactgatgaccttcgcctggccctgcctgctgagcaaggcctgcgtggaccccgcctgcaagtacagcggccacctgctgctggcccacatcatcgccaagttcgccatccacaagaagatcgtgctgcaggtgttccacagcctgctgaaggcccacgccatggaggccagagccatcgtgagacaggccatggccatcctgacccccgccgtgcccgccagaatggaggacggccaccagatgctgacccactggaccagaaagatcatcgtggaggagggccacaccgtgccccagctggtgcacatcctgcacctgatcgtgcagcacttcaaggtgtactaccccgtgagacaccacctggtgcagcacatggtgagcgccatgcagagactgggcttcacccccagcgtgaccatcgagcagagaagactggccgtggacctgagcgaggtggtgatcaagtgggagctgcagagaatcaaggaccagcagcccgacagcgacatggaccccaacagcagcggcgagggcgtgaacagcgtgagcagcagcatcaagagaggcctgagcgtggacagcgcccaggaggtgaagagattcagaaccgccaccggcgccatcagcgccgtgttcggcagaagccagagcctgcccggcgccgacagcctgctggccaagcccatcgacaagcagcacaccgacaccgtggtgaacttcctgatcagagtggcctgccaggtgaacgacaacaccaacaccgccggcagccccggcgaggtgctgagcagaagatgcgtgaacctgctgaagaccgccctgagacccgacatgtggcccaagagcgagctgaagctgcagtggttcgacaagctgctgatgaccgtggagcagcccaaccaggtgaactacggcaacatctgcaccggcctggaggtgctgagcttcctgctgaccgtgctgcagagccccgccatcctgagcagcttcaagcccctgcagagaggcatcgccgcctgcatgacctgcggcaacaccaaggtgctgagagccgtgcacagcctgctgagcagactgatgagcatcttccccaccgagcccagcaccagcagcgtggccagcaagtacgaggagctggagtgcctgtacgccgccgtgggcaaggtgatctacgagggcctgaccaactacgagaaggccaccaacgccaaccccagccagctgttcggcaccctgatgatcctgaagagcgcctgcagcaacaaccccagctacatcgacagactgatcagcgtgttcatgagaagcctgcagaagatggtgagagagcacctgaacccccaggccgccagcggcagcaccgaggccaccagcggcaccagcgagctggtgatgctgagcctggagctggtgaagaccagactggccgtgatgagcatggagatgagaaagaacttcatccaggccatcctgaccagcctgatcgagaagagccccgacgccaagatcctgagagccgtggtgaagatcgtggaggagtgggtgaagaacaacagccccatggccgccaaccagacccccaccctgagagagaagagcatcctgctggtgaagatgatgacctacatcgagaagagattccccgaggacctggagctgaacgcccagttcctggacctggtgaactacgtgtacagagacgagaccctgagcggcagcgagctgaccgccaagctggagcccgccttcctgagcggcctgagatgcgcccagcccctgatcagagccaagttcttcgaggtgttcgacaacagcatgaagagaagagtgtacgagagactgctgtacgtgacctgcagccagaactgggaggccatgggcaaccacttctggatcaagcagtgcatcgagctgctgctggccgtgtgcgagaagagcacccccatcggcaccagctgccagggcgccatgctgcccagcatcaccaacgtgatcaacctggccgacagccacgacagagccgccttcgccatggtgacccacgtgaagcaggagcccagagagagagagaacagcgagagcaaggaggaggacgtggagatcgacatcgagctggcccccggcgaccagaccagcacccccaagaccaaggagctgagcgagaaggacatcggcaaccagctgcacatgctgaccaacagacacgacaagttcctggacaccctgagagaggtgaagaccggcgccctgctgagcgccttcgtgcagctgtgccacatcagcaccaccctggccgagaagacctgggtgcagctgttccccagactgtggaagatcctgagcgacagacagcagcacgccctggccggcgagatcagccccttcctgtgcagcggcagccaccaggtgcagagagactgccagcccagcgccctgaactgcttcgtggaggccatgagccagtgcgtgccccccatccccatcagaccctgcgtgctgaagtacctgggcaagacccacaacctgtggttcagaagcaccctgatgctggagcaccaggccttcgagaagggcctgagcctgcagatcaagcccaagcagaccaccgagttctacgagcaggagagcatcacccccccccagcaggagatcctggacagcctggccgagctgtacagcctgctgcaggaggaggacatgtgggccggcctgtggcagaagagatgcaagtacagcgagaccgccaccgccatcgcctacgagcagcacggcttcttcgagcaggcccaggagagctacgagaaggccatggacaaggccaagaaggagcacgagagaagcaacgccagccccgccatcttccccgagtaccagctgtgggaggaccactggatcagatgcagcaaggagctgaaccagtgggaggccctgaccgagtacggccagagcaagggccacatcaacccctacctggtgctggagtgcgcctggagagtgagcaactggaccgccatgaaggaggccctggtgcaggtggaggtgagctgccccaaggagatggcctggaaggtgaacatgtacagaggctacctggccatctgccaccccgaggagcagcagctgagcttcatcgagagactggtggagatggccagcagcctggccatcagagagtggagaagactgccccacgtggtgagccacgtgcacacccccctgctgcaggccgcccagcagatcatcgagctgcaggaggccgcccagatcaacgccggcctgcagcccaccaacctgggcagaaacaacagcctgcacgacatgaagaccgtggtgaagacctggagaaacagactgcccatcgtgagcgacgacctgagccactggagcagcatcttcatgtggagacagcaccactaccaggccatcgtgaccgcctacgagaacagcagccagcacgaccccagcagcaacaacgccatgctgggcgtgcacgccagcgccagcgccatcatccagtacggcaagatcgccagaaagcagggcctggtgaacgtggccctggacatcctgagcagaatccacaccatccccaccgtgcccatcgtggactgcttccagaagatcagacagcaggtgaagtgctacctgcagctggccggcgtgatgggcaagaacgagtgcatgcagggcctggaggtgatcgagagcaccaacctgaagtacttcaccaaggagatgaccgccgagttctacgccctgaagggcatgttcctggcccagatcaacaagagcgaggaggccaacaaggccttcagcgccgccgtgcagatgcacgacgtgctggtgaaggcctgggccatgtggggcgactacctggagaacatcttcgtgaaggagagacagctgcacctgggcgtgagcgccatcacctgctacctgcacgcctgcagacaccagaacgagagcaagagcagaaagtacctggccaaggtgctgtggctgctgagcttcgacgacgacaagaacaccctggccgacgccgtggacaagtactgcatcggcgtgccccccatccagtggctggcctggatcccccagctgctgacctgcctggtgggcagcgagggcaagctgctgctgaacctgatcagccaggtgggcagagtgtacccccaggccgtgtacttccccatcagaaccctgtacctgaccctgaagatcgagcagagagagagatacaagagcgaccccggccccatcagagccaccgcccccatgtggagatgcagcagaatcatgcacatgcagagagagctgcaccccaccctgctgagcagcctggagggcatcgtggaccagatggtgtggttcagagagaactggcacgaggaggtgctgagacagctgcagcagggcctggccaagtgctacagcgtggccttcgagaagagcggcgccgtgagcgacgccaagatcaccccccacaccctgaacttcgtgaagaagctggtgagcaccttcggcgtgggcctggagaacgtgagcaacgtgagcaccatgttcagcagcgccgccagcgagagcctggccagaagagcccaggccaccgcccaggaccccgtgttccagaagctgaagggccagttcaccaccgacttcgacttcagcgtgcccggcagcatgaagctgcacaacctgatcagcaagctgaagaagtggatcaagatcctggaggccaagaccaagcagctgcccaagttcttcctgatcgaggagaagtgcagattcctgagcaacttcagcgcccagaccgccgaggtggagatccccggcgagttcctgatgcccaagcccacccactactacatcaagatcgccagattcatgcccagagtggagatcgtgcagaagcacaacaccgccgccagaagactgtacatcagaggccacaacggcaagatctacccctacctggtgatgaacgacgcctgcctgaccgagagcagaagagaggagagagtgctgcagctgctgagactgctgaacccctgcctggagaagagaaaggagaccaccaagagacacctgttcttcaccgtgcccagagtggtggccgtgagcccccagatgagactggtggaggacaaccccagcagcctgagcctggtggagatctacaagcagagatgcgccaagaagggcatcgagcacgacaaccccatcagcagatactacgacagactggccaccgtgcaggccagaggcacccaggccagccaccaggtgctgagagacatcctgaaggaggtgcagagcaacatggtgcccagaagcatgctgaaggagtgggccctgcacaccttccccaacgccaccgactactggaccttcagaaagatgttcaccatccagctggccctgatcggcttcgccgagttcgtgctgcacctgaacagactgaaccccgagatgctgcagatcgcccaggacaccggcaagctgaacgtggcctacttcagattcgacatcaacgacgccaccggcgacctggacgccaacagacccgtgcccttcagactgacccccaacatcagcgagttcctgaccaccatcggcgtgagcggccccctgaccgccagcatgatcgccgtggccagatgcttcgcccagcccaacttcaaggtggacggcatcctgaagaccgtgctgagagacgagatcatcgcctggcacaagaagacccaggaggacaccagcagccccctgagcgccgccggccagcccgagaacatggacagccagcagctggtgagcctggtgcagaaggccgtgaccgccatcatgaccagactgcacaacctggcccagttcgagggcggcgagagcaaggtgaacaccctggtggccgccgccaacagcctggacaacctgtgcagaatggaccccgcctggcacccctggctgtag

SEQ ID NO: 102897 - DNA, 11580 bp, Artificial Sequence
  Description of Artificial Sequence: Synthetic coding sequence
atggccttcgtggccacccagggcgccaccgtggtggaccagaccaccctgatgaagaagtacctgcagttcgtggccgccctgaccgacgtgaacacccccgacgagaccaagctgaagatgatgcaggaggtgagcgagaacttcgagaacgtgaccagcagcccccagtacagcaccttcctggagcacatcatccccagattcctgaccttcctgcaggacggcgaggtgcagttcctgcaggagaagcccgcccagcagctgagaaagctggtgctggagatcatccacagaatccccaccaacgagcacctgagaccccacaccaagaacgtgctgagcgtgatgttcagattcctggagaccgagaacgaggagaacgtgctgatctgcctgagaatcatcatcgagctgcacaagcagttcagaccccccatcacccaggagatccaccacttcctggacttcgtgaagcagatctacaaggagctgcccaaggtggtgaacagatacttcgagaacccccaggtgatccccgagaacaccgtgcccccccccgagatggtgggcatgatcaccaccatcgccgtgaaggtgaaccccgagagagaggacagcgagaccagaacccacagcatcatccccagaggcagcctgagcctgaaggtgctggccgagctgcccatcatcgtggtgctgatgtaccagctgtacaagctgaacatccacaacgtggtggccgagttcgtgcccctgatcatgaacaccatcgccatccaggtgagcgcccaggccagacagcacaagctgtacaacaaggagctgtacgccgacttcatcgccgcccagatcaagaccctgagcttcctggcctacatcatcagaatctaccaggagctggtgaccaagtacagccagcagatggtgaagggcatgctgcagctgctgagcaactgccccgccgagaccgcccacctgagaaaggagctgctgatcgccgccaagcacatcctgaccaccgagctgagaaaccagttcatcccctgcatggacaagctgttcgacgagagcatcctgatcggcagcggctacaccgccagagagaccctgagacccctggcctacagcaccctggccgacctggtgcaccacgtgagacagcacctgcccctgagcgacctgagcctggccgtgcagctgttcgccaagaacatcgacgacgagagcctgcccagcagcatccagaccatgagctgcaagctgctgctgaacctggtggactgcatcagaagcaagagcgagcaggagagcggcaacggcagagacgtgctgatgagaatgctggaggtgttcgtgctgaagttccacaccatcgccagataccagctgagcgccatcttcaagaagtgcaagccccagagcgagctgggcgccgtggaggccgccctgcccggcgtgcccaccgcccccgccgcccccggccccgcccccagccccgcccccgtgcccgccccccccccccccccccccccccccccccccgccacccccgtgacccccgcccccgtgccccccttcgagaagcagggcgagaaggacaaggaggacaagcagaccttccaggtgaccgactgcagaagcctggtgaagaccctggtgtgcggcgtgaagaccatcacctggggcatcaccagctgcaaggcccccggcgaggcccagttcatccccaacaagcagctgcagcccaaggagacccagatctacatcaagctggtgaagtacgccatgcaggccctggacatctaccaggtgcagatcgccggcaacggccagacctacatcagagtggccaactgccagaccgtgagaatgaaggaggagaaggaggtgctggagcacttcgccggcgtgttcaccatgatgaaccccctgaccttcaaggagatcttccagaccaccgtgccctacatggtggagagaatcagcaagaactacgccctgcagatcgtggccaacagcttcctggccaaccccaccaccagcgccctgttcgccaccatcctggtggagtacctgctggacagactgcccgagatgggcagcaacgtggagctgagcaacctgtacctgaagctgttcaagctggtgttcggcagcgtgagcctgttcgccgccgagaacgagcagatgctgaagccccacctgcacaagatcgtgaacagcagcatggagctggcccagaccgccaaggagccctacaactacttcctgctgctgagagccctgttcagaagcatcggcggcggcagccacgacctgctgtaccaggagttcctgcccctgctgcccaacctgctgcagggcctgaacatgctgcagagcggcctgcacaagcagcacatgaaggacctgttcgtggagctgtgcctgaccgtgcccgtgagactgagcagcctgctgccctacctgcccatgctgatggaccccctggtgagcgccctgaacggcagccagaccctggtgagccagggcctgagaaccctggagctgtgcgtggacaacctgcagcccgacttcctgtacgaccacatccagcccgtgagagccgagctgatgcaggccctgtggagaaccctgagaaaccccgccgacagcatcagccacgtggcctacagagtgctgggcaagttcggcggcagcaacagaaagatgctgaaggagagccagaagctgcactacgtggtgaccgaggtgcagggccccagcatcaccgtggagttcagcgactgcaaggccagcctgcagctgcccatggagaaggccatcgagaccgccctggactgcctgaagagcgccaacaccgagccctactacagaagacaggcctgggaggtgatcaagtgcttcctggtggccatgatgagcctggaggacaacaagcacgccctgtaccagctgctggcccaccccaacttcaccgagaagaccatccccaacgtgatcatcagccacagatacaaggcccaggacacccccgccagaaagaccttcgagcaggccctgaccggcgccttcatgagcgccgtgatcaaggacctgagacccagcgccctgcccttcgtggccagcctgatcagacactacaccatggtggccgtggcccagcagtgcggccccttcctgctgccctgctaccaggtgggcagccagcccagcaccgccatgttccacagcgaggagaacggcagcaagggcatggaccccctggtgctgatcgacgccatcgccatctgcatggcctacgaggagaaggagctgtgcaagatcggcgaggtggccctggccgtgatcttcgacgtggccagcatcatcctgggcagcaaggagagagcctgccagctgcccctgttcagctacatcgtggagagactgtgcgcctgctgctacgagcaggcctggtacgccaagctgggcggcgtggtgagcatcaagttcctgatggagagactgcccctgacctgggtgctgcagaaccagcagaccttcctgaaggccctgctgttcgtgatgatggacctgaccggcgaggtgagcaacggcgccgtggccatggccaagaccaccctggagcagctgctgatgagatgcgccacccccctgaaggacgaggagagagccgaggagatcgtggccgcccaggagaagagcttccaccacgtgacccacgacctggtgagagaggtgaccagccccaacagcaccgtgagaaagcaggccatgcacagcctgcaggtgctggcccaggtgaccggcaagagcgtgaccgtgatcatggagccccacaaggaggtgctgcaggacatggtgccccccaagaagcacctgctgagacaccagcccgccaacgcccagatcggcctgatggagggcaacaccttctgcaccaccctgcagcccagactgttcaccatggacctgaacgtggtggagcacaaggtgttctacaccgagctgctgaacctgtgcgaggccgaggacagcgccctgaccaagctgccctgctacaagagcctgcccagcctggtgcccctgagaatcgccgccctgaacgccctggccgcctgcaactacctgccccagagcagagagaagatcatcgccgccctgttcaaggccctgaacagcaccaacagcgagctgcaggaggccggcgaggcctgcatgagaaagttcctggagggcgccaccatcgaggtggaccagatccacacccacatgagacccctgctgatgatgctgggcgactacagaagcctgaccctgaacgtggtgaacagactgaccagcgtgaccagactgttccccaacagcttcaacgacaagttctgcgaccagatgatgcagcacctgagaaagtggatggaggtggtggtgatcacccacaagggcggccagagaagcgacggcaacgagagcatcagcgagtgcggcagatgccccctgagccccttctgccagttcgaggagatgaagatctgcagcgccatcatcaacctgttccacctgatccccgccgccccccagaccctggtgaagcccctgctggaggtggtgatgaagaccgagagagccatgctgatcgaggccggcagccccttcagagagcccctgatcaagttcctgaccagacaccccagccagaccgtggagctgttcatgatggaggccaccctgaacgacccccagtggagcagaatgttcatgagcttcctgaagcacaaggacgccagacccctgagagacgtgctggccgccaaccccaacagattcatcaccctgctgctgcccggcggcgcccagaccgccgtgagacccggcagccccagcaccagcaccatgagactggacctgcagttccaggccatcaagatcatcagcatcatcgtgaagaacgacgacagctggctggccagccagcacagcctggtgagccagctgagaagagtgtgggtgagcgagaacttccaggagagacacagaaaggagaacatggccgccaccaactggaaggagcccaagctgctggcctactgcctgctgaactactgcaagagaaactacggcgacatcgagctgctgttccagctgctgagagccttcaccggcagattcctgtgcaacatgaccttcctgaaggagtacatggaggaggagatccccaagaactacagcatcgcccagaagagagccctgttcttcagattcgtggacttcaacgaccccaacttcggcgacgagctgaaggccaaggtgctgcagcacatcctgaaccccgccttcctgtacagcttcgagaagggcgagggcgagcagctgctgggcccccccaaccccgagggcgacaaccccgagagcatcaccagcgtgttcatcaccaaggtgctggaccccgagaagcaggccgacatgctggacagcctgagaatctacctgctgcagtacgccaccctgctggtggagcacgccccccaccacatccacgacaacaacaagaacagaaacagcaagctgagaagactgatgaccttcgcctggccctgcctgctgagcaaggcctgcgtggaccccgcctgcaagtacagcggccacctgctgctggcccacatcatcgccaagttcgccatccacaagaagatcgtgctgcaggtgttccacagcctgctgaaggcccacgccatggaggccagagccatcgtgagacaggccatggccatcctgacccccgccgtgcccgccagaatggaggacggccaccagatgctgacccactggaccagaaagatcatcgtggaggagggccacaccgtgccccagctggtgcacatcctgcacctgatcgtgcagcacttcaaggtgtactaccccgtgagacaccacctggtgcagcacatggtgagcgccatgcagagactgggcttcacccccagcgtgaccatcgagcagagaagactggccgtggacctgagcgaggtggtgatcaagtgggagctgcagagaatcaaggaccagcagcccgacagcgacatggaccccaacagcagcggcgagggcgtgaacagcgtgagcagcagcatcaagagaggcctgagcgtggacagcgcccaggaggtgaagagattcagaaccgccaccggcgccatcagcgccgtgttcggcagaagccagagcctgcccggcgccgacagcctgctggccaagcccatcgacaagcagcacaccgacaccgtggtgaacttcctgatcagagtggcctgccaggtgaacgacaacaccaacaccgccggcagccccggcgaggtgctgagcagaagatgcgtgaacctgctgaagaccgccctgagacccgacatgtggcccaagagcgagctgaagctgcagtggttcgacaagctgctgatgaccgtggagcagcccaaccaggtgaactacggcaacatctgcaccggcctggaggtgctgagcttcctgctgaccgtgctgcagagccccgccatcctgagcagcttcaagcccctgcagagaggcatcgccgcctgcatgacctgcggcaacaccaaggtgctgagagccgtgcacagcctgctgagcagactgatgagcatcttccccaccgagcccagcaccagcagcgtggccagcaagtacgaggagctggagtgcctgtacgccgccgtgggcaaggtgatctacgagggcctgaccaactacgagaaggccaccaacgccaaccccagccagctgttcggcaccctgatgatcctgaagagcgcctgcagcaacaaccccagctacatcgacagactgatcagcgtgttcatgagaagcctgcagaagatggtgagagagcacctgaacccccaggccgccagcggcagcaccgaggccaccagcggcaccagcgagctggtgatgctgagcctggagctggtgaagaccagactggccgtgatgagcatggagatgagaaagaacttcatccaggccatcctgaccagcctgatcgagaagagccccgacgccaagatcctgagagccgtggtgaagatcgtggaggagtgggtgaagaacaacagccccatggccgccaaccagacccccaccctgagagagaagagcatcctgctggtgaagatgatgacctacatcgagaagagattccccgaggacctggagctgaacgcccagttcctggacctggtgaactacgtgtacagagacgagaccctgagcggcagcgagctgaccgccaagctggagcccgccttcctgagcggcctgagatgcgcccagcccctgatcagagccaagttcttcgaggtgttcgacaacagcatgaagagaagagtgtacgagagactgctgtacgtgacctgcagccagaactgggaggccatgggcaaccacttctggatcaagcagtgcatcgagctgctgctggccgtgtgcgagaagagcacccccatcggcaccagctgccagggcgccatgctgcccagcatcaccaacgtgatcaacctggccgacagccacgacagagccgccttcgccatggtgacccacgtgaagcaggagcccagagagagagagaacagcgagagcaaggaggaggacgtggagatcgacatcgagctggcccccggcgaccagaccagcacccccaagaccaaggagctgagcgagaaggacatcggcaaccagctgcacatgctgaccaacagacacgacaagttcctggacaccctgagagaggtgaagaccggcgccctgctgagcgccttcgtgcagctgtgccacatcagcaccaccctggccgagaagacctgggtgcagctgttccccagactgtggaagatcctgagcgacagacagcagcacgccctggccggcgagatcagccccttcctgtgcagcggcagccaccaggtgcagagagactgccagcccagcgccctgaactgcttcgtggaggccatgagccagtgcgtgccccccatccccatcagaccctgcgtgctgaagtacctgggcaagacccacaacctgtggttcagaagcaccctgatgctggagcaccaggccttcgagaagggcctgagcctgcagatcaagcccaagcagaccaccgagttctacgagcaggagagcatcacccccccccagcaggagatcctggacagcctggccgagctgtacagcctgctgcaggaggaggacatgtgggccggcctgtggcagaagagatgcaagtacagcgagaccgccaccgccatcgcctacgagcagcacggcttcttcgagcaggcccaggagagctacgagaaggccatggacaaggccaagaaggagcacgagagaagcaacgccagccccgccatcttccccgagtaccagctgtgggaggaccactggatcagatgcagcaaggagctgaaccagtgggaggccctgaccgagtacggccagagcaagggccacatcaacccctacctggtgctggagtgcgcctggagagtgagcaactggaccgccatgaaggaggccctggtgcaggtggaggtgagctgccccaaggagatggcctggaaggtgaacatgtacagaggctacctggccatctgccaccccgaggagcagcagctgagcttcatcgagagactggtggagatggccagcagcctggccatcagagagtggagaagactgccccacgtggtgagccacgtgcacacccccctgctgcaggccgcccagcagatcatcgagctgcaggaggccgcccagatcaacgccggcctgcagcccaccaacctgggcagaaacaacagcctgcacgacatgaagaccgtggtgaagacctggagaaacagactgcccatcgtgagcgacgacctgagccactggagcagcatcttcatgtggagacagcaccactaccagggcaagcccacctggagcggcatgcacagcagcagcatcgtgaccgcctacgagaacagcagccagcacgaccccagcagcaacaacgccatgctgggcgtgcacgccagcgccagcgccatcatccagtacggcaagatcgccagaaagcagggcctggtgaacgtggccctggacatcctgagcagaatccacaccatccccaccgtgcccatcgtggactgcttccagaagatcagacagcaggtgaagtgctacctgcagctggccggcgtgatgggcaagaacgagtgcatgcagggcctggaggtgatcgagagcaccaacctgaagtacttcaccaaggagatgaccgccgagttctacgccctgaagggcatgttcctggcccagatcaacaagagcgaggaggccaacaaggccttcagcgccgccgtgcagatgcacgacgtgctggtgaaggcctgggccatgtggggcgactacctggagaacatcttcgtgaaggagagacagctgcacctgggcgtgagcgccatcacctgctacctgcacgcctgcagacaccagaacgagagcaagagcagaaagtacctggccaaggtgctgtggctgctgagcttcgacgacgacaagaacaccctggccgacgccgtggacaagtactgcatcggcgtgccccccatccagtggctggcctggatcccccagctgctgacctgcctggtgggcagcgagggcaagctgctgctgaacctgatcagccaggtgggcagagtgtacccccaggccgtgtacttccccatcagaaccctgtacctgaccctgaagatcgagcagagagagagatacaagagcgaccccggccccatcagagccaccgcccccatgtggagatgcagcagaatcatgcacatgcagagagagctgcaccccaccctgctgagcagcctggagggcatcgtggaccagatggtgtggttcagagagaactggcacgaggaggtgctgagacagctgcagcagggcctggccaagtgctacagcgtggccttcgagaagagcggcgccgtgagcgacgccaagatcaccccccacaccctgaacttcgtgaagaagctggtgagcaccttcggcgtgggcctggagaacgtgagcaacgtgagcaccatgttcagcagcgccgccagcgagagcctggccagaagagcccaggccaccgcccaggaccccgtgttccagaagctgaagggccagttcaccaccgacttcgacttcagcgtgcccggcagcatgaagctgcacaacctgatcagcaagctgaagaagtggatcaagatcctggaggccaagaccaagcagctgcccaagttcttcctgatcgaggagaagtgcagattcctgagcaacttcagcgcccagaccgccgaggtggagatccccggcgagttcctgatgcccaagcccacccactactacatcaagatcgccagattcatgcccagagtggagatcgtgcagaagcacaacaccgccgccagaagactgtacatcagaggccacaacggcaagatctacccctacctggtgatgaacgacgcctgcctgaccgagagcagaagagaggagagagtgctgcagctgctgagactgctgaacccctgcctggagaagagaaaggagaccaccaagagacacctgttcttcaccgtgcccagagtggtggccgtgagcccccagatgagactggtggaggacaaccccagcagcctgagcctggtggagatctacaagcagagatgcgccaagaagggcatcgagcacgacaaccccatcagcagatactacgacagactggccaccgtgcaggccagaggcacccaggccagccaccaggtgctgagagacatcctgaaggaggtgcagagcaacatggtgcccagaagcatgctgaaggagtgggccctgcacaccttccccaacgccaccgactactggaccttcagaaagatgttcaccatccagctggccctgatcggcttcgccgagttcgtgctgcacctgaacagactgaaccccgagatgctgcagatcgcccaggacaccggcaagctgaacgtggcctacttcagattcgacatcaacgacgccaccggcgacctggacgccaacagacccgtgcccttcagactgacccccaacatcagcgagttcctgaccaccatcggcgtgagcggccccctgaccgccagcatgatcgccgtggccagatgcttcgcccagcccaacttcaaggtggacggcatcctgaagaccgtgctgagagacgagatcatcgcctggcacaagaagacccaggaggacaccagcagccccctgagcgccgccggccagcccgagaacatggacagccagcagctggtgagcctggtgcagaaggccgtgaccgccatcatgaccagactgcacaacctggcccagttcgagggcggcgagagcaaggtgaacaccctggtggccgccgccaacagcctggacaacctgtgcagaatggaccccgcctggcacccctggctgtag

SEQ ID NO: 102898 - DNA, 216 bp, Artificial Sequence
  Description of Artificial Sequence: Synthetic coding sequence
atggccttcgtggccacccagggcgccaccgtggtggaccagaccaccctgatgaagaagtacctgcagttcgtggccgccctgaccgacgtgaacacccccgacgagaccaagctgaagatgatgcaggaggtgagcgagaacttcgagaacgtgaccagcagcccccagtacagcaccttcctggagcacatcatccccagattcctgacctag

SEQ ID NO: 102899 - DNA, 117 bp, Artificial Sequence
  Description of Artificial Sequence: Synthetic coding sequence
atgagcgacagcggcgagcagaactacggcgagagagtgaacgtggaggagggcaagtgcggcagcagacacctgaccagcttcatcaacgagtacctgaagctgagaaacaagtag

SEQ ID NO: 102900 - DNA, 567 bp, Artificial Sequence
  Description of Artificial Sequence: Synthetic coding sequence
atgagcaccagaagaagacacgtgggcaacagagccaaccccgaccccaactgctgcctgggcgtgttcggcctgagcctgtacaccaccgagagagacctgagagaggtgttcagcaagtacggccccatcgccgacgtgagcatcgtgtacgaccagcagagcagaagaagcagaggcttcgccttcgtgtacttcgagaacgtggacgacgccaaggaggccaaggagagagccaacggcatggagctggacggcagaagaatcagagtggacttcagcatcaccaagagaccccacacccccacccccggcatctacatgggcagacccacctacggcagcagcagaagaagagactactacgacagaggctacgacagaggctacgacgacagagactactacagcagaagctacagaggcggcggcggcggcggcggcggctggagagccgcccaggacagagaccagatctacagaagaagaagccccagcccctactacagcagaggcggctacagaagcagaagcagaagcagaagctacagccccagaagatactag

SEQ ID NO: 102901 - DNA, 867 bp, Artificial Sequence
  Description of Artificial Sequence: Synthetic coding sequence
atgagcgacagcggcgagcagaactacggcgagagagagagcagaagcgccagcagaagcggcagcgcccacggcagcggcaagagcgccagacacacccccgccagaagcagaagcaaggaggacagcagaagaagcagaagcaagagcagaagcagaagcgagagcagaagcagaagcagaagaagcagcagaagacactacaccagaagcagaagcagaagcagaagccacagaagaagcagaagcagaagctacagcagagactacagaagaagacacagccacagccacagccccatgagcaccagaagaagacacgtgggcaacagagccaaccccgaccccaactgctgcctgggcgtgttcggcctgagcctgtacaccaccgagagagacctgagagaggtgttcagcaagtacggccccatcgccgacgtgagcatcgtgtacgaccagcagagcagaagaagcagaggcttcgccttcgtgtacttcgagaacgtggacgacgccaaggaggccaaggagagagccaacggcatggagctggacggcagaagaatcagagtggacttcagcatcaccaagagaccccacacccccacccccggcatctacatgggcagacccacctacggcagcagcagaagaagagactactacgacagaggctacgacagaggctacgacgacagagactactacagcagaagctacagaggcggcggcggcggcggcggcggctggagagccgcccaggacagagaccagatctacagaagaagaagccccagcccctactacagcagaggcggctacagaagcagaagcagaagcagaagctacagccccagaagatactag

SEQ ID NO: 102902 - DNA, 483 bp, Artificial Sequence
  Description of Artificial Sequence: Synthetic coding sequence
atggtgcccagcgccggccagctggccctgttcgccctgggcatcgtgctggccgcctgccaggccctggagaacagcaccagccccctgagcgccgacccccccgtggccgccgccgtggtgagccacttcaacgactgccccgacagccacacccagttctgcttccacggcacctgcagattcctggtgcaggaggacaagcccgcctgcgtgtgccacagcggctacgtgggcgccagatgcgagcacgccgacctgctggccgtggtggccgccagccagaagaagcaggccatcaccgccctggtggtggtgagcatcgtggccctggccgtgctgatcatcacctgcgtgctgatccactgctgccaggtgagaaagcactgcgagtggtgcagagccctgatctgcagacacgagaagcccagcgccctgctgaagggcagaaccgcctgctgccacagcgagaccgtggtgtag

SEQ ID NO: 102903 - DNA, 480 bp, Artificial Sequence
  Description of Artificial Sequence: Synthetic coding sequence
atggtgcccagcgccggccagctggccctgttcgccctgggcatcgtgctggccgcctgccaggccctggagaacagcaccagccccctgagcgacccccccgtggccgccgccgtggtgagccacttcaacgactgccccgacagccacacccagttctgcttccacggcacctgcagattcctggtgcaggaggacaagcccgcctgcgtgtgccacagcggctacgtgggcgccagatgcgagcacgccgacctgctggccgtggtggccgccagccagaagaagcaggccatcaccgccctggtggtggtgagcatcgtggccctggccgtgctgatcatcacctgcgtgctgatccactgctgccaggtgagaaagcactgcgagtggtgcagagccctgatctgcagacacgagaagcccagcgccctgctgaagggcagaaccgcctgctgccacagcgagaccgtggtgtag

SEQ ID NO: 102904 - DNA, 2583 bp, Artificial Sequence
  Description of Artificial Sequence: Synthetic coding sequence
atgatgagcatcaaggccttcaccctggtgagcgccgtggagagagagctgctgatgggcgacaaggagagagtgaacatcgagtgcgtggagtgctgcggcagagacctgtacgtgggcaccaacgactgcttcgtgtaccacttcctgctggaggagagacccgtgcccgccggccccgccaccttcaccgccaccaagcagctgcagagacacctgggcttcaagaagcccgtgaacgagctgagagccgccagcgccctgaacagactgctggtgctgtgcgacaacagcatcagcctggtgaacatgctgaacctggagcccgtgcccagcggcgccagaatcaagggcgccgccaccttcgccctgaacgagaaccccgtgagcggcgaccccttctgcgtggaggtgtgcatcatcagcgtgaagagaagaaccatccagatgttcctggtgtacgaggacagagtgcagatcgtgaaggaggtgagcaccgccgagcagcccctggccgtggccgtggacggccacttcctgtgcctggccctgaccacccagtacatcatccacaactacagcaccggcgtgagccaggacctgttcccctactgcagcgaggagagaccccccatcgtgaagagaatcggcagacaggagttcctgctggccggccccggcggcctgggcatgttcgccaccgtggccggcatcagccagagagcccccgtgcactggagcgagaacgtgatcggcgccgccgtgagcttcccctacgtgatcgccctggacgacgagttcatcaccgtgcacagcatgctggaccagcagcagaagcagaccctgcccttcaaggagggccacatcctgcaggacttcgagggcagagtgatcgtggccaccagcaagggcgtgtacatcctggtgcccctgcccctggagaagcagatccaggacctgctggccagcagaagagtggaggaggccctggtgctggccaagggcgccagaagaaacatccccaaggagaagttccaggtgatgtacagaagaatcctgcagcaggccggcttcatccagttcgcccagctgcagttcctggaggccaaggagctgttcagaagcggccagctggacgtgagagagctgatcagcctgtaccccttcctgctgcccaccagcagcagcttcaccagaagccacccccccctgcacgagtacgccgacctgaaccagctgacccagggcgaccaggagaagatggccaagtgcaagagattcctgatgagctacctgaacgaggtgagaagcaccgaggtggccaacggctacaaggaggacatcgacaccgccctgctgaagctgtacgccgaggccgaccacgacagcctgctggacctgctggtgaccgagaacttctgcctgctgaccgacagcgccgcctggctggagaagcacaagaagtacttcgccctgggcctgctgtaccactacaacaaccaggacgccgccgccgtgcagctgtgggtgaacatcgtgaacggcgacgtgcaggacagcaccagaagcgacctgtacgagtacatcgtggacttcctgacctactgcctggacgaggagctggtgtgggcctacgccgactgggtgctgcagaagagcgaggaggtgggcgtgcaggtgttcaccaagagacccctggacgagcagcagaagaacagcttcaaccccgacgacatcatcaactgcctgaagaagtaccccaaggccctggtgaagtacctggagcacctggtgatcgacaagagactgcagaaggaggagtaccacacccacctggccgtgctgtacctggaggaggtgctgctgcagagagccagcgccagcggcaagggcgccgaggccaccgagacccaggccaagctgagaagactgctgcagaagagcgacctgtacagagtgcacttcctgctggagagactgcagggcgccggcctgcccatggagagcgccatcctgcacggcaagctgggcgagcacgagaaggccctgcacatcctggtgcacgagctgcaggacttcgccgccgccgaggactactgcctgtggtgcagcgagggcagagaccccccccacagacagcagctgttccacaccctgctggccatctacctgcacgccggccccaccgcccacgagctggccgtggccgccgtggacctgctgaacagacacgccaccgagttcgacgccgcccaggtgctgcagatgctgcccgacacctggagcgtgcagctgctgtgccccttcctgatgggcgccatgagagacagcatccacgccagaagaaccatgcaggtggccctgggcctggccagaagcgagaacctgatctacacctacgacaagatgaagctgaagggcagcagcatccagctgagcgacaagaagctgtgccagatctgccagaaccccttctgcgagcccgtgttcgtgagataccccaacggcggcctggtgcacacccactgcgccgccagcagacacaccaaccccagcagcagcagccccggcaccagaacctag

SEQ ID NO: 102905 - DNA, 2583 bp, Artificial Sequence; identical to SEQ ID NO: 102904
  Description of Artificial Sequence: Synthetic coding sequence

SEQ ID NO: 102906 - DNA, 948 bp, Artificial Sequence
  Description of Artificial Sequence: Synthetic coding sequence
atgctgatcggcagctgcagaaaggtgaagagaagcgtgcaggtgttcaccaagagacccctggacgagcagcagaagaacagcttcaaccccgacgacatcatcaactgcctgaagaagtaccccaaggccctggtgaagtacctggagcacctggtgatcgacaagagactgcagaaggaggagtaccacacccacctggccgtgctgtacctggaggaggtgctgctgcagagagccagcgccagcggcaagggcgccgaggccaccgagacccaggccaagctgagaagactgctgcagaagagcgacctgtacagagtgcacttcctgctggagagactgcagggcgccggcctgcccatggagagcgccatcctgcacggcaagctgggcgagcacgagaaggccctgcacatcctggtgcacgagctgcaggacttcgccgccgccgaggactactgcctgtggtgcagcgagggcagagaccccccccacagacagcagctgttccacaccctgctggccatctacctgcacgccggccccaccgcccacgagctggccgtggccgccgtggacctgctgaacagacacgccaccgagttcgacgccgcccaggtgctgcagatgctgcccgacacctggagcgtgcagctgctgtgccccttcctgatgggcgccatgagagacagcatccacgccagaagaaccatgcaggtggccctgggcctggccagaagcgagaacctgatctacacctacgacaagatgaagctgaagggcagcagcatccagctgagcgacaagaagctgtgccagatctgccagaaccccttctgcgagcccgtgttcgtgagataccccaacggcggcctggtgcacacccactgcgccgccagcagacacaccaaccccagcagcagcagccccggcaccagaacctag

SEQ ID NO: 102907 - DNA, 1704 bp, Artificial Sequence
  Description of Artificial Sequence: Synthetic coding sequence
atgggcagaggcctgctgagaggcctgtggcccctgcacatcgtgctgtggaccagaatcgccagcaccatccccccccacgtgcagaagagcgtgaacaacgacatgatcgtgaccgacaacaacggcgccgtgaagttcccccagctgtgcaagttctgcgacgtgagattcagcacctgcgacaaccagaagagctgcatgagcaactgcagcatcaccagcatctgcgagaagccccaggaggtgtgcgtggccgtgtggagaaagaacgacgagaacatcaccctggagaccgtgtgccacgaccccaagctgccctaccacgacttcatcctggaggacgccgccagccccaagtgcatcatgaaggagaagaagaagcccggcgagaccttcttcatgtgcagctgcagcagcgacgagtgcaacgacaacatcatcttcagcgaggagtacaacaccagcaaccccgacctgctgctggtgatcttccaggtgaccggcatcagcctgctgccccccctgggcgtggccatcagcgtgatcatcatcttctactgctacagagtgaacagacagcagaagctgagcagcacctgggagaccggcaagaccagaaagctgatggagttcagcgagcactgcgccatcatcctggaggacgacagaagcgacatcagcagcacctgcgccaacaacatcaaccacaacaccgagctgctgcccatcgagctggacaccctggtgggcaagggcagattcgccgaggtgtacaaggccaagctgaagcagaacaccagcgagcagttcgagaccgtggccgtgaagatcttcccctacgaggagtacgccagctggaagaccgagaaggacatcttcagcgacatcaacctgaagcacgagaacatcctgcagttcctgaccgccgaggagagaaagaccgagctgggcaagcagtactggctgatcaccgccttccacgccaagggcaacctgcaggagtacctgaccagacacgtgatcagctgggaggacctgagaaagctgggcagcagcctggccagaggcatcgcccacctgcacagcgaccacaccccctgcggcagacccaagatgcccatcgtgcacagagacctgaagagcagcaacatcctggtgaagaacgacctgacctgctgcctgtgcgacttcggcctgagcctgagactggaccccaccctgagcgtggacgacctggccaacagcggccaggtgggcaccgccagatacatggcccccgaggtgctggagagcagaatgaacctggagaacgtggagagcttcaagcagaccgacgtgtacagcatggccctggtgctgtgggagatgaccagcagatgcaacgccgtgggcgaggtgaaggactacgagccccccttcggcagcaaggtgagagagcacccctgcgtggagagcatgaaggacaacgtgctgagagacagaggcagacccgagatccccagcttctggctgaaccaccagggcatccagatggtgtgcgagaccctgaccgagtgctgggaccacgaccccgaggccagactgaccgcccagtgcgtggccgagagattcagcgagctggagcacctggacagactgagcggcagaagctgcagcgaggagaagatccccgaggacggcagcctgaacaccaccaagtag

SEQ ID NO: 102908 - DNA, 1779 bp, Artificial Sequence
  Description of Artificial Sequence: Synthetic coding sequence
atgggcagaggcctgctgagaggcctgtggcccctgcacatcgtgctgtggaccagaatcgccagcaccatccccccccacgtgcagaagagcgacgtggagatggaggcccagaaggacgagatcatctgccccagctgcaacagaaccgcccaccccctgagacacatcaacaacgacatgatcgtgaccgacaacaacggcgccgtgaagttcccccagctgtgcaagttctgcgacgtgagattcagcacctgcgacaaccagaagagctgcatgagcaactgcagcatcaccagcatctgcgagaagccccaggaggtgtgcgtggccgtgtggagaaagaacgacgagaacatcaccctggagaccgtgtgccacgaccccaagctgccctaccacgacttcatcctggaggacgccgccagccccaagtgcatcatgaaggagaagaagaagcccggcgagaccttcttcatgtgcagctgcagcagcgacgagtgcaacgacaacatcatcttcagcgaggagtacaacaccagcaaccccgacctgctgctggtgatcttccaggtgaccggcatcagcctgctgccccccctgggcgtggccatcagcgtgatcatcatcttctactgctacagagtgaacagacagcagaagctgagcagcacctgggagaccggcaagaccagaaagctgatggagttcagcgagcactgcgccatcatcctggaggacgacagaagcgacatcagcagcacctgcgccaacaacatcaaccacaacaccgagctgctgcccatcgagctggacaccctggtgggcaagggcagattcgccgaggtgtacaaggccaagctgaagcagaacaccagcgagcagttcgagaccgtggccgtgaagatcttcccctacgaggagtacgccagctggaagaccgagaaggacatcttcagcgacatcaacctgaagcacgagaacatcctgcagttcctgaccgccgaggagagaaagaccgagctgggcaagcagtactggctgatcaccgccttccacgccaagggcaacctgcaggagtacctgaccagacacgtgatcagctgggaggacctgagaaagctgggcagcagcctggccagaggcatcgcccacctgcacagcgaccacaccccctgcggcagacccaagatgcccatcgtgcacagagacctgaagagcagcaacatcctggtgaagaacgacctgacctgctgcctgtgcgacttcggcctgagcctgagactggaccccaccctgagcgtggacgacctggccaacagcggccaggtgggcaccgccagatacatggcccccgaggtgctggagagcagaatgaacctggagaacgtggagagcttcaagcagaccgacgtgtacagcatggccctggtgctgtgggagatgaccagcagatgcaacgccgtgggcgaggtgaaggactacgagccccccttcggcagcaaggtgagagagcacccctgcgtggagagcatgaaggacaacgtgctgagagacagaggcagacccgagatccccagcttctggctgaaccaccagggcatccagatggtgtgcgagaccctgaccgagtgctgggaccacgaccccgaggccagactgaccgcccagtgcgtggccgagagattcagcgagctggagcacctggacagactgagcggcagaagctgcagcgaggagaagatccccgaggacggcagcctgaacaccaccaagtag

SEQ ID NO: 102909 - DNA, 339 bp, Artificial Sequence
  Description of Artificial Sequence: Synthetic coding sequence
atgtgcagctgcagcagcgacgagtgcaacgacaacatcatcttcagcgagggcagatgcaagatcagacacatcggcagcaacaacagactgcagagaagcacctgccagaacaccggctgggagagcgcccacgtgatgaagacccccggcttcagagagtacaacaccagcaaccccgacctgctgctggtgatcttccaggtgaccggcatcagcctgctgccccccctgggcgtggccatcagcgtgatcatcatcttctactgctacagagtgaacagacagcagaagctgagcagcacctgggagaccggcaagaccagaaagctgatgtag

SEQ ID NO: 102910 - DNA, 1194 bp, Artificial Sequence
  Description of Artificial Sequence: Synthetic coding sequence
atgtgcagctgcagcagcgacgagtgcaacgacaacatcatcttcagcgaggagtacaacaccagcaaccccgacctgctgctggtgatcttccaggtgaccggcatcagcctgctgccccccctgggcgtggccatcagcgtgatcatcatcttctactgctacagagtgaacagacagcagaagctgagcagcacctgggagaccggcaagaccagaaagctgatggagttcagcgagcactgcgccatcatcctggaggacgacagaagcgacatcagcagcacctgcgccaacaacatcaaccacaacaccgagctgctgcccatcgagctggacaccctggtgggcaagggcagattcgccgaggtgtacaaggccaagctgaagcacgagaacatcctgcagttcctgaccgccgaggagagaaagaccgagctgggcaagcagtactggctgatcaccgccttccacgccaagggcaacctgcaggagtacctgaccagacacgtgatcagctgggaggacctgagaaagctgggcagcagcctggccagaggcatcgcccacctgcacagcgaccacaccccctgcggcagacccaagatgcccatcgtgcacagagacctgaagagcagcaacatcctggtgaagaacgacctgacctgctgcctgtgcgacttcggcctgagcctgagactggaccccaccctgagcgtggacgacctggccaacagcggccaggtgggcaccgccagatacatggcccccgaggtgctggagagcagaatgaacctggagaacgtggagagcttcaagcagaccgacgtgtacagcatggccctggtgctgtgggagatgaccagcagatgcaacgccgtgggcgaggtgaaggactacgagccccccttcggcagcaaggtgagagagcacccctgcgtggagagcatgaaggacaacgtgctgagagacagaggcagacccgagatccccagcttctggctgaaccaccagggcatccagatggtgtgcgagaccctgaccgagtgctgggaccacgaccccgaggccagactgaccgcccagtgcgtggccgagagattcagcgagctggagcacctggacagactgagcggcagaagctgcagcgaggagaagatccccgaggacggcagcctgaacaccaccaagtag

SEQ ID NO: 102911 - DNA, 2244 bp, Artificial Sequence
  Description of Artificial Sequence: Synthetic coding sequence
atggccgacgaggccgccctggccctgcagcccggcggcagccccagcgccgccggcgccgacagagaggccgccagcagccccgccggcgagcccctgagaaagagacccagaagagacggccccggcctggagagaagccccggcgagcccggcggcgccgcccccgagagagaggtgcccgccgccgccagaggctgccccggcgccgccgccgccgccctgtggagagaggccgaggccgaggccgccgccgccggcggcgagcaggaggcccaggccaccgccgccgccggcgagggcgacaacggccccggcctgcagggccccagcagagagccccccctggccgacaacctgtacgacgaggacgacgacgacgagggcgaggaggaggaggaggccgccgccgccgccatcggctacagagacaacctgctgttcggcgacgagatcatcaccaacggcttccacagctgcgagagcgacgaggaggacagagccagccacgccagcagcagcgactggacccccagacccagaatcggcccctacaccttcgtgcagcagcacctgatgatcggcaccgaccccagaaccatcctgaaggacctgctgcccgagaccatccccccccccgagctggacgacatgaccctgtggcagatcgtgatcaacatcctgagcgagccccccaagagaaagaagagaaaggacatcaacaccatcgaggacgccgtgaagctgctgcaggagtgcaagaagatcatcgtgctgaccggcgccggcgtgagcgtgagctgcggcatccccgacttcagaagcagagacggcatctacgccagactggccgtggacttccccgacctgcccgacccccaggccatgttcgacatcgagtacttcagaaaggaccccagacccttcttcaagttcgccaaggagatctaccccggccagttccagcccagcctgtgccacaagttcatcgccctgagcgacaaggagggcaagctgctgagaaactacacccagaacatcgacaccctggagcaggtggccggcatccagagaatcatccagtgccacggcagcttcgccaccgccagctgcctgatctgcaagtacaaggtggactgcgaggccgtgagaggcgacatcttcaaccaggtggtgcccagatgccccagatgccccgccgacgagcccctggccatcatgaagcccgagatcgtgttcttcggcgagaacctgcccgagcagttccacagagccatgaagtacgacaaggacgaggtggacctgctgatcgtgatcggcagcagcctgaaggtgagacccgtggccctgatccccagcagcatcccccacgaggtgccccagatcctgatcaacagagagcccctgccccacctgcacttcgacgtggagctgctgggcgactgcgacgtgatcatcaacgagctgtgccacagactgggcggcgagtacgccaagctgtgctgcaaccccgtgaagctgagcgagatcaccgagaagccccccagaacccagaaggagctggcctacctgagcgagctgccccccacccccctgcacgtgagcgaggacagcagcagccccgagagaaccagcccccccgacagcagcgtgatcgtgaccctgctggaccaggccgccaagagcaacgacgacctggacgtgagcgagagcaagggctgcatggaggagaagccccaggaggtgcagaccagcagaaacgtggagagcatcgccgagcagatggagaaccccgacctgaagaacgtgggcagcagcaccggcgagaagaacgagagaaccagcgtggccggcaccgtgagaaagtgctggcccaacagagtggccaaggagcagatcagcagaagactggacggcaaccagtacctgttcctgccccccaacagatacatcttccacggcgccgaggtgtacagcgacagcgaggacgacgtgctgagcagcagcagctgcggcagcaacagcgacagcggcacctgccagagccccagcctggaggagcccatggaggacgagagcgagatcgaggagttctacaacggcctggaggacgagcccgacgtgcccgagagagccggcggcgccggcttcggcaccgacggcgacgaccaggaggccatcaacgaggccatcagcgtgaagcaggaggtgaccgacatgaactaccccagcaacaagagctag

SEQ ID NO: 102912 - DNA, 2553 bp, Artificial Sequence
  Description of Artificial Sequence: Synthetic coding sequence
atgaccagccactacgtgatcgccatcttcgccctgatgagcagctgcctggccaccgccggccccgagcccggcgccctgtgcgagctgagccccgtgagcgccagccaccccgtgcaggccctgatggagagcttcaccgtgctgagcggctgcgccagcagaggcaccaccggcctgccccaggaggtgcacgtgctgaacctgagaaccgccggccagggccccggccagctgcagagagaggtgaccctgcacctgaaccccatcagcagcgtgcacatccaccacaagagcgtggtgttcctgctgaacagcccccaccccctggtgtggcacctgaagaccgagagactggccaccggcgtgagcagactgttcctggtgagcgagggcagcgtggtgcagttcagcagcgccaacttcagcctgaccgccgagaccgaggagagaaacttcccccacggcaacgagcacctgctgaactgggccagaaaggagtacggcgccgtgaccagcttcaccgagctgaagatcgccagaaacatctacatcaaggtgggcgaggaccaggtgttcccccccaagtgcaacatcggcaagaacttcctgagcctgaactacctggccgagtacctgcagcccaaggccgccgagggctgcgtgatgagcagccagccccagaacgaggaggtgcacatcatcgagctgatcacccccaacagcaacccctacagcgccttccaggtggacatcaccatcgacatcagacccagccaggaggacctggaggtggtgaagaacctgatcctgatcctgaagtgcaagaagagcgtgaactgggtgatcaagagcttcgacgtgaagggcagcctgaagatcatcgcccccaacagcatcggcttcggcaaggagagcgagagaagcatgaccatgaccaagagcatcagagacgacatccccagcacccagggcaacctggtgaagtgggccctggacaacggctacagccccatcaccagctacaccatggcccccgtggccaacagattccacctgagactggagaacaacgaggagatgggcgacgaggaggtgcacaccatcccccccgagctgagaatcctgctggaccccggcgccctgcccgccctgcagaacccccccatcagaggcggcgagggccagaacggcggcctgcccttccccttccccgacatcagcagaagagtgtggaacgaggagggcgaggacggcctgcccagacccaaggaccccgtgatccccagcatccagctgttccccggcctgagagagcccgaggaggtgcagggcagcgtggacatcgccctgagcgtgaagtgcgacaacgagaagatgatcgtggccgtggagaaggacagcttccaggccagcggctacagcggcatggacgtgaccctgctggaccccacctgcaaggccaagatgaacggcacccacttcgtgctggagagccccctgaacggctgcggcaccagacccagatggagcgccctggacggcgtggtgtactacaacagcatcgtgatccaggtgcccgccctgggcgacagcagcggctggcccgacggctacgaggacctggagagcggcgacaacggcttccccggcgacatggacgagggcgacgccagcctgttcaccagacccgagatcgtggtgttcaactgcagcctgcagcaggtgagaaaccccagcagcttccaggagcagccccacggcaacatcaccttcaacatggagctgtacaacaccgacctgttcctggtgcccagccagggcgtgttcagcgtgcccgagaacggccacgtgtacgtggaggtgagcgtgaccaaggccgagcaggagctgggcttcgccatccagacctgcttcatcagcccctacagcaaccccgacagaatgagccactacaccatcatcgagaacatctgccccaaggacgagagcgtgaagttctacagccccaagagagtgcacttccccatcccccaggccgacatggacaagaagagattcagcttcgtgttcaagcccgtgttcaacaccagcctgctgttcctgcagtgcgagctgaccctgtgcaccaagatggagaagcacccccagaagctgcccaagtgcgtgccccccgacgaggcctgcaccagcctggacgccagcatcatctgggccatgatgcagaacaagaagaccttcaccaagcccctggccgtgatccaccacgaggccgagagcaaggagaagggccccagcatgaaggagcccaaccccatcagcccccccatcttccacggcctggacaccctgaccgtgatgggcatcgccttcgccgccttcgtgatcggcgccctgctgaccggcgccctgtggtacatctacagccacaccggcgagaccgccggcagacagcaggtgcccaccagcccccccgccagcgagaacagcagcgccgcccacagcatcggcagcacccagagcaccccctgcagcagcagcagcaccgcctag

SEQ ID NO: 102913 - DNA, 108 bp, Artificial Sequence
  Description of Artificial Sequence: Synthetic coding sequence
atgaccagccactacgtgatcgccatcttcgccctgatgagcagctgcctggccaccgccggccccgagcccggcgccctgtgcgagctgagccccgtgagcgcctag

SEQ ID NO: 102914 - DNA, 2553 bp, Artificial Sequence; identical to SEQ ID NO: 102912
  Description of Artificial Sequence: Synthetic coding sequence

SEQ ID NO: 102915 - DNA, 2556 bp, Artificial Sequence
  Description of Artificial Sequence: Synthetic coding sequence
atgaccagccactacgtgatcgccatcttcgccctgatgagcagctgcctggccaccgccggccccgagcccggcgccctgtgcgagctgagccccgtgagcgccagccaccccgtgcaggccctgatggagagcttcaccgtgctgagcggctgcgccagcagaggcaccaccggcctgccccaggaggtgcacgtgctgaacctgagaaccgccggccagggccccggccagctgcagagagaggtgaccctgcacctgaaccccatcagcagcgtgcacatccaccacaagagcgtggtgttcctgctgaacagcccccaccccctggtgtggcacctgaagaccgagagactggccaccggcgtgagcagactgttcctggtgagcgagggcagcgtggtgcagttcagcagcgccaacttcagcctgaccgccgagaccgaggagagaaacttcccccacggcaacgagcacctgctgaactgggccagaaaggagtacggcgccgtgaccagcttcaccgagctgaagatcgccagaaacatctacatcaaggtgggcgaggaccaggtgttcccccccaagtgcaacatcggcaagaacttcctgagcctgaactacctggccgagtacctgcagcccaaggccgccgagggctgcgtgatgagcagccagccccagaacgaggaggtgcacatcatcgagctgatcacccccaacagcaacccctacagcgccttccaggtggacatcaccatcgacatcagacccagccaggaggacctggaggtggtgaagaacctgatcctgatcctgaagtgcaagaagagcgtgaactgggtgatcaagagcttcgacgtgaagggcagcctgaagatcatcgcccccaacagcatcggcttcggcaaggagagcgagagaagcatgaccatgaccaagagcatcagagacgacatccccagcacccagggcaacctggtgaagtgggccctggacaacggctacagccccatcaccagctacaccatggcccccgtggccaacagattccacctgagactggagaacaacgccgaggagatgggcgacgaggaggtgcacaccatcccccccgagctgagaatcctgctggaccccggcgccctgcccgccctgcagaacccccccatcagaggcggcgagggccagaacggcggcctgcccttccccttccccgacatcagcagaagagtgtggaacgaggagggcgaggacggcctgcccagacccaaggaccccgtgatccccagcatccagctgttccccggcctgagagagcccgaggaggtgcagggcagcgtggacatcgccctgagcgtgaagtgcgacaacgagaagatgatcgtggccgtggagaaggacagcttccaggccagcggctacagcggcatggacgtgaccctgctggaccccacctgcaaggccaagatgaacggcacccacttcgtgctggagagccccctgaacggctgcggcaccagacccagatggagcgccctggacggcgtggtgtactacaacagcatcgtgatccaggtgcccgccctgggcgacagcagcggctggcccgacggctacgaggacctggagagcggcgacaacggcttccccggcgacatggacgagggcgacgccagcctgttcaccagacccgagatcgtggtgttcaactgcagcctgcagcaggtgagaaaccccagcagcttccaggagcagccccacggcaacatcaccttcaacatggagctgtacaacaccgacctgttcctggtgcccagccagggcgtgttcagcgtgcccgagaacggccacgtgtacgtggaggtgagcgtgaccaaggccgagcaggagctgggcttcgccatccagacctgcttcatcagcccctacagcaaccccgacagaatgagccactacaccatcatcgagaacatctgccccaaggacgagagcgtgaagttctacagccccaagagagtgcacttccccatcccccaggccgacatggacaagaagagattcagcttcgtgttcaagcccgtgttcaacaccagcctgctgttcctgcagtgcgagctgaccctgtgcaccaagatggagaagcacccccagaagctgcccaagtgcgtgccccccgacgaggcctgcaccagcctggacgccagcatcatctgggccatgatgcagaacaagaagaccttcaccaagcccctggccgtgatccaccacgaggccgagagcaaggagaagggccccagcatgaaggagcccaaccccatcagcccccccatcttccacggcctggacaccctgaccgtgatgggcatcgccttcgccgccttcgtgatcggcgccctgctgaccggcgccctgtggtacatctacagccacaccggcgagaccgccggcagacagcaggtgcccaccagcccccccgccagcgagaacagcagcgccgcccacagcatcggcagcacccagagcaccccctgcagcagcagcagcaccgcctag

SEQ ID NO: 102916 - DNA, 2052 bp, Artificial Sequence
  Description of Artificial Sequence: Synthetic coding sequence
atggccctgttcgtgagactgctggccctggccctggccctggccctgggccccgccgccaccctggccggccccgccaagagcccctaccagctggtgctgcagcacagcagactgagaggcagacagcacggccccaacgtgtgcgccgtgcagaaggtgatcggcaccaacagaaagtacttcaccaactgcaagcagtggtaccagagaaagatctgcggcaagagcaccgtgatcagctacgagtgctgccccggctacgagaaggtgcccggcgagaagggctgccccgccgccctgcccctgagcaacctgtacgagaccctgggcgtggtgggcagcaccaccacccagctgtacaccgacagaaccgagaagctgagacccgagatggagggccccggcagcttcaccatcttcgcccccagcaacgaggcctgggccagcctgcccgccgaggtgctggacagcctggtgagcaacgtgaacatcgagctgctgaacgccctgagataccacatggtgggcagaagagtgctgaccgacgagctgaagcacggcatgaccctgaccagcatgtaccagaacagcaacatccagatccaccactaccccaacggcatcgtgaccgtgaactgcgccagactgctgaaggccgaccaccacgccaccaacggcgtggtgcacctgatcgacaaggtgatcagcaccatcaccaacaacatccagcagatcatcgagatcgaggacaccttcgagaccctgagagccgccgtggccgccagcggcctgaacaccatgctggagggcaacggccagtacaccctgctggcccccaccaacgaggccttcgagaagatccccagcgagaccctgaacagaatcctgggcgaccccgaggccctgagagacctgctgaacaaccacatcctgaagagcgccatgtgcgccgaggccatcgtggccggcctgagcgtggagaccctggagggcaccaccctggaggtgggctgcagcggcgacatgctgaccatcaacggcaaggccatcatcagcaacaaggacatcctggccaccaacggcgtgatccactacatcgacgagctgctgatccccgacagcgccaagaccctgttcgagctggccgccgagagcgacgtgagcaccgccatcgacctgttcagacaggccggcctgggcaaccacctgagcggcagcgagagactgaccctgctggcccccctgaacagcgtgttcaaggacggcaccccccccatcgacgcccacaccagaaacctgctgagaaaccacatcatcaaggaccagctggccagcaagtacctgtaccacggccagaccctggagaccctgggcggcaagaagctgagagtgttcgtgtacagaaacagcctgtgcatcgagaacagctgcatcgccgcccacgacaagagaggcagatacggcaccctgttcaccatggacagagtgctgaccccccccatgggcaccgtgatggacgtgctgaagggcgacaacagattcagcatgctggtggccgccatccagagcgccggcctgaccgagaccctgaacagagagggcgtgtacaccgtgttcgcccccaccaacgaggccttcagagccctgccccccagagagagaagcagactgctgggcgacgccaaggagctggccaacatcctgaagtaccacatcggcgacgagatcctggtgagcggcggcatcggcgccctggtgagactgaagagcctgcagggcgacaagctggaggtgagcctgaagaacaacgtggtgagcgtgaacaaggagcccgtggccgagcccgacatcatggccaccaacggcgtggtgcacgtgatcaccaacgtgctgcagccccccgccaacagaccccaggagagaggcgacgagctggccgacagcgccctggagatcttcaagcaggccagcgccttcagcagacccgagcagccccaggtgctgtgcagccccgtgtaccagaagctgctggagagaatgaagcactag

SEQ ID NO: 102917 - DNA, 1251 bp, Artificial Sequence
  Description of Artificial Sequence: Synthetic coding sequence
atgctggagggcaacggccagtacaccctgctggcccccaccaacgaggccttcgagaagatccccagcgagaccctgaacagaatcctgggcgaccccgaggccctgagagacctgctgaacaaccacatcctgaagagcgccatgtgcgccgaggccatcgtggccggcctgagcgtggagaccctggagggcaccaccctggaggtgggctgcagcggcgacatgctgaccatcaacggcaaggccatcatcagcaacaaggacatcctggccaccaacggcgtgatccactacatcgacgagctgctgatccccgacagcgccaagaccctgttcgagctggccgccgagagcgacgtgagcaccgccatcgacctgttcagacaggccggcctgggcaaccacctgagcggcagcgagagactgaccctgctggcccccctgaacagcgtgttcaaggacggcaccccccccatcgacgcccacaccagaaacctgctgagaaaccacatcatcaaggaccagctggccagcaagtacctgtaccacggccagaccctggagaccctgggcggcaagaagctgagagtgttcgtgtacagaaacagcctgtgcatcgagaacagctgcatcgccgcccacgacaagagaggcagatacggcaccctgttcaccatggacagagtgctgaccccccccatgggcaccgtgatggacgtgctgaagggcgacaacagattcagcatgctggtggccgccatccagagcgccggcctgaccgagaccctgaacagagagggcgtgtacaccgtgttcgcccccaccaacgaggccttcagagccctgccccccagagagagaagcagactgctgggcgacgccaaggagctggccaacatcctgaagtaccacatcggcgacgagatcctggtgagcggcggcatcggcgccctggtgagactgaagagcctgcagggcgacaagctggaggtgagcctgaagaacaacgtggtgagcgtgaacaaggagcccgtggccgagcccgacatcatggccaccaacggcgtggtgcacgtgatcaccaacgtgctgcagccccccgccaacagaccccaggagagaggcgacgagctggccgacagcgccctggagatcttcaagcaggccagcgccttcagcagagccagccagagaagcgtgagactggcccccgtgtaccagaagctgctggagagaatgaagcactag

SEQ ID NO: 102918 - DNA, 2052 bp, Artificial Sequence
  Description of Artificial Sequence: Synthetic coding sequence
atggccctgttcgtgagactgctggccctggccctggccctggccctgggccccgccgccaccctggccggccccgccaagagcccctaccagctggtgctgcagcacagcagactgagaggcagacagcacggccccaacgtgtgcgccgtgcagaaggtgatcggcaccaacagaaagtacttcaccaactgcaagcagtggtaccagagaaagatctgcggcaagagcaccgtgatcagctacgagtgctgccccggctacgagaaggtgcccggcgagaagggctgccccgccgccctgcccctgagcaacctgtacgagaccctgggcgtggtgggcagcaccaccacccagctgtacaccgacagaaccgagaagctgagacccgagatggagggccccggcagcttcaccatcttcgcccccagcaacgaggcctgggccagcctgcccgccgaggtgctggacagcctggtgagcaacgtgaacatcgagctgctgaacgccctgagataccacatggtgggcagaagagtgctgaccgacgagctgaagcacggcatgaccctgaccagcatgtaccagaacagcaacatccagatccaccactaccccaacggcatcgtgaccgtgaactgcgccagactgctgaaggccgaccaccacgccaccaacggcgtggtgcacctgatcgacaaggtgatcagcaccatcaccaacaacatccagcagatcatcgagatcgaggacaccttcgagaccctgagagccgccgtggccgccagcggcctgaacaccatgctggagggcaacggccagtacaccctgctggcccccaccaacgaggccttcgagaagatccccagcgagaccctgaacagaatcctgggcgaccccgaggccctgagagacctgctgaacaaccacatcctgaagagcgccatgtgcgccgaggccatcgtggccggcctgagcgtggagaccctggagggcaccaccctggaggtgggctgcagcggcgacatgctgaccatcaacggcaaggccatcatcagcaacaaggacatcctggccaccaacggcgtgatccactacatcgacgagctgctgatccccgacagcgccaagaccctgttcgagctggccgccgagagcgacgtgagcaccgccatcgacctgttcagacaggccggcctgggcaaccacctgagcggcagcgagagactgaccctgctggcccccctgaacagcgtgttcaaggacggcaccccccccatcgacgcccacaccagaaacctgctgagaaaccacatcatcaaggaccagctggccagcaagtacctgtaccacggccagaccctggagaccctgggcggcaagaagctgagagtgttcgtgtacagaaacagcctgtgcatcgagaacagctgcatcgccgcccacgacaagagaggcagatacggcaccctgttcaccatggacagagtgctgaccccccccatgggcaccgtgatggacgtgctgaagggcgacaacagattcagcatgctggtggccgccatccagagcgccggcctgaccgagaccctgaacagagagggcgtgtacaccgtgttcgcccccaccaacgaggccttcagagccctgccccccagagagagaagcagactgctgggcgacgccaaggagctggccaacatcctgaagtaccacatcggcgacgagatcctggtgagcggcggcatcggcgccctggtgagactgaagagcctgcagggcgacaagctggaggtgagcctgaagaacaacgtggtgagcgtgaacaaggagcccgtggccgagcccgacatcatggccaccaacggcgtggtgcacgtgatcaccaacgtgctgcagccccccgccaacagaccccaggagagaggcgacgagctggccgacagcgccctggagatcttcaagcaggccagcgccttcagcagagccagccagagaagcgtgagactggcccccgtgtaccagaagctgctggagagaatgaagcactag

SEQ ID NO: 102919 - DNA, 1188 bp, Artificial Sequence
  Description of Artificial Sequence: Synthetic coding sequence
atggccttcagcccctggcagatcctgagccccgtgcagtgggccaagtggacctggagcgccgtgagaggcggcgccgccggcgaggacgaggccggcggccccgagggcgaccccgaggaggaggacagccaggccgagaccaagagcctgagcttcagaagcggctgcaaggtgaagaagcacgagacccagagcctggccctggacgcctgcagcagagacgagggcgccgtgatcagccagatcagcgacatcagcaacagagacggccacgccaccgacgaggagaagctggccagcaccagctgcggccagaagagcgccggcgccgaggtgaagggcgagcccgaggaggacctggagtacttcgagtgcagcaacgtgcccgtgagcaccatcaaccacgccttcagcagcagcgaggccggcatcgagaaggagacctgccagaagatggaggaggacggcagcaccgtgctgggcctgctggagagcagcgccgagaaggcccccgtgagcgtgagctgcggcggcgagagccccctggacggcatctgcctgagcgagagcgacaagaccgccgtgctgaccctgatcagagaggagatcatcaccaaggagatcgaggccaacgagtggaagaagaagtacgaggagaccagacaggaggtgctggagatgagaaagatcgtggccgagtacgagaagaccatcgcccagatgatcgaggacgagcagagaaccagcatgaccagccagaagagcttccagcagctgaccatggagaaggagcaggccctggccgacctgaacagcgtggagagaagcctgagcgacctgttcagaagatacgagaacctgaagggcgtgctggagggcttcaagaagaacgaggaggccctgaagaagtgcgcccaggactacctggccagagtgaagcaggaggagcagagataccaggccctgaagatccacgccgaggagaagctggacaaggccaacgaggagatcgcccaggtgagaaccaaggccaaggccgagagcgccgccctgcacgccggcctgagaaaggagcagatgaaggtggagagcctggagagagccctgcagcagaagaaccaggagatcgaggagctgaccaagatctgcgacgagctgatcgccaagctgggcaagaccgactag

SEQ ID NO: 102920 - DNA, 2418 bp, Artificial Sequence
  Description of Artificial Sequence: Synthetic coding sequence
atggccttcagcccctggcagatcctgagccccgtgcagtgggccaagtggacctggagcgccgtgagaggcggcgccgccggcgaggacgaggccggcggccccgagggcgaccccgaggaggaggacagccaggccgagaccaagagcctgagcttcagcagcgacagcgagggcaacttcgagacccccgaggccgagacccccatcagaagccccttcaaggagagctgcgaccccagcctgggcctggccggccccggcgccaagagccaggagagccaggaggccgacgagcagctggtggccgaggtggtggagaagtgcagcagcaagacctgcagcaagcccagcgagaacgaggtgccccagcaggccatcgacagccacagcgtgaagaacttcagagaggagcccgagcacgacttcagcaagatcagcatcgtgagacccttcagcatcgagaccaaggacagcaccgacatcagcgccgtgctgggcaccaaggccgcccacggctgcgtgaccgccgtgagcggcaaggccctgcccagcagcccccccgacgccctgcaggacgaggccatgaccgagggcagcatgggcgtgaccctggaggccagcgccgaggccgacctgaaggccggcaacagctgccccgagctggtgcccagcagaagaagcaagctgagaaagcccaagcccgtgcccctgagaaagaaggccatcggcggcgagttcagcgacaccaacgccgccgtggagggcacccccctgcccaaggccagctaccacttcagccccgaggagctggacgagaacaccagccccctgctgggcgacgccagattccagaagagcccccccgacctgaaggagacccccggcaccctgagcagcgacaccaacgacagcggcgtggagctgggcgaggagagcagaagcagccccctgaagctggagttcgacttcaccgaggacaccggcaacatcgaggccagaaaggccctgcccagaaagctgggcagaaagctgggcagcaccctgacccccaagatccagaaggacggcatcagcaagagcgccggcctggagcagcccaccgaccccgtggccagagacggccccctgagccagaccagcagcaagcccgaccccagccagtgggagagccccagcttcaaccccttcggcagccacagcgtgctgcagaacagcccccccctgagcagcgagggcagctaccacttcgaccccgacaacttcgacgagagcatggaccccttcaagcccaccaccaccctgaccagcagcgacttctgcagccccaccggcaaccacgtgaacgagatcctggagagccccaagaaggccaagagcagactgatcaccagcggctgcaaggtgaagaagcacgagacccagagcctggccctggacgcctgcagcagagacgagggcgccgtgatcagccagatcagcgacatcagcaacagagacggccacgccaccgacgaggagaagctggccagcaccagctgcggccagaagagcgccggcgccgaggtgaagggcgagcccgaggaggacctggagtacttcgagtgcagcaacgtgcccgtgagcaccatcaaccacgccttcagcagcagcgaggccggcatcgagaaggagacctgccagaagatggaggaggacggcagcaccgtgctgggcctgctggagagcagcgccgagaaggcccccgtgagcgtgagctgcggcggcgagagccccctggacggcatctgcctgagcgagagcgacaagaccgccgtgctgaccctgatcagagaggagatcatcaccaaggagatcgaggccaacgagtggaagaagaagtacgaggagaccagacaggaggtgctggagatgagaaagatcgtggccgagtacgagaagaccatcgcccagatgatcgaggacgagcagagaaccagcatgaccagccagaagagcttccagcagctgaccatggagaaggagcaggccctggccgacctgaacagcgtggagagaagcctgagcgacctgttcagaagatacgagaacctgaagggcgtgctggagggcttcaagaagaacgaggaggccctgaagaagtgcgcccaggactacctggccagagtgaagcaggaggagcagagataccaggccctgaagatccacgccgaggagaagctggacaaggccaacgaggagatcgcccaggtgagaaccaaggccaaggccgagagcgccgccctgcacgccggcctgagaaaggagcagatgaaggtggagagcctggagagagccctgcagcagaagaaccaggagatcgaggagctgaccaagatctgcgacgagctgatcgccaagctgggcaagaccgactag

SEQ ID NO: 102921 - DNA, 1140 bp, Artificial Sequence
  Description of Artificial Sequence: Synthetic coding sequence
atgggcggcagccacagccagacccccagaggcagagagcccgccggcgagagacaccccagacccaccgagaccgccaccaccgagcaggtgaagttcctgtgcttcctgctgagcggctgcaaggtgaagaagcacgagacccagagcctggccctggacgcctgcagcagagacgagggcgccgtgatcagccagatcagcgacatcagcaacagagacggccacgccaccgacgaggagaagctggccagcaccagctgcggccagaagagcgccggcgccgaggtgaagggcgagcccgaggaggacctggagtacttcgagtgcagcaacgtgcccgtgagcaccatcaaccacgccttcagcagcagcgaggccggcatcgagaaggagacctgccagaagatggaggaggacggcagcaccgtgctgggcctgctggagagcagcgccgagaaggcccccgtgagcgtgagctgcggcggcgagagccccctggacggcatctgcctgagcgagagcgacaagaccgccgtgctgaccctgatcagagaggagatcatcaccaaggagatcgaggccaacgagtggaagaagaagtacgaggagaccagacaggaggtgctggagatgagaaagatcgtggccgagtacgagaagaccatcgcccagatgatcgaggacgagcagagaaccagcatgaccagccagaagagcttccagcagctgaccatggagaaggagcaggccctggccgacctgaacagcgtggagagaagcctgagcgacctgttcagaagatacgagaacctgaagggcgtgctggagggcttcaagaagaacgaggaggccctgaagaagtgcgcccaggactacctggccagagtgaagcaggaggagcagagataccaggccctgaagatccacgccgaggagaagctggacaaggccaacgaggagatcgcccaggtgagaaccaaggccaaggccgagagcgccgccctgcacgccggcctgagaaaggagcagatgaaggtggagagcctggagagagccctgcagcagaagaaccaggagatcgaggagctgaccaagatctgcgacgagctgatcgccaagctgggcaagaccgactag

SEQ ID NO: 102922 - DNA, 1104 bp, Artificial Sequence
  Description of Artificial Sequence: Synthetic coding sequence
atgggcggcagccacagccagacccccagaggcagagagcccgccggcgagagacaccccagacccaccgagaccgccagcggctgcaaggtgaagaagcacgagacccagagcctggccctggacgcctgcagcagagacgagggcgccgtgatcagccagatcagcgacatcagcaacagagacggccacgccaccgacgaggagaagctggccagcaccagctgcggccagaagagcgccggcgccgaggtgaagggcgagcccgaggaggacctggagtacttcgagtgcagcaacgtgcccgtgagcaccatcaaccacgccttcagcagcagcgaggccggcatcgagaaggagacctgccagaagatggaggaggacggcagcaccgtgctgggcctgctggagagcagcgccgagaaggcccccgtgagcgtgagctgcggcggcgagagccccctggacggcatctgcctgagcgagagcgacaagaccgccgtgctgaccctgatcagagaggagatcatcaccaaggagatcgaggccaacgagtggaagaagaagtacgaggagaccagacaggaggtgctggagatgagaaagatcgtggccgagtacgagaagaccatcgcccagatgatcgaggacgagcagagaaccagcatgaccagccagaagagcttccagcagctgaccatggagaaggagcaggccctggccgacctgaacagcgtggagagaagcctgagcgacctgttcagaagatacgagaacctgaagggcgtgctggagggcttcaagaagaacgaggaggccctgaagaagtgcgcccaggactacctggccagagtgaagcaggaggagcagagataccaggccctgaagatccacgccgaggagaagctggacaaggccaacgaggagatcgcccaggtgagaaccaaggccaaggccgagagcgccgccctgcacgccggcctgagaaaggagcagatgaaggtggagagcctggagagagccctgcagcagaagaaccaggagatcgaggagctgaccaagatctgcgacgagctgatcgccaagctgggcaagaccgactag

SEQ ID NO: 102923 - DNA, 2454 bp, Artificial Sequence
  Description of Artificial Sequence: Synthetic coding sequence
atggccttcagcccctggcagatcctgagccccgtgcagtgggccaagtggacctggagcgccgtgagaggcggcgccgccggcgaggacgaggccggcggccccgagggcgaccccgaggaggaggacagccaggccgagaccaagagcctgagcttcagcagcgacagcgagggcaacttcgagacccccgaggccgagacccccatcagaagccccttcaaggagagctgcgaccccagcctgggcctggccggccccggcgccaagagccaggagagccaggaggccgacgagcagctggtggccgaggtggtggagaagtgcagcagcaagacctgcagcaagcccagcgagaacgaggtgccccagcaggccatcgacagccacagcgtgaagaacttcagagaggagcccgagcacgacttcagcaagatcagcatcgtgagacccttcagcatcgagaccaaggacagcaccgacatcagcgccgtgctgggcaccaaggccgcccacggctgcgtgaccgccgtgagcggcaaggccctgcccagcagcccccccgacgccctgcaggacgaggccatgaccgagggcagcatgggcgtgaccctggaggccagcgccgaggccgacctgaaggccggcaacagctgccccgagctggtgcccagcagaagaagcaagctgagaaagcccaagcccgtgcccctgagaaagaaggccatcggcggcgagttcagcgacaccaacgccgccgtggagggcacccccctgcccaaggccagctaccacttcagccccgaggagctggacgagaacaccagccccctgctgggcgacgccagattccagaagagcccccccgacctgaaggagacccccggcaccctgagcagcgacaccaacgacagcggcgtggagctgggcgaggagagcagaagcagccccctgaagctggagttcgacttcaccgaggacaccggcaacatcgaggccagaaaggccctgcccagaaagctgggcagaaagctgggcagcaccctgacccccaagatccagaaggacggcatcagcaagagcgccggcctggagcagcccaccgaccccgtggccagagacggccccctgagccagaccagcagcaagcccgaccccagccagtgggagagccccagcttcaaccccttcggcagccacagcgtgctgcagaacagcccccccctgagcagcgagggcagctaccacttcgaccccgacaacttcgacgagagcatggaccccttcaagcccaccaccaccctgaccagcagcgacttctgcagccccaccggcaaccacgtgaacgagatcctggagagccccaagaaggccaagagcagactgatcaccaccaccgagcaggtgaagttcctgtgcttcctgctgagcggctgcaaggtgaagaagcacgagacccagagcctggccctggacgcctgcagcagagacgagggcgccgtgatcagccagatcagcgacatcagcaacagagacggccacgccaccgacgaggagaagctggccagcaccagctgcggccagaagagcgccggcgccgaggtgaagggcgagcccgaggaggacctggagtacttcgagtgcagcaacgtgcccgtgagcaccatcaaccacgccttcagcagcagcgaggccggcatcgagaaggagacctgccagaagatggaggaggacggcagcaccgtgctgggcctgctggagagcagcgccgagaaggcccccgtgagcgtgagctgcggcggcgagagccccctggacggcatctgcctgagcgagagcgacaagaccgccgtgctgaccctgatcagagaggagatcatcaccaaggagatcgaggccaacgagtggaagaagaagtacgaggagaccagacaggaggtgctggagatgagaaagatcgtggccgagtacgagaagaccatcgcccagatgatcgaggacgagcagagaaccagcatgaccagccagaagagcttccagcagctgaccatggagaaggagcaggccctggccgacctgaacagcgtggagagaagcctgagcgacctgttcagaagatacgagaacctgaagggcgtgctggagggcttcaagaagaacgaggaggccctgaagaagtgcgcccaggactacctggccagagtgaagcaggaggagcagagataccaggccctgaagatccacgccgaggagaagctggacaaggccaacgaggagatcgcccaggtgagaaccaaggccaaggccgagagcgccgccctgcacgccggcctgagaaaggagcagatgaaggtggagagcctggagagagccctgcagcagaagaaccaggagatcgaggagctgaccaagatctgcgacgagctgatcgccaagctgggcaagaccgactag

SEQ ID NO: 102924 - DNA, 2379 bp, Artificial Sequence
  Description of Artificial Sequence: Synthetic coding sequence
atgcagagacagaccatcaagggcgccggcgccggcggcgccgccctgatggccttcagcccctggcagatcctgagccccgtgcagtgggccaagtggacctggagcgccgtgagaggcggcgccgccggcgaggacgaggccggcggccccgagggcgaccccgaggaggaggacagccaggccgagaccaagagcctgagcttcagcagcgacagcgagggcaacttcgagacccccgaggccgagacccccatcagaagccccttcaaggagagctgcgaccccagcctgggcctggccggccccggcgccaagagccaggagagccaggaggccgacgagcagctggtggccgaggtggtggagaagtgcagcagcaagacctgcagcaagcccagcgagaacgaggtgccccagcaggccatcgacagccacagcgtgaagaacttcagagaggagcccgagcacgacttcagcaagatcagcatcgtgagacccttcagcatcgagaccaaggacagcaccgacatcagcgccgtgctgggcaccaaggccgcccacggctgcgtgaccgccgtgagcggcaaggccctgcccagcagcccccccgacgccctgcaggacgaggccatgaccgagggcagcatgggcgtgaccctggaggccagcgccgaggccgacctgaaggccggcaacagctgccccgagctggtgcccagcagaagaagcaagctgagaaagcccaagcccgtgcccctgagaaagaaggccatcggcggcgagttcagcgacaccaacgccgccgtggagggcacccccctgcccaaggccagctaccacttcagccccgaggagctggacgagaacaccagccccctgctgggcgacgccagattccagaagagcccccccgacctgaaggagacccccggcaccctgagcagcgacaccaacgacagcggcgtggagctgggcgaggagagcagaagcagccccctgaagctggagttcgacttcaccgaggacaccggcaacatcgaggccagaaaggccctgcccagaaagctgggcagaaagctgggcagcaccctgacccccaagatccagaaggacggcatcagcaagagcgccggcctggagcagcccaccgaccccgtggccagagacggccccctgagccagaccagcagcaagcccgaccccagccagtgggagagccccagcttcaaccccttcggcagccacagcgtgctgcagaacagcccccccctgagcagcgagggcagctaccacttcgaccccgacaacttcgacgagagcatggaccccttcaagcccaccaccaccctgaccagcagcgacttctgcagccccaccggcaaccacgtgaacgagatcctggagagccccaagaaggccaagagcagactgatcaccagcggctgcaaggtgaagaagcacgagacccagagcctggccctggacgcctgcagcagagacgagggcgccgtgatcagccagatcagcgacatcagcaacagagacggccacgccaccgacgaggagaagctggccagcaccagctgcggccagaagagcgccggcgccgaggtgaagggcatcgagaaggagacctgccagaagatggaggaggacggcagcaccgtgctgggcctgctggagagcagcgccgagaaggcccccgtgagcgtgagctgcggcggcgagagccccctggacggcatctgcctgagcgagagcgacaagaccgccgtgctgaccctgatcagagaggagatcatcaccaaggagatcgaggccaacgagtggaagaagaagtacgaggagaccagacaggaggtgctggagatgagaaagatcgtggccgagtacgagaagaccatcgcccagatgatcgaggacgagcagagaaccagcatgaccagccagaagagcttccagcagctgaccatggagaaggagcaggccctggccgacctgaacagcgtggagagaagcctgagcgacctgttcagaagatacgagaacctgaagggcgtgctggagggcttcaagaagaacgaggaggccctgaagaagtgcgcccaggactacctggccagagtgaagcaggaggagcagagataccaggccctgaagatccacgccgaggagaagctggacaaggccaacgaggagatcgcccaggtgagaaccaaggccaaggccgagagcgccgccctgcacgccggcctgagaaaggagcagatgaaggtggagagcctggagagagccctgcagcagaagaaccaggagatcgaggagctgaccaagatctgcgacgagctgatcgccaagctgggcaagaccgactag

SEQ ID NO: 102925 - DNA, 1431 bp, Artificial Sequence
  Description of Artificial Sequence: Synthetic coding sequence
atgaccgagggcagcatgggcgtgaccctggaggccagcgccgaggccgacctgaaggccggcaacagctgccccgagctggtgcccagcagaagaagcaagctgagaaagcccaagcccgtgcccctgagaaagaaggccatcggcggcgagttcagcgacaccaacgccgccgtggagggcacccccctgcccaaggccagctaccacttcagccccgaggagctggacgagaacaccagccccctgctgggcgacgccagattccagaagagcccccccgacctgaaggagacccccggcaccctgagcagcgacaccaacgacagcggcgtggagctgggcgaggagagcagaagcagccccctgaagctggagttcgacttcaccgaggacaccggcaacatcgaggccagaaaggccctgcccagaaagctgggcagaaagctgggcagcaccctgacccccaagatccagaaggacggcatcagcaagagcgccggcctggagcagcccaccgaccccgtggccagagacggccccctgagccagaccagcagcaagcccgaccccagccagtgggagagccccagcttcaaccccttcggcagccacagcgtgctgcagaacagcccccccctgagcagcgagggcagctaccacttcgaccccgacaacttcgacgagagcatggaccccttcaagcccaccaccaccctgaccagcagcgacttctgcagccccaccggcaaccacgtgaacgagatcctggagagccccaagaaggccaagagcagactgatcaccagcggctgcaaggtgaagaagcacgagacccagagcctggccctggacgcctgcagcagagacgagggcgccgtgatcagccagatcagcgacatcagcaacagagacggccacgccaccgacgaggagaagctggccagcaccagctgcggccagaagagcgccggcgccgaggtgaagggcgagcccgaggaggacctggagtacttcgagtgcagcaacgtgcccgtgagcaccatcaaccacgccttcagcagcagcgaggccggcatcgagaaggagacctgccagaagatggaggaggacggcagcaccgtgctgggcctgctggagagcagcgccgagaaggcccccgtgagcgtgagctgcggcggcgagagccccctggacggcatctgcctgagcgagagcgacaagaccgccgtgctgaccctgatcagagaggagatcatcaccaaggagatcgaggccaacgagtggaagaagaagtacttcaacaaggaggtgttcagaggcgacatctgccccaagagattcggcctgcagatccccgtgatcttcaagaagcagctgaccaccaagagcctgagcctgcacagagtgaccgtgaagaagctgatgtag

SEQ ID NO: 102926 - DNA, 2196 bp, Artificial Sequence
  Description of Artificial Sequence: Synthetic coding sequence
atgaacaacatcctgaagctgaagagcagcgacagcgagggcaacttcgagacccccgaggccgagacccccatcagaagccccttcaaggagagctgcgaccccagcctgggcctggccggccccggcgccaagagccaggagagccaggaggccgacgagcagctggtggccgaggtggtggagaagtgcagcagcaagacctgcagcaagcccagcgagaacgaggtgccccagcaggccatcgacagccacagcgtgaagaacttcagagaggagcccgagcacgacttcagcaagatcagcatcgtgagacccttcagcatcgagaccaaggacagcaccgacatcagcgccgtgctgggcaccaaggccgcccacggctgcgtgaccgccgtgagcggcaaggccctgcccagcagcccccccgacgccctgcaggacgaggccatgaccgagggcagcatgggcgtgaccctggaggccagcgccgaggccgacctgaaggccggcaacagctgccccgagctggtgcccagcagaagaagcaagctgagaaagcccaagcccgtgcccctgagaaagaaggccatcggcggcgagttcagcgacaccaacgccgccgtggagggcacccccctgcccaaggccagctaccacttcagccccgaggagctggacgagaacaccagccccctgctgggcgacgccagattccagaagagcccccccgacctgaaggagacccccggcaccctgagcagcgacaccaacgacagcggcgtggagctgggcgaggagagcagaagcagccccctgaagctggagttcgacttcaccgaggacaccggcaacatcgaggccagaaaggccctgcccagaaagctgggcagaaagctgggcagcaccctgacccccaagatccagaaggacggcatcagcaagagcgccggcctggagcagcccaccgaccccgtggccagagacggccccctgagccagaccagcagcaagcccgaccccagccagtgggagagccccagcttcaaccccttcggcagccacagcgtgctgcagaacagcccccccctgagcagcgagggcagctaccacttcgaccccgacaacttcgacgagagcatggaccccttcaagcccaccaccaccctgaccagcagcgacttctgcagccccaccggcaaccacgtgaacgagatcctggagagccccaagaaggccaagagcagactgatcaccagcggctgcaaggtgaagaagcacgagacccagagcctggccctggacgcctgcagcagagacgagggcgccgtgatcagccagatcagcgacatcagcaacagagacggccacgccaccgacgaggagaagctggccagcaccagctgcggccagaagagcgccggcgccgaggtgaagggcatcgagaaggagacctgccagaagatggaggaggacggcagcaccgtgctgggcctgctggagagcagcgccgagaaggcccccgtgagcgtgagctgcggcggcgagagccccctggacggcatctgcctgagcgagagcgacaagaccgccgtgctgaccctgatcagagaggagatcatcaccaaggagatcgaggccaacgagtggaagaagaagtacgaggagaccagacaggaggtgctggagatgagaaagatcgtggccgagtacgagaagaccatcgcccagatgatcgaggacgagcagagaaccagcatgaccagccagaagagcttccagcagctgaccatggagaaggagcaggccctggccgacctgaacagcgtggagagaagcctgagcgacctgttcagaagatacgagaacctgaagggcgtgctggagggcttcaagaagaacgaggaggccctgaagaagtgcgcccaggactacctggccagagtgaagcaggaggagcagagataccaggccctgaagatccacgccgaggagaagctggacaaggccaacgaggagatcgcccaggtgagaaccaaggccaaggccgagagcgccgccctgcacgccggcctgagaaaggagcagatgaaggtggagagcctggagagagccctgcagcagaagaaccaggagatcgaggagctgaccaagatctgcgacgagctgatcgccaagctgggcaagaccgactag

SEQ ID NO: 102927 - DNA, 1833 bp, Artificial Sequence
  Description of Artificial Sequence: Synthetic coding sequence
atgaccgagggcagcatgggcgtgaccctggaggccagcgccgaggccgacctgaaggccggcaacagctgccccgagctggtgcccagcagaagaagcaagctgagaaagcccaagcccgtgcccctgagaaagaaggccatcggcggcgagttcagcgacaccaacgccgccgtggagggcacccccctgcccaaggccagctaccacttcagccccgaggagctggacgagaacaccagccccctgctgggcgacgccagattccagaagagcccccccgacctgaaggagacccccggcaccctgagcagcgacaccaacgacagcggcgtggagctgggcgaggagagcagaagcagccccctgaagctggagttcgacttcaccgaggacaccggcaacatcgaggccagaaaggccctgcccagaaagctgggcagaaagctgggcagcaccctgacccccaagatccagaaggacggcatcagcaagagcgccggcctggagcagcccaccgaccccgtggccagagacggccccctgagccagaccagcagcaagcccgaccccagccagtgggagagccccagcttcaaccccttcggcagccacagcgtgctgcagaacagcccccccctgagcagcgagggcagctaccacttcgaccccgacaacttcgacgagagcatggaccccttcaagcccaccaccaccctgaccagcagcgacttctgcagccccaccggcaaccacgtgaacgagatcctggagagccccaagaaggccaagagcagactgatcaccagcggctgcaaggtgaagaagcacgagacccagagcctggccctggacgcctgcagcagagacgagggcgccgtgatcagccagatcagcgacatcagcaacagagacggccacgccaccgacgaggagaagctggccagcaccagctgcggccagaagagcgccggcgccgaggtgaagggcgagcccgaggaggacctggagtacttcgagtgcagcaacgtgcccgtgagcaccatcaaccacgccttcagcagcagcgaggccggcatcgagaaggagacctgccagaagatggaggaggacggcagcaccgtgctgggcctgctggagagcagcgccgagaaggcccccgtgagcgtgagctgcggcggcgagagccccctggacggcatctgcctgagcgagagcgacaagaccgccgtgctgaccctgatcagagaggagatcatcaccaaggagatcgaggccaacgagtggaagaagaagtacgaggagaccagacaggaggtgctggagatgagaaagatcgtggccgagtacgagaagaccatcgcccagatgatcgaggacgagcagagaaccagcatgaccagccagaagagcttccagcagctgaccatggagaaggagcaggccctggccgacctgaacagcgtggagagaagcctgagcgacctgttcagaagatacgagaacctgaagggcgtgctggagggcttcaagaagaacgaggaggccctgaagaagtgcgcccaggactacctggccagagtgaagcaggaggagcagagataccaggccctgaagatccacgccgaggagaagctggacaaggccaacgaggagatcgcccaggtgagaaccaaggccaaggccgagagcgccgccctgcacgccggcctgagaaaggagcagatgaaggtggagagcctggagagagccctgcagcagaagaaccaggagatcgaggagctgaccaagatctgcgacgagctgatcgccaagctgggcaagaccgactag

SEQ ID NO: 102928 - DNA, 1746 bp, Artificial Sequence
  Description of Artificial Sequence: Synthetic coding sequence
atgaccgagggcagcatgggcgtgaccctggaggccagcgccgaggccgacctgaaggccggcaacagctgccccgagctggtgcccagcagaagaagcaagctgagaaagcccaagcccgtgcccctgagaaagaaggccatcggcggcgagttcagcgacaccaacgccgccgtggagggcacccccctgcccaaggccagctaccacttcagccccgaggagctggacgagaacaccagccccctgctgggcgacgccagattccagaagagcccccccgacctgaaggagacccccggcaccctgagcagcgacaccaacgacagcggcgtggagctgggcgaggagagcagaagcagccccctgaagctggagttcgacttcaccgaggacaccggcaacatcgaggccagaaaggccctgcccagaaagctgggcagaaagctgggcagcaccctgacccccaagatccagaaggacggcatcagcaagagcgccggcctggagcagcccaccgaccccgtggccagagacggccccctgagccagaccagcagcaagcccgaccccagccagtgggagagccccagcttcaaccccttcggcagccacagcgtgctgcagaacagcccccccctgagcagcgagggcagctaccacttcgaccccgacaacttcgacgagagcatggaccccttcaagcccaccaccaccctgaccagcagcgacttctgcagccccaccggcaaccacgtgaacgagatcctggagagccccaagaaggccaagagcagactgatcaccagcggctgcaaggtgaagaagcacgagacccagagcctggccctggacgcctgcagcagagacgagggcgccgtgatcagccagatcagcgacatcagcaacagagacggccacgccaccgacgaggagaagctggccagcaccagctgcggccagaagagcgccggcgccgaggtgaagggcatcgagaaggagacctgccagaagatggaggaggacggcagcaccgtgctgggcctgctggagagcagcgccgagaaggcccccgtgagcgtgagctgcggcggcgagagccccctggacggcatctgcctgagcgagagcgacaagaccgccgtgctgaccctgatcagagaggagatcatcaccaaggagatcgaggccaacgagtggaagaagaagtacgaggagaccagacaggaggtgctggagatgagaaagatcgtggccgagtacgagaagaccatcgcccagatgatcgaggacgagcagagaaccagcatgaccagccagaagagcttccagcagctgaccatggagaaggagcaggccctggccgacctgaacagcgtggagagaagcctgagcgacctgttcagaagatacgagaacctgaagggcgtgctggagggcttcaagaagaacgaggaggccctgaagaagtgcgcccaggactacctggccagagtgaagcaggaggagcagagataccaggccctgaagatccacgccgaggagaagctggacaaggccaacgaggagatcgcccaggtgagaaccaaggccaaggccgagagcgccgccctgcacgccggcctgagaaaggagcagatgaaggtggagagcctggagagagccctgcagcagaagaaccaggagatcgaggagctgaccaagatctgcgacgagctgatcgccaagctgggcaagaccgactag

SEQ ID NO: 102929 - DNA, 93 bp, Artificial Sequence
  Description of Artificial Sequence: Synthetic coding sequence
atgaccgagggcagcatgggcgtgaccctggaggccagcgccgaggccgacctgaaggccggcaacagctgccccgagctggtgcccagctag

SEQ ID NO: 102930 - DNA, 417 bp, Artificial Sequence
  Description of Artificial Sequence: Synthetic coding sequence
atgaccgagggcagcatgggcgtgaccctggaggccagcgccgaggccgacctgaaggccggcaacagctgccccgagctggtgcccagcagaagaagcaagctgagaaagcccaagcccgtgcccctgagaaagaaggccatcggcggcgagttcagcgacaccaacgccgccgtggagggcacccccctgcccaaggccagctaccacttcagccccgaggagctggacgagaacaccagccccctgctgggcgacgccagattccagaagagcccccccgacctgaaggagacccccggcaccctgagcagcgacaccaacgacagcggcgtggagctgggcgaggagagcagaagcagccccctgaagctggagttcgacttcaccgaggacaccggcaacatcgaggcctag

SEQ ID NO: 102931 - DNA, 186 bp, Artificial Sequence
  Description of Artificial Sequence: Synthetic coding sequence
atgaccgagggcagcatgggcgtgaccctggaggccagcgccgaggccgacctgaaggccggcaacagctgccccgagctggtgcccagcagaagaagcaagctgagaaagcccaagcccgtgcccctgagaaagaaggccatcggcggcgagttcagcgacaccaacgccgccgtggagggctag

SEQ ID NO: 102932 - DNA, 390 bp, Artificial Sequence
  Description of Artificial Sequence: Synthetic coding sequence
atggccttcagcccctggcagatcctgagccccgtgcagtgggccaagtggacctggagcgccgtgagaggcggcgccgccggcgaggacgaggccggcggccccgagggcgaccccgaggaggaggacagccaggccgagaccaagagcctgagcttcagcagcgacagcgagggcaacttcgagacccccgaggccgagacccccatcagaagccccttcaaggagagctgcgaccccagcctgggcctggccggccccggcgccaagagccaggagagccaggaggccgacgagcagctggtggccgaggtggtggagaagtgcagcagcaagacctgcagcaagcccagcgagaacgaggtgccccagcaggccatcgacagctag

SEQ ID NO: 102933 - DNA, 3081 bp, Artificial Sequence
  Description of Artificial Sequence: Synthetic coding sequence
atgggcggcagccagagcctgcagcccgcccccgccagcgacctgaacctggaggccagcgaggccatgagcagcgacagcgaggaggccttcgagacccccgagagcaccacccccgtgaaggccccccccgccccccccccccccccccccgaggtgatccccgagcccgaggtgagcacccagcccccccccgaggagcccggctgcggcagcgagaccgtgcccgtgcccgacggccccagaagcgacagcgtggagggcagccccttcagaccccccagccacagcttcagcgccgtgttcgacgaggacaagcccatcgccagcagcggcacctacaacctggacttcgacaacatcgagctggtggacaccttccagaccctggagcccagagccagcgacgccaagaaccaggagggcaaggtgaacaccagaagaaagagcaccgacagcgtgcccatcagcaagagcaccctgagcagaagcctgagcctgcaggccagcgacttcgacggcgccagcagcagcggcaaccccgaggccgtggccctggcccccgacgcctacagcaccggcagcagcagcgccagcagcaccctgaagagaaccaagaagcccagaccccccagcctgaagaagaagcagaccaccaagaagcccaccgagaccccccccgtgaaggagacccagcaggagcccgacgaggagagcctggtgcccagcggcgagaacctggccagcgagaccaagaccgagagcgccaagaccgagggccccagccccgccctgctggaggagacccccctggagcccgccgtgggccccaaggccgcctgccccctggacagcgagagcgccgagggcgtggtgccccccgccagcggcggcggcagagtgcagaacagcccccccgtgggcagaaagaccctgcccctgaccaccgcccccgaggccggcgaggtgacccccagcgacagcggcggccaggaggacagccccgccaagggcctgagcgtgagactggagttcgactacagcgaggacaagagcagctgggacaaccagcaggagaaccccccccccaccaagaagatcggcaagaagcccgtggccaagatgcccctgagaagacccaagatgaagaagacccccgagaagctggacaacacccccgccagcccccccagaagccccgccgagcccaacgacatccccatcgccaagggcacctacaccttcgacatcgacaagtgggacgaccccaacttcaaccccttcagcagcaccagcaagatgcaggagagccccaagctgccccagcagagctacaacttcgaccccgacacctgcgacgagagcgtggaccccttcaagaccagcagcaagacccccagcagccccagcaagagccccgccagcttcgagatccccgccagcgccatggaggccaacggcgtggacggcgacggcctgaacaagcccgccaagaagaagaagacccccctgaagaccgacaccttcagagtgaagaagagccccaagagaagccccctgagcgacccccccagccaggaccccacccccgccgccacccccgagaccccccccgtgatcagcgccgtggtgcacgccaccgacgaggagaagctggccgtgaccaaccagaagtggacctgcatgaccgtggacctggaggccgacaagcaggactacccccagcccagcgacctgagcaccttcgtgaacgagaccaagttcagcagccccaccgaggagctggactacagaaacagctacgagatcgagtacatggagaagatcggcagcagcctgccccaggacgacgacgcccccaagaagcaggccctgtacctgatgttcgacaccagccaggagagccccgtgaagagcagccccgtgagaatgagcgagagccccaccccctgcagcggcagcagcttcgaggagaccgaggccctggtgaacaccgccgccaagaaccagcaccccgtgcccagaggcctggcccccaaccaggagagccacctgcaggtgcccgagaagagcagccagaaggagctggaggccatgggcctgggcacccccagcgaggccatcgagatcaccgcccccgagggcagcttcgccagcgccgacgccctgctgagcagactggcccaccccgtgagcctgtgcggcgccctggactacctggagcccgacctggccgagaagaacccccccctgttcgcccagaagctgcaggaggagctggagttcgccatcatgagaatcgaggccctgaagctggccagacagatcgccctggccagcagaagccaccaggacgccaagagagaggccgcccaccccaccgacgtgagcatcagcaagaccgccctgtacagcagaatcggcaccgccgaggtggagaagcccgccggcctgctgttccagcagcccgacctggacagcgccctgcagatcgccagagccgagatcatcaccaaggagagagaggtgagcgagtggaaggacaagtacgaggagagcagaagagaggtgatggagatgagaaagatcgtggccgagtacgagaagaccatcgcccagatgatcgaggacgagcagagagagaagagcgtgagccaccagaccgtgcagcagctggtgctggagaaggagcaggccctggccgacctgaacagcgtggagaagagcctggccgacctgttcagaagatacgagaagatgaaggaggtgctggagggcttcagaaagaacgaggaggtgctgaagagatgcgcccaggagtacctgagcagagtgaagaaggaggagcagagataccaggccctgaaggtgcacgccgaggagaagctggacagagccaacgccgagatcgcccaggtgagaggcaaggcccagcaggagcaggccgcccaccaggccagcctgagaaaggagcagctgagagtggacgccctggagagaaccctggagcagaagaacaaggagatcgaggagctgaccaagatctgcgacgagctgatcgccaagatgggcaagagctag

SEQ ID NO: 102934 - DNA, 8847 bp, Artificial Sequence
  Description of Artificial Sequence: Synthetic coding sequence
atgggcaacgagaacagcaccagcgacaaccagagaaccctgagcgcccagacccccagaagcgcccagccccccggcaacagccagaacatcaagagaaagcagcaggacacccccggcagccccgaccacagagacgccagcagcatcggcagcgtgggcctgggcggcttctgcaccgccagcgagagcagcgccagcctggacccctgcctggtgagccccgaggtgaccgagcccagaaaggacccccagggcgccagaggccccgagggcagcctgctgcccagccccccccccagccaggagagagagcaccccagcagcagcatgcccttcgccgagtgcccccccgagggctgcctggccagccccgccgccgcccccgaggacggcccccagacccagagccccagaagagagcccgcccccaacgcccccggcgacatcgccgccgccttccccgccgagagagacagcagcaccccctaccaggagatcgccgccgtgcccagcgccggcagagagagacagcccaaggaggagggccagaagagcagcttcagcttcagcagcggcatcgaccagagccccggcatgagccccgtgcccctgagagagcccatgaaggcccccctgtgcggcgagggcgaccagcccggcggcttcgagagccaggagaaggaggccgccggcggcttcccccccgccgagagcagacagggcgtggccagcgtgcaggtgacccccgaggcccccgccgccgcccagcagggcaccgagagcagcgccgtgctggagaagagccccctgaagcccatggcccccatcccccaggaccccgcccccagagccagcgacagagagagaggccagggcgaggcccccccccagtacctgaccgacgacctggagttcctgagagcctgccacctgcccagaagcaacagcggcgccgcccccgaggccgaggtgaacgccgccagccaggagagctgccagcagcccgtgggcgcctacctgccccacgccgagctgccctggggcctgcccagccccgccctggtgcccgaggccggcggcagcggcaaggaggccctggacaccatcgacgtgcagggccacccccagaccggcatgagaggcaccaagcccaaccaggtggtgtgcgtggccgccggcggccagcccgagggcggcctgcccgtgagccccgagcccagcctgctgacccccaccgaggaggcccaccccgccagcagcctggccagcttccccgccgcccagatccccatcgccgtggaggagcccggcagcagcagcagagagagcgtgagcaaggccggcatgcccgtgagcgccgacgccgccaaggaggtggtggacgccggcctggtgggcctggagagacaggtgagcgacctgggcagcaagggcgagcaccccgagggcgaccccggcgaggtgcccgcccccagcccccaggagagaggcgagcacctgaacaccgagcagagccacgaggtgcagcccggcgtgccccccccccccctgcccaaggagcagagccacgaggtgcagcccggcgccccccccccccccctgcccaaggcccccagcgagagcgccagaggcccccccggccccaccgacggcgccaaggtgcacgaggacagcaccagccccgccgtggccaaggagggcagcagaagccccggcgacagccccggcggcaaggaggaggcccccgagccccccgacggcggcgaccccggcaacctgcagggcgaggacagccaggccttcagcagcaagagagaccccgaggtgggcaaggacgagctgagcaagcccagcagcgacgccgagagcagagaccaccccagcagccacagcgcccagccccccagaaagggcggcgccggccacaccgacggcccccacagccagaccgccgaggccgacgccagcggcctgccccacaagctgggcgaggaggaccccgtgctgccccccgtgcccgacggcgccggcgagcccaccgtgcccgagggcgccatctgggagggcagcggcctgcagcccaagtgccccgacaccctgcagagcagagagggcctgggcagaatggagagcttcctgaccctggagagcgagaagagcgacttcccccccacccccgtggccgaggtggcccccaaggcccaggagggcgagagcaccctggagatcagaaagatgggcagctgcgacggcgagggcctgctgaccagccccgaccagcccagaggccccgcctgcgacgccagcagacaggagttccacgccggcgtgccccaccccccccagggcgagaacctggccgccgacctgggcctgaccgccctgatcctggaccaggaccagcagggcatccccagctgccccggcgagggctggatcagaggcgccgccagcgagtggcccctgctgagcagcgagaagcacctgcagcccagccaggcccagcccgagaccagcatcttcgacgtgctgaaggagcaggcccagccccccgagaacggcaaggagaccagccccagccaccccggcttcaaggaccagggcgccgacagcagccagatccacgtgcccgtggagccccaggaggacaacaacctgcccacccacggcggccaggagcaggccctgggcagcgagctgcagagccagctgcccaagggcaccctgagcgacacccccaccagcagccccaccgacatggtgtgggagagcagcctgaccgaggagagcgagctgagcgcccccaccagacagaagctgcccgccctgggcgagaagagacccgagggcgcctgcggcgacggccagagcagcagagtgagcccccccgccgccgacgtgctgaaggacttcagcctggccggcaacttcagcagaaaggagacctgctgcaccggccagggccccaacaagagccagcaggccctggccgacgccctggaggagggcagccagcacgaggaggcctgccagagacaccccggcgccagcgaggccgccgacggctgcagccccctgtggggcctgagcaagagagagatggccagcggcaacaccggcgaggcccccccctgccagcccgacagcgtggccctgctggacgccgtgccctgcctgcccgccctggcccccgccagccccggcgtgacccccacccaggacgcccccgagaccgaggcctgcgacgagacccaggagggcagacagcagcccgtgcccgccccccagcagaagatggagtgctgggccaccagcgacgccgagagccccaagctgctggccagcttccccagcgccggcgagcagggcggcgaggccggcgccgccgagaccggcggcagcgccggcgccggcgaccccggcaagcagcaggcccccgagaagcccggcgaggccaccctgagctgcggcctgctgcagaccgagcactgcctgaccagcggcgaggaggccagcaccagcgccctgagagagagctgccaggccgagcaccccatggccagctgccaggacgccctgctgcccgccagagagctgggcggcatccccagaagcaccatggacttcagcacccaccaggccgtgcccgaccccaaggagctgctgctgagcggcccccccgaggtggccgcccccgacaccccctacctgcacgtggacagcgccgcccagagaggcgccgaggacagcggcgtgaaggccgtgagcagcgccgaccccagagcccccggcgagagcccctgccccgtgggcgagccccccctggccctggagaacgccgccagcctgaagctgttcgccggcagcctggcccccctgctgcagcccggcgccgccggcggcgagatccccgccgtgcaggccagcagcggcagccccaaggccagaaccaccgagggccccgtggacagcatgccctgcctggacagaatgcccctgctggccaagggcaagcaggccaccggcgaggagaaggccgccaccgcccccggcgccggcgccaaggccagcggcgagggcatggccggcgacgccgccggcgagaccgagggcagcatggagagaatgggcgagcccagccaggaccccaagcagggcaccagcggcggcgtggacaccagcagcgagcagatcgccaccctgaccggcttccccgacttcagagagcacatcgccaagatcttcgagaagcccgtgctgggcgccctggccacccccggcgagaaggccggcgccggcagaagcgccgtgggcaaggacctgaccagacccctgggccccgagaagctgctggacggcccccccggcgtggacgtgaccctgctgcccgccccccccgccagactgcaggtggagaagaagcagcagctggccggcgaggccgagatcagccacctggccctgcaggaccccgccagcgacaagctgctgggccccgccggcctgacctgggagagaaacctgcccggcgccggcgtgggcaaggagatggccggcgtgccccccaccctgagagaggacgagagacccgagggccccggcgccgcctggcccggcctggagggccaggcctacagccagctggagagaagcagacaggagctggccagcggcctgcccagccccgccgccacccaggagctgcccgtggagagagccgccgccttccaggtggccccccacagccacggcgaggaggccgtggcccaggacagaatccccagcggcaagcagcaccaggagaccagcgcctgcgacagcccccacggcgaggacggccccggcgacttcgcccacaccggcgtgcccggccacgtgcccagaagcacctgcgcccccagcccccagagagaggtgctgaccgtgcccgaggccaacagcgagccctggaccctggacaccctgggcggcgagagaagacccggcgtgaccgccggcatcctggagatgagaaacgccctgggcaaccagagcacccccgccccccccaccggcgaggtggccgacacccccctggagcccggcaaggtggccggcgccgccggcgaggccgagggcgacatcaccctgagcaccgccgagacccaggcctgcgccagcggcgacctgcccgaggccggcaccaccagaaccttcagcgtggtggccggcgacctggtgctgcccggcagctgccaggaccccgcctgcagcgacaaggcccccggcatggagggcaccgccgccctgcacggcgacagccccgccagaccccagcaggccaaggagcagcccggccccgagagacccatccccgccggcgacggcaaggtgtgcgtgagcagcccccccgagcccgacgagacccacgaccccaagctgcagcacctggcccccgaggagctgcacaccgacagagagagccccagacccggccccagcatgctgcccagcgtgcccaagaaggacgcccccagagtgatggacaaggtgaccagcgacgagaccagaggcgccgagggcaccgagagcagccccgtggccgacgacatcatccagcccgccgcccccgccgacctggagagccccaccctggccgccagcagctaccacggcgacgtggtgggccaggtgagcaccgacctgatcgcccagagcatcagccccgccgccgcccacgccggcctgccccccagcgccgccgagcacatcgtgagccccagcgcccccgccggcgacagagtggaggccagcacccccagctgccccgaccccgccaaggacctgagcagaagcagcgacagcgaggaggccttcgagacccccgagagcaccacccccgtgaaggccccccccgccccccccccccccccccccgaggtgatccccgagcccgaggtgagcacccagcccccccccgaggagcccggctgcggcagcgagaccgtgcccgtgcccgacggccccagaagcgacagcgtggagggcagccccttcagaccccccagccacagcttcagcgccgtgttcgacgaggacaagcccatcgccagcagcggcacctacaacctggacttcgacaacatcgagctggtggacaccttccagaccctggagcccagagccagcgacgccaagaaccaggagggcaaggtgaacaccagaagaaagagcaccgacagcgtgcccatcagcaagagcaccctgagcagaagcctgagcctgcaggccagcgacttcgacggcgccagcagcagcggcaaccccgaggccgtggccctggcccccgacgcctacagcaccggcagcagcagcgccagcagcaccctgaagagaaccaagaagcccagaccccccagcctgaagaagaagcagaccaccaagaagcccaccgagaccccccccgtgaaggagacccagcaggagcccgacgaggagagcctggtgcccagcggcgagaacctggccagcgagaccaagaccgagagcgccaagaccgagggccccagccccgccctgctggaggagacccccctggagcccgccgtgggccccaaggccgcctgccccctggacagcgagagcgccgagggcgtggtgccccccgccagcggcggcggcagagtgcagaacagcccccccgtgggcagaaagaccctgcccctgaccaccgcccccgaggccggcgaggtgacccccagcgacagcggcggccaggaggacagccccgccaagggcctgagcgtgagactggagttcgactacagcgaggacaagagcagctgggacaaccagcaggagaaccccccccccaccaagaagatcggcaagaagcccgtggccaagatgcccctgagaagacccaagatgaagaagacccccgagaagctggacaacacccccgccagcccccccagaagccccgccgagcccaacgacatccccatcgccaagggcacctacaccttcgacatcgacaagtgggacgaccccaacttcaaccccttcagcagcaccagcaagatgcaggagagccccaagctgccccagcagagctacaacttcgaccccgacacctgcgacgagagcgtggaccccttcaagaccagcagcaagacccccagcagccccagcaagagccccgccagcttcgagatccccgccagcgccatggaggccaacggcgtggacggcgacggcctgaacaagcccgccaagaagaagaagacccccctgaagaccgacaccttcagagtgaagaagagccccaagagaagccccctgagcgacccccccagccaggaccccacccccgccgccacccccgagaccccccccgtgatcagcgccgtggtgcacgccaccgacgaggagaagctggccgtgaccaaccagaagtggacctgcatgaccgtggacctggaggccgacaagcaggactacccccagcccagcgacctgagcaccttcgtgaacgagaccaagttcagcagccccaccgaggagctggactacagaaacagctacgagatcgagtacatggagaagatcggcagcagcctgccccaggacgacgacgcccccaagaagcaggccctgtacctgatgttcgacaccagccaggagagccccgtgaagagcagccccgtgagaatgagcgagagccccaccccctgcagcggcagcagcttcgaggagaccgaggccctggtgaacaccgccgccaagaaccagcaccccgtgcccagaggcctggcccccaaccaggagagccacctgcaggtgcccgagaagagcagccagaaggagctggaggccatgggcctgggcacccccagcgaggccatcgagatcaccgcccccgagggcagcttcgccagcgccgacgccctgctgagcagactggcccaccccgtgagcctgtgcggcgccctggactacctggagcccgacctggccgagaagaacccccccctgttcgcccagaagctgcaggaggagctggagttcgccatcatgagaatcgaggccctgaagctggccagacagatcgccctggccagcagaagccaccaggacgccaagagagaggccgcccaccccaccgacgtgagcatcagcaagaccgccctgtacagcagaatcggcaccgccgaggtggagaagcccgccggcctgctgttccagcagcccgacctggacagcgccctgcagatcgccagagccgagatcatcaccaaggagagagaggtgagcgagtggaaggacaagtacgaggagagcagaagagaggtgatggagatgagaaagatcgtggccgagtacgagaagaccatcgcccagatgatcgaggacgagcagagagagaagagcgtgagccaccagaccgtgcagcagctggtgctggagaaggagcaggccctggccgacctgaacagcgtggagaagagcctggccgacctgttcagaagatacgagaagatgaaggaggtgctggagggcttcagaaagaacgaggaggtgctgaagagatgcgcccaggagtacctgagcagagtgaagaaggaggagcagagataccaggccctgaaggtgcacgccgaggagaagctggacagagccaacgccgagatcgcccaggtgagaggcaaggcccagcaggagcaggccgcccaccaggccagcctgagaaaggagcagctgagagtggacgccctggagagaaccctggagcagaagaacaaggagatcgaggagctgaccaagatctgcgacgagctgatcgccaagatgggcaagagctag

SEQ ID NO: 102935 - DNA, 8586 bp, Artificial Sequence
  Description of Artificial Sequence: Synthetic coding sequence
cagagaaccctgagcgcccagacccccagaagcgcccagccccccggcaacagccagaacatcaagagaaagcagcaggacacccccggcagccccgaccacagagacgccagcagcatcggcagcgtgggcctgggcggcttctgcaccgccagcgagagcagcgccagcctggacccctgcctggtgagccccgaggtgaccgagcccagaaaggacccccagggcgccagaggccccgagggcagcctgctgcccagccccccccccagccaggagagagagcaccccagcagcagcatgcccttcgccgagtgcccccccgagggctgcctggccagccccgccgccgcccccgaggacggcccccagacccagagccccagaagagagcccgcccccaacgcccccggcgacatcgccgccgccttccccgccgagagagacagcagcaccccctaccaggagatcgccgccgtgcccagcgccggcagagagagacagcccaaggaggagggccagaagagcagcttcagcttcagcagcggcatcgaccagagccccggcatgagccccgtgcccctgagagagcccatgaaggcccccctgtgcggcgagggcgaccagcccggcggcttcgagagccaggagaaggaggccgccggcggcttcccccccgccgagagcagacagggcgtggccagcgtgcaggtgacccccgaggcccccgccgccgcccagcagggcaccgagagcagcgccgtgctggagaagagccccctgaagcccatggcccccatcccccaggaccccgcccccagagccagcgacagagagagaggccagggcgaggcccccccccagtacctgaccgacgacctggagttcctgagagcctgccacctgcccagaagcaacagcggcgccgcccccgaggccgaggtgaacgccgccagccaggagagctgccagcagcccgtgggcgcctacctgccccacgccgagctgccctggggcctgcccagccccgccctggtgcccgaggccggcggcagcggcaaggaggccctggacaccatcgacgtgcagggccacccccagaccggcatgagaggcaccaagcccaaccaggtggtgtgcgtggccgccggcggccagcccgagggcggcctgcccgtgagccccgagcccagcctgctgacccccaccgaggaggcccaccccgccagcagcctggccagcttccccgccgcccagatccccatcgccgtggaggagcccggcagcagcagcagagagagcgtgagcaaggccggcatgcccgtgagcgccgacgccgccaaggaggtggtggacgccggcctggtgggcctggagagacaggtgagcgacctgggcagcaagggcgagcaccccgagggcgaccccggcgaggtgcccgcccccagcccccaggagagaggcgagcacctgaacaccgagcagagccacgaggtgcagcccggcgtgccccccccccccctgcccaaggagcagagccacgaggtgcagcccggcgccccccccccccccctgcccaaggcccccagcgagagcgccagaggcccccccggccccaccgacggcgccaaggtgcacgaggacagcaccagccccgccgtggccaaggagggcagcagaagccccggcgacagccccggcggcaaggaggaggcccccgagccccccgacggcggcgaccccggcaacctgcagggcgaggacagccaggccttcagcagcaagagagaccccgaggtgggcaaggacgagctgagcaagcccagcagcgacgccgagagcagagaccaccccagcagccacagcgcccagccccccagaaagggcggcgccggccacaccgacggcccccacagccagaccgccgaggccgacgccagcggcctgccccacaagctgggcgaggaggaccccgtgctgccccccgtgcccgacggcgccggcgagcccaccgtgcccgagggcgccatctgggagggcagcggcctgcagcccaagtgccccgacaccctgcagagcagagagggcctgggcagaatggagagcttcctgaccctggagagcgagaagagcgacttcccccccacccccgtggccgaggtggcccccaaggcccaggagggcgagagcaccctggagatcagaaagatgggcagctgcgacggcgagggcctgctgaccagccccgaccagcccagaggccccgcctgcgacgccagcagacaggagttccacgccggcgtgccccaccccccccagggcgagaacctggccgccgacctgggcctgaccgccctgatcctggaccaggaccagcagggcatccccagctgccccggcgagggctggatcagaggcgccgccagcgagtggcccctgctgagcagcgagaagcacctgcagcccagccaggcccagcccgagaccagcatcttcgacgtgctgaaggagcaggcccagccccccgagaacggcaaggagaccagccccagccaccccggcttcaaggaccagggcgccgacagcagccagatccacgtgcccgtggagccccaggaggacaacaacctgcccacccacggcggccaggagcaggccctgggcagcgagctgcagagccagctgcccaagggcaccctgagcgacacccccaccagcagccccaccgacatggtgtgggagagcagcctgaccgaggagagcgagctgagcgcccccaccagacagaagctgcccgccctgggcgagaagagacccgagggcgcctgcggcgacggccagagcagcagagtgagcccccccgccgccgacgtgctgaaggacttcagcctggccggcaacttcagcagaaaggagacctgctgcaccggccagggccccaacaagagccagcaggccctggccgacgccctggaggagggcagccagcacgaggaggcctgccagagacaccccggcgccagcgaggccgccgacggctgcagccccctgtggggcctgagcaagagagagatggccagcggcaacaccggcgaggcccccccctgccagcccgacagcgtggccctgctggacgccgtgccctgcctgcccgccctggcccccgccagccccggcgtgacccccacccaggacgcccccgagaccgaggcctgcgacgagacccaggagggcagacagcagcccgtgcccgccccccagcagaagatggagtgctgggccaccagcgacgccgagagccccaagctgctggccagcttccccagcgccggcgagcagggcggcgaggccggcgccgccgagaccggcggcagcgccggcgccggcgaccccggcaagcagcaggcccccgagaagcccggcgaggccaccctgagctgcggcctgctgcagaccgagcactgcctgaccagcggcgaggaggccagcaccagcgccctgagagagagctgccaggccgagcaccccatggccagctgccaggacgccctgctgcccgccagagagctgggcggcatccccagaagcaccatggacttcagcacccaccaggccgtgcccgaccccaaggagctgctgctgagcggcccccccgaggtggccgcccccgacaccccctacctgcacgtggacagcgccgcccagagaggcgccgaggacagcggcgtgaaggccgtgagcagcgccgaccccagagcccccggcgagagcccctgccccgtgggcgagccccccctggccctggagaacgccgccagcctgaagctgttcgccggcagcctggcccccctgctgcagcccggcgccgccggcggcgagatccccgccgtgcaggccagcagcggcagccccaaggccagaaccaccgagggccccgtggacagcatgccctgcctggacagaatgcccctgctggccaagggcaagcaggccaccggcgaggagaaggccgccaccgcccccggcgccggcgccaaggccagcggcgagggcatggccggcgacgccgccggcgagaccgagggcagcatggagagaatgggcgagcccagccaggaccccaagcagggcaccagcggcggcgtggacaccagcagcgagcagatcgccaccctgaccggcttccccgacttcagagagcacatcgccaagatcttcgagaagcccgtgctgggcgccctggccacccccggcgagaaggccggcgccggcagaagcgccgtgggcaaggacctgaccagacccctgggccccgagaagctgctggacggcccccccggcgtggacgtgaccctgctgcccgccccccccgccagactgcaggtggagaagaagcagcagctggccggcgaggccgagatcagccacctggccctgcaggaccccgccagcgacaagctgctgggccccgccggcctgacctgggagagaaacctgcccggcgccggcgtgggcaaggagatggccggcgtgccccccaccctgagagaggacgagagacccgagggccccggcgccgcctggcccggcctggagggccaggcctacagccagctggagagaagcagacaggagctggccagcggcctgcccagccccgccgccacccaggagctgcccgtggagagagccgccgccttccaggtggccccccacagccacggcgaggaggccgtggcccaggacagaatccccagcggcaagcagcaccaggagaccagcgcctgcgacagcccccacggcgaggacggccccggcgacttcgcccacaccggcgtgcccggccacgtgcccagaagcacctgcgcccccagcccccagagagaggtgctgaccgtgcccgaggccaacagcgagccctggaccctggacaccctgggcggcgagagaagacccggcgtgaccgccggcatcctggagatgagaaacgccctgggcaaccagagcacccccgccccccccaccggcgaggtggccgacacccccctggagcccggcaaggtggccggcgccgccggcgaggccgagggcgacatcaccctgagcaccgccgagacccaggcctgcgccagcggcgacctgcccgaggccggcaccaccagaaccttcagcgtggtggccggcgacctggtgctgcccggcagctgccaggaccccgcctgcagcgacaaggcccccggcatggagggcaccgccgccctgcacggcgacagccccgccagaccccagcaggccaaggagcagcccggccccgagagacccatccccgccggcgacggcaaggtgtgcgtgagcagcccccccgagcccgacgagacccacgaccccaagctgcagcacctggcccccgaggagctgcacaccgacagagagagccccagacccggccccagcatgctgcccagcgtgcccaagaaggacgcccccagagtgatggacaaggtgaccagcgacgagaccagaggcgccgagggcaccgagagcagccccgtggccgacgacatcatccagcccgccgcccccgccgacctggagagccccaccctggccgccagcagctaccacggcgacgtggtgggccaggtgagcaccgacctgatcgcccagagcatcagccccgccgccgcccacgccggcctgccccccagcgccgccgagcacatcgtgagccccagcgcccccgccggcgacagagtggaggccagcacccccagctgccccgaccccgccaaggacctgagcagaagcagcgacagcgaggaggccttcgagacccccgagagcaccacccccgtgaaggccccccccgccccccccccccccccccccgaggtgatccccgagcccgaggtgagcacccagcccccccccgaggagcccggctgcggcagcgagaccgtgcccgtgcccgacggccccagaagcgacagcgtggagggcagccccttcagaccccccagccacagcttcagcgccgtgttcgacgaggacaagcccatcgccagcagcggcacctacaacctggacttcgacaacatcgagctggtggacaccttccagaccctggagcccagagccagcgacgccaagaaccaggagggcaaggtgaacaccagaagaaagagcaccgacagcgtgcccatcagcaagagcaccctgagcagaagcctgagcctgcaggccagcgacttcgacggcgccagcagcagcggcaaccccgaggccgtggccctggcccccgacgcctacagcaccggcagcagcagcgccagcagcaccctgaagagaaccaagaagcccagaccccccagcctgaagaagaagcagaccaccaagaagcccaccgagaccccccccgtgaaggagacccagcaggagcccgacgaggagagcctggtgcccagcggcgagaacctggccagcgagaccaagaccgagagcgccaagaccgagggccccagccccgccctgctggaggagacccccctggagcccgccgtgggccccaaggccgcctgccccctggacagcgagagcgccgagggcgtggtgccccccgccagcggcggcggcagagtgcagaacagcccccccgtgggcagaaagaccctgcccctgaccaccgcccccgaggccggcgaggtgacccccagcgacagcggcggccaggaggacagccccgccaagggcctgagcgtgagactggagttcgactacagcgaggacaagagcagctgggacaaccagcaggagaaccccccccccaccaagaagatcggcaagaagcccgtggccaagatgcccctgagaagacccaagatgaagaagacccccgagaagctggacaacacccccgccagcccccccagaagccccgccgagcccaacgacatccccatcgccaagggcacctacaccttcgacatcgacaagtgggacgaccccaacttcaaccccttcagcagcaccagcaagatgcaggagagccccaagctgccccagcagagctacaacttcgaccccgacacctgcgacgagagcgtggaccccttcaagaccagcagcaagacccccagcagccccagcaagagccccgccagcttcgagatccccgccagcgccatggaggccaacggcgtggacggcgacggcctgaacaagcccgccaagaagaagaagacccccctgaagaccgacaccttcagagtgaagaagagccccaagagaagccccctgagcgacccccccagccaggaccccacccccgccgccacccccgagaccccccccgtgatcagcgccgtggtgcacgccaccgacgaggagaagctggccgtgaccaaccagaagtggacctgcatgaccgtggacctggaggccgacaagcaggactacccccagcccagcgacctgagcaccttcgtgaacgagaccaagttcagcagccccaccgaggagctggactacagaaacagctacgagatcgagtacatggagaagatcggcagcagcctgccccaggacgacgacgcccccaagaagcaggccctgtacctgatgttcgacaccagccaggagagccccgtgaagagcagccccgtgagaatgagcgagagccccaccccctgcagcggcagcagcttcgaggagaccgaggccctggtgaacaccgccgccaagaaccagcaccccgtgcccagaggcctggcccccaaccaggagagccacctgcaggtgcccgagaagagcagccagaaggagctggaggccatgggcctgggcacccccagcgaggccatcgagatcagagaggccgcccaccccaccgacgtgagcatcagcaagaccgccctgtacagcagaatcggcaccgccgaggtggagaagcccgccggcctgctgttccagcagcccgacctggacagcgccctgcagatcgccagagccgagatcatcaccaaggagagagaggtgagcgagtggaaggacaagtacgaggagagcagaagagaggtgatggagatgagaaagatcgtggccgagtacgagaagaccatcgcccagatgatcgaggacgagcagagagagaagagcgtgagccaccagaccgtgcagcagctggtgctggagaaggagcaggccctggccgacctgaacagcgtggagaagagcctggccgacctgttcagaagatacgagaagatgaaggaggtgctggagggcttcagaaagaacgaggaggtgctgaagagatgcgcccaggagtacctgagcagagtgaagaaggaggagcagagataccaggccctgaaggtgcacgccgaggagaagctggacagagccaacgccgagatcgcccaggtgagaggcaaggcccagcaggagcaggccgcccaccaggccagcctgagaaaggagcagctgagagtggacgccctggagagaaccctggagcagaagaacaaggagatcgaggagctgaccaagatctgcgacgagctgatcgccaagatgggcaagagctag

SEQ ID NO: 102936 - DNA, 3285 bp, Artificial Sequence
  Description of Artificial Sequence: Synthetic coding sequence
atgggcaacgagaacagcaccagcgacaaccagagaaccctgagcgcccagacccccagaagcgcccagccccccggcaacagccagaacatcaagagaaagcagcaggacacccccggcagccccgaccacagagacgccagcagcagccccgtggccgacgacatcatccagcccgccgcccccgccgacctggagagccccaccctggccgccagcagctaccacggcgacgtggtgggccaggtgagcaccgacctgatcgcccagagaagcagcgacagcgaggaggccttcgagacccccgagagcaccacccccgtgaaggccccccccgccccccccccccccccccccgaggtgatccccgagcccgaggtgagcacccagcccccccccgaggagcccggctgcggcagcgagaccgtgcccgtgcccgacggccccagaagcgacagcgtggagggcagccccttcagaccccccagccacagcttcagcgccgtgttcgacgaggacaagcccatcgccagcagcggcacctacaacctggacttcgacaacatcgagctggtggacaccttccagaccctggagcccagagccagcgacgccaagaaccaggagggcaaggtgaacaccagaagaaagagcaccgacagcgtgcccatcagcaagagcaccctgagcagaagcctgagcctgcaggccagcgacttcgacggcgccagcagcagcggcaaccccgaggccgtggccctggcccccgacgcctacagcaccggcagcagcagcgccagcagcaccctgaagagaaccaagaagcccagaccccccagcctgaagaagaagcagaccaccaagaagcccaccgagaccccccccgtgaaggagacccagcaggagcccgacgaggagagcctggtgcccagcggcgagaacctggccagcgagaccaagaccgagagcgccaagaccgagggccccagccccgccctgctggaggagacccccctggagcccgccgtgggccccaaggccgcctgccccctggacagcgagagcgccgagggcgtggtgccccccgccagcggcggcggcagagtgcagaacagcccccccgtgggcagaaagaccctgcccctgaccaccgcccccgaggccggcgaggtgacccccagcgacagcggcggccaggaggacagccccgccaagggcctgagcgtgagactggagttcgactacagcgaggacaagagcagctgggacaaccagcaggagaaccccccccccaccaagaagatcggcaagaagcccgtggccaagatgcccctgagaagacccaagatgaagaagacccccgagaagctggacaacacccccgccagcccccccagaagccccgccgagcccaacgacatccccatcgccaagggcacctacaccttcgacatcgacaagtgggacgaccccaacttcaaccccttcagcagcaccagcaagatgcaggagagccccaagctgccccagcagagctacaacttcgaccccgacacctgcgacgagagcgtggaccccttcaagaccagcagcaagacccccagcagccccagcaagagccccgccagcttcgagatccccgccagcgccatggaggccaacggcgtggacggcgacggcctgaacaagcccgccaagaagaagaagacccccctgaagaccgacaccttcagagtgaagaagagccccaagagaagccccctgagcgacccccccagccaggaccccacccccgccgccacccccgagaccccccccgtgatcagcgccgtggtgcacgccaccgacgaggagaagctggccgtgaccaaccagaagtggacctgcatgaccgtggacctggaggccgacaagcaggactacccccagcccagcgacctgagcaccttcgtgaacgagaccaagttcagcagccccaccgaggagctggactacagaaacagctacgagatcgagtacatggagaagatcggcagcagcctgccccaggacgacgacgcccccaagaagcaggccctgtacctgatgttcgacaccagccaggagagccccgtgaagagcagccccgtgagaatgagcgagagccccaccccctgcagcggcagcagcttcgaggagaccgaggccctggtgaacaccgccgccaagaaccagcaccccgtgcccagaggcctggcccccaaccaggagagccacctgcaggtgcccgagaagagcagccagaaggagctggaggccatgggcctgggcacccccagcgaggccatcgagatcaccgcccccgagggcagcttcgccagcgccgacgccctgctgagcagactggcccaccccgtgagcctgtgcggcgccctggactacctggagcccgacctggccgagaagaacccccccctgttcgcccagaagctgcaggaggagctggagttcgccatcatgagaatcgaggccctgaagctggccagacagatcgccctggccagcagaagccaccaggacgccaagagagaggccgcccaccccaccgacgtgagcatcagcaagaccgccctgtacagcagaatcggcaccgccgaggtggagaagcccgccggcctgctgttccagcagcccgacctggacagcgccctgcagatcgccagagccgagatcatcaccaaggagagagaggtgagcgagtggaaggacaagtacgaggagagcagaagagaggtgatggagatgagaaagatcgtggccgagtacgagaagaccatcgcccagatgatcgaggacgagcagagagagaagagcgtgagccaccagaccgtgcagcagctggtgctggagaaggagcaggccctggccgacctgaacagcgtggagaagagcctggccgacctgttcagaagatacgagaagatgaaggaggtgctggagggcttcagaaagaacgaggaggtgctgaagagatgcgcccaggagtacctgagcagagtgaagaaggaggagcagagataccaggccctgaaggtgcacgccgaggagaagctggacagagccaacgccgagatcgcccaggtgagaggcaaggcccagcaggagcaggccgcccaccaggccagcctgagaaaggagcagctgagagtggacgccctggagagaaccctggagcagaagaacaaggagatcgaggagctgaccaagatctgcgacgagctgatcgccaagatgggcaagagctag

SEQ ID NO: 102937 - DNA, 2991 bp, Artificial Sequence
  Description of Artificial Sequence: Synthetic coding sequence
atgggcggcagccagagcctgcagcccgcccccgccagcgacctgaacctggaggccagcgaggccatgagcagcgacagcgaggaggccttcgagacccccgagagcaccacccccgtgaaggccccccccgccccccccccccccccccccgaggtgatccccgagcccgaggtgagcacccagcccccccccgaggagcccggctgcggcagcgagaccgtgcccgtgcccgacggccccagaagcgacagcgtggagggcagccccttcagaccccccagccacagcttcagcgccgtgttcgacgaggacaagcccatcgccagcagcggcacctacaacctggacttcgacaacatcgagctggtggacaccttccagaccctggagcccagagccagcgacgccaagaaccaggagggcaaggtgaacaccagaagaaagagcaccgacagcgtgcccatcagcaagagcaccctgagcagaagcctgagcctgcaggccagcgacttcgacggcgccagcagcagcggcaaccccgaggccgtggccctggcccccgacgcctacagcaccggcagcagcagcgccagcagcaccctgaagagaaccaagaagcccagaccccccagcctgaagaagaagcagaccaccaagaagcccaccgagaccccccccgtgaaggagacccagcaggagcccgacgaggagagcctggtgcccagcggcgagaacctggccagcgagaccaagaccgagagcgccaagaccgagggccccagccccgccctgctggaggagacccccctggagcccgccgtgggccccaaggccgcctgccccctggacagcgagagcgccgagggcgtggtgccccccgccagcggcggcggcagagtgcagaacagcccccccgtgggcagaaagaccctgcccctgaccaccgcccccgaggccggcgaggtgacccccagcgacagcggcggccaggaggacagccccgccaagggcctgagcgtgagactggagttcgactacagcgaggacaagagcagctgggacaaccagcaggagaaccccccccccaccaagaagatcggcaagaagcccgtggccaagatgcccctgagaagacccaagatgaagaagacccccgagaagctggacaacacccccgccagcccccccagaagccccgccgagcccaacgacatccccatcgccaagggcacctacaccttcgacatcgacaagtgggacgaccccaacttcaaccccttcagcagcaccagcaagatgcaggagagccccaagctgccccagcagagctacaacttcgaccccgacacctgcgacgagagcgtggaccccttcaagaccagcagcaagacccccagcagccccagcaagagccccgccagcttcgagatccccgccagcgccatggaggccaacggcgtggacggcgacggcctgaacaagcccgccaagaagaagaagacccccctgaagaccgacaccttcagagtgaagaagagccccaagagaagccccctgagcgacccccccagccaggaccccacccccgccgccacccccgagaccccccccgtgatcagcgccgtggtgcacgccaccgacgaggagaagctggccgtgaccaaccagaagtggacctgcatgaccgtggacctggaggccgacaagcaggactacccccagcccagcgacctgagcaccttcgtgaacgagaccaagttcagcagccccaccgaggagctggactacagaaacagctacgagatcgagtacatggagaagatcggcagcagcctgccccaggacgacgacgcccccaagaagcaggccctgtacctgatgttcgacaccagccaggagagccccgtgaagagcagccccgtgagaatgagcgagagccccaccccctgcagcggcagcagcttcgaggagaccgaggccctggtgaacaccgccgccaagaaccagcaccccgtgcccagaggcctggcccccaaccaggagagccacctgcaggtgcccgagaagagcagccagaaggagctggaggccatgggcctgggcacccccagcgaggccatcgagatcaccgcccccgagggcagcttcgccagcgccgacgccctgctgagcagactggcccaccccgtgagcctgtgcggcgccctggactacctggagcccgacctggccgagaagaacccccccctgttcgcccagaagctgcagagagaggccgcccaccccaccgacgtgagcatcagcaagaccgccctgtacagcagaatcggcaccgccgaggtggagaagcccgccggcctgctgttccagcagcccgacctggacagcgccctgcagatcgccagagccgagatcatcaccaaggagagagaggtgagcgagtggaaggacaagtacgaggagagcagaagagaggtgatggagatgagaaagatcgtggccgagtacgagaagaccatcgcccagatgatcgaggacgagcagagagagaagagcgtgagccaccagaccgtgcagcagctggtgctggagaaggagcaggccctggccgacctgaacagcgtggagaagagcctggccgacctgttcagaagatacgagaagatgaaggaggtgctggagggcttcagaaagaacgaggaggtgctgaagagatgcgcccaggagtacctgagcagagtgaagaaggaggagcagagataccaggccctgaaggtgcacgccgaggagaagctggacagagccaacgccgagatcgcccaggtgagaggcaaggcccagcaggagcaggccgcccaccaggccagcctgagaaaggagcagctgagagtggacgccctggagagaaccctggagcagaagaacaaggagatcgaggagctgaccaagatctgcgacgagctgatcgccaagatgggcaagagctag

SEQ ID NO: 102938 - DNA, 1716 bp, Artificial Sequence
  Description of Artificial Sequence: Synthetic coding sequence
atgcccctgagaagacccaagatgaagaagacccccgagaagctggacaacacccccgccagcccccccagaagccccgccgagcccaacgacatccccatcgccaagggcacctacaccttcgacatcgacaagtgggacgaccccaacttcaaccccttcagcagcaccagcaagatgcaggagagccccaagctgccccagcagagctacaacttcgaccccgacacctgcgacgagagcgtggaccccttcaagaccagcagcaagacccccagcagccccagcaagagccccgccagcttcgagatccccgccagcgccatggaggccaacggcgtggacggcgacggcctgaacaagcccgccaagaagaagaagacccccctgaagaccgtgaagaagagccccaagagaagccccctgagcgacccccccagccaggaccccacccccgccgccacccccgagaccccccccgtgatcagcgccgtggtgcacgccaccgacgaggagaagctggccgtgaccaaccagaagtggacctgcatgaccgtggacctggaggccgacaagcaggactacccccagcccagcgacctgagcaccttcgtgaacgagaccaagttcagcagccccaccgaggagctggactacagaaacagctacgagatcgagtacatggagaagatcggcagcagcctgccccaggacgacgacgcccccaagaagcaggccctgtacctgatgttcgacaccagccaggagagccccgtgaagagcagccccgtgagaatgagcgagagccccaccccctgcagcggcagcagcttcgaggagaccgaggccctggtgaacaccgccgccaagaaccagcaccccgtgcccagaggcctggcccccaaccaggagagccacctgcaggtgcccgagaagagcagccagaaggagctggaggccatgggcctgggcacccccagcgaggccatcgagatcagagaggccgcccaccccaccgacgtgagcatcagcaagaccgccctgtacagcagaatcggcaccgccgaggtggagaagcccgccggcctgctgttccagcagcccgacctggacagcgccctgcagatcgccagagccgagatcatcaccaaggagagagaggtgagcgagtggaaggacaagtacgaggagagcagaagagaggtgatggagatgagaaagatcgtggccgagtacgagaagaccatcgcccagatgatcgaggacgagcagagagagaagagcgtgagccaccagaccgtgcagcagctggtgctggagaaggagcaggccctggccgacctgaacagcgtggagaagagcctggccgacctgttcagaagatacgagaagatgaaggaggtgctggagggcttcagaaagaacgaggaggtgctgaagagatgcgcccaggagtacctgagcagagtgaagaaggaggagcagagataccaggccctgaaggtgcacgccgaggagaagctggacagagccaacgccgagatcgcccaggtgagaggcaaggcccagcaggagcaggccgcccaccaggccagcctgagaaaggagcagctgagagtggacgccctggagagaaccctggagcagaagaacaaggagatcgaggagctgaccaagatctgcgacgagctgatcgccaagatgggcaagagctag

SEQ ID NO: 102939 - DNA, 8847 bp, Artificial Sequence; identical to SEQ ID NO: 102934
  Description of Artificial Sequence: Synthetic coding sequence

SEQ ID NO: 102940 - DNA, 8628 bp, Artificial Sequence
  Description of Artificial Sequence: Synthetic coding sequence
atgggcaacgagaacagcaccagcgacaaccagagaaccctgagcgcccagacccccagaagcgcccagccccccggcaacagccagaacatcaagagaaagcagcaggacacccccggcagccccgaccacagagacgccagcagcatcggcagcgtgggcctgggcggcttctgcaccgccagcgagagcagcgccagcctggacccctgcctggtgagccccgaggtgaccgagcccagaaaggacccccagggcgccagaggccccgagggcagcctgctgcccagccccccccccagccaggagagagagcaccccagcagcagcatgcccttcgccgagtgcccccccgagggctgcctggccagccccgccgccgcccccgaggacggcccccagacccagagccccagaagagagcccgcccccaacgcccccggcgacatcgccgccgccttccccgccgagagagacagcagcaccccctaccaggagatcgccgccgtgcccagcgccggcagagagagacagcccaaggaggagggccagaagagcagcttcagcttcagcagcggcatcgaccagagccccggcatgagccccgtgcccctgagagagcccatgaaggcccccctgtgcggcgagggcgaccagcccggcggcttcgagagccaggagaaggaggccgccggcggcttcccccccgccgagagcagacagggcgtggccagcgtgcaggtgacccccgaggcccccgccgccgcccagcagggcaccgagagcagcgccgtgctggagaagagccccctgaagcccatggcccccatcccccaggaccccgcccccagagccagcgacagagagagaggccagggcgaggcccccccccagtacctgaccgacgacctggagttcctgagagcctgccacctgcccagaagcaacagcggcgccgcccccgaggccgaggtgaacgccgccagccaggagagctgccagcagcccgtgggcgcctacctgccccacgccgagctgccctggggcctgcccagccccgccctggtgcccgaggccggcggcagcggcaaggaggccctggacaccatcgacgtgcagggccacccccagaccggcatgagaggcaccaagcccaaccaggtggtgtgcgtggccgccggcggccagcccgagggcggcctgcccgtgagccccgagcccagcctgctgacccccaccgaggaggcccaccccgccagcagcctggccagcttccccgccgcccagatccccatcgccgtggaggagcccggcagcagcagcagagagagcgtgagcaaggccggcatgcccgtgagcgccgacgccgccaaggaggtggtggacgccggcctggtgggcctggagagacaggtgagcgacctgggcagcaagggcgagcaccccgagggcgaccccggcgaggtgcccgcccccagcccccaggagagaggcgagcacctgaacaccgagcagagccacgaggtgcagcccggcgtgccccccccccccctgcccaaggagcagagccacgaggtgcagcccggcgccccccccccccccctgcccaaggcccccagcgagagcgccagaggcccccccggccccaccgacggcgccaaggtgcacgaggacagcaccagccccgccgtggccaaggagggcagcagaagccccggcgacagccccggcggcaaggaggaggcccccgagccccccgacggcggcgaccccggcaacctgcagggcgaggacagccaggccttcagcagcaagagagaccccgaggtgggcaaggacgagctgagcaagcccagcagcgacgccgagagcagagaccaccccagcagccacagcgcccagccccccagaaagggcggcgccggccacaccgacggcccccacagccagaccgccgaggccgacgccagcggcctgccccacaagctgggcgaggaggaccccgtgctgccccccgtgcccgacggcgccggcgagcccaccgtgcccgagggcgccatctgggagggcagcggcctgcagcccaagtgccccgacaccctgcagagcagagagggcctgggcagaatggagagcttcctgaccctggagagcgagaagagcgacttcccccccacccccgtggccgaggtggcccccaaggcccaggagggcgagagcaccctggagatcagaaagatgggcagctgcgacggcgagggcctgctgaccagccccgaccagcccagaggccccgcctgcgacgccagcagacaggagttccacgccggcgtgccccaccccccccagggcgagaacctggccgccgacctgggcctgaccgccctgatcctggaccaggaccagcagggcatccccagctgccccggcgagggctggatcagaggcgccgccagcgagtggcccctgctgagcagcgagaagcacctgcagcccagccaggcccagcccgagaccagcatcttcgacgtgctgaaggagcaggcccagccccccgagaacggcaaggagaccagccccagccaccccggcttcaaggaccagggcgccgacagcagccagatccacgtgcccgtggagccccaggaggacaacaacctgcccacccacggcggccaggagcaggccctgggcagcgagctgcagagccagctgcccaagggcaccctgagcgacacccccaccagcagccccaccgacatggtgtgggagagcagcctgaccgaggagagcgagctgagcgcccccaccagacagaagctgcccgccctgggcgagaagagacccgagggcgcctgcggcgacggccagagcagcagagtgagcccccccgccgccgacgtgctgaaggacttcagcctggccggcaacttcagcagaaaggagacctgctgcaccggccagggccccaacaagagccagcaggccctggccgacgccctggaggagggcagccagcacgaggaggcctgccagagacaccccggcgccagcgaggccgccgacggctgcagccccctgtggggcctgagcaagagagagatggccagcggcaacaccggcgaggcccccccctgccagcccgacagcgtggccctgctggacgccgtgccctgcctgcccgccctggcccccgccagccccggcgtgacccccacccaggacgcccccgagaccgaggcctgcgacgagacccaggagggcagacagcagcccgtgcccgccccccagcagaagatggagtgctgggccaccagcgacgccgagagccccaagctgctggccagcttccccagcgccggcgagcagggcggcgaggccggcgccgccgagaccggcggcagcgccggcgccggcgaccccggcaagcagcaggcccccgagaagcccggcgaggccaccctgagctgcggcctgctgcagaccgagcactgcctgaccagcggcgaggaggccagcaccagcgccctgagagagagctgccaggccgagcaccccatggccagctgccaggacgccctgctgcccgccagagagctgggcggcatccccagaagcaccatggacttcagcacccaccaggccgtgcccgaccccaaggagctgctgctgagcggcccccccgaggtggccgcccccgacaccccctacctgcacgtggacagcgccgcccagagaggcgccgaggacagcggcgtgaaggccgtgagcagcgccgaccccagagcccccggcgagagcccctgccccgtgggcgagccccccctggccctggagaacgccgccagcctgaagctgttcgccggcagcctggcccccctgctgcagcccggcgccgccggcggcgagatccccgccgtgcaggccagcagcggcagccccaaggccagaaccaccgagggccccgtggacagcatgccctgcctggacagaatgcccctgctggccaagggcaagcaggccaccggcgaggagaaggccgccaccgcccccggcgccggcgccaaggccagcggcgagggcatggccggcgacgccgccggcgagaccgagggcagcatggagagaatgggcgagcccagccaggaccccaagcagggcaccagcggcggcgtggacaccagcagcgagcagatcgccaccctgaccggcttccccgacttcagagagcacatcgccaagatcttcgagaagcccgtgctgggcgccctggccacccccggcgagaaggccggcgccggcagaagcgccgtgggcaaggacctgaccagacccctgggccccgagaagctgctggacggcccccccggcgtggacgtgaccctgctgcccgccccccccgccagactgcaggtggagaagaagcagcagctggccggcgaggccgagatcagccacctggccctgcaggaccccgccagcgacaagctgctgggccccgccggcctgacctgggagagaaacctgcccggcgccggcgtgggcaaggagatggccggcgtgccccccaccctgagagaggacgagagacccgagggccccggcgccgcctggcccggcctggagggccaggcctacagccagctggagagaagcagacaggagctggccagcggcctgcccagccccgccgccacccaggagctgcccgtggagagagccgccgccttccaggtggccccccacagccacggcgaggaggccgtggcccaggacagaatccccagcggcaagcagcaccaggagaccagcgcctgcgacagcccccacggcgaggacggccccggcgacttcgcccacaccggcgtgcccggccacgtgcccagaagcacctgcgcccccagcccccagagagaggtgctgaccgtgcccgaggccaacagcgagccctggaccctggacaccctgggcggcgagagaagacccggcgtgaccgccggcatcctggagatgagaaacgccctgggcaaccagagcacccccgccccccccaccggcgaggtggccgacacccccctggagcccggcaaggtggccggcgccgccggcgaggccgagggcgacatcaccctgagcaccgccgagacccaggcctgcgccagcggcgacctgcccgaggccggcaccaccagaaccttcagcgtggtggccggcgacctggtgctgcccggcagctgccaggaccccgcctgcagcgacaaggcccccggcatggagggcaccgccgccctgcacggcgacagccccgccagaccccagcaggccaaggagcagcccggccccgagagacccatccccgccggcgacggcaaggtgtgcgtgagcagcccccccgagcccgacgagacccacgaccccaagctgcagcacctggcccccgaggagctgcacaccgacagagagagccccagacccggccccagcatgctgcccagcgtgcccaagaaggacgcccccagagtgatggacaaggtgaccagcgacgagaccagaggcgccgagggcaccgagagaagcgccaaggacatcggcctgtggaaggccatgatgcccagcctggacaccgacaccctggacgtgctggagagaagagtggtgctgatccagcacgagttcctgcacaagaaggaggccaacggccacagcagattcatgtacagcagccccgtggccgacgacatcatccagcccgccgcccccgccgacctggagagccccaccctggccgccagcagctaccacggcgacgtggtgggccaggtgagcaccgacctgatcgcccagagaagcagcgacagcgaggaggccttcgagacccccgagagcaccacccccgtgaaggccccccccgccccccccccccccccccccgaggtgatccccgagcccgaggtgagcacccagcccccccccgaggagcccggctgcggcagcgagaccgtgcccgtgcccgacggccccagaagcgacagcgtggagggcagccccttcagaccccccagccacagcttcagcgccgtgttcgacgaggacaagcccatcgccagcagcggcacctacaacctggacttcgacaacatcgagctggtggacaccttccagaccctggagcccagagccagcgacgccaagaaccaggagggcaaggtgaacaccagaagaaagagcaccgacagcgtgcccatcagcaagagcaccctgagcagaagcctgagcctgcaggccagcgacttcgacggcgccagcagcagcggcaaccccgaggccgtggccctggcccccgacgcctacagcaccggcagcagcagcgccagcagcaccctgaagagaaccaagaagcccagaccccccagcctgaagaagaagcagaccaccaagaagcccaccgagaccccccccgtgaaggagacccagcaggagcccgacgaggagagcctggtgcccagcggcgagaacctggccagcgagaccaagaccgagagcgccaagaccgagggccccagccccgccctgctggaggagacccccctggagcccgccgtgggccccaaggccgcctgccccctggacagcgagagcgccgagggcgtggtgccccccgccagcggcggcggcagagtgcagaacagcccccccgtgggcagaaagaccctgcccctgaccaccgcccccgaggccggcgaggtgacccccagcgacagcggcggccaggaggacagccccgccaagggcctgagcgtgagactggagttcgactacagcgaggacaagagcagctgggacaaccagcaggagaaccccccccccaccaagaagatcggcaagaagcccgtggccaagatgcccctgagaagacccaagatgaagaagacccccgagaagctggacaacacccccgccagcccccccagaagccccgccgagcccaacgacatccccatcgccaagggcacctacaccttcgacatcgacaagtgggacgaccccaacttcaaccccttcagcagcaccagcaagatgcaggagagccccaagctgccccagcagagctacaacttcgaccccgacacctgcgacgagagcgtggaccccttcaagaccagcagcaagacccccagcagccccagcaagagccccgccagcttcgagatccccgccagcgccatggaggccaacggcgtggacggcgacggcctgaacaagcccgccaagaagaagaagacccccctgaagaccgacaccttcagagtgaagaagagccccaagagaagccccctgagcgacccccccagccaggaccccacccccgccgccacccccgagaccccccccgtgatcagcgccgtggtgcacgccaccgacgaggagaagctggccgtgaccaaccagaagtggacctgcatgaccgtggacctggaggccgacaagcaggactacccccagcccagcgacctgagcaccttcgtgaacgagaccaagttcagcagccccaccgaggagctggactacagaaacagctacgagatcgagtacatggagaagatcggcagcagcctgccccaggacgacgacgcccccaagaagcaggccctgtacctgatgttcgacaccagccaggagagccccgtgaagagcagccccgtgagaatgagcgagagccccaccccctgcagcggcagcagcttcgaggagaccgaggccctggtgaacaccgccgccaagaaccagcaccccgtgcccagaggcctggcccccaaccaggagagccacctgcaggtgcccgagaagagcagccagaaggagctggaggccatgggcctgggcacccccagcgaggccatcgagatcagagaggccgcccaccccaccgacgtgagcatcagcaagaccgccctgtacagcagaatcggcaccgccgaggtggagaagcccgccggcctgctgttccagcagcccgacctggacagcgccctgcagatcgccagagccgagatcatcaccaaggagagagaggtgagcgagtggaaggacaagtacgaggagagcagaagagaggtgatggagatgagaaagatcgtggccgagtacgagaagaccatcgcccagatgatcgaggacgagcagagagagaagagcgtgagccaccagaccgtgcagcagctggtgctggagaaggagcaggccctggccgacctgaacagcgtggagaagagcctggccgacctgttcagaagatacgagaagatgaaggaggtgctggagggcttcagaaagaacgaggaggtgctgaagagatgcgcccaggagtacctgagcagagtgaagaaggaggagcagagataccaggccctgaaggtgcacgccgaggagaagctggacagagccaacgccgagatcgcccaggtgagaggcaaggcccagcaggagcaggccgcccaccaggccagcctgagaaaggagcagctgagagtggacgccctggagagaaccctggagcagaagaacaaggagatcgaggagctgaccaagatctgcgacgagctgatcgccaagatgggcaagagctag

SEQ ID NO: 102941 - DNA, 3285 bp, Artificial Sequence; identical to SEQ ID NO: 102936
  Description of Artificial Sequence: Synthetic coding sequence

SEQ ID NO: 102942 - DNA, 2517 bp, Artificial Sequence
  Description of Artificial Sequence: Synthetic coding sequence
atgagcctgcaggtgctgaacgacaagaacgtgagcaacgagaagaacaccgagaactgcgacttcctgttcagcccccccgaggtgaccggcagaagcagcgtgctgagagtgagccagaaggagaacgtgccccccaagaacctggccaaggccatgaaggtgaccttccagacccccctgagagacccccagacccacagaatcctgagccccagcatggccagcaagctggaggcccccttcacccaggacgacaccctgggcctggagaacagccaccccgtgtggacccagaaggagaaccagcagctgatcaaggaggtggacgccaagaccacccacggcatcctgcagaagcccgtggaggccgacaccgacctgctgggcgacgccagccccgccttcggcagcggcagcagcagcgagagcggccccggcgccctggccgacctggactgcagcagcagcagccagagccccggcagcagcgagaaccagatggtgagccccggcaaggtgagcggcagccccgagcaggccgtggaggagaacctgagcagctacagcctggacagaagagtgacccccgccagcgagaccctggaggacccctgcagaaccgagagccagcacaaggccgagaccccccacggcgccgaggaggagtgcaaggccgagaccccccacggcgccgaggaggagtgcagacacggcggcgtgtgcgcccccgccgccgtggccaccagcccccccggcgccatccccaaggaggcctgcggcggcgcccccctgcagggcctgcccggcgaggccctgggctgccccgccggcgtgggcacccccgtgcccgccgacggcacccagaccctgacctgcgcccacaccagcgcccccgagagcaccgcccccaccaaccacctggtggccggcagagccatgaccctgagcccccaggaggaggtggccgccggccagatggccagcagcagcagaagcggccccgtgaagctggagttcgacgtgagcgacggcgccaccagcaagagagcccccccccccagaagactgggcgagagaagcggcctgaagccccccctgagaaaggccgccgtgagacagcagaaggccccccaggaggtggaggaggacgacggcagaagcggcgccggcgaggacccccccatgcccgccagcagaggcagctaccacctggactgggacaagatggacgaccccaacttcatccccttcggcggcgacaccaagagcggctgcagcgaggcccagccccccgagagccccgagaccagactgggccagcccgccgccgagcagctgcacgccggccccgccaccgaggagcccggcccctgcctgagccagcagctgcacagcgccagcgccgaggacacccccgtggtgcagctggccgccgagacccccaccgccgagagcaaggagagagccctgaacagcgccagcaccagcctgcccaccagctgccccggcagcgagcccgtgcccacccaccagcagggccagcccgccctggagctgaaggaggagagcttcagagaccccgccgaggtgctgggcaccggcgccgaggtggactacctggagcagttcggcaccagcagcttcaaggagagcgccctgagaaagcagagcctgtacctgaagttcgaccccctgctgagagacagccccggcagacccgtgcccgtggccaccgagaccagcagcatgcacggcgccaacgagacccccagcggcagacccagagaggccaagctggtggagttcgacttcctgggcgccctggacatccccgtgcccggccccccccccggcgtgcccgcccccggcggcccccccctgagcaccggccccatcgtggacctgctgcagtacagccagaaggacctggacgccgtggtgaaggccacccaggaggagaacagagagctgagaagcagatgcgaggagctgcacggcaagaacctggagctgggcaagatcatggacagattcgaggaggtggtgtaccaggccatggaggaggtgcagaagcagaaggagctgagcaaggccgagatccagaaggtgctgaaggagaaggaccagctgaccaccgacctgaacagcatggagaagagcttcagcgacctgttcaagagattcgagaagcagaaggaggtgatcgagggctacagaaagaacgaggagagcctgaagaagtgcgtggaggactacctggccagaatcacccaggagggccagagataccaggccctgaaggcccacgccgaggagaagctgcagctggccaacgaggagatcgcccaggtgagaagcaaggcccaggccgaggccctggccctgcaggccagcctgagaaaggagcagatgagaatccagagcctggagaagaccgtggagcagaagaccaaggagaacgaggagctgaccagaatctgcgacgacctgatcagcaagatggagaagatctag

SEQ ID NO: 102943 - DNA, 438 bp, Artificial Sequence
  Description of Artificial Sequence: Synthetic coding sequence
atgagcctgcaggtgctgaacgacaagaacgtgagcaacgagaagaacaccgagaactgcgacttcctgttcagcccccccgaggtgaccggcagaagcagcgtgctgagagtgagccagaaggagaacgtgccccccaagaacctggccaaggccatgaaggtgaccttccagacccccctgagagacccccagacccacagaatcctgagccccagcatggccagcaagctggaggcccccttcacccaggacgacaccctgggcctggagaacagccaccccgtgtggacccagaaggagaaggccgccgccttcagcctgagcggcggccacgcctgcggcgccgtgggcagcagagaccccaacagcagagagcagggcgagagcctggagctgtgccagcacctggccagccacaagctgagcagacagtag

SEQ ID NO: 102944 - DNA, 666 bp, Artificial Sequence
  Description of Artificial Sequence: Synthetic coding sequence
atgagcctgcaggtgctgaacgacaagaacgtgagcaacgagaagaacaccgagaactgcgacttcctgttcagcccccccgaggtgaccggcagaagcagcgtgctgagagtgagccagaaggagaacgtgccccccaagaacctggccaaggccatgaaggtgaccttccagacccccctgagagacccccagacccacagaatcctgagccccagcatggccagcaagctggaggcccccttcacccaggacgacaccctgggcctggagaacagccaccccgtgtggacccagaaggagaaccagcagctgatcaaggaggtggacgccaagaccacccacggcatcctgcagaagcccgtggaggccgacaccgacctgctgggcgacgccagccccgccttcggcagcggcagcagcagcgagagcggccccggcgccctggccgacctggactgcagcagcagcagccagagccccggcagcagcgagaaccagatggtgagccccggcaaggtgagcggcagccccgagcaggccgtggaggagaacctgagcagctacagcctggacagaagagtgacccccgccagcgagaccctggaggacccctgcagaaccgagagccagcacaaggccgagaccccccacggcgccgagtag

SEQ ID NO: 102945 - DNA, 696 bp, Artificial Sequence
  Description of Artificial Sequence: Synthetic coding sequence
atgagcctgcaggtgctgaacgacaagaacgtgagcaacgagaagaacaccgagaactgcgacttcctgttcagcccccccgaggtgaccggcagaagcagcgtgctgagagtgagccagaaggagaacgtgccccccaagaacctggccaaggccatgaaggtgaccttccagacccccctgagagacccccagacccacagaatcctgagccccagcatggccagcaagctggaggcccccttcacccaggacgacaccctgggcctggagaacagccaccccgtgtggacccagaaggagaaccagcagctgatcaaggaggtggacgccaagaccacccacggcatcctgcagaagcccgtggaggccgacaccgacctgctgggcgacgccagccccgccttcggcagcggcagcagcagcgagagcggccccggcgccctggccgacctggactgcagcagcagcagccagagccccggcagcagcgagaaccagatggtgagccccggcaaggtgagcggcagccccgagcaggccgtggaggagaacctgagcagctacagcctggacagaagagtgacccccgccagcgagaccctggaggacccctgcagaaccgagagccagcacaaggccgagaccccccacggcgccgaggaggagtgcaaggccgagaccccccacggctag

SEQ ID NO: 102946 - DNA, 606 bp, Artificial Sequence
  Description of Artificial Sequence: Synthetic coding sequence
atggccaacaagggccccagctacggcatgagcagagaggtgcagagcaagatcgagaagaagtacgacgaggagctggaggagagactggtggagtggatcatcgtgcagtgcggccccgacgtgggcagacccgacagaggcagactgggcttccaggtgtggctgaagaacggcgtgatcctgagcaagctggtgaacagcctgtaccccgacggcagcaagcccgtgaaggtgcccgagaacccccccagcatggtgttcaagcagatggagcaggtggcccagttcctgaaggccgccgaggactacggcgtgatcaagaccgacatgttccagaccgtggacctgttcgagggcaaggacatggccgccgtgcagagaaccctgatggccctgggcagcctggccgtgaccaagaacgacggccactacagaggcgaccccaactggttcatgaagaaggcccaggagcacaagagagagttcaccgagagccagctgcaggagggcaagcacgtgatcggcctgcagatgggcagcaacagaggcgccagccaggccggcatgaccggctacggcagacccagacagatcatcagctag

SEQ ID NO: 102947 - DNA, 108 bp, Artificial Sequence
  Description of Artificial Sequence: Synthetic coding sequence
atggccaacaagggccccagctacggcatgagcagagaggtgcagcccagcagactggcctgcctgacccacaccagagtggtgcccagcgccctggccaagctgtag

SEQ ID NO: 102948 - DNA, 606 bp, Artificial Sequence; identical to SEQ ID NO: 102946
  Description of Artificial Sequence: Synthetic coding sequence

SEQ ID NO: 102949 - DNA, 606 bp, Artificial Sequence; identical to SEQ ID NO: 102946
  Description of Artificial Sequence: Synthetic coding sequence

SEQ ID NO: 102950 - DNA, 276 bp, Artificial Sequence
  Description of Artificial Sequence: Synthetic coding sequence
atggccaacaagggccccagctacggcatgagcagagaggtgcagagcaagatcgagaagaagtacgacgaggagctggaggagagactggtggagtggatcatcgtgcagtgcggccccgacgtgggcagacccgacagaggcagactgggcttccaggtgtggctgaagaacggcgtgatcctgagcaagctggtgaacagcctgtaccccgacggcagcaagcccgtgaaggtgcccgagaacccccccagcatggtgttcaagcagatgtag

SEQ ID NO: 102951 - DNA, 606 bp, Artificial Sequence; identical to SEQ ID NO: 102946
  Description of Artificial Sequence: Synthetic coding sequence

SEQ ID NO: 102952 - DNA, 606 bp, Artificial Sequence; identical to SEQ ID NO: 102946
  Description of Artificial Sequence: Synthetic coding sequence

SEQ ID NO: 102953 - DNA, 600 bp, Artificial Sequence
  Description of Artificial Sequence: Synthetic coding sequence
atggccaacagaggccccgcctacggcctgagcagagaggtgcagcagaagatcgagaagcagtacgacgccgacctggagcagatcctgatccagtggatcaccacccagtgcagaaaggacgtgggcagaccccagcccggcagagagaacttccagaactggctgaaggacggcaccgtgctgtgcgagctgatcaacgccctgtaccccgagggccaggcccccgtgaagaagatccaggccagcaccatggccttcaagcagatggagcagatcagccagttcctgcaggccgccgagagatacggcatcaacaccaccgacatcttccagaccgtggacctgtgggagggcaagaacatggcctgcgtgcagagaaccctgatgaacctgggcggcctggccgtggccagagacgacggcctgttcagcggcgaccccaactggttccccaagaagagcaaggagaaccccagaaacttcagcgacaaccagctgcaggagggcaagaacgtgatcggcctgcagatgggcaccaacagaggcgccagccaggccggcatgaccggctacggcatgcccagacagatcctgtag

SEQ ID NO: 102954 - DNA, 663 bp, Artificial Sequence
  Description of Artificial Sequence: Synthetic coding sequence
atgagcgccttcagcctggccctggccctggtgagcagcccccagccccccccccccatcggcatggccaacagaggccccgcctacggcctgagcagagaggtgcagcagaagatcgagaagcagtacgacgccgacctggagcagatcctgatccagtggatcaccacccagtgcagaaaggacgtgggcagaccccagcccggcagagagaacttccagaactggctgaaggacggcaccgtgctgtgcgagctgatcaacgccctgtaccccgagggccaggcccccgtgaagaagatccaggccagcaccatggccttcaagcagatggagcagatcagccagttcctgcaggccgccgagagatacggcatcaacaccaccgacatcttccagaccgtggacctgtgggagggcaagaacatggcctgcgtgcagagaaccctgatgaacctgggcggcctggccgtggccagagacgacggcctgttcagcggcgaccccaactggttccccaagaagagcaaggagaaccccagaaacttcagcgacaaccagctgcaggagggcaagaacgtgatcggcctgcagatgggcaccaacagaggcgccagccaggccggcatgaccggctacggcatgcccagacagatcctgtag

SEQ ID NO: 102955 - DNA, 600 bp, Artificial Sequence; identical to SEQ ID NO: 102953
  Description of Artificial Sequence: Synthetic coding sequence

SEQ ID NO: 102956 - DNA, 564 bp, Artificial Sequence
  Description of Artificial Sequence: Synthetic coding sequence
atggccaacagaggccccgcctacggcctgagcagagaggtgcagcagaagatcgagaagcagtacgacgccgacctggagcagatcctgatccagtggatcaccacccagtgcagaaaggacgtgggcagaccccagcccggcagagagaacttccagaactggctgaaggacggcaccgtgctgtgcgagctgatcaacgccctgtaccccgagggccaggcccccgtgaagaagatccaggccagcaccatggccttcaagcagatggagcagatcagccagttcctgcaggccgccgagagatacggcatcaacaccaccgacatcttccagaccgtggacctgtgggagggcaagaacatggcctgcgtgcagagaaccctgatgaacctgggcggcctggccgtggccagagacgacggcctgttcagcggcgaccccaactggttccccaagaagagcaaggagaaccccagaaacttcagcgacaaccagctgcaggagggcaagaacgtgatcggcctgcagatgggcaccaacagaggcgccagccaggcctag

SEQ ID NO: 102957 - DNA, 3861 bp, Artificial Sequence
  Description of Artificial Sequence: Synthetic coding sequence
atgagccacctggtggaccccaccagcggcgacctgcccgtgagagacatcgacgccatccccctggtgctgcccgccagcaagggcaagaacatgaagacccagccccccctgagcagaatgaacagagaggagctggaggacagcttcttcagactgagagaggaccacatgctggtgaaggagctgagctggaagcagcaggacgagatcaagagactgagaaccaccctgctgagactgaccgccgccggcagagacctgagagtggccgaggaggccgcccccctgagcgagaccgccagaagaggccagaaggccggctggagacagagactgagcatgcaccagagaccccagatgcacagactgcagggccacttccactgcgtgggccccgccagccccagaagagcccagcccagagtgcaggtgggccacagacagctgcacaccgccggcgcccccgtgcccgagaagcccaagagaggccccagagacagactgagctacaccgccccccccagcttcaaggagcacgccaccaacgagaacagaggcgaggtggccagcaagcccagcgagctggtgagcggcagcaacagcatcatcagcttcagcagcgtgatcagcatggccaagcccatcggcctgtgcatgcccaacagcgcccacatcatggccagcaacaccatgcaggtggaggagccccccaagagccccgagaagatgtggcccaaggacgagaacttcgagcagagaagcagcctggagtgcgcccagaaggccgccgagctgagagccagcatcaaggagaaggtggagctgatcagactgaagaagctgctgcacgagagaaacgccagcctggtgatgaccaaggcccagctgaccgaggtgcaggaggcctgcaccttcctgctgacccagaaccagggcatcctgagcgccgcccacgaggccctgctgaagcaggtgaacgagctgagagccgagctgaaggaggagagcaagaaggccgtgagcctgaagagccagctggaggacgtgagcatcctgcagatgaccctgaaggagttccaggagagagtggaggacctggagaaggagagaaagctgctgaacgacaactacgacaagctgctggagagcatgctggacagcagcgacagcagcagccagccccactggagcaacgagctgatcgccgagcagctgcagcagcaggtgagccagctgcaggaccagctggacgccgagctggaggacaagagaaaggtgctgctggagctgagcagagagaaggcccagaacgaggacctgaagctggaggtgaccaacatcctgcagaagcacaagcaggaggtggagctgctgcagaacgccgccaccatcagccagccccccgacagacagagcgagcccgccacccaccccgccgtgctgcaggagaacacccagatcgagcccagcgagcccaagaaccaggaggagaagaagctgagccaggtgctgaacgagctgcaggtgagccacgccgagaccaccctggagctggagaagaccagagacatgctgatcctgcagagaaagatcaacgtgtgctaccaggaggagctggaggccatgatgaccaaggccgacaacgacaacagagaccacaaggagaagctggagagactgaccagactgctggacctgaagaacaacagaatcaagcagctggagggcatcctgagaagccacgacctgcccaccagcgagcagctgaaggacgtggcctacggcaccagacccctgagcctgtgcctggagaccctgcccgcccacggcgacgaggacaaggtggacatcagcctgctgcaccagggcgagaacctgttcgagctgcacatccaccaggccttcctgaccagcgccgccctggcccaggccggcgacacccagcccaccaccttctgcacctacagcttctacgacttcgagacccactgcacccccctgagcgtgggcccccagcccctgtacgacttcaccagccagtacgtgatggagaccgacagcctgttcctgcactacctgcaggaggccagcgccagactggacatccaccaggccatggccagcgagcacagcaccctggccgccggctggatctgcttcgacagagtgctggagaccgtggagaaggtgcacggcctggccaccctgatcggcgccggcggcgaggagttcggcgtgctggagtactggatgagactgagattccccatcaagcccagcctgcaggcctgcaacaagagaaagaaggcccaggtgtacctgagcaccgacgtgctgggcggcagaaaggcccaggaggaggagttcagaagcgagagctgggagccccagaacgagctgtggatcgagatcaccaagtgctgcggcctgagaagcagatggctgggcacccagcccagcccctacgccgtgtacagattcttcaccttcagcgaccacgacaccgccatcatccccgccagcaacaacccctacttcagagaccaggccagattccccgtgctggtgaccagcgacctggaccactacctgagaagagaggccctgagcatccacgtgttcgacgacgaggacctggagcccggcagctacctgggcagagccagagtgcccctgctgcccctggccaagaacgagagcatcaagggcgacttcaacctgaccgaccccgccgagaagcccaacggcagcatccaggtgcagctggactggaagttcccctacatcccccccgagagcttcctgaagcccgaggcccagaccaagggcaaggacaccaaggacagcagcaagatcagcagcgaggaggagaaggccagcttccccagccaggaccagatggccagccccgaggtgcccatcgaggccggccagtacagaagcaagagaaagcccccccacggcggcgagagaaaggagaaggagcaccaggtggtgagctacagcagaagaaagcacggcaagagaatcggcgtgcagggcaagaacagaatggagtacctgagcctgaacatcctgaacggcaacacccccgagcaggtgaactacaccgagtggaagttcagcgagaccaacagcttcatcggcgacggcttcaagaaccagcacgaggaggaggagatgaccctgagccacagcgccctgaagcagaaggagcccctgcaccccgtgaacgacaaggagagcagcgagcagggcagcgaggtgagcgaggcccagaccaccgacagcgacgacgtgatcgtgccccccatgagccagaagtaccccaaggccgacagcgagaagatgtgcatcgagatcgtgagcctggccttctaccccgaggccgaggtgatgagcgacgagaacatcaagcaggtgtacgtggagtacaagttctacgacctgcccctgagcgagaccgagacccccgtgagcctgagaaagcccagagccggcgaggagatccacttccacttcagcaaggtgatcgacctggacccccaggagcagcagggcagaagaagattcctgttcgacatgctgaacggccaggaccccgaccagggccacctgaagttcaccgtggtgagcgaccccctggacgaggagaagaaggagtgcgaggaggtgggctacgcctacctgcagctgtggcagatcctggagagcggcagagacatcctggagcaggagctggacatcgtgagccccgaggacctggccacccccatcggcagactgaaggtgagcctgcaggccgccgccgtgctgcacgccatctacaaggagatgaccgaggacctgttcagctag

SEQ ID NO: 102958 - DNA, 1128 bp, Artificial Sequence
  Description of Artificial Sequence: Synthetic coding sequence
atgaagagacccgacctgcccagcggcttcgacggctggcaggtggtggacgccaccccccaggagaccagcagcggcatcttctgctgcggcccctgcagcgtggagagcatcaagaacggcctggtgtacatgaagtacgacacccccttcatcttcgccgaggtgaacagcgacaaggtgtactggcagagacaggacgacggcagcttcaagatcgtgtacgtggaggagaaggccatcggcaccctgatcgtgaccaaggccatcagcagcaacatgagagaggacatcacctacctgtacaagcaccccgagggcagcgacgccgagagaaaggccgtggagaccgccgccgcccacggcagcaagcccaacgtgtacgccaacagaggcagcgccgaggacgtggccatgcaggtggaggcccaggacgccgtgatgggccaggacctgatggtgagcgtgatgctgatcaaccacagcagcagcagaagaaccgtgaagctgcacctgtacctgagcgtgaccttctacaccggcgtgagcggcaccatcttcaaggagaccaagaaggaggtggagctggcccccggcgccagcgacagagtgaccatgcccgtggcctacaaggagtacagaccccacctggtggaccagggcgccatgctgctgaacgtgagcggccacgtgaaggagagcggccaggtgctggccaagcagcacaccttcagactgagaacccccgacctgagcctgaccctgctgggcgccgccgtggtgggccaggagtgcgaggtgcagatcgtgttcaagaaccccctgcccgtgaccctgaccaacgtggtgttcagactggagggcagcggcctgcagagacccaagatcctgaacgtgggcgacatcggcggcaacgagaccgtgaccctgagacagagcttcgtgcccgtgagacccggccccagacagctgatcgccagcctggacagcccccagctgagccaggtgcacggcgtgatccaggtggacgtggcccccgcccccggcgacggcggcttcttcagcgacgccggcggcgacagccacctgggcgagaccatccccatggccagcagaggcggcgcctag

SEQ ID NO: 102959 - DNA, 408 bp, Artificial Sequence
  Description of Artificial Sequence: Synthetic coding sequence
atgatggacggccccagaagcgacgtgggcagatggggcggcaaccccctgcagccccccaccacccccagccccgagcccgagcccgagcccgacggcagaagcagaagaggcggcggcagaagcttctgggccagatgctgcggctgctgcagctgcagaaacgccgccgacgacgactggggccccgagcccagcgacagcagaggcagaggcagcagcagcggcaccagaagacccggcagcagaggcagcgacagcagaagacccgtgagcagaggcagcggcgtgaacgccgccggcgacggcaccatcagagagggcatgctggtggtgaacggcgtggacctgctgagcagcagaagcgaccagaacagaagagagcaccacaccgacgagtacgagtag

SEQ ID NO: 102960 - DNA, 129 bp, Artificial Sequence
  Description of Artificial Sequence: Synthetic coding sequence
atgatggacggccccagaagcgacgtgggcagatggggcggcaaccccctgcagccccccaccacccccagccccgagcccgagcccgagcccgacggcagaagcagaagaggcggcggcagaagctag

SEQ ID NO: 102961 - DNA, 198 bp, Artificial Sequence
  Description of Artificial Sequence: Synthetic coding sequence
atgatggacggccccagaagcgacgtgggcagatggggcggcaaccccctgcagccccccaccacccccagccccgagcccgagcccgagcccgacggcagaagcagaagaggcggcggcagaagcttctgggccagatgctgcggctgctgcagctgcagaaacgccgccgacgacgactggggccccgagccctag

SEQ ID NO: 102962 - DNA, 153 bp, Artificial Sequence
  Description of Artificial Sequence: Synthetic coding sequence
atgatggacggccccagaagcgacgtgggcagatggggcggcaaccccctgcagccccccaccacccccagccccgagcccgagcccgagcccgacggcagaagcagaagaggcggcggcagaagcttctgggccagatgctgcggctgctag

SEQ ID NO: 102963 - DNA, 30 bp, Artificial Sequence
  Description of Artificial Sequence: Synthetic coding sequence
atgatggacggccccagaagcgacgtgtag

SEQ ID NO: 102964 - DNA, 2064 bp, Artificial Sequence
  Description of Artificial Sequence: Synthetic coding sequence
atggccgaggagctggtgctggagagatgcgacctggagctggagaccaacggcagagaccaccacaccgccgacctgtgcagagagaagctggtggtgagaagaggccagcccttctggctgaccctgcacttcgagggcagaaactacgaggccagcgtggacagcctgaccttcagcgtggtgaccggccccgcccccagccaggaggccggcaccaaggccagattccccctgagagacgccgtggaggagggcgactggaccgccaccgtggtggaccagcaggactgcaccctgagcctgcagctgaccacccccgccaacgcccccatcggcctgtacagactgagcctggaggccagcaccggctaccagggcagcagcttcgtgctgggccacttcatcctgctgttcaacgcctggtgccccgccgacgccgtgtacctggacagcgaggaggagagacaggagtacgtgctgacccagcagggcttcatctaccagggcagcgccaagttcatcaagaacatcccctggaacttcggccagttcgaggacggcatcctggacatctgcctgatcctgctggacgtgaaccccaagttcctgaagaacgccggcagagactgcagcagaagaagcagccccgtgtacgtgggcagagtggtgagcggcatggtgaactgcaacgacgaccagggcgtgctgctgggcagatgggacaacaactacggcgacggcgtgagccccatgagctggatcggcagcgtggacatcctgagaagatggaagaaccacggctgccagagagtgaagtacggccagtgctgggtgttcgccgccgtggcctgcaccgtgctgagatgcctgggcatccccaccagagtggtgaccaactacaacagcgcccacgaccagaacagcaacctgctgatcgagtacttcagaaacgagttcggcgagatccagggcgacaagagcgagatgatctggaacttccactgctgggtggagagctggatgaccagacccgacctgcagcccggctacgagggctggcaggccctggaccccaccccccaggagaagagcgagggcacctactgctgcggccccgtgcccgtgagagccatcaaggagggcgacctgagcaccaagtacgacgcccccttcgtgttcgccgaggtgaacgccgacgtggtggactggatccagcaggacgacggcagcgtgcacaagagcatcaacagaagcctgatcgtgggcctgaagatcagcaccaagagcgtgggcagagacgagagagaggacatcacccacacctacaagtaccccgagggcagcagcgaggagagagaggccttcaccagagccaaccacctgaacaagctggccgagaaggaggagaccggcatggccatgagaatcagagtgggccagagcatgaacatgggcagcgacttcgacgtgttcgcccacatcaccaacaacaccgccgaggagtacgtgtgcagactgctgctgtgcgccagaaccgtgagctacaacggcatcctgggccccgagtgcggcaccaagtacctgctgaacctgaacctggagcccttcagcgagaagagcgtgcccctgtgcatcctgtacgagaagtacagagactgcctgaccgagagcaacctgatcaaggtgagagccctgctggtggagcccgtgatcaacagctacctgctggccgagagagacctgtacctggagaaccccgagatcaagatcagaatcctgggcgagcccaagcagaagagaaagctggtggccgaggtgagcctgcagaaccccctgcccgtggccctggagggctgcaccttcaccgtggagggcgccggcctgaccgaggagcagaagaccgtggagatccccgaccccgtggaggccggcgaggaggtgaaggtgagaatggacctgctgcccctgcacatgggcctgcacaagctggtggtgaacttcgagagcgacaagctgaaggccgtgaagggcttcagaaacgtgatcatcggccccgcctag

SEQ ID NO: 102965 - DNA, 846 bp, Artificial Sequence
  Description of Artificial Sequence: Synthetic coding sequence
atggccgaggagctggtgctggagagatgcgacctggagctggagaccaacggcagagaccaccacaccgccgacctgtgcagagagaagctggtggtgagaagaggccagcccttctggctgaccctgcacttcgagggcagaaactacgaggccagcgtggacagcctgaccttcagcgtggtgaccggccccgcccccagccaggaggccggcaccaaggccagattccccctgagagacgccgtggaggagggcgactggaccgccaccgtggtggaccagcaggactgcaccctgagcctgcagctgaccacccccgccaacgcccccatcggcctgtacagactgagcctggaggccagcaccggctaccagggcagcagcttcgtgctgggccacttcatcctgctgttcaacgcctggtgccccgccgacgccgtgtacctggacagcgaggaggagagacaggagtacgtgctgacccagcagggcttcatctaccagggcagcgccaagttcatcaagaacatcccctggaacttcggccagttcgaggacggcatcctggacatctgcctgatcctgctggacgtgaaccccaagttcctgaagaacgccggcagagactgcagcagaagaagcagccccgtgtacgtgggcagagtggtgagcggcatggtgaactgcaacgacgaccagggcgtgctgctgggcagatgggacaacaactacggcgacggcgtgagccccatgagctggatcggcagcgtggacatcctgagaagatggaagaaccacggctgccagagagtgaagtacggccagtgctgggtgttcgcctag

SEQ ID NO: 102966 - DNA, 483 bp, Artificial Sequence
  Description of Artificial Sequence: Synthetic coding sequence
atggccgaggagctggtgctggagagatgcgacctggagctggagaccaacggcagagaccaccacaccgccgacctgtgcagagagaagctggtggtgagaagaggccagcccttctggctgaccctgcacttcgagggcagaaactacgaggccagcgtggacagcctgaccttcagcgtggtgaccggccccgcccccagccaggaggccggcaccaaggccagattccccctgagagacgccgtggaggagggcgactggaccgccaccgtggtggaccagcaggactgcaccctgagcctgcagctgaccacccccgccaacgcccccatcggcctgtacagactgagcctggaggccagcaccggctaccagggcagcagcttcgtgctgggccacttcatcctgctgttcaacgcctggtgccccgccgacgccgtgtacctggacagcgaggaggagagacaggagtacgtgtag

SEQ ID NO: 102967 - DNA, 1821 bp, Artificial Sequence
  Description of Artificial Sequence: Synthetic coding sequence
atggccgaggagctggtgctggagagatgcgacctggagctggagaccaacggcagagaccaccacaccgccgacctgtgcagagagaagctggtggtgagaagaggccagcccttctggctgaccctgcacttcgagggcagaaactacgaggccagcgtggacagcctgaccttcagcgtggtgaccgccgacgccgtgtacctggacagcgaggaggagagacaggagtacgtgctgacccagcagggcttcatctaccagggcagcgccaagttcatcaagaacatcccctggaacttcggccagttcgaggacggcatcctggacatctgcctgatcctgctggacgtgaaccccaagttcctgaagaacgccggcagagactgcagcagaagaagcagccccgtgtacgtgggcagagtggtgagcggcatggtgaactgcaacgacgaccagggcgtgctgctgggcagatgggacaacaactacggcgacggcgtgagccccatgagctggatcggcagcgtggacatcctgagaagatggaagaaccacggctgccagagagtgaagtacggccagtgctgggtgttcgccgccgtggcctgcaccgtgctgagatgcctgggcatccccaccagagtggtgaccaactacaacagcgcccacgaccagaacagcaacctgctgatcgagtacttcagaaacgagttcggcgagatccagggcgacaagagcgagatgatctggaacttccactgctgggtggagagctggatgaccagacccgacctgcagcccggctacgagggctggcaggccctggaccccaccccccaggagaagagcgagggcacctactgctgcggccccgtgcccgtgagagccatcaaggagggcgacctgagcaccaagtacgacgcccccttcgtgttcgccgaggtgaacgccgacgtggtggactggatccagcaggacgacggcagcgtgcacaagagcatcaacagaagcctgatcgtgggcctgaagatcagcaccaagagcgtgggcagagacgagagagaggacatcacccacacctacaagtaccccgagggcagcagcgaggagagagaggccttcaccagagccaaccacctgaacaagctggccgagaaggaggagaccggcatggccatgagaatcagagtgggccagagcatgaacatgggcagcgacttcgacgtgttcgcccacatcaccaacaacaccgccgaggagtacgtgtgcagactgctgctgtgcgccagaaccgtgagctacaacggcatcctgggccccgagtgcggcaccaagtacctgctgaacctgaacctggagcccttcagcgagaagagcgtgcccctgtgcatcctgtacgagaagtacagagactgcctgaccgagagcaacctgatcaaggtgagagccctgctggtggagcccgtgatcaacagctacctgctggccgagagagacctgtacctggagaaccccgagatcaagatcagaatcctgggcgagcccaagcagaagagaaagctggtggccgaggtgagcctgcagaaccccctgcccgtggccctggagggctgcaccttcaccgtggagggcgccggcctgaccgaggagcagaagaccgtggagatccccgaccccgtggaggccggcgaggaggtgaaggtgagaatggacctgctgcccctgcacatgggcctgcacaagctggtggtgaacttcgagagcgacaagctgaaggccgtgaagggcttcagaaacgtgatcatcggccccgcctag

SEQ ID NO: 102968 - DNA, 1884 bp, Artificial Sequence
  Description of Artificial Sequence: Synthetic coding sequence
atggccgagggccccgcccccagccaggaggccggcaccaaggccagattccccctgagagacgccgtggaggagggcgactggaccgccaccgtggtggaccagcaggactgcaccctgagcctgcagctgaccacccccgccaacgcccccatcggcctgtacagactgagcctggaggccagcaccggctaccagggcagcagcttcgtgctgggccacttcatcctgctgttcaacgcctggtgccccgccgacgccgtgtacctggacagcgaggaggagagacaggagtacgtgctgacccagcagggcttcatctaccagggcagcgccaagttcatcaagaacatcccctggaacttcggccagttcgaggacggcatcctggacatctgcctgatcctgctggacgtgaaccccaagttcctgaagaacgccggcagagactgcagcagaagaagcagccccgtgtacgtgggcagagtggtgagcggcatggtgaactgcaacgacgaccagggcgtgctgctgggcagatgggacaacaactacggcgacggcgtgagccccatgagctggatcggcagcgtggacatcctgagaagatggaagaaccacggctgccagagagtgaagtacggccagtgctgggtgttcgccgccgtggcctgcaccgtgctgagatgcctgggcatccccaccagagtggtgaccaactacaacagcgcccacgaccagaacagcaacctgctgatcgagtacttcagaaacgagttcggcgagatccagggcgacaagagcgagatgatctggaacttccactgctgggtggagagctggatgaccagacccgacctgcagcccggctacgagggctggcaggccctggaccccaccccccaggagaagagcgagggcacctactgctgcggccccgtgcccgtgagagccatcaaggagggcgacctgagcaccaagtacgacgcccccttcgtgttcgccgaggtgaacgccgacgtggtggactggatccagcaggacgacggcagcgtgcacaagagcatcaacagaagcctgatcgtgggcctgaagatcagcaccaagagcgtgggcagagacgagagagaggacatcacccacacctacaagtaccccgagggcagcagcgaggagagagaggccttcaccagagccaaccacctgaacaagctggccgagaaggaggagaccggcatggccatgagaatcagagtgggccagagcatgaacatgggcagcgacttcgacgtgttcgcccacatcaccaacaacaccgccgaggagtacgtgtgcagactgctgctgtgcgccagaaccgtgagctacaacggcatcctgggccccgagtgcggcaccaagtacctgctgaacctgaacctggagcccttcagcgagaagagcgtgcccctgtgcatcctgtacgagaagtacagagactgcctgaccgagagcaacctgatcaaggtgagagccctgctggtggagcccgtgatcaacagctacctgctggccgagagagacctgtacctggagaaccccgagatcaagatcagaatcctgggcgagcccaagcagaagagaaagctggtggccgaggtgagcctgcagaaccccctgcccgtggccctggagggctgcaccttcaccgtggagggcgccggcctgaccgaggagcagaagaccgtggagatccccgaccccgtggaggccggcgaggaggtgaaggtgagaatggacctgctgcccctgcacatgggcctgcacaagctggtggtgaacttcgagagcgacaagctgaaggccgtgaagggcttcagaaacgtgatcatcggccccgcctag

SEQ ID NO: 102969 - DNA, 2082 bp, Artificial Sequence
  Description of Artificial Sequence: Synthetic coding sequence
atggccgccctgggcgtgcagagcatcaactggcagaccgccttcaacagacaggcccaccacaccgacaagttcagcagccaggagctgatcctgagaagaggccagaacttccaggtgctgatgatcatgaacaagggcctgggcagcaacgagagactggagttcatcgtgagcaccggcccctaccccagcgagagcgccatgaccaaggccgtgttccccctgagcaacggcagcagcggcggctggagcgccgtgctgcaggccagcaacggcaacaccctgaccatcagcatcagcagccccgccagcgcccccatcggcagatacaccatggccctgcagatcttcagccagggcggcatcagcagcgtgaagctgggcaccttcatcctgctgttcaacccctggctgaacgtggacagcgtgttcatgggcaaccacgccgagagagaggagtacgtgcaggaggacgccggcatcatcttcgtgggcagcaccaacagaatcggcatgatcggctggaacttcggccagttcgaggaggacatcctgagcatctgcctgagcatcctggacagaagcctgaacttcagaagagacgccgccaccgacgtggccagcagaaacgaccccaagtacgtgggcagagtgctgagcgccatgatcaacagcaacgacgacaacggcgtgctggccggcaactggagcggcacctacaccggcggcagagaccccagaagctggaacggcagcgtggagatcctgaagaactggaagaagagcggcttcagccccgtgagatacggccagtgctgggtgttcgccggcaccctgaacaccgccctgagaagcctgggcatccccagcagagtgatcaccaacttcaacagcgcccacgacaccgacagaaacctgagcgtggacgtgtactacgaccccatgggcaaccccctggacaagggcagcgacagcgtgtggaacttccacgtgtggaacgagggctggttcgtgagaagcgacctgggccccagctacggcggctggcaggtgctggacgccaccccccaggagagaagccagggcgtgttccagtgcggccccgccagcgtgatcggcgtgagagagggcgacgtgcagctgaacttcgacatgcccttcatcttcgccgaggtgaacgccgacagaatcacctggctgtacgacaacaccaccggcaagcagtggaagaacagcgtgaacagccacaccatcggcagatacatcagcaccaaggccgtgggcagcaacgccagaatggacgtgaccgacaagtacaagtaccccgagggcagcgaccaggagagacaggtgttccagaaggccctgggcaagctgaagcccaacacccccttcgccgccaccagcagcatgggcctggagaccgaggagcaggagcccagcatcatcggcaagctgaaggtggccggcatgctggccgtgggcaaggaggtgaacctggtgctgctgctgaagaacctgagcagagacaccaagaccgtgaccgtgaacatgaccgcctggaccatcatctacaacggcaccctggtgcacgaggtgtggaaggacagcgccaccatgagcctggaccccgaggaggaggccgagcaccccatcaagatcagctacgcccagtacgagaagtacctgaagagcgacaacatgatcagaatcaccgccgtgtgcaaggtgcccgacgagagcgaggtggtggtggagagagacatcatcctggacaaccccaccctgaccctggaggtgctgaacgaggccagagtgagaaagcccgtgaacgtgcagatgctgttcagcaaccccctggacgagcccgtgagagactgcgtgctgatggtggagggcagcggcctgctgctgggcaacctgaagatcgacgtgcccaccctgggccccaaggagggcagcagagtgagattcgacatcctgcccagcagaagcggcaccaagcagctgctggccgacttcagctgcaacaagttccccgccatcaaggccatgctgagcatcgacgtggccgagtag

SEQ ID NO: 102970 - DNA, 1602 bp, Artificial Sequence
  Description of Artificial Sequence: Synthetic coding sequence
atggccgccctgggcgtgcagagcatcaactggcagaccgccttcaacagacaggcccaccacaccgacaagttcagcagccaggagctgatcctgagaagaggccagaacttccaggtgctgatgatcatgaacaagggcctgggcagcaacgagagactggagttcatcgtgagcaccggcccctaccccagcgagagcgccatgaccaaggccgtgttccccctgagcaacggcagcagcggcggctggagcgccgtgctgcaggccagcaacggcaacaccctgaccatcagcatcagcagccccgccagcgcccccatcggcagatacaccatggccctgcagatcttcagccagggcggcatcagcagcgtgaagctgggcaccttcatcctgctgttcaacccctggctgaacgtggacagcgtgttcatgggcaaccacgccgagagagaggagtacgtgcaggaggacgccggcatcatcttcgtgggcagcaccaacagaatcggcatgatcggctggaacttcggccagttcgaggaggacatcctgagcatctgcctgagcatcctggacagaagcctgaacttcagaagagacgccgccaccgacgtggccagcagaaacgaccccaagtacgtgggcagagtgctgagcgccatgatcaacagcaacgacgacaacggcgtgctggccggcaactggagcggcacctacaccggcggcagagaccccagaagctggaacggcagcgtggagatcctgaagaactggaagaagagcggcttcagccccgtgagatacggccagtgctgggtgttcgccggcaccctgaacaccgccctgagaagcctgggcatccccagcagagtgatcaccaacttcaacagcgcccacgacaccgacagaaacctgagcgtggacgtgtactacgaccccatgggcaaccccctggacaagggcagcgacagcgtgtggaacttccacgtgtggaacgagggctggttcgtgagaagcgacctgggccccagctacggcggctggcaggtgctggacgccaccccccaggagagaagccagggcgtgttccagtgcggccccgccagcgtgatcggcgtgagagagggcgacgtgcagctgaacttcgacatgcccttcatcttcgccgaggtgaacgccgacagaatcacctggctgtacgacaacaccaccggcaagcagtggaagaacagcgtgaacagccacaccatcggcagatacatcagcaccaaggccgtgggcagcaacgccagaatggacgtgaccgacaagtacaagtaccccgagggcagcgaccaggagagacaggtgttccagaaggccctgggcaagctgaagcccaacacccccttcgccgccaccagcagcatgggcctggagaccgaggagcaggagcccagcatcatcggcaagctgaaggtggccggcatgctggccgtgggcaaggaggtgaacctggtgctgctgctgatcccccacgccctgcagtgctgcagaatggactggcccctgacccagggcctgagcaagagagacaccggcgagaagctggtgtag

SEQ ID NO: 102971 - DNA, 2055 bp, Artificial Sequence
  Description of Artificial Sequence: Synthetic coding sequence
atgatggacgccagcaaggagctgcaggtgctgcacatcgacttcctgaaccaggacaacgccgtgagccaccacacctgggagttccagaccagcagccccgtgttcagaagaggccaggtgttccacctgagactggtgctgaaccagcccctgcagagctaccaccagctgaagctggagttcagcaccggccccaaccccagcatcgccaagcacaccctggtggtgctggaccccagaacccccagcgaccactacaactggcaggccaccctgcagaacgagagcggcaaggaggtgaccgtggccgtgaccagcagccccaacgccatcctgggcaagtaccagctgaacgtgaagaccggcaaccacatcctgaagagcgaggagaacatcctgtacctgctgttcaacccctggtgcaaggaggacatggtgttcatgcccgacgaggacgagagaaaggagtacatcctgaacgacaccggctgccactacgtgggcgccgccagaagcatcaagtgcaagccctggaacttcggccagttcgagaagaacgtgctggactgctgcatcagcctgctgaccgagagcagcctgaagcccaccgacagaagagaccccgtgctggtgtgcagagccatgtgcgccatgatgagcttcgagaagggccagggcgtgctgatcggcaactggaccggcgactacgagggcggcaccgccccctacaagtggaccggcagcgcccccatcctgcagcagtactacaacaccaagcaggccgtgtgcttcggccagtgctgggtgttcgccggcatcctgaccaccgtgctgagagccctgggcatccccgccagaagcgtgaccggcttcgacagcgcccacgacaccgagagaaacctgaccgtggacacctacgtgaacgagaacggcgagaagatcaccagcatgacccacgacagcgtgtggaacttccacgtgtggaccgacgcctggatgaagagacccgacctgcccaagggctacgacggctggcaggccgtggacgccaccccccaggagagaagccagggcgtgttctgctgcggccccagccccctgaccgccatcagaaagggcgacatcttcatcgtgtacgacaccagattcgtgttcagcgaggtgaacggcgacagactgatctggctggtgaagatggtgaacggccaggaggagctgcacgtgatcagcatggagaccaccagcatcggcaagaacatcagcaccaaggccgtgggccaggacagaagaagagacatcacctacgagtacaagtaccccgagggcagcagcgaggagagacaggtgatggaccacgccttcctgctgctgagcagcgagagagagcacagaagacccgtgaaggagaacttcctgcacatgagcgtgcagagcgacgacgtgctgctgggcaacagcgtgaacttcaccgtgatcctgaagagaaagaccgccgccctgcagaacgtgaacatcctgggcagcttcgagctgcagctgtacaccggcaagaagatggccaagctgtgcgacctgaacaagaccagccagatccagggccaggtgagcgaggtgaccctgaccctggacagcaagacctacatcaacagcctggccatcctggacgacgagcccgtgatcagaggcttcatcatcgccgagatcgtggagagcaaggagatcatggccagcgaggtgttcaccagcttccagtaccccgagttcagcatcgagctgcccaacaccggcagaatcggccagctgctggtgtgcaactgcatcttcaagaacaccctggccatccccctgaccgacgtgaagttcagcctggagagcctgggcatcagcagcctgcagaccagcgaccacggcaccgtgcagcccggcgagaccatccagagccagatcaagtgcacccccatcaagaccggccccaagaagttcatcgtgaagctgagcagcaagcaggtgaaggagatcaacgcccagaagatcgtgctgatcaccaagtag

SEQ ID NO: 102972 - DNA, 1626 bp, Artificial Sequence
  Description of Artificial Sequence: Synthetic coding sequence
atgttcagctggatgggcagacaggccggcggcagagagagagccggcggcgccgacgccgtgcagaccgtgaccggcggcctgagaagcctgtacctgagaaaggtgctgcccctggaggaggcctacagattccacgagttccacagccccgccctggaggacgccgacttcgagaacaagcccatgatcctgctggtgggccagtacagcaccggcaagaccaccttcatcagatacctgctggagcaggacttccccggcatgagaatcggccccgagcccaccaccgacagcttcatcgccgtgatgtacggcgagaccgagggcagcacccccggcaacgccctggtggtggaccccaagaagcccttcagaaagctgagcagattcggcaacgccttcctgaacagattcatgtgcagccagctgcccaaccaggtgctgaagagcatcagcgtgatcgacagccccggcatcctgagcggcgagaagcagagaatcagcagaggctacgacttctgccaggtgctgcagtggttcgccgagagagtggacagaatcatcctgctgttcgacgcccacaagctggacatcagcgacgagttcagcgaggccatcaaggccttcagaggccaggacgacaagatcagagtggtgctgaacaaggccgaccaggtggacacccagcagctgatgagagtgtacggcgccctgatgtggagcctgggcaaggtgatcaacacccccgaggtgctgagagtgtacatcggcagcttctgggcccagcccctgcagaacaccgacaacagaagactgttcgaggccgaggcccaggacctgttcagagacatccagagcctgccccagaaggccgccgtgagaaagctgaacgacctgatcaagagagccagactggccaaggtgcacgcctacatcatcagctacctgaagaaggagatgcccagcgtgttcggcaaggagaacaagaagagagagctgatcagcagactgcccgagatctacatccagctgcagagagagtaccagatcagcgccggcgacttccccgaggtgaaggccatgcaggagcagctggagaactacgacttcaccaagttccacagcctgaagcccaagctgatcgaggccgtggacaacatgctgagcaacaagatcagccccctgatgaacctgatcagccaggaggagaccagcacccccacccagctggtgcagggcggcgccttcgacggcaccaccgagggccccttcaaccagggctacggcgagggcgccaaggagggcgccgacgaggaggagtgggtggtggccaaggacaagcccgtgtacgacgagctgttctacaccctgagccccatcaacggcaagatcagcggcgtgaacgccaagaaggagatggtgaccagcaagctgcccaacagcgtgctgggcaagatctggaagctggccgactgcgactgcgacggcatgctggacgaggaggagttcgccctggccaagcacctgatcaagatcaagctggacggctacgagctgcccagcagcctgcccccccacctggtgccccccagccacagaaagagcctgcccaaggccgactag

SEQ ID NO: 102973 - DNA, 1917 bp, Artificial Sequence
  Description of Artificial Sequence: Synthetic coding sequence
atggcccagggcctggaggtggccctgaccgacctgcagagcagcagaaacaacgtgagacaccacaccgaggagatcaccgtggaccacctgctggtgagaagaggccaggccttcaacctgaccctgtacttcagaaacagaagcttccagcccggcctggacaacatcatcttcgtggtggagaccgaggacgccgtgtacctggacagcgagccccagagacaggagtacgtgatgaacgactacggcttcatctaccagggcagcaagaactggatcagaccctgcccctggaactacggccagttcgaggacaagatcatcgacatctgcctgaagctgctggacaagagcctgcacttccagaccgaccccgccaccgactgcgccctgagaggcagccccgtgtacgtgagcagagtggtgtgcgccatgatcaacagcaacgacgacaacggcgtgctgaacggcaactggagcgagaactacaccgacggcgccaaccccgccgagtggaccggcagcgtggccatcctgaagcagtggaacgccaccggctgccagcccgtgagatacggccagtgctgggtgttcgccgccgtgatgtgcaccgtgatgagatgcctgggcatccccaccagagtgatcaccaacttcgacagcggccacgacaccgacggcaacctgatcatcgacgagtactacgacaacaccggcagaatcctgggcaacaagaagaaggacaccatctggaacttccacgtgtggaacgagtgctggatggccagaaaggacctgccccccgcctacggcggctggcaggtgctggacgccaccccccaggagatgagcaacggcgtgtactgctgcggccccgccagcgtgagagccatcaaggagggcgaggtggacctgaactacgacacccccttcgtgttcagcatggtgaacgccgactgcatgagctggctggtgcagggcggcaaggagcagaagctgcaccaggacaccagcagcgtgggcaacttcatcagcaccaagagcatccagagcgacgagagagacgacatcaccgagaactacaagtacgaggagggcagcctgcaggagagacaggtgttcctgaaggccctgcagaagctgaaggccagaagcttccacggcagccagagaggcgccgagctgcagcccagcagacccaccagcctgagccaggacagccccagaagcctgcacacccccagcctgagacccagcgacgtggtgcaggtgagcctgaagttcaagctgctggacccccccaacatgggccaggacatctgcttcgtgctgctggccctgaacatgagcagccagttcaaggacctgaaggtgaacctgagcgcccagagcctgctgcacgacggcagccccctgagccccttctggcaggacaccgccttcatcaccctgagccccaaggaggccaagacctacccctgcaagatcagctacagccagtacagccagtacctgagcaccgacaagctgatcagaatcagcgccctgggcgaggagaagagcagccccgagaagatcctggtgaacaagatcatcaccctgagctaccccagcatcaccatcaacgtgctgggcgccgccgtggtgaaccagcccctgagcatccaggtgatcttcagcaaccccctgagcgagcaggtggaggactgcgtgctgaccgtggagggcagcggcctgttcaagaagcagcagaaggtgttcctgggcgtgctgaagccccagcaccaggccagcatcatcctggagaccgtgcccttcaagagcggccagagacagatccaggccaacatgagaagcaacaagttcaaggacatcaagggctacagaaacgtgtacgtggacttcgccctgtag

SEQ ID NO: 102974 - DNA, 2160 bp, Artificial Sequence
  Description of Artificial Sequence: Synthetic coding sequence
gcccagggcctggaggtggccctgaccgacctgcagagcagcagaaacaacgtgagacaccacaccgaggagatcaccgtggaccacctgctggtgagaagaggccaggccttcaacctgaccctgtacttcagaaacagaagcttccagcccggcctggacaacatcatcttcgtggtggagaccggccccctgcccgacctggccctgggcaccagagccgtgttcagcctggccagacaccacagccccagcccctggatcgcctggctggagaccaacggcgccaccagcaccgaggtgagcctgtgcgccccccccaccgccgccgtgggcagatacctgctgaagatccacatcgacagcttccagggcagcgtgaccgcctaccagctgggcgagttcatcctgctgttcaacccctggtgccccgaggacgccgtgtacctggacagcgagccccagagacaggagtacgtgatgaacgactacggcttcatctaccagggcagcaagaactggatcagaccctgcccctggaactacggccagttcgaggacaagatcatcgacatctgcctgaagctgctggacaagagcctgcacttccagaccgaccccgccaccgactgcgccctgagaggcagccccgtgtacgtgagcagagtggtgtgcgccatgatcaacagcaacgacgacaacggcgtgctgaacggcaactggagcgagaactacaccgacggcgccaaccccgccgagtggaccggcagcgtggccatcctgaagcagtggaacgccaccggctgccagcccgtgagatacggccagtgctgggtgttcgccgccgtgatgtgcaccgtgatgagatgcctgggcatccccaccagagtgatcaccaacttcgacagcggccacgacaccgacggcaacctgatcatcgacgagtactacgacaacaccggcagaatcctgggcaacaagaagaaggacaccatctggaacttccacgtgtggaacgagtgctggatggccagaaaggacctgccccccgcctacggcggctggcaggtgctggacgccaccccccaggagatgagcaacggcgtgtactgctgcggccccgccagcgtgagagccatcaaggagggcgaggtggacctgaactacgacacccccttcgtgttcagcatggtgaacgccgactgcatgagctggctggtgcagggcggcaaggagcagaagctgcaccaggacaccagcagcgtgggcaacttcatcagcaccaagagcatccagagcgacgagagagacgacatcaccgagaactacaagtacgaggagggcagcctgcaggagagacaggtgttcctgaaggccctgcagaagctgaaggccagaagcttccacggcagccagagaggcgccgagctgcagcccagcagacccaccagcctgagccaggacagccccagaagcctgcacacccccagcctgagacccagcgacgtggtgcaggtgagcctgaagttcaagctgctggacccccccaacatgggccaggacatctgcttcgtgctgctggccctgaacatgagcagccagttcaaggacctgaaggtgaacctgagcgcccagagcctgctgcacgacggcagccccctgagccccttctggcaggacaccgccttcatcaccctgagccccaaggaggccaagacctacccctgcaagatcagctacagccagtacagccagtacctgagcaccgacaagctgatcagaatcagcgccctgggcgaggagaagagcagccccgagaagatcctggtgaacaagatcatcaccctgagctaccccagcatcaccatcaacgtgctgggcgccgccgtggtgaaccagcccctgagcatccaggtgatcttcagcaaccccctgagcgagcaggtggaggactgcgtgctgaccgtggagggcagcggcctgttcaagaagcagcagaaggtgttcctgggcgtgctgaagccccagcaccaggccagcatcatcctggagaccgtgcccttcaagagcggccagagacagatccaggccaacatgagaagcaacaagttcaaggacatcaagggctacagaaacgtgtacgtggacttcgccctgtag

SEQ ID NO: 102975 - DNA, 2121 bp, Artificial Sequence
  Description of Artificial Sequence: Synthetic coding sequence
atggccggcatcagagtgaccaaggtggactggcagagaagcagaaacggcgccgcccaccacacccaggagtacccctgccccgagctggtggtgagaagaggccagagcttcagcctgaccctggagctgagcagagccctggactgcgaggagatcctgatcttcaccatggagaccggccccagagccagcgaggccctgcacaccaaggccgtgttccagaccagcgagctggagagaggcgagggctggaccgccgccagagaggcccagatggagaagaccctgaccgtgagcctggccagcccccccagcgccgtgatcggcagatacctgctgagcatcagactgagcagccacagaaagcacagcaacagaagactgggcgagttcgtgctgctgttcaacccctggtgcgccgaggacgacgtgttcctggccagcgaggaggagagacaggagtacgtgctgagcgacagcggcatcatcttcagaggcgtggagaagcacatcagagcccagggctggaactacggccagttcgaggaggacatcctgaacatctgcctgagcatcctggacagaagccccggccaccagaacaaccccgccaccgacgtgagctgcagacacaaccccatctacgtgaccagagtgatcagcgccatggtgaacagcaacaacgacagaggcgtggtgcagggccagtggcagggcaagtacggcggcggcaccagccccctgcactggagaggcagcgtggccatcctgcagaagtggctgaagggcagatacaagcccgtgaagtacggccagtgctgggtgttcgccggcgtgctgtgcaccgtgctgagatgcctgggcatcgccaccagagtggtgagcaacttcaacagcgcccacgacaccgaccagaacctgagcgtggacaagtacgtggacagcttcggcagaaccctggaggacctgaccgaggacagcatgtggaacttccacgtgtggaacgagagctggttcgccagacaggacctgggccccagctacaacggctggcaggtgctggacgccaccccccaggaggagagcgagggcgtgttcagatgcggccccgccagcgtgaccgccatcagagagggcgacgtgcacctggcccacgacggccccttcgtgttcgccgaggtgaacgccgactacatcacctggctgtggcacgaggacgagagcagagagagagtgtacagcaacaccaagaagatcggcagatgcatcagcaccaaggccgtgggcagcgacagcagagtggacatcaccgacctgtacaagtaccccgagggcagcagaaaggagagacaggtgtacagcaaggccgtgaacagactgttcggcgtggaggccagcggcagaagaatctggatcagaagagccggcggcagatgcctgtggagagacgacctgctggagcccgccaccaagcccagcatcgccggcaagttcaaggtgctggagccccccatgctgggccacgacctgagactggccctgtgcctggccaacctgaccagcagagcccagagagtgagagtgaacctgagcggcgccaccatcctgtacaccagaaagcccgtggccgagatcctgcacgagagccacgccgtgagactgggcccccaggaggagaagagaatccccatcaccatcagctacagcaagtacaaggaggacctgaccgaggacaagaagatcctgctggccgccatgtgcctggtgaccaagggcgagaagctgctggtggagaaggacatcaccctggaggacttcatcaccatcaaggtgctgggccccgccatggtgggcgtggccgtgaccgtggaggtgaccgtggtgaaccccctgatcgagagagtgaaggactgcgccctgatggtggagggcagcggcctgctgcaggagcagctgagcatcgacgtgcccaccctggagccccaggagagagccagcgtgcagttcgacatcacccccagcaagagcggccccagacagctgcaggtggacctggtgagcccccacttccccgacatcaagggcttcgtgatcgtgcacgtggccaccgccaagtag

SEQ ID NO: 102976 - DNA, 1878 bp, Artificial Sequence
  Description of Artificial Sequence: Synthetic coding sequence
atggccggcatcagagtgaccaaggtggactggcagagaagcagaaacggcgccgcccaccacacccaggagtacccctgccccgagctggtggtgagaagaggccagagcttcagcctgaccctggagctgagcagagccctggactgcgaggagatcctgatcttcaccatggagaccggccccagagccagcgaggccctgcacaccaaggccgtgttccagaccagcgagctggagagaggcgagggctggaccgccgccagagaggcccagatggagaagaccctgaccgtgagcctggccagcccccccagcgccgtgatcggcagatacctgctgagcatcagactgagcagccacagaaagcacagcaacagaagactgggcgagttcgtgctgctgttcaacccctggtgcgccgaggacgacgtgttcctggccagcgaggaggagagacaggagtacgtgctgagcgacagcggcatcatcttcagaggcgtggagaagcacatcagagcccagggctggaactacggccagttcgaggaggacatcctgaacatctgcctgagcatcctggacagaagccccggccaccagaacaaccccgccaccgacgtgagctgcagacacaaccccatctacgtgaccagagtgatcagcgccatggtgaacagcaacaacgacagaggcgtggtgcagggccagtggcagggcaagtacggcggcggcaccagccccctgcactggagaggcagcgtggccatcctgcagaagtggctgaagggcagatacaagcccgtgaagtacggccagtgctgggtgttcgccggcgtgctgtgcaccgtgctgagatgcctgggcatcgccaccagagtggtgagcaacttcaacagcgcccacgacaccgaccagaacctgagcgtggacaagtacgtggacagcttcggcagaaccctggaggacctgaccgaggacagcatgtggaacttccacgtgtggaacgagagctggttcgccagacaggacctgggccccagctacaacggctggcaggtgctggacgccaccccccaggaggagagcgagggcgtgttcagatgcggccccgccagcgtgaccgccatcagagagggcgacgtgcacctggcccacgacggccccttcgtgttcgccgaggtgaacgccgactacatcacctggctgtggcacgaggacgagagcagagagagagtgtacagcaacaccaagaagatcggcagatgcatcagcaccaaggccgtgggcagcgacagcagagtggacatcaccgacctgtacaagtaccccgagggcagcagaaaggagagacaggtgtacagcaaggccgtgaacagactgttcggcgtggaggccagcggcagaagaatctggatcagaagagccggcggcagatgcctgtggagagacgacctgctggagcccgccaccaagcccagcatcgccggcaagttcaaggtgctggagccccccatgctgggccacgacctgagactggccctgtgcctggccaacctgaccagcagagcccagagagtgagagtgaacctgagcggcgccaccatcctgtacaccagaaagcccgtggccgagatcctgcacgagagccacgccgtgagactgggcccccaggaggagaagagaatccccatcaccatcagctacagcaagtacaaggaggacctgaccgaggacaagaagatcctgctggccgccatgtgcctggtgaccaagggcgagaagctgctggtggagaaggacatcaccctggaggacttcatcaccatcaagagagcctaccccggcgccagcggcgagggcctgagccccgtgtag

SEQ ID NO: 102977 - DNA, 2133 bp, Artificial Sequence
  Description of Artificial Sequence: Synthetic coding sequence
atggaccaggtggccaccctgagactggagagcgtggacctgcagagcagcagaaacaacaaggagcaccacacccaggagatgggcgtgaagagactgaccgtgagaagaggccagcccttctacctgagactgagcttcagcagacccttccagagccagaacgaccacatcaccttcgtggccgagaccggccccaagcccagcgagctgctgggcaccagagccaccttcttcctgaccagagtgcagcccggcaacgtgtggagcgccagcgacttcaccatcgacagcaacagcctgcaggtgagcctgttcacccccgccaacgccgtgatcggccactacaccctgaagatcgagatcagccagggccagggccacagcgtgacctaccccctgggcaccttcatcctgctgttcaacccctggagccccgaggacgacgtgtacctgcccagcgagatcctgctgcaggagtacatcatgagagactacggcttcgtgtacaagggccacgagagattcatcaccagctggccctggaactacggccagttcgaggaggacatcatcgacatctgcttcgagatcctgaacaagagcctgtaccacctgaagaaccccgccaaggactgcagccagagaaacgacgtggtgtacgtgtgcagagtggtgagcgccatgatcaacagcaacgacgacaacggcgtgctgcagggcaactggggcgaggactacagcaagggcgtgagccccctggagtggaagggcagcgtggccatcctgcagcagtggagcgccagaggcggccagcccgtgaagtacggccagtgctgggtgttcgccagcgtgatgtgcaccgtgatgagatgcctgggcgtgcccaccagagtggtgagcaacttcagaagcgcccacaacgtggacagaaacctgaccatcgacacctactacgacagaaacgccgagatgctgagcacccagaagagagacaagatctggaacttccacgtgtggaacgagtgctggatgatcagaaaggacctgccccccggctacaacggctggcaggtgctggaccccaccccccagcagaccagcagcggcctgttctgctgcggccccgccagcgtgaaggccatcagagagggcgacgtgcacctggcctacgacacccccttcgtgtacgccgaggtgaacgccgacgaggtgatctggctgctgggcgacggccaggcccaggagatcctggcccacaacaccagcagcatcggcaaggagatcagcaccaagatggtgggcagcgaccagagacagagcatcaccagcagctacaagtaccccgagggcagccccgaggagagagccgtgttcatgaaggccagcagaaagatgctgggcccccagagagccagcctgcccttcctggacctgctggagagcggcggcctgagagaccagcccgcccagctgcagctgcacctggccagaatccccgagtggggccaggacctgcagctgctgctgagaatccagagagtgcccgacagcacccaccccagaggccccatcggcctggtggtgagattctgcgcccaggccctgctgcacggcggcggcacccagaagcccttctggagacacaccgtgagaatgaacctggacttcggcaaggagacccagtggcccctgctgctgccctacagcaactacagaaacaagctgaccgacgagaagctgatcagagtgagcggcatcgccgaggtggaggagaccggcagaagcatgctggtgctgaaggacatctgcctggagcccccccacctgagcatcgaggtgagcgagagagccgaggtgggcaaggccctgagagtgcacgtgaccctgaccaacaccctgatggtggccctgagcagctgcaccatggtgctggagggcagcggcctgatcaacggccagatcgccaaggacctgggcaccctggtggccggccacaccctgcagatccagctggacctgtaccccaccaaggccggccccagacagctgcaggtgctgatcagcagcaacgaggtgaaggagatcaagggctacaaggacatcttcgtgaccgtggccggcgccccctag

SEQ ID NO: 102978 - DNA, 846 bp, Artificial Sequence
  Description of Artificial Sequence: Synthetic coding sequence
atgagattcgtggtggccctggtgctgctgaacgtggccgccgccggcgccgtgcccctgctggccaccgagagcgtgaagcaggaggaggccggcgtgagacccagcgccggcaacgtgagcacccaccccagcctgagccagagacccggcggcagcaccaagagccaccccgagccccagacccccaaggacagccccagcaagagcagcagcgaggcccagaccaccaaggacgtgcccaacaagagcggcgccgacggccagacccccaaggacggcagcagcaagagcggcgccgaggaccagacccccaaggacgtgcccaacaagagcggcgccgagaagcagacccccaaggacggcagcaacaagagcggcgccgaggagcagggccccatcgacggccccagcaagagcggcgccgaggagcagaccagcaaggacagccccaacaaggaggaggtgaagagcagcgagcccaccgaggacgtggagcccaaggaggccgaggacgacgacaccggccccgaggagggcagcccccccaaggaggagaaggagaagatgagcggcagcgccagcagcgagaacagagagggcaccctgagcgacagcaccggcagcgagaaggacgacctgtaccccaacggcagcggcaacggcagcgccgagagcagccacttcttcgcctacctggtgaccgccgccatcctggtggccgtgctgtacatcgcccaccacaacaagagaaagatcatcgccttcgtgctggagggcaagagaagcaaggtgaccagaagacccaaggccagcgactaccagagactggaccagaagagctag

SEQ ID NO: 102979 - DNA, 1314 bp, Artificial Sequence
  Description of Artificial Sequence: Synthetic coding sequence
atgagattcgtggtggccctggtgctgctgaacgtggccgccgccggcgccgtgcccctgctggccaccgagagcgtgaagcaggaggaggccggcgtgagacccagcgccggcaacgtgagcacccaccccagcctgagccagagacccggcggcagcaccaagagccaccccgagccccagacccccaaggacagccccagcaagagcagcgccgaggcccagacccccgaggacacccccaacaagagcggcgccgaggccaagacccagaaggacagcagcaacaagagcggcgccgaggccaagacccagaagggcagcaccagcaagagcggcagcgaggcccagaccaccaaggacagcaccagcaagagccaccccgagctgcagacccccaaggacagcaccggcaagagcggcgccgaggcccagacccccgaggacagccccaacagaagcggcgccgaggccaagacccagaaggacagccccagcaagagcggcagcgaggcccagaccaccaaggacgtgcccaacaagagcggcgccgacggccagacccccaaggacggcagcagcaagagcggcgccgaggaccagacccccaaggacgtgcccaacaagagcggcgccgagaagcagacccccaaggacggcagcaacaagagcggcgccgaggagcagggccccatcgacggccccagcaagagcggcgccgaggagcagaccagcaaggacagccccaacaaggtggtgcccgagcagcccagcagaaaggaccacagcaagcccatcagcaaccccagcgacaacaaggagctgcccaaggccgacaccaaccagctggccgacaagggcaagctgagcccccacgccttcaagaccgagagcggcgaggagaccgacctgatcagccccccccaggaggaggtgaagagcagcgagcccaccgaggacgtggagcccaaggaggccgaggacgacgacaccggccccgaggagggcagcccccccaaggaggagaaggagaagatgagcggcagcgccagcagcgagaacagagagggcaccctgagcgacagcaccggcagcgagaaggacgacctgtaccccaacggcagcggcaacggcagcgccgagagcagccacttcttcgcctacctggtgaccgccgccatcctggtggccgtgctgtacatcgcccaccacaacaagagaaagatcatcgccttcgtgctggagggcaagagaagcaaggtgaccagaagacccaaggccagcgactaccagagactggaccagaagagctag

SEQ ID NO: 102980 - DNA, 1140 bp, Artificial Sequence
  Description of Artificial Sequence: Synthetic coding sequence
atgagattcgtggtggccctggtgctgctgaacgtggccgccgccggcgccgtgcccctgctggccaccgagagcgtgaagcaggaggaggccggcgtgagacccagcgccggcaacgtgagcacccaccccagcctgagccagagacccggcggcagcaccaagagccaccccgagccccagacccccaaggacagccccagcaagagcagcgccgaggcccagacccccgaggacacccccaacaagagcggcgccgaggccaagacccagaaggacagcagcaacaagagcggcgccgaggccaagacccagaagggcagcaccagcaagagcggcagcgaggcccagaccaccaaggacagcaccagcaagagccaccccgagctgcagacccccaaggacagcaccggcaagagcggcgccgaggcccagacccccgaggacagccccaacagaagcggcgccgaggccaagacccagaaggacagccccagcaagagcggcagcgaggcccagaccaccaaggacgtgcccaacaagagcggcgccgacggccagacccccaaggacggcagcagcaagagcggcgccgaggaccagacccccaaggacgtgcccaacaagagcggcgccgagaagcagacccccaaggacggcagcaacaagagcggcgccgaggagcagggccccatcgacggccccagcaagagcggcgccgaggagcagaccagcaaggacagccccaacaaggaggaggtgaagagcagcgagcccaccgaggacgtggagcccaaggaggccgaggacgacgacaccggccccgaggagggcagcccccccaaggaggagaaggagaagatgagcggcagcgccagcagcgagaacagagagggcaccctgagcgacagcaccggcagcgagaaggacgacctgtaccccaacggcagcggcaacggcagcgccgagagcagccacttcttcgcctacctggtgaccgccgccatcctggtggccgtgctgtacatcgcccaccacaacaagagaaagatcatcgccttcgtgctggagggcaagagaagcaaggtgaccagaagacccaaggccagcgactaccagagactggaccagaagagctag

SEQ ID NO: 102981 - DNA, 1362 bp, Artificial Sequence
  Description of Artificial Sequence: Synthetic coding sequence
atgagattcgtggtggccctggtgctgctgaacgtggccgccgccggcgccgtgcccctgctggccaccgagagcgtgaagcaggaggaggccggcgtgagacccagcgccggcaacgtgagcacccaccccagcctgagccagagacccggcggcagcaccaagagccaccccgagccccagacccccaaggacagccccagcaagagcagcgccgaggcccagacccccgaggacacccccaacaagagcggcgccgaggccaagacccagaaggacagcagcaacaagagcggcgccgaggccaagacccagaagggcagcaccagcaagagcggcagcgaggcccagaccaccaaggacagcaccagcaagagccaccccgagctgcagacccccaaggacagcaccggcaagagcggcgccgaggcccagacccccgaggacagccccaacagaagcggcgccgaggccaagacccagaaggacagccccagcaagagcggcagcgaggcccagaccaccaaggacgtgcccaacaagagcggcgccgacggccagacccccaaggacggcagcagcaagagcggcgccgaggaccagacccccaaggacgtgcccaacaagagcggcgccgagaagcagacccccaaggacggcagcaacaagagcggcgccgaggagcagggccccatcgacggccccagcaagagcggcgccgaggagcagaccagcaaggacagccccaacaaggtggtgcccgagcagcccagcagaaaggaccacagcaagcccatcagcaaccccagcgacaacaaggagctgcccaaggccgacaccaaccagctggccgacaagggcaagctgagcccccacgccttcaagaccgagagcggcgaggagaccgacctgatcagccccccccaggaggaggtgaagagcagcgagcccaccgaggacgtggagcccaaggaggccgaggacgacgacaccggccccgaggagggcagcccccccaaggaggagaaggagaagatgagcggcagcgccagcagcgagaacagagagggcaccctgagcgacagcaccggcagcgagaaggacgacctgtaccccaacggcagcggcaacggcagcgccgagagcagccacttcttcgcctacctggtgaccgccgccatcctggtggccgtgctgtacatcgcccaccacaacaagagaaagatcatcgccttcgtgctggagggcaagagaagcaaggtgaccagaagacccaaggccagcgactaccagagactggaccagaagatcttcttccccctgagccccaacagaatggtgtacagcagcggcaagagatag

SEQ ID NO: 102982 - DNA, 693 bp, Artificial Sequence
  Description of Artificial Sequence: Synthetic coding sequence
atgtacgtgagagtgagcttcgacaccaagcccgacctgctgctgcacctgatgaccaaggagtggcagctggagctgcccaagctgctgatcagcgtgcacggcggcctgcagaacttcgagctgcagcccaagctgaagcaggtgttcggcaagggcctgatcaaggccgccatgaccaccggcgcctggatcttcaccggcggcgtgaacaccggcgtgatcagacacgtgggcgacgccctgaaggaccacgccagcaagagcagaggcaagatctgcaccatcggcatcgccccctggggcatcgtggagaaccaggaggacctgatcggcagagacgtggtgagaccctaccagaccatgagcaaccccatgagcaagctgaccgtgctgaacagcatgcacagccacttcatcctggccgacaacggcaccaccggcaagtacggcgccgaggtgaagctgagaagacagctggagaagcacatcagcctgcagaagatcaacaccagaatcggccagggcgtgcccgtggtggccctgatcgtggagggcggccccaacgtgatcagcatcgtgctggagtacctgagagacaccccccccgtgcccgtggtggtgtgcgacggcagcggcagagccagcgacatcctggccttcggccacaagtacagcgaggagggcggctag

SEQ ID NO: 102983 - DNA, 2520 bp, Artificial Sequence
  Description of Artificial Sequence: Synthetic coding sequence
atgaagaagtggagcagcaccgacctgggcgccgccgccgaccccctgcagaaggacacctgccccgaccccctggacggcgaccccaacagcagacccccccccgccaagccccagctgagcaccgccaagagcagaaccagactgttcggcaagggcgacagcgaggaggccttccccgtggactgcccccacgaggagggcgagctggacagctgccccaccatcaccgtgagccccgtgatcaccatccagagacccggcgacggccccaccggcgccagactgctgagccaggacagcgtggccgccagcaccgagaagaccctgagactgtacgacagaagaagcatcttcgaggccgtggcccagaacaactgccaggacctggagagcctgctgctgttcctgcagaagagcaagaagcacctgaccgacaacgagttcaaggaccccgagaccggcaagacctgcctgctgaaggccatgctgaacctgcacgacggccagaacaccaccatccccctgctgctggagatcgccagacagaccgacagcctgaaggagctggtgaacgccagctacaccgacagctactacaagggccagaccgccctgcacatcgccatcgagagaagaaacatggccctggtgaccctgctggtggagaacggcgccgacgtgcaggccgccgcccacggcgacttcttcaagaagaccaagggcagacccggcttctacttcggcgagctgcccctgagcctggccgcctgcaccaaccagctgggcatcgtgaagttcctgctgcagaacagctggcagaccgccgacatcagcgccagagacagcgtgggcaacaccgtgctgcacgccctggtggaggtggccgacaacaccgccgacaacaccaagttcgtgaccagcatgtacaacgagatcctgatgctgggcgccaagctgcaccccaccctgaagctggaggagctgaccaacaagaagggcatgacccccctggccctggccgccggcaccggcaagatcggcgtgctggcctacatcctgcagagagagatccaggagcccgagtgcagacacctgagcagaaagttcaccgagtgggcctacggccccgtgcacagcagcctgtacgacctgagctgcatcgacacctgcgagaagaacagcgtgctggaggtgatcgcctacagcagcagcgagacccccaacagacacgacatgctgctggtggagcccctgaacagactgctgcaggacaagtgggacagattcgtgaagagaatcttctacttcaacttcctggtgtactgcctgtacatgatcatcttcaccatggccgcctactacagacccgtggacggcctgccccccttcaagatggagaagaccggcgactacttcagagtgaccggcgagatcctgagcgtgctgggcggcgtgtacttcttcttcagaggcatccagtacttcctgcagagaagacccagcatgaagaccctgttcgtggacagctacagcgagatgctgttcttcctgcagagcctgttcatgctggccaccgtggtgctgtacttcagccacctgaaggagtacgtggccagcatggtgttcagcctggccctgggctggaccaacatgctgtactacaccagaggcttccagcagatgggcatctacgccgtgatgatcgagaagatgatcctgagagacctgtgcagattcatgttcgtgtacatcgtgttcctgttcggcttcagcaccgccgtggtgaccctgatcgaggacggcaagaacgacagcctgcccagcgagagcaccagccacagatggagaggccccgcctgcagaccccccgacagcagctacaacagcctgtacagcacctgcctggagctgttcaagttcaccatcggcatgggcgacctggagttcaccgagaactacgacttcaaggccgtgttcatcatcctgctgctggcctacgtgatcctgacctacatcctgctgctgaacatgctgatcgccctgatgggcgagaccgtgaacaagatcgcccaggagagcaagaacatctggaagctgcagagagccatcaccatcctggacaccgagaagagcttcctgaagtgcatgagaaaggccttcagaagcggcaagctgctgcaggtgggctacacccccgacggcaaggacgactacagatggtgcttcagagtggacgaggtgaactggaccacctggaacaccaacgtgggcatcatcaacgaggaccccggcaactgcgagggcgtgaagagaaccctgagcttcagcctgagaagcagcagagtgagcggcagacactggaagaacttcgccctggtgcccctgctgagagaggccagcgccagagacagacagagcgcccagcccgaggaggtgtacctgagacagttcagcggcagcctgaagcccgaggacgccgaggtgttcaagagccccgccgccagcggcgagaagtag

SEQ ID NO: 102984 - DNA, 2373 bp, Artificial Sequence
  Description of Artificial Sequence: Synthetic coding sequence
atgaaggcccaccccaaggagatggtgcccctgatgggcaagagagtggccgcccccagcggcaaccccgccatcctgcccgagaagagacccgccgagatcacccccaccaagaagagcgcccacttcttcctggagatcgagggcttcgagcccaaccccaccgtggccaagaccagcccccccgtgttcagcaagcccatggacagcaacatcagacagtgcatcagcggcaactgcgacgacatggacagcccccagagcccccaggacgacgtgaccgagacccccagcaaccccaacagccccagcgcccagctggccaaggaggagcagagaagaaagaagagaagactgaagaagagaatcttcgccgccgtgagcgagggctgcgtggaggagctggtggagctgctggtggagctgcaggagctgtgcagaagaagacacgacgaggacgtgcccgacttcctgatgcacaagctgaccgccagcgacaccggcaagacctgcctgatgaaggccctgctgaacatcaaccccaacaccaaggagatcgtgagaatcctgctggccttcgccgaggagaacgacatcctgggcagattcatcaacgccgagtacaccgaggaggcctacgagggccagaccgccctgaacatcgccatcgagagaagacagggcgacatcgccgccctgctgatcgccgccggcgccgacgtgaacgcccacgccaagggcgccttcttcaaccccaagtaccagcacgagggcttctacttcggcgagacccccctggccctggccgcctgcaccaaccagcccgagatcgtgcagctgctgatggagcacgagcagaccgacatcaccagcagagacagcagaggcaacaacatcctgcacgccctggtgaccgtggccgaggacttcaagacccagaacgacttcgtgaagagaatgtacgacatgatcctgctgagaagcggcaactgggagctggagaccaccagaaacaacgacggcctgacccccctgcagctggccgccaagatgggcaaggccgagatcctgaagtacatcctgagcagagagatcaaggagaagagactgagaagcctgagcagaaagttcaccgactgggcctacggccccgtgagcagcagcctgtacgacctgaccaacgtggacaccaccaccgacaacagcgtgctggagatcaccgtgtacaacaccaacatcgacaacagacacgagatgctgaccctggagcccctgcacaccctgctgcacatgaagtggaagaagttcgccaagcacatgttcttcctgagcttctgcttctacttcttctacaacatcaccctgaccctggtgagctactacagacccagagaggaggaggccatcccccaccccctggccctgacccacaagatgggctggctgcagctgctgggcagaatgttcgtgctgatctgggccatgtgcatcagcgtgaaggagggcatcgccatcttcctgctgagacccagcgacctgcagagcatcctgagcgacgcctggttccacttcgtgttcttcatccaggccgtgctggtgatcctgagcgtgttcctgtacctgttcgcctacaaggagtacctggcctgcctggtgctggccatggccctgggctgggccaacatgctgtactacaccagaggcttccagagcatgggcatgtacagcgtgatgatccagaaggtgatcctgcacgacgtgctgaagttcctgttcgtgtacatcgtgttcctgctgggcttcggcgtggccctggccagcctgatcgagaagtgccccaaggacaacaaggactgcagcagctacggcagcttcagcgacgccgtgctggagctgttcaagctgaccatcggcctgggcgacctgaacatccagcagaacagcaagtaccccatcctgttcctgttcctgctgatcacctacgtgatcctgaccttcgtgctgctgctgaacatgctgatcgccctgatgggcgagaccgtggagaacgtgagcaaggagagcgagagaatctggagactgcagagagccagaaccatcctggagttcgagaagatgctgcccgagtggctgagaagcagattcagaatgggcgagctgtgcaaggtggccgaggacgacttcagactgtgcctgagaatcaacgaggtgaagtggaccgagtggaagacccacgtgagcttcctgaacgaggaccccggccccgtgagaagaaccgacttcaacaagatccaggacagcagcagaaacaacagcaagaccaccctgaacgccttcgaggaggtggaggagttccccgagaccagcgtgtag

SEQ ID NO: 102985 - DNA, 3360 bp, Artificial Sequence
  Description of Artificial Sequence: Synthetic coding sequence
atgaagagaagcctgagaaagatgtggagacccggcgagaagaaggagccccagggcgtggtgtacgaggacgtgcccgacgacaccgaggacttcaaggagagcctgaaggtggtgttcgagggcagcgcctacggcctgcagaacttcaacaagcagaagaagctgaagagatgcgacgacatggacaccttcttcctgcactacgccgccgccgagggccagatcgagctgatggagaagatcaccagagacagcagcctggaggtgctgcacgagatggacgactacggcaacacccccctgcactgcgccgtggagaagaaccagatcgagagcgtgaagttcctgctgagcagaggcgccaaccccaacctgagaaacttcaacatgatggcccccctgcacatcgccgtgcagggcatgaacaacgaggtgatgaaggtgctgctggagcacagaaccatcgacgtgaacctggagggcgagaacggcaacaccgccgtgatcatcgcctgcaccaccaacaacagcgaggccctgcagatcctgctgaagaagggcgccaagccctgcaagagcaacaagtggggctgcttccccatccaccaggccgccttcagcggcagcaaggagtgcatggagatcatcctgagattcggcgaggagcacggctacagcagacagctgcacatcaacttcatgaacaacggcaaggccacccccctgcacctggccgtgcagaacggcgacctggagatgatcaagatgtgcctggacaacggcgcccagatcgaccccgtggagaagggcagatgcaccgccatccacttcgccgccacccagggcgccaccgagatcgtgaagctgatgatcagcagctacagcggcagcgtggacatcgtgaacaccaccgacggctgccacgagaccatgctgcacagagccagcctgttcgaccaccacgagctggccgactacctgatcagcgtgggcgccgacatcaacaagatcgacagcgagggcagaagccccctgatcctggccaccgccagcgccagctggaacatcgtgaacctgctgctgagcaagggcgcccaggtggacatcaaggacaacttcggcagaaacttcctgcacctgaccgtgcagcagccctacggcctgaagaacctgagacccgagttcatgcagatgcagcagatcaaggagctggtgatggacgaggacaacgacggctgcacccccctgcactacgcctgcagacagggcggccccggcagcgtgaacaacctgctgggcttcaacgtgagcatccacagcaagagcaaggacaagaagagccccctgcacttcgccgccagctacggcagaatcaacacctgccagagactgctgcaggacatcagcgacaccagactgctgaacgagggcgacctgcacggcatgacccccctgcacctggccgccaagaacggccacgacaaggtggtgcagctgctgctgaagaagggcgccctgttcctgagcgaccacaacggctggaccgccctgcaccacgccagcatgggcggctacacccagaccatgaaggtgatcctggacaccaacctgaagtgcaccgacagactggacgaggacggcaacaccgccctgcacttcgccgccagagagggccacgccaaggccgtggccctgctgctgagccacaacgccgacatcgtgctgaacaagcagcaggccagcttcctgcacctggccctgcacaacaagagaaaggaggtggtgctgaccatcatcagaagcaagagatgggacgagtgcctgaagatcttcagccacaacagccccggcaacaagtgccccatcaccgagatgatcgagtacctgcccgagtgcatgaaggtgctgctggacttctgcatgctgcacagcaccgaggacaagagctgcagagactactacatcgagtacaacttcaagtacctgcagtgccccctggagttcaccaagaagacccccacccaggacgtgatctacgagcccctgaccgccctgaacgccatggtgcagaacaacagaatcgagctgctgaaccaccccgtgtgcaaggagtacctgctgatgaagtggctggcctacggcttcagagcccacatgatgaacctgggcagctactgcctgggcctgatccccatgaccatcctggtggtgaacatcaagcccggcatggccttcaacagcaccggcatcatcaacgagaccagcgaccacagcgagatcctggacaccaccaacagctacctgatcaagacctgcatgatcctggtgttcctgagcagcatcttcggctactgcaaggaggccggccagatcttccagcagaagagaaactacttcatggacatcagcaacgtgctggagtggatcatctacaccaccggcatcatcttcgtgctgcccctgttcgtggagatccccgcccacctgcagtggcagtgcggcgccatcgccgtgtacttctactggatgaacttcctgctgtacctgcagagattcgagaactgcggcatcttcatcgtgatgctggaggtgatcctgaagaccctgctgagaagcaccgtggtgttcatcttcctgctgctggccttcggcctgagcttctacatcctgctgaacctgcaggaccccttcagcagccccctgctgagcatcatccagaccttcagcatgatgctgggcgacatcaactacagagagagcttcctggagccctacctgagaaacgagctggcccaccccgtgctgagcttcgcccagctggtgagcttcaccatcttcgtgcccatcgtgctgatgaacctgctgatcggcctggccgtgggcgacatcgccgaggtgcagaagcacgccagcctgaagagaatcgccatgcaggtggagctgcacaccagcctggagaagaagctgcccctgtggttcctgagaaaggtggaccagaagagcaccatcgtgtaccccaacaagcccagaagcggcggcatgctgttccacatcttctgcttcctgttctgcaccggcgagatcagacaggagatccccaacgccgacaagagcctggagatggagatcctgaagcagaagtacagactgaaggacctgaccttcctgctggagaagcagcacgagctgatcaagctgatcatccagaagatggagatcatcagcgagaccgaggacgacgacagccactgcagcttccaggacagattcaagaaggagcagatggagcagagaaacagcagatggaacaccgtgctgagagccgtgaaggccaagacccaccacctggagccctag

SEQ ID NO: 102986 - DNA, 2280 bp, Artificial Sequence
  Description of Artificial Sequence: Synthetic coding sequence
atgatggccgccctgtaccccagcaccgacctgagcggcgccagcagcagcagcctgcccagcagccccagcagcagcagccccaacgaggtgatggccctgaaggacgtgagagaggtgaaggaggagaacaccctgaacgagaagctgttcctgctggcctgcgacaagggcgactactacatggtgaagaagatcctggaggagaacagcagcggcgacctgaacatcaactgcgtggacgtgctgggcagaaacgccgtgaccatcaccatcgagaacgagaacctggacatcctgcagctgctgctggactacggctgccagaagctgatggagagaatccagaaccccgagtacagcaccaccatggacgtggcccccgtgatcctggccgcccacagaaacaactacgagatcctgaccatgctgctgaagcaggacgtgagcctgcccaagccccacgccgtgggctgcgagtgcaccctgtgcagcgccaagaacaagaaggacagcctgagacacagcagattcagactggacatctacagatgcctggccagccccgccctgatcatgctgaccgaggaggaccccatcctgagagccttcgagctgagcgccgacctgaaggagctgagcctggtggaggtggagttcagaaacgactacgaggagctggccagacagtgcaagatgttcgccaaggacctgctggcccaggccagaaacagcagagagctggaggtgatcctgaaccacaccagcagcgacgagcccctggacaagagaggcctgctggaggagagaatgaacctgagcagactgaagctggccatcaagtacaaccagaaggagttcgtgagccagagcaactgccagcagttcctgaacaccgtgtggttcggccagatgagcggctacagaagaaagcccacctgcaagaagatcatgaccgtgctgaccgtgggcatcttctggcccgtgctgagcctgtgctacctgatcgcccccaagagccagttcggcagaatcatccacacccccttcatgaagttcatcatccacggcgccagctacttcaccttcctgctgctgctgaacctgtacagcctggtgtacaacgaggacaagaagaacaccatgggccccgccctggagagaatcgactacctgctgatcctgtggatcatcggcatgatctggagcgacatcaagagactgtggtacgagggcctggaggacttcctggaggagagcagaaaccagctgagcttcgtgatgaacagcctgtacctggccaccttcgccctgaaggtggtggcccacaacaagttccacgacttcgccgacagaaaggactgggacgccttccaccccaccctggtggccgagggcctgttcgccttcgccaacgtgctgagctacctgagactgttcttcatgtacaccaccagcagcatcctgggccccctgcagatcagcatgggccagatgctgcaggacttcggcaagttcctgggcatgttcctgctggtgctgttcagcttcaccatcggcctgacccagctgtacgacaagggctacaccagcaaggagcagaaggactgcgtgggcatcttctgcgagcagcagagcaacgacaccttccacagcttcatcggcacctgcttcgccctgttctggtacatcttcagcctggcccacgtggccatcttcgtgaccagattcagctacggcgaggagctgcagagcttcgtgggcgccgtgatcgtgggcacctacaacgtggtggtggtgatcgtgctgaccaagctgctggtggccatgctgcacaagagcttccagctgatcgccaaccacgaggacaaggagtggaagttcgccagagccaagctgtggctgagctacttcgacgacaagtgcaccctgcccccccccttcaacatcatccccagccccaagaccatctgctacatgatcagcagcctgagcaagtggatctgcagccacaccagcaagggcaaggtgaagagacagaacagcctgaaggagtggagaaacctgaagcagaagagagacgagaactaccagaaggtgatgtgctgcctggtgcacagatacctgaccagcatgagacagaagatgcagagcaccgaccaggccaccgtggagaacctgaacgagctgagacaggacctgagcaagttcagaaacgagatcagagacctgctgggcttcagaaccagcaagtacgccatgttctaccccagaaactag

SEQ ID NO: 102987 - DNA, 435 bp, Artificial Sequence
  Description of Artificial Sequence: Synthetic coding sequence
atgatctggagcgacatcaagagactgtggtacgagggcctggaggacttcctggaggagagcagaaaccagctgagcttcgtgatgaacagcctgtacctggccaccttcgccctgaaggtggtggcccacaacaagatcagcatgggccagatgctgcaggacttcggcaagttcctgggcatgttcctgctggtgctgttcagcttcaccatcggcctgacccagctgtacgacaagggctacaccagcaaggagcagaaggactgcgtgggcatcttctgcgagcagcagagcaacgacaccttccacagcttcatcggcacctgcttcgccctgttctggtacatcttcagcctggcccacgtggccatcttcgtgaccagattcagctacggcgaggagctgcagagcttcgtgggcgccgtgatctag

SEQ ID NO: 102988 - DNA, 2382 bp, Artificial Sequence
  Description of Artificial Sequence: Synthetic coding sequence
atgatggccgccctgtaccccagcaccgacctgagcggcgccagcagcagcagcctgcccagcagccccagcagcagcagccccaacgaggtgatggccctgaaggacgtgagagaggtgaaggaggagaacaccctgaacgagaagctgttcctgctggcctgcgacaagggcgactactacatggtgaagaagatcctggaggagaacagcagcggcgacctgaacatcaactgcgtggacgtgctgggcagaaacgccgtgaccatcaccatcgagaacgagaacctggacatcctgcagctgctgctggactacggctgccagagcgccgacgccctgctggtggccatcgacagcgaggtggtgggcgccgtggacatcctgctgaaccacagacccaagagaagcagcagacccaccatcgtgaagctgatggagagaatccagaaccccgagtacagcaccaccatggacgtggcccccgtgatcctggccgcccacagaaacaactacgagatcctgaccatgctgctgaagcaggacgtgagcctgcccaagccccacgccgtgggctgcgagtgcaccctgtgcagcgccaagaacaagaaggacagcctgagacacagcagattcagactggacatctacagatgcctggccagccccgccctgatcatgctgaccgaggaggaccccatcctgagagccttcgagctgagcgccgacctgaaggagctgagcctggtggaggtggagttcagaaacgactacgaggagctggccagacagtgcaagatgttcgccaaggacctgctggcccaggccagaaacagcagagagctggaggtgatcctgaaccacaccagcagcgacgagcccctggacaagagaggcctgctggaggagagaatgaacctgagcagactgaagctggccatcaagtacaaccagaaggagttcgtgagccagagcaactgccagcagttcctgaacaccgtgtggttcggccagatgagcggctacagaagaaagcccacctgcaagaagatcatgaccgtgctgaccgtgggcatcttctggcccgtgctgagcctgtgctacctgatcgcccccaagagccagttcggcagaatcatccacacccccttcatgaagttcatcatccacggcgccagctacttcaccttcctgctgctgctgaacctgtacagcctggtgtacaacgaggacaagaagaacaccatgggccccgccctggagagaatcgactacctgctgatcctgtggatcatcggcatgatctggagcgacatcaagagactgtggtacgagggcctggaggacttcctggaggagagcagaaaccagctgagcttcgtgatgaacagcctgtacctggccaccttcgccctgaaggtggtggcccacaacaagttccacgacttcgccgacagaaaggactgggacgccttccaccccaccctggtggccgagggcctgttcgccttcgccaacgtgctgagctacctgagactgttcttcatgtacaccaccagcagcatcctgggccccctgcagatcagcatgggccagatgctgcaggacttcggcaagttcctgggcatgttcctgctggtgctgttcagcttcaccatcggcctgacccagctgtacgacaagggctacaccagcaaggagcagaaggactgcgtgggcatcttctgcgagcagcagagcaacgacaccttccacagcttcatcggcacctgcttcgccctgttctggtacatcttcagcctggcccacgtggccatcttcgtgaccagattcagctacggcgaggagctgcagagcttcgtgggcgccgtgatcgtgggcacctacaacgtggtggtggtgatcgtgctgaccaagctgctggtggccatgctgcacaagagcttccagctgatcgccaaccacgaggacaaggagtggaagttcgccagagccaagctgtggctgagctacttcgacgacaagtgcaccctgcccccccccttcaacatcatccccagccccaagaccatctgctacatgatcagcagcctgagcaagtggatctgcagccacaccagcaagggcaaggtgaagagacagaacagcctgaaggagtggagaaacctgaagcagaagagagacgagaactaccagaaggtgatgtgctgcctggtgcacagatacctgaccagcatgagacagaagatgcagagcaccgaccaggccaccgtggagaacctgaacgagctgagacaggacctgagcaagttcagaaacgagatcagagacctgctgggcttcagaaccagcaagtacgccatgttctaccccagaaactag

SEQ ID NO: 102989 - DNA, 2415 bp, Artificial Sequence
  Description of Artificial Sequence: Synthetic coding sequence
atggcccagttctactacaagagaaacgtgaacgccccctacagagacagaatccccctgagaatcgtgagagccgagagcgagctgagccccagcgagaaggcctacctgaacgccgtggagaagggcgactacgccagcgtgaagaagagcctggaggaggccgagatctacttcaagatcaacatcaactgcatcgaccccctgggcagaaccgccctgctgatcgccatcgagaacgagaacctggagctgatcgagctgctgctgagcttcaacgtgtacgtgggcgacgccctgctgcacgccatcagaaaggaggtggtgggcgccgtggagctgctgctgaaccacaagaagcccagcggcgagaagcagttcgtggcccagcccaactgccagcagctgctggccagcagatggtacgacgagttccccggctggagaagaagacactgggccgtgaagatggtgacctgcttcatcatcggcctgctgttccccgtgttcagcgtgtgctacctgatcgcccccaagagccccctgggcctgttcatcagaaagcccttcatcaagttcatctgccacaccgccagctacctgaccttcctgttcctgctgctgctggccagccagcacatcgacagaagcgacctgaacagacagggccccccccccaccatcgtggagtggatgatcctgccctgggtgctgggcttcatctggggcgagatcaagcagatgtgggacggcggcctgcaggactacatccacgactggtggaacctgatggacttcgtgatgaacagcctgtacctggccaccatcagcctgaagatcgtggccttcgtgaagtacagcgccctgaaccccagagagagctgggacatgtggcaccccaccctggtggccgaggccctgttcgccatcgccaacatcttcagcagcctgagactgatcagcctgttcaccgccaacagccacctgggccccctgcagatcagcctgggcagaatgctgctggacatcctgaagttcctgttcatctactgcctggtgctgctggccttcgccaacggcctgaaccagctgtacttctactacgaggagaccaagggcctgacctgcaagggcatcagatgcgagaagcagaacaacgccttcagcaccctgttcgagaccctgcagagcctgttctggagcatcttcggcctgatcaacctgtacgtgaccaacgtgaaggcccagcacgagttcaccgagttcgtgggcgccaccatgttcggcacctacaacgtgatcagcctggtggtgctgctgaacatgctgatcgccatgatgaacaacagctaccagctgatcgccgaccacgccgacatcgagtggaagttcgccagaaccaagctgtggatgagctacttcgaggagggcggcaccctgcccacccccttcaacgtgatccccagccccaagagcctgtggtacctgatcaagtggatctggacccacctgtgcaagaagaagatgagaagaaagcccgagagcttcggcaccatcggcagaagagccgccgacaacctgagaagacaccaccagtaccaggaggtgatgagaaacctggtgaagagatacgtggccgccatgatcagagacgccaagaccgaggagggcctgaccgaggagaacttcaaggagctgaagcaggacatcagcagcttcagattcgaggtgctgggcctgctgagaggcagcaagctgagcaccatccagagcgccaacgccagcaaggagagcagcaacagcgccgacagcgacgagaagagcgacagcgagggcaacagcaaggacaagaagaagaacttcagcctgttcgacctgaccaccctgatccaccccagaagcgccgccatcgccagcgagagacacaacatcagcaacggcagcgccctggtggtgcaggagccccccagagagaagcagagaaaggtgaacttcgtgaccgacatcaagaacttcggcctgttccacagaagaagcaagcagaacgccgccgagcagaacgccaaccagatcttcagcgtgagcgaggaggtggccagacagcaggccgccggccccctggagagaaacatccagctggagagcagaggcctggccagcagaggcgacctgagcatccccggcctgagcgagcagtgcgtgctggtggaccacagagagagaaacaccgacaccctgggcctgcaggtgggcaagagagtgtgccccttcaagagcgagaaggtggtggtggaggacaccgtgcccatcatccccaaggagaagcacgccaaggaggaggacagcagcatcgactacgacctgaacctgcccgacaccgtgacccacgaggactacgtgaccaccagactgtag

SEQ ID NO: 102990 - DNA, 2511 bp, Artificial Sequence
  Description of Artificial Sequence: Synthetic coding sequence
atggcccagttctactacaagagaaacgtgaacgccccctacagagacagaatccccctgagaatcgtgagagccgagagcgagctgagccccagcgagaaggcctacctgaacgccgtggagaagggcgactacgccagcgtgaagaagagcctggaggaggccgagatctacttcaagatcaacatcaactgcatcgaccccctgggcagaaccgccctgctgatcgccatcgagaacgagaacctggagctgatcgagctgctgctgagcttcaacgtgtacgtgggcgacgccctgctgcacgccatcagaaaggaggtggtgggcgccgtggagctgctgctgaaccacaagaagcccagcggcgagaagcaggtgccccccatcctgctggacaagcagttcagcgagttcacccccgacatcacccccatcatcctggccgcccacaccaacaactacgagatcatcaagctgctggtgcagaagggcgtgagcgtgcccagaccccacgaggtgagatgcaactgcgtggagtgcgtgagcagcagcgacgtggacagcctgagacacagcagaagcagactgaacatctacaaggccctggccagccccagcctgatcgccctgagcagcgaggaccccttcctgaccgccttccagctgagctgggagctgcaggagctgagcaaggtggagaacgagttcaagagcgagtacgaggagctgagcagacagtgcaagcagttcgccaaggacctgctggaccagaccagaagcagcagagagctggagatcatcctgaactacagagacgacaacagcctgatcgaggagcagagcggcaacgacctggccagactgaagctggccatcaagtacagacagaaggagttcgtggcccagcccaactgccagcagctgctggccagcagatggtacgacgagttccccggctggagaagaagacactgggccgtgaagatggtgacctgcttcatcatcggcctgctgttccccgtgttcagcgtgtgctacctgatcgcccccaagagccccctgggcctgttcatcagaaagcccttcatcaagttcatctgccacaccgccagctacctgaccttcctgttcctgctgctgctggccagccagcacatcgacagaagcgacctgaacagacagggccccccccccaccatcgtggagtggatgatcctgccctgggtgctgggcttcatctggggcgagatcaagcagatgtgggacggcggcctgcaggactacatccacgactggtggaacctgatggacttcgtgatgaacagcctgtacctggccaccatcagcctgaagatcgtggccttcgtgaagtacagcgccctgaaccccagagagagctgggacatgtggcaccccaccctggtggccgaggccctgttcgccatcgccaacatcttcagcagcctgagactgatcagcctgttcaccgccaacagccacctgggccccctgcagatcagcctgggcagaatgctgctggacatcctgaagttcctgttcatctactgcctggtgctgctggccttcgccaacggcctgaaccagctgtacttctactacgaggagaccaagggcctgacctgcaagggcatcagatgcgagaagcagaacaacgccttcagcaccctgttcgagaccctgcagagcctgttctggagcatcttcggcctgatcaacctgtacgtgaccaacgtgaaggcccagcacgagttcaccgagttcgtgggcgccaccatgttcggcacctacaacgtgatcagcctggtggtgctgctgaacatgctgatcgccatgatgaacaacagctaccagctgatcgccgaccacgccgacatcgagtggaagttcgccagaaccaagctgtggatgagctacttcgaggagggcggcaccctgcccacccccttcaacgtgatccccagccccaagagcctgtggtacctgatcaagtggatctggacccacctgtgcaagaagaagatgagaagaaagcccgagagcttcggcaccatcggcagaagagccgccgacaacctgagaagacaccaccagtaccaggaggtgatgagaaacctggtgaagagatacgtggccgccatgatcagagacgccaagaccgaggaggtggccagacagcaggccgccggccccctggagagaaacatccagctggagagcagaggcctggccagcagaggcgacctgagcatccccggcctgagcgagcagtgcgtgctggtggaccacagagagagaaacaccgacaccctgggcctgcaggtgggcaagagagtgtgccccttcaagagcgagaaggtggtggtggaggacaccgtgcccatcatccccaaggagaagcacgccaaggaggaggacagcagcatcgactacgacctgaacctgcccgacaccgtgacccacgaggactacgtgaccaccagactgtag

SEQ ID NO: 102991 - DNA, 2682 bp, Artificial Sequence
  Description of Artificial Sequence: Synthetic coding sequence
atggcccagttctactacaagagaaacgtgaacgccccctacagagacagaatccccctgagaatcgtgagagccgagagcgagctgagccccagcgagaaggcctacctgaacgccgtggagaagggcgactacgccagcgtgaagaagagcctggaggaggccgagatctacttcaagatcaacatcaactgcatcgaccccctgggcagaaccgccctgctgatcgccatcgagaacgagaacctggagctgatcgagctgctgctgagcttcaacgtgtacgtgggcgacgccctgctgcacgccatcagaaaggaggtggtgggcgccgtggagctgctgctgaaccacaagaagcccagcggcgagaagcaggtgccccccatcctgctggacaagcagttcagcgagttcacccccgacatcacccccatcatcctggccgcccacaccaacaactacgagatcatcaagctgctggtgcagaagggcgtgagcgtgcccagaccccacgaggtgagatgcaactgcgtggagtgcgtgagcagcagcgacgtggacagcctgagacacagcagaagcagactgaacatctacaaggccctggccagccccagcctgatcgccctgagcagcgaggaccccttcctgaccgccttccagctgagctgggagctgcaggagctgagcaaggtggagaacgagttcaagagcgagtacgaggagctgagcagacagtgcaagcagttcgccaaggacctgctggaccagaccagaagcagcagagagctggagatcatcctgaactacagagacgacaacagcctgatcgaggagcagagcggcaacgacctggccagactgaagctggccatcaagtacagacagaaggagttcgtggcccagcccaactgccagcagctgctggccagcagatggtacgacgagttccccggctggagaagaagacactgggccgtgaagatggtgacctgcttcatcatcggcctgctgttccccgtgttcagcgtgtgctacctgatcgcccccaagagccccctgggcctgttcatcagaaagcccttcatcaagttcatctgccacaccgccagctacctgaccttcctgttcctgctgctgctggccagccagcacatcgacagaagcgacctgaacagacagggccccccccccaccatcgtggagtggatgatcctgccctgggtgctgggcttcatctggggcgagatcaagcagatgtgggacggcggcctgcaggactacatccacgactggtggaacctgatggacttcgtgatgaacagcctgtacctggccaccatcagcctgaagatcgtggccttcgtgaagtacagcgccctgaaccccagagagagctgggacatgtggcaccccaccctggtggccgaggccctgttcgccatcgccaacatcttcagcagcctgagactgatcagcctgttcaccgccaacagccacctgggccccctgcagatcagcctgggcagaatgctgctggacatcctgaagttcctgttcatctactgcctggtgctgctggccttcgccaacggcctgaaccagctgtacttctactacgaggagaccaagggcctgacctgcaagggcatcagatgcgagaagcagaacaacgccttcagcaccctgttcgagaccctgcagagcctgttctggagcatcttcggcctgatcaacctgtacgtgaccaacgtgaaggcccagcacgagttcaccgagttcgtgggcgccaccatgttcggcacctacaacgtgatcagcctggtggtgctgctgaacatgctgatcgccatgatgaacaacagctaccagctgatcgccgaccacgccgacatcgagtggaagttcgccagaaccaagctgtggatgagctacttcgaggagggcggcaccctgcccacccccttcaacgtgatccccagccccaagagcctgtggtacctgatcaagtggatctggacccacctgtgcaagaagaagatgagaagaaagcccgagagcttcggcaccatcggcagaagagccgccgacaacctgagaagacaccaccagtaccaggaggtgatgagaaacctggtgaagagatacgtggccgccatgatcagagacgccaagaccgaggagggcctgaccgaggagaacttcaaggagctgaagcaggacatcagcagcttcagattcgaggtgctgggcctgctgagaggcagcaagctgagcaccatccagagcgccaacgccagcaaggagagcagcaacagcgccgacagcgacgagaagagcgacagcgaggaggaggtggccagacagcaggccgccggccccctggagagaaacatccagctggagagcagaggcctggccagcagaggcgacctgagcatccccggcctgagcgagcagtgcgtgctggtggaccacagagagagaaacaccgacaccctgggcctgcaggtgggcaagagagtgtgccccttcaagagcgagaaggtggtggtggaggacaccgtgcccatcatccccaaggagaagcacgccaaggaggaggacagcagcatcgactacgacctgaacctgcccgacaccgtgacccacgaggactacgtgaccaccagactgtag

SEQ ID NO: 102992 - DNA, 2487 bp, Artificial Sequence
  Description of Artificial Sequence: Synthetic coding sequence
atggcccagttctactacaagagaaacgtgaacgccccctacagagacagaatccccctgagaatcgtgagagccgagagcgagctgagccccagcgagaaggcctacctgaacgccgtggagaagggcgactacgccagcgtgaagaagagcctggaggaggccgagatctacttcaagatcaacatcaactgcatcgaccccctgggcagaaccgccctgctgatcgccatcgagaacgagaacctggagctgatcgagctgctgctgagcttcaacgtgtacgtgggcgacgccctgctgcacgccatcagaaaggaggtggtgggcgccgtggagctgctgctgaaccacaagaagcccagcggcgagaagcaggtgccccccatcctgctggacaagcagttcagcgagttcacccccgacatcacccccatcatcctggccgcccacaccaacaactacgagatcatcaagctgctggtgcagaagggcgtgagcgtgcccagaccccacgaggtgagatgcaactgcgtggagtgcgtgagcagcagcgacgtggacagcctgagacacagcagaagcagactgaacatctacaaggccctggccagccccagcctgatcgccctgagcagcgaggaccccttcctgaccgccttccagctgagctgggagctgcaggagctgagcaaggtggagaacgagttcaagagcgagtacgaggagctgagcagacagtgcaagcagttcgccaaggacctgctggaccagaccagaagcagcagagagctggagatcatcctgaactacagagacgacaacagcctgatcgaggagcagagcggcaacgacctggccagactgaagctggccatcaagtacagacagaaggagttcgtggcccagcccaactgccagcagctgctggccagcagatggtacgacgagttccccggctggagaagaagacactgggccgtgaagatggtgacctgcttcatcatcggcctgctgttccccgtgttcagcgtgtgctacctgatcgcccccaagagccccctgggcctgttcatcagaaagcccttcatcaagttcatctgccacaccgccagctacctgaccttcctgttcctgctgctgctggccagccagcacatcgacagaagcgacctgaacagacagggccccccccccaccatcgtggagtggatgatcctgccctgggtgctgggcttcatctggggcgagatcaagcagatgtgggacggcggcctgcaggactacatccacgactggtggaacctgatggacttcgtgatgaacagcctgtacctggccaccatcagcctgaagatcgtggccttcgtgaagtacagcgccctgaaccccagagagagctgggacatgtggcaccccaccctggtggccgaggccctgttcgccatcgccaacatcttcagcagcctgagactgatcagcctgttcaccgccaacagccacctgggccccctgcagatcagcctgggcagaatgctgctggacatcctgaagttcctgttcatctactgcctggtgctgctggccttcgccaacggcctgaaccagctgtacttctactacgaggagaccaagggcctgacctgcaagggcatcagatgcgagaagcagaacaacgccttcagcaccctgttcgagaccctgcagagcctgttctggagcatcttcggcctgatcaacctgtacgtgaccaacgtgaaggcccagcacgagttcaccgagttcgtgggcgccaccatgttcggcacctacaacgtgatcagcctggtggtgctgctgaacatgctgatcgccatgatgaacaacagctaccagctgatcgccagaagagccgccgacaacctgagaagacaccaccagtaccaggaggtgatgagaaacctggtgaagagatacgtggccgccatgatcagagacgccaagaccgaggagggcctgaccgaggagaacttcaaggagctgaagcaggacatcagcagcttcagattcgaggtgctgggcctgctgagaggcagcaagctgagcaccatccagagcgccaacgccagcaaggagagcagcaacagcgccgacagcgacgagaagagcgacagcgaggaggaggtggccagacagcaggccgccggccccctggagagaaacatccagctggagagcagaggcctggccagcagaggcgacctgagcatccccggcctgagcgagcagtgcgtgctggtggaccacagagagagaaacaccgacaccctgggcctgcaggtgggcaagagagtgtgccccttcaagagcgagaaggtggtggtggaggacaccgtgcccatcatccccaaggagaagcacgccaaggaggaggacagcagcatcgactacgacctgaacctgcccgacaccgtgacccacgaggactacgtgaccaccagactgtag

SEQ ID NO: 102993 - DNA, 2415 bp, Artificial Sequence; identical to SEQ ID NO: 102989
  Description of Artificial Sequence: Synthetic coding sequence

SEQ ID NO: 102994 - DNA, 2949 bp, Artificial Sequence
  Description of Artificial Sequence: Synthetic coding sequence
atggcccagttctactacaagagaaacgtgaacgccccctacagagacagaatccccctgagaatcgtgagagccgagagcgagctgagccccagcgagaaggcctacctgaacgccgtggagaagggcgactacgccagcgtgaagaagagcctggaggaggccgagatctacttcaagatcaacatcaactgcatcgaccccctgggcagaaccgccctgctgatcgccatcgagaacgagaacctggagctgatcgagctgctgctgagcttcaacgtgtacgtgggcgacgccctgctgcacgccatcagaaaggaggtggtgggcgccgtggagctgctgctgaaccacaagaagcccagcggcgagaagcaggtgccccccatcctgctggacaagcagttcagcgagttcacccccgacatcacccccatcatcctggccgcccacaccaacaactacgagatcatcaagctgctggtgcagaagggcgtgagcgtgcccagaccccacgaggtgagatgcaactgcgtggagtgcgtgagcagcagcgacgtggacagcctgagacacagcagaagcagactgaacatctacaaggccctggccagccccagcctgatcgccctgagcagcgaggaccccttcctgaccgccttccagctgagctgggagctgcaggagctgagcaaggtggagaacgagttcaagagcgagtacgaggagctgagcagacagtgcaagcagttcgccaaggacctgctggaccagaccagaagcagcagagagctggagatcatcctgaactacagagacgacaacagcctgatcgaggagcagagcggcaacgacctggccagactgaagctggccatcaagtacagacagaaggagttcgtggcccagcccaactgccagcagctgctggccagcagatggtacgacgagttccccggctggagaagaagacactgggccgtgaagatggtgacctgcttcatcatcggcctgctgttccccgtgttcagcgtgtgctacctgatcgcccccaagagccccctgggcctgttcatcagaaagcccttcatcaagttcatctgccacaccgccagctacctgaccttcctgttcctgctgctgctggccagccagcacatcgacagaagcgacctgaacagacagggccccccccccaccatcgtggagtggatgatcctgccctgggtgctgggcttcatctggggcgagatcaagcagatgtgggacggcggcctgcaggactacatccacgactggtggaacctgatggacttcgtgatgaacagcctgtacctggccaccatcagcctgaagatcgtggccttcgtgaagtacagcgccctgaaccccagagagagctgggacatgtggcaccccaccctggtggccgaggccctgttcgccatcgccaacatcttcagcagcctgagactgatcagcctgttcaccgccaacagccacctgggccccctgcagatcagcctgggcagaatgctgctggacatcctgaagttcctgttcatctactgcctggtgctgctggccttcgccaacggcctgaaccagctgtacttctactacgaggagaccaagggcctgacctgcaagggcatcagatgcgagaagcagaacaacgccttcagcaccctgttcgagaccctgcagagcctgttctggagcatcttcggcctgatcaacctgtacgtgaccaacgtgaaggcccagcacgagttcaccgagttcgtgggcgccaccatgttcggcacctacaacgtgatcagcctggtggtgctgctgaacatgctgatcgccatgatgaacaacagctaccagctgatcgccgaccacgccgacatcgagtggaagttcgccagaaccaagctgtggatgagctacttcgaggagggcggcaccctgcccacccccttcaacgtgatccccagccccaagagcctgtggtacctgatcaagtggatctggacccacctgtgcaagaagaagatgagaagaaagcccgagagcttcggcaccatcggcgtgagaacccagcacagaagagccgccgacaacctgagaagacaccaccagtaccaggaggtgatgagaaacctggtgaagagatacgtggccgccatgatcagagacgccaagaccgaggagggcctgaccgaggagaacttcaaggagctgaagcaggacatcagcagcttcagattcgaggtgctgggcctgctgagaggcagcaagctgagcaccatccagagcgccaacgccagcaaggagagcagcaacagcgccgacagcgacgagaagagcgacagcgagggcaacagcaaggacaagaagaagaacttcagcctgttcgacctgaccaccctgatccaccccagaagcgccgccatcgccagcgagagacacaacatcagcaacggcagcgccctggtggtgcaggagccccccagagagaagcagagaaaggtgaacttcgtgaccgacatcaagaacttcggcctgttccacagaagaagcaagcagaacgccgccgagcagaacgccaaccagatcttcagcgtgagcgaggaggtggccagacagcaggccgccggccccctggagagaaacatccagctggagagcagaggcctggccagcagaggcgacctgagcatccccggcctgagcgagcagtgcgtgctggtggaccacagagagagaaacaccgacaccctgggcctgcaggtgggcaagagagtgtgccccttcaagagcgagaaggtggtggtggaggacaccgtgcccatcatccccaaggagaagcacgccaaggaggaggacagcagcatcgactacgacctgaacctgcccgacaccgtgacccacgaggactacgtgaccaccagactgtag

SEQ ID NO: 102995 - DNA, 2934 bp, Artificial Sequence
  Description of Artificial Sequence: Synthetic coding sequence
atggcccagttctactacaagagaaacgtgaacgccccctacagagacagaatccccctgagaatcgtgagagccgagagcgagctgagccccagcgagaaggcctacctgaacgccgtggagaagggcgactacgccagcgtgaagaagagcctggaggaggccgagatctacttcaagatcaacatcaactgcatcgaccccctgggcagaaccgccctgctgatcgccatcgagaacgagaacctggagctgatcgagctgctgctgagcttcaacgtgtacgtgggcgacgccctgctgcacgccatcagaaaggaggtggtgggcgccgtggagctgctgctgaaccacaagaagcccagcggcgagaagcaggtgccccccatcctgctggacaagcagttcagcgagttcacccccgacatcacccccatcatcctggccgcccacaccaacaactacgagatcatcaagctgctggtgcagaagggcgtgagcgtgcccagaccccacgaggtgagatgcaactgcgtggagtgcgtgagcagcagcgacgtggacagcctgagacacagcagaagcagactgaacatctacaaggccctggccagccccagcctgatcgccctgagcagcgaggaccccttcctgaccgccttccagctgagctgggagctgcaggagctgagcaaggtggagaacgagttcaagagcgagtacgaggagctgagcagacagtgcaagcagttcgccaaggacctgctggaccagaccagaagcagcagagagctggagatcatcctgaactacagagacgacaacagcctgatcgaggagcagagcggcaacgacctggccagactgaagctggccatcaagtacagacagaaggagttcgtggcccagcccaactgccagcagctgctggccagcagatggtacgacgagttccccggctggagaagaagacactgggccgtgaagatggtgacctgcttcatcatcggcctgctgttccccgtgttcagcgtgtgctacctgatcgcccccaagagccccctgggcctgttcatcagaaagcccttcatcaagttcatctgccacaccgccagctacctgaccttcctgttcctgctgctgctggccagccagcacatcgacagaagcgacctgaacagacagggccccccccccaccatcgtggagtggatgatcctgccctgggtgctgggcttcatctggggcgagatcaagcagatgtgggacggcggcctgcaggactacatccacgactggtggaacctgatggacttcgtgatgaacagcctgtacctggccaccatcagcctgaagatcgtggccttcgtgaagtacagcgccctgaaccccagagagagctgggacatgtggcaccccaccctggtggccgaggccctgttcgccatcgccaacatcttcagcagcctgagactgatcagcctgttcaccgccaacagccacctgggccccctgcagatcagcctgggcagaatgctgctggacatcctgaagttcctgttcatctactgcctggtgctgctggccttcgccaacggcctgaaccagctgtacttctactacgaggagaccaagggcctgacctgcaagggcatcagatgcgagaagcagaacaacgccttcagcaccctgttcgagaccctgcagagcctgttctggagcatcttcggcctgatcaacctgtacgtgaccaacgtgaaggcccagcacgagttcaccgagttcgtgggcgccaccatgttcggcacctacaacgtgatcagcctggtggtgctgctgaacatgctgatcgccatgatgaacaacagctaccagctgatcgccgaccacgccgacatcgagtggaagttcgccagaaccaagctgtggatgagctacttcgaggagggcggcaccctgcccacccccttcaacgtgatccccagccccaagagcctgtggtacctgatcaagtggatctggacccacctgtgcaagaagaagatgagaagaaagcccgagagcttcggcaccatcggcagaagagccgccgacaacctgagaagacaccaccagtaccaggaggtgatgagaaacctggtgaagagatacgtggccgccatgatcagagacgccaagaccgaggagggcctgaccgaggagaacttcaaggagctgaagcaggacatcagcagcttcagattcgaggtgctgggcctgctgagaggcagcaagctgagcaccatccagagcgccaacgccagcaaggagagcagcaacagcgccgacagcgacgagaagagcgacagcgagggcaacagcaaggacaagaagaagaacttcagcctgttcgacctgaccaccctgatccaccccagaagcgccgccatcgccagcgagagacacaacatcagcaacggcagcgccctggtggtgcaggagccccccagagagaagcagagaaaggtgaacttcgtgaccgacatcaagaacttcggcctgttccacagaagaagcaagcagaacgccgccgagcagaacgccaaccagatcttcagcgtgagcgaggaggtggccagacagcaggccgccggccccctggagagaaacatccagctggagagcagaggcctggccagcagaggcgacctgagcatccccggcctgagcgagcagtgcgtgctggtggaccacagagagagaaacaccgacaccctgggcctgcaggtgggcaagagagtgtgccccttcaagagcgagaaggtggtggtggaggacaccgtgcccatcatccccaaggagaagcacgccaaggaggaggacagcagcatcgactacgacctgaacctgcccgacaccgtgacccacgaggactacgtgaccaccagactgtag

SEQ ID NO: 102996 - DNA, 1383 bp, Artificial Sequence
  Description of Artificial Sequence: Synthetic coding sequence
atggcccagttctactacaagagaaacgtgaacgccccctacagagacagaatccccctgagaatcgtgagagccgagagcgagctgagccccagcgagaaggcctacctgaacgccgtggagaagggcgactacgccagcgtgaagaagagcctggaggaggccgagatctacttcaagatcaacatcaactgcatcgaccccctgggcagaaccgccctgctgatcgccatcgagaacgagaacctggagctgatcgagctgctgctgagcttcaacgtgtacgtgggcgacgccctgctgcacgccatcagaaaggaggtggtgggcgccgtggagctgctgctgaaccacaagaagcccagcggcgagaagcaggtgccccccatcctgctggacaagcagttcagcgagttcacccccgacatcacccccatcatcctggccgcccacaccaacaactacgagatcatcaagctgctggtgcagaagggcgtgagcgtgcccagaccccacgaggtgagatgcaactgcgtggagtgcgtgagcagcagcgacgtggacagcctgagacacagcagaagcagactgaacatctacaaggccctggccagccccagcctgatcgccctgagcagcgaggaccccttcctgaccgccttccagctgagctgggagctgcaggagctgagcaaggtggagaacgagttcaagagcgagtacgaggagctgagcagacagtgcaagcagttcgccaaggacctgctggaccagaccagaagcagcagagagctggagatcatcctgaactacagagacgacaacagcctgatcgaggagcagagcggcaacgacctggccagactgaagctggccatcaagtacagacagaaggagttcgtggcccagcccaactgccagcagctgctggccagcagatggtacgacgagttccccggctggagaagaagacactgggccgtgaagatggtgacctgcttcatcatcggcctgctgttccccgtgttcagcgtgtgctacctgatcgcccccaagagccccctgggcctgttcatcagaaagcccttcatcaagttcatctgccacaccgccagctacctgaccttcctgttcctgctgctgctggccagccagcacatcgacagaagcgacctgaacagacagggccccccccccaccatcgtggagtggatgatcctgccctgggtgctgggcttcatctggggcgagatcaagcagatgtgggacggcggcctgcaggactacatccacgactggtggaacctgatggacttcgtgatgaacagcctgtacctggccaccatcagcctgaagatcgtggccttcgtgaaggtgatctag

SEQ ID NO: 102997 - DNA, 2511 bp, Artificial Sequence; identical to SEQ ID NO: 102990
  Description of Artificial Sequence: Synthetic coding sequence

SEQ ID NO: 102998 - DNA, 2394 bp, Artificial Sequence
  Description of Artificial Sequence: Synthetic coding sequence
atggccgccgcccccgtggccgccggcagcggcgccggcagaggcagaagaagcgccgccaccgtggccgcctggggcggctggggcggcagacccagacccggcaacatcctgctgcagctgagacagggccagctgaccggcagaggcctggtgagagccgtgcagttcaccgagaccttcctgaccgagagagacaagcagagcaagtggagcggcatcccccagctgctgctgaagctgcacaccaccagccacctgcacagcgacttcgtggagtgccagaacatcctgaaggagatcagccccctgctgagcatggaggccatggccttcgtgaccgaggagagaaagctgacccaggagaccacctaccccaacacctacatcttcgacctgttcggcggcgtggacctgctggtggagatcctgatgagacccaccatcagcatcagaggccagaagctgaagatcagcgacgagatgagcaaggactgcctgagcatcctgtacaacacctgcgtgtgcaccgagggcgtgaccaagagactggccgagaagaacgacttcgtgatcttcctgttcaccctgatgaccagcaagaagaccttcctgcagaccgccaccctgatcgaggacatcctgggcgtgaagaaggagatgatcagactggacgaggtgcccaacctgagcagcctggtgagcaacttcgaccagcagcagctggccaacttctgcagaatcctggccgtgaccatcagcgagatggacaccggcaacgacgacaagcacaccctgctggccaagaacgcccagcagaagaagagcctgagcctgggccccagcgccgccgagatcaaccaggccgccctgctgagcatccccggcttcgtggagagactgtgcaagctggccaccagaaaggtgagcgagagcaccggcaccgccagcttcctgcaggagctggaggagtggtacacctggctggacaacgccctggtgctggacgccctgatgagagtggccaacgaggagagcgagcacaaccaggccagcatcgtgttccccccccccggcgccagcgaggagaacggcctgccccacaccagcgccagaacccagctgccccagagcatgaagatcatgcacgagatcatgtacaagctggaggtgctgtacgtgctgtgcgtgctgctgatgggcagacagagaaaccaggtgcacagaatgatcgccgagttcaagctgatccccggcctgaacaacctgttcgacaagctgatctggagaaagcacagcgccagcgccctggtgctgcacggccacaaccagaactgcgactgcagccccgacatcaccctgaagatccagttcctgagactgctgcagagcttcagcgaccaccacgagaacaagtacctgctgctgaacaaccaggagctgaacgagctgagcgccatcagcctgaaggccaacatccccgaggtggaggccgtgctgaacaccgacagaagcctggtgtgcgacggcaagagaggcctgctgaccagactgctgcaggtgatgaagaaggagcccgccgagagcagcttcagattctggcaggccagagccgtggagagcttcctgagaggcaccaccagctacgccgaccagatgttcctgctgaagagaggcctgctggagcacatcctgtactgcatcgtggacagcgagtgcaagagcagagacgtgctgcagagctacttcgacctgctgggcgagctgatgaagttcaacgtggacgccttcaagagattcaacaagtacatcaacaccgacgccaagttccaggtgttcctgaagcagatcaacagcagcctggtggacagcaacatgctggtgagatgcgtgaccctgagcctggacagattcgagaaccaggtggacatgaaggtggccgaggtgctgagcgagtgcagactgctggcctacatcagccaggtgcccacccagatgagcttcctgttcagactgatcaacatcatccacgtgcagaccctgacccaggagaacgtgagctgcctgaacaccagcctggtgatcctgatgctggccagaagaaaggagagactgcccctgtacctgagactgctgcagagaatggagcacagcaagaagtaccccggcttcctgctgaacaacttccacaacctgctgagattctggcagcagcactacctgcacaaggacaaggacagcacctgcctggagaacagcagctgcatcagcttcagctactggaaggagaccgtgagcatcctgctgaaccccgacagacagagccccagcgccctggtgagctacatcgaggagccctacatggacatcgacagagacttcaccgaggagtag

SEQ ID NO: 102999 - DNA, 2277 bp, Artificial Sequence
  Description of Artificial Sequence: Synthetic coding sequence
atggccgccgcccccgtggccgccggcagcggcgccggcagaggcagaagaagcgccgccaccgtggccgcctggggcggctggggcggcagacccagacccggcaacatcctgctgcagctgagacagggccagctgaccggcagaggcctggtgagagccgtgcagttcaccgagaccttcctgaccgagagagacaagcagagcaagtggagcggcatcccccagctgctgctgaagctgcacaccaccagccacctgcacagcgacttcgtggagtgccagaacatcctgaagctgctggtggagatcctgatgagacccaccatcagcatcagaggccagaagctgaagatcagcgacgagatgagcaaggactgcctgagcatcctgtacaacacctgcgtgtgcaccgagggcgtgaccaagagactggccgagaagaacgacttcgtgatcttcctgttcaccctgatgaccagcaagaagaccttcctgcagaccgccaccctgatcgaggacatcctgggcgtgaagaaggagatgatcagactggacgaggtgcccaacctgagcagcctggtgagcaacttcgaccagcagcagctggccaacttctgcagaatcctggccgtgaccatcagcgagatggacaccggcaacgacgacaagcacaccctgctggccaagaacgcccagcagaagaagagcctgagcctgggccccagcgccgccgagatcaaccaggccgccctgctgagcatccccggcttcgtggagagactgtgcaagctggccaccagaaaggtgagcgagagcaccggcaccgccagcttcctgcaggagctggaggagtggtacacctggctggacaacgccctggtgctggacgccctgatgagagtggccaacgaggagagcgagcacaaccaggccagcatcgtgttccccccccccggcgccagcgaggagaacggcctgccccacaccagcgccagaacccagctgccccagagcatgaagatcatgcacgagatcatgtacaagctggaggtgctgtacgtgctgtgcgtgctgctgatgggcagacagagaaaccaggtgcacagaatgatcgccgagttcaagctgatccccggcctgaacaacctgttcgacaagctgatctggagaaagcacagcgccagcgccctggtgctgcacggccacaaccagaactgcgactgcagccccgacatcaccctgaagatccagttcctgagactgctgcagagcttcagcgaccaccacgagaacaagtacctgctgctgaacaaccaggagctgaacgagctgagcgccatcagcctgaaggccaacatccccgaggtggaggccgtgctgaacaccgacagaagcctggtgtgcgacggcaagagaggcctgctgaccagactgctgcaggtgatgaagaaggagcccgccgagagcagcttcagattctggcaggccagagccgtggagagcttcctgagaggcaccaccagctacgccgaccagatgttcctgctgaagagaggcctgctggagcacatcctgtactgcatcgtggacagcgagtgcaagagcagagacgtgctgcagagctacttcgacctgctgggcgagctgatgaagttcaacgtggacgccttcaagagattcaacaagtacatcaacaccgacgccaagttccaggtgttcctgaagcagatcaacagcagcctggtggacagcaacatgctggtgagatgcgtgaccctgagcctggacagattcgagaaccaggtggacatgaaggtggccgaggtgctgagcgagtgcagactgctggcctacatcagccaggtgcccacccagatgagcttcctgttcagactgatcaacatcatccacgtgcagaccctgacccaggagaacgtgagctgcctgaacaccagcctggtgatcctgatgctggccagaagaaaggagagactgcccctgtacctgagactgctgcagagaatggagcacagcaagaagtaccccggcttcctgctgaacaacttccacaacctgctgagattctggcagcagcactacctgcacaaggacaaggacagcacctgcctggagaacagcagctgcatcagcttcagctactggaaggagaccgtgagcatcctgctgaaccccgacagacagagccccagcgccctggtgagctacatcgaggagccctacatggacatcgacagagacttcaccgaggagtag

SEQ ID NO: 103000 - DNA, 2370 bp, Artificial Sequence
  Description of Artificial Sequence: Synthetic coding sequence
atggccgccgcccccgtggccgccggcagcggcgccggcagaggcagaagaagcgccgccaccgtggccgcctggggcggctggggcggcagacccagacccggcaacatcctgctgcagctgagacagggccagctgaccggcagaggcctggtgagagccgtgcagttcaccgagaccttcctgaccgagagagacaagcagagcaagtggagcggcatcccccagctgctgctgaagctgcacaccaccagccacctgcacagcgacttcgtggagtgccagaacatcctgaaggagatcagccccctgctgagcatggaggccatggccttcgtgaccgaggagagaaagctgacccaggagaccacctaccccaacacctacatcttcgacctgttcggcggcgtggacctgctggtggagatcctgatgagacccaccatcagcatcagaggccagaagctgaagatcagcgacgagatgagcaaggactgcctgagcatcctgtacaacacctgcgtgtgcaccgagggcgtgaccaagagactggccgagaagaacgacttcgtgatcttcctgttcaccctgatgaccagcaagaagaccttcctgcagaccgccaccctgatcgaggacatcctgggcgtgaagaaggagatgatcagactggacgaggtgcccaacctgagcagcctggtgagcaacttcgaccagcagcagctggccaacttctgcagaatcctggccgtgaccatcagcgagatggacaccggcaacgacgacaagcacaccctgctggccaagaacgcccagcagaagaagagcctgagcctgggccccagcgccgccgagatcaaccaggccgccctgctgagcatccccggcttcgtggagagactgtgcaagctggccaccagaaaggtgagcgagagcaccggcaccgccagcttcctgcaggagctggaggagtggtacacctggctggacaacgccctggtgctggacgccctgatgagagtggccaacgaggagagcgagcacaaccagggcgccagcgaggagaacggcctgccccacaccagcgccagaacccagctgccccagagcatgaagatcatgcacgagatcatgtacaagctggaggtgctgtacgtgctgtgcgtgctgctgatgggcagacagagaaaccaggtgcacagaatgatcgccgagttcaagctgatccccggcctgaacaacctgttcgacaagctgatctggagaaagcacagcgccagcgccctggtgctgcacggccacaaccagaactgcgactgcagccccgacatcaccctgaagatccagttcctgagactgctgcagagcttcagcgaccaccacgagaacaagtacctgctgctgaacaaccaggagctgaacgagctgagcgccatcagcctgaaggccaacatccccgaggtggaggccgtgctgaacaccgacagaagcctggtgtgcgacggcaagagaggcctgctgaccagactgctgcaggtgatgaagaaggagcccgccgagagcagcttcagattctggcaggccagagccgtggagagcttcctgagaggcaccaccagctacgccgaccagatgttcctgctgaagagaggcctgctggagcacatcctgtactgcatcgtggacagcgagtgcaagagcagagacgtgctgcagagctacttcgacctgctgggcgagctgatgaagttcaacgtggacgccttcaagagattcaacaagtacatcaacaccgacgccaagttccaggtgttcctgaagcagatcaacagcagcctggtggacagcaacatgctggtgagatgcgtgaccctgagcctggacagattcgagaaccaggtggacatgaaggtggccgaggtgctgagcgagtgcagactgctggcctacatcagccaggtgcccacccagatgagcttcctgttcagactgatcaacatcatccacgtgcagaccctgacccaggagaacgtgagctgcctgaacaccagcctggtgatcctgatgctggccagaagaaaggagagactgcccctgtacctgagactgctgcagagaatggagcacagcaagaagtaccccggcttcctgctgaacaacttccacaacctgctgagattctggcagcagcactacctgcacaaggacaaggacagcacctgcctggagaacagcagctgcatcagcttcagctactggaaggagaccgtgagcatcctgctgaaccccgacagacagagccccagcgccctggtgagctacatcgaggagccctacatggacatcgacagagacttcaccgaggagtag

SEQ ID NO: 103001 - DNA, 1200 bp, Artificial Sequence
  Description of Artificial Sequence: Synthetic coding sequence
atgagaagccagagcaccatcaaggtgcacagaatgatcgccgagttcaagctgatccccggcctgaacaacctgttcgacaagctgatctggagaaagcacagcgccagcgccctggtgctgcacggccacaaccagaactgcgactgcagccccgacatcaccctgaagatccagttcctgagactgctgcagagcttcagcgaccaccacgagaacaagtacctgctgctgaacaaccaggagctgaacgagctgagcgccatcagcctgaaggccaacatccccgaggtggaggccgtgctgaacaccgacagaagcctggtgtgcgacggcaagagaggcctgctgaccagactgctgcaggtgatgaagaaggagcccgccgagagcagcttcagattctggcaggccagagccgtggagagcttcctgagaggcaccaccagctacgccgaccagatgttcctgctgaagagaggcctgctggagcacatcctgtactgcatcgtggacagcgagtgcaagagcagagacgtgctgcagagctacttcgacctgctgggcgagctgatgaagttcaacgtggacgccttcaagagattcaacaagtacatcaacaccgacgccaagttccaggtgttcctgaagcagatcaacagcagcctggtggacagcaacatgctggtgagatgcgtgaccctgagcctggacagattcgagaaccaggtggacatgaaggtggccgaggtgctgagcgagtgcagactgctggcctacatcagccaggtgcccacccagatgagcttcctgttcagactgatcaacatcatccacgtgcagaccctgacccaggagaacgtgagctgcctgaacaccagcctggtgatcctgatgctggccagaagaaaggagagactgcccctgtacctgagactgctgcagagaatggagcacagcaagaagtaccccggcttcctgctgaacaacttccacaacctgctgagattctggcagcagcactacctgcacaaggacaaggacagcacctgcctggagaacagcagctgcatcagcttcagctactggaaggagaccgtgagcatcctgctgaaccccgacagacagagccccagcgccctggtgagctacatcgaggagccctacatggacatcgacagagacttcaccgaggagtag

SEQ ID NO: 103002 - DNA, 2349 bp, Artificial Sequence
  Description of Artificial Sequence: Synthetic coding sequence
atggccgccgcccccgtggccgccggcagcggcgccggcagaggcagaagaagcgccgccaccgtggccgcctggggcggctggggccagctgaccggcagaggcctggtgagagccgtgcagttcaccgagaccttcctgaccgagagagacaagcagagcaagtggagcggcatcccccagctgctgctgaagctgcacaccaccagccacctgcacagcgacttcgtggagtgccagaacatcctgaaggagatcagccccctgctgagcatggaggccatggccttcgtgaccgaggagagaaagctgacccaggagaccacctaccccaacacctacatcttcgacctgttcggcggcgtggacctgctggtggagatcctgatgagacccaccatcagcatcagaggccagaagctgaagatcagcgacgagatgagcaaggactgcctgagcatcctgtacaacacctgcgtgtgcaccgagggcgtgaccaagagactggccgagaagaacgacttcgtgatcttcctgttcaccctgatgaccagcaagaagaccttcctgcagaccgccaccctgatcgaggacatcctgggcgtgaagaaggagatgatcagactggacgaggtgcccaacctgagcagcctggtgagcaacttcgaccagcagcagctggccaacttctgcagaatcctggccgtgaccatcagcgagatggacaccggcaacgacgacaagcacaccctgctggccaagaacgcccagcagaagaagagcctgagcctgggccccagcgccgccgagatcaaccaggccgccctgctgagcatccccggcttcgtggagagactgtgcaagctggccaccagaaaggtgagcgagagcaccggcaccgccagcttcctgcaggagctggaggagtggtacacctggctggacaacgccctggtgctggacgccctgatgagagtggccaacgaggagagcgagcacaaccaggccagcatcgtgttccccccccccggcgccagcgaggagaacggcctgccccacaccagcgccagaacccagctgccccagagcatgaagatcatgcacgagatcatgtacaagctggaggtgctgtacgtgctgtgcgtgctgctgatgggcagacagagaaaccaggtgcacagaatgatcgccgagttcaagctgatccccggcctgaacaacctgttcgacaagctgatctggagaaagcacagcgccagcgccctggtgctgcacggccacaaccagaactgcgactgcagccccgacatcaccctgaagatccagttcctgagactgctgcagagcttcagcgaccaccacgagaacaagtacctgctgctgaacaaccaggagctgaacgagctgagcgccatcagcctgaaggccaacatccccgaggtggaggccgtgctgaacaccgacagaagcctggtgtgcgacggcaagagaggcctgctgaccagactgctgcaggtgatgaagaaggagcccgccgagagcagcttcagattctggcaggccagagccgtggagagcttcctgagaggcaccaccagctacgccgaccagatgttcctgctgaagagaggcctgctggagcacatcctgtactgcatcgtggacagcgagtgcaagagcagagacgtgctgcagagctacttcgacctgctgggcgagctgatgaagttcaacgtggacgccttcaagagattcaacaagtacatcaacaccgacgccaagttccaggtgttcctgaagcagatcaacagcagcctggtggacagcaacatgctggtgagatgcgtgaccctgagcctggacagattcgagaaccaggtggacatgaaggtggccgaggtgctgagcgagtgcagactgctggcctacatcagccaggtgcccacccagatgagcttcctgttcagactgatcaacatcatccacgtgcagaccctgacccaggagaacgtgagctgcctgaacaccagcctggtgatcctgatgctggccagaagaaaggagagactgcccctgtacctgagactgctgcagagaatggagcacagcaagaagtaccccggcttcctgctgaacaacttccacaacctgctgagattctggcagcagcactacctgcacaaggacaaggacagcacctgcctggagaacagcagctgcatcagcttcagctactggaaggagaccgtgagcatcctgctgaaccccgacagacagagccccagcgccctggtgagctacatcgaggagccctacatggacatcgacagagacttcaccgaggagtag

SEQ ID NO: 103003 - DNA, 2922 bp, Artificial Sequence
  Description of Artificial Sequence: Synthetic coding sequence
atggcccagctgtactacaagaaggtgaactacagcccctacagagacagaatccccctgcagatcgtgagagccgagaccgagctgagcgccgaggagaaggccttcctgaacgccgtggagaagggcgactacgccaccgtgaagcaggccctgcaggaggccgagatctactacaacgtgaacatcaactgcatggaccccctgggcagaagcgccctgctgatcgccatcgagaacgagaacctggagatcatggagctgctgctgaaccacagcgtgtacgtgggcgacgccctgctgtacgccatcagaaaggaggtggtgggcgccgtggagctgctgctgagctacagaagacccagcggcgagaagcaggtgcccaccctgatgatggacacccagttcagcgagttcacccccgacatcacccccatcatgctggccgcccacaccaacaactacgagatcatcaagctgctggtgcagaagagagtgaccatccccagaccccaccagatcagatgcaactgcgtggagtgcgtgagcagcagcgaggtggacagcctgagacacagcagaagcagactgaacatctacaaggccctggccagccccagcctgatcgccctgagcagcgaggaccccatcctgaccgccttcagactgggctgggagctgaaggagctgagcaaggtggagaacgagttcaaggccgagtacgaggagctgagccagcagtgcaagctgttcgccaaggacctgctggaccaggccagaagcagcagagagctggagatcatcctgaaccacagagacgaccacagcgaggagctggacccccagaagtaccacgacctggccaagctgaaggtggccatcaagtaccaccagaaggagttcgtggcccagcccaactgccagcagctgctggccaccctgtggtacgacggcttccccggctggagaagaaagcactgggtggtgaagctgctgacctgcatgaccatcggcttcctgttccccatgctgagcatcgcctacctgatcagccccagaagcaacctgggcctgttcatcaagaagcccttcatcaagttcatctgccacaccgccagctacctgaccttcctgttcatgctgctgctggccagccagcacatcgtgagaaccgacctgcacgtgcagggccccccccccaccgtggtggagtggatgatcctgccctgggtgctgggcttcatctggggcgagatcaaggagatgtgggacggcggcttcaccgagtacatccacgactggtggaacctgatggacttcgccatgaacagcctgtacctggccaccatcagcctgaagatcgtggcctacgtgaagtacaacggcagcagacccagagaggagtgggagatgtggcaccccaccctgatcgccgaggccctgttcgccatcagcaacatcctgagcagcctgagactgatcagcctgttcaccgccaacagccacctgggccccctgcagatcagcctgggcagaatgctgctggacatcctgaagttcctgttcatctactgcctggtgctgctggccttcgccaacggcctgaaccagctgtacttctactacgagaccagagccatcgacgagcccaacaactgcaagggcatcagatgcgagaagcagaacaacgccttcagcaccctgttcgagaccctgcagagcctgttctggagcgtgttcggcctgctgaacctgtacgtgaccaacgtgaaggccagacacgagttcaccgagttcgtgggcgccaccatgttcggcacctacaacgtgatcagcctggtggtgctgctgaacatgctgatcgccatgatgaacaacagctaccagctgatcgccgaccacgccgacatcgagtggaagttcgccagaaccaagctgtggatgagctacttcgacgagggcggcaccctgcccccccccttcaacatcatccccagccccaagagcttcctgtacctgggcaactggttcaacaacaccttctgccccaagagagaccccgacggcagaagaagaagaagaaacctgagaagcttcaccgagagaaacgccgacagcctgatccagaaccagcactaccaggaggtgatcagaaacctggtgaagagatacgtggccgccatgatcagaaacagcaagacccacgagggcctgaccgaggagaacttcaaggagctgaagcaggacatcagcagcttcagatacgaggtgctggacctgctgggcaacagaaagcaccccagaagcttcagcaccagcagcaccgagctgagccagagagacgacaacaacgacggcagcggcggcgccagagccaagagcaagagcgtgagcttcaacctgggctgcaagaagaagacctgccacggcccccccctgatcagaaccatgcccagaagcagcggcgcccagggcaagagcaaggccgagagcagcagcaagagaagcttcatgggccccagcctgaagaagctgggcctgctgttcagcaagttcaacggccacatgagcgagcccagcagcgagcccatgtacaccatcagcgacggcatcgtgcagcagcactgcatgtggcaggacatcagatacagccagatggagaagggcaaggccgaggcctgcagccagagcgagatcaacctgagcgaggtggagctgggcgaggtgcagggcgccgcccagagcagcgagtgccccctggcctgcagcagcagcctgcactgcgccagcagcatctgcagcagcaacagcaagctgctggacagcagcgaggacgtgttcgagacctggggcgaggcctgcgacctgctgatgcacaagtggggcgacggccaggaggagcaggtgaccaccagactgtag

SEQ ID NO: 103004 - DNA, 2796 bp, Artificial Sequence
  Description of Artificial Sequence: Synthetic coding sequence
atgagccagagccccgccttcggccccagaagaggcagcagccccagaggcgccgccggcgccgccgccagaagaaacgagagccaggactacctgctgatggacagcgagctgggcgaggacggctgcccccaggcccccctgccctgctacggctactacccctgcttcagaggcagcgacaacagactggcccacagaagacagaccgtgctgagagagaagggcagaagactggccaacagaggccccgcctacatgttcagcgacagaagcaccagcctgagcatcgaggaggagagattcctggacgccgccgagtacggcaacatccccgtggtgagaaagatgctggaggagtgccacagcctgaacgtgaactgcgtggactacatgggccagaacgccctgcagctggccgtggccaacgagcacctggagatcaccgagctgctgctgaagaaggagaacctgagcagagtgggcgacgccctgctgctggccatcagcaagggctacgtgagaatcgtggaggccatcctgagccaccccgccttcgccgagggcaagagactggccaccagccccagccagagcgagctgcagcaggacgacttctacgcctacgacgaggacggcaccagattcagccacgacgtgacccccatcatcctggccgcccactgccaggagtacgagatcgtgcacaccctgctgagaaagggcgccagaatcgagagaccccacgactacttctgcaagtgcaacgactgcaaccagaagcagaagcacgacagcttcagccacagcagaagcagaatcaacgcctacaagggcctggccagccccgcctacctgagcctgagcagcgaggaccccgtgatgaccgccctggagctgagcaacgagctggccgtgctggccaacatcgagaaggagttcaagaacgactacaagaagctgagcatgcagtgcaaggacttcgtggtgggcctgctggacctgtgcagaaacaccgaggaggtggaggccatcctgaacggcgacgtggagaccctgcagagcggcgaccacggcagacccaacctgagcagactgaagctggccatcaagtacgaggtgaagaagttcgtggcccaccccaactgccagcagcagctgctgagcatctggtacgagaacctgagcggcctgagacagcagaccatggccgtgaagttcctggtggtgctggccgtggccatcggcctgcccttcctggccctgatctactggttcgccccctgcagcaagatgggcaagatcatgagaggccccttcatgaagttcgtggcccacgccgccagcttcaccatcttcctgggcctgctggtgatgaacgccgccgacagattcgagggcaccaagctgctgcccaacgagaccagcaccgacaacgccaagcagctgttcagaatgaagaccagctgcttcagctggatggagatgctgatcatcagctgggtgatcggcatgatctgggccgagtgcaaggagatctggacccagggccccaaggagtacctgttcgagctgtggaacatgctggacttcggcatgctggccatcttcgccgccagcttcatcgccagattcatggccttctggcacgccagcaaggcccagagcatcatcgacgccaacgacaccctgaaggacctgaccaaggtgaccctgggcgacaacgtgaagtactacaacctggccagaatcaagtgggaccccagcgacccccagatcatcagcgagggcctgtacgccatcgccgtggtgctgagcttcagcagaatcgcctacatcctgcccgccaacgagagcttcggccccctgcagatcagcctgggcagaaccgtgaaggacatcttcaagttcatggtgatcttcatcatggtgttcgtggccttcatgatcggcatgttcaacctgtacagctactacatcggcgccaagcagaacgaggccttcaccaccgtggaggagagcttcaagaccctgttctgggccatcttcggcctgagcgaggtgaagagcgtggtgatcaactacaaccacaagttcatcgagaacatcggctacgtgctgtacggcgtgtacaacgtgaccatggtgatcgtgctgctgaacatgctgatcgccatgatcaacagcagcttccaggagatcgaggacgacgccgacgtggagtggaagttcgccagagccaagctgtggttcagctacttcgaggagggcagaaccctgcccgtgcccttcaacctggtgcccagccccaagagcctgttctacctgctgctgaagctgaagaagtggatcagcgagctgttccagggccacaagaagggcttccaggaggacgccgagatgaacaagatcaacgaggagaagaagctgggcatcctgggcagccacgaggacctgagcaagctgagcctggacaagaagcaggtgggccacaacaagcagcccagcatcagaagcagcgaggacttccacctgaacagcttcaacaacccccccagacagtaccagaagatcatgaagagactgatcaagagatacgtgctgcaggcccagatcgacaaggagagcgacgaggtgaacgagggcgagctgaaggagatcaagcaggacatcagcagcctgagatacgagctgctggaggagaagagccagaacaccgaggacctggccgagctgatcagagagctgggcgagaagctgagcatggagcccaaccaggaggagaccaacagatag

SEQ ID NO: 103005 - DNA, 2448 bp, Artificial Sequence
  Description of Artificial Sequence: Synthetic coding sequence
atgagccagagccccgccttcggccccagaagaggcagcagccccagaggcgccgccggcgccgccgccagaagaaacgagagccaggactacctgctgatggacagcgagctgggcgaggacggctgcccccaggcccccctgccctgctacggctactacccctgcttcagaggcagcgacaacagactggcccacagaagacagaccgtgctgagagagaagggcagaagactggccaacagaggccccgcctacatgttcagcgacagaagcaccagcctgagcatcgaggaggagagattcctggacgccgccgagtacggcaacatccccgtggtgagaaagatgctggaggagtgccacagcctgaacgtgaactgcgtggactacatgggccagaacgccctgcagctggccgtggccaacgagcacctggagatcaccgagctgctgctgaagaaggagaacctgagcagagtgggcgacgccctgctgctggccatcagcaagggctacgtgagaatcgtggaggccatcctgagccaccccgccttcgccgagggcaagagactggccaccagccccagccagagcgagctgcagcaggacgacttctacgcctacgacgaggacggcaccagattcagccacgacgtgacccccatcatcctggccgcccactgccaggagtacgagatcgtgcacaccctgctgagaaagggcgccagaatcgagagaccccacgactacttctgcaagtgcaacgactgcaaccagaagcagaagcacgacagcttcagccacagcagaagcagaatcaacgcctacaagggcctggccagccccgcctacctgagcctgagcagcgaggaccccgtgatgaccgccctggagctgagcaacgagctggccgtgctggccaacatcgagaaggagttcaagatgggcaagatcatgagaggccccttcatgaagttcgtggcccacgccgccagcttcaccatcttcctgggcctgctggtgatgaacgccgccgacagattcgagggcaccaagctgctgcccaacgagaccagcaccgacaacgccaagcagctgttcagaatgaagaccagctgcttcagctggatggagatgctgatcatcagctgggtgatcggcatgatctgggccgagtgcaaggagatctggacccagggccccaaggagtacctgttcgagctgtggaacatgctggacttcggcatgctggccatcttcgccgccagcttcatcgccagattcatggccttctggcacgccagcaaggcccagagcatcatcgacgccaacgacaccctgaaggacctgaccaaggtgaccctgggcgacaacgtgaagtactacaacctggccagaatcaagtgggaccccagcgacccccagatcatcagcgagggcctgtacgccatcgccgtggtgctgagcttcagcagaatcgcctacatcctgcccgccaacgagagcttcggccccctgcagatcagcctgggcagaaccgtgaaggacatcttcaagttcatggtgatcttcatcatggtgttcgtggccttcatgatcggcatgttcaacctgtacagctactacatcggcgccaagcagaacgaggccttcaccaccgtggaggagagcttcaagaccctgttctgggccatcttcggcctgagcgaggtgaagagcgtggtgatcaactacaaccacaagttcatcgagaacatcggctacgtgctgtacggcgtgtacaacgtgaccatggtgatcgtgctgctgaacatgctgatcgccatgatcaacagcagcttccaggagatcgaggacgacgccgacgtggagtggaagttcgccagagccaagctgtggttcagctacttcgaggagggcagaaccctgcccgtgcccttcaacctggtgcccagccccaagagcctgttctacctgctgctgaagctgaagaagtggatcagcgagctgttccagggccacaagaagggcttccaggaggacgccgagatgaacaagatcaacgaggagaagaagctgggcatcctgggcagccacgaggacctgagcaagctgagcctggacaagaagcaggtgggccacaacaagcagcccagcatcagaagcagcgaggacttccacctgaacagcttcaacaacccccccagacagtaccagaagatcatgaagagactgatcaagagatacgtgctgcaggcccagatcgacaaggagagcgacgaggtgaacgagggcgagctgaaggagatcaagcaggacatcagcagcctgagatacgagctgctggaggagaagagccagaacaccgaggacctggccgagctgatcagagagctgggcgagaagctgagcatggagcccaaccaggaggagaccaacagatag

SEQ ID NO: 103006 - DNA, 2631 bp, Artificial Sequence
  Description of Artificial Sequence: Synthetic coding sequence
atgagccagagccccgccttcggccccagaagaggcagcagccccagaggcgccgccggcgccgccgccagaagaaacgagagccaggactacctgctgatggacagcgagctgggcgaggacggctgcccccaggcccccctgccctgctacggctactacccctgcttcagaggcagcgacaacagactggcccacagaagacagaccgtgctgagagagaagggcagaagactggccaacagaggccccgcctacatgttcagcgacagaagcaccagcctgagcatcgaggaggagagattcctggacgccgccgagtacggcaacatccccgtggtgagaaagatgctggaggagtgccacagcctgaacgtgaactgcgtggactacatgggccagaacgccctgcagctggccgtggccaacgagcacctggagatcaccgagctgctgctgaagaaggagaacctgagcagagtgggcgacgccctgctgctggccatcagcaagggctacgtgagaatcgtggaggccatcctgagccaccccgccttcgccgagggcaagagactggccaccagccccagccagagcgagctgcagcaggacgacttctacgcctacgacgaggacggcaccagattcagccacgacgtgacccccatcatcctggccgcccactgccaggagtacgagatcgtgcacaccctgctgagaaagggcgccagaatcgagagaccccacgactacttctgcaagtgcaacgactgcaaccagaagcagaagcacgacagcttcagccacagcagaagcagaatcaacgcctacaagggcctggccagccccgcctacctgagcctgagcagcgaggaccccgtgatgaccgccctggagctgagcaacgagctggccgtgctggccaacatcgagaaggagttcaagaacgactacaagaagctgagcatgcagtgcaaggacttcgtggtgggcctgctggacctgtgcagaaacaccgaggaggtggaggccatcctgaacggcgacgtggagaccctgcagagcggcgaccacggcagacccaacctgagcagactgaagctggccatcaagtacgaggtgaagaagatgggcaagatcatgagaggccccttcatgaagttcgtggcccacgccgccagcttcaccatcttcctgggcctgctggtgatgaacgccgccgacagattcgagggcaccaagctgctgcccaacgagaccagcaccgacaacgccaagcagctgttcagaatgaagaccagctgcttcagctggatggagatgctgatcatcagctgggtgatcggcatgatctgggccgagtgcaaggagatctggacccagggccccaaggagtacctgttcgagctgtggaacatgctggacttcggcatgctggccatcttcgccgccagcttcatcgccagattcatggccttctggcacgccagcaaggcccagagcatcatcgacgccaacgacaccctgaaggacctgaccaaggtgaccctgggcgacaacgtgaagtactacaacctggccagaatcaagtgggaccccagcgacccccagatcatcagcgagggcctgtacgccatcgccgtggtgctgagcttcagcagaatcgcctacatcctgcccgccaacgagagcttcggccccctgcagatcagcctgggcagaaccgtgaaggacatcttcaagttcatggtgatcttcatcatggtgttcgtggccttcatgatcggcatgttcaacctgtacagctactacatcggcgccaagcagaacgaggccttcaccaccgtggaggagagcttcaagaccctgttctgggccatcttcggcctgagcgaggtgaagagcgtggtgatcaactacaaccacaagttcatcgagaacatcggctacgtgctgtacggcgtgtacaacgtgaccatggtgatcgtgctgctgaacatgctgatcgccatgatcaacagcagcttccaggagatcgaggacgacgccgacgtggagtggaagttcgccagagccaagctgtggttcagctacttcgaggagggcagaaccctgcccgtgcccttcaacctggtgcccagccccaagagcctgttctacctgctgctgaagctgaagaagtggatcagcgagctgttccagggccacaagaagggcttccaggaggacgccgagatgaacaagatcaacgaggagaagaagctgggcatcctgggcagccacgaggacctgagcaagctgagcctggacaagaagcaggtgggccacaacaagcagcccagcatcagaagcagcgaggacttccacctgaacagcttcaacaacccccccagacagtaccagaagatcatgaagagactgatcaagagatacgtgctgcaggcccagatcgacaaggagagcgacgaggtgaacgagggcgagctgaaggagatcaagcaggacatcagcagcctgagatacgagctgctggaggagaagagccagaacaccgaggacctggccgagctgatcagagagctgggcgagaagctgagcatggagcccaaccaggaggagaccaacagatag

SEQ ID NO: 103007 - DNA, 2406 bp, Artificial Sequence
  Description of Artificial Sequence: Synthetic coding sequence
atgctgagaaacagcaccttcaagaacatgcagagaagacacaccaccctgagagagaagggcagaagacaggccatcagaggccccgcctacatgttcaacgagaagggcaccagcctgacccccgaggaggagagattcctggacagcgccgagtacggcaacatccccgtggtgagaaagatgctggaggagagcaagaccctgaacttcaactgcgtggactacatgggccagaacgccctgcagctggccgtgggcaacgagcacctggaggtgaccgagctgctgctgaagaaggagaacctggccagagtgggcgacgccctgctgctggccatcagcaagggctacgtgagaatcgtggaggccatcctgaaccaccccgccttcgcccagggccagagactgaccctgagccccctggagcaggagctgagagacgacgacttctacgcctacgacgaggacggcaccagattcagccacgacatcacccccatcatcctggccgcccactgccaggagtacgagatcgtgcacatcctgctgctgaagggcgccagaatcgagagaccccacgactacttctgcaagtgcaacgagtgcaccgagaagcagagaaaggacagcttcagccacagcagaagcagaatgaacgcctacaagggcctggccagcgccgcctacctgagcctgagcagcgaggaccccgtgctgaccgccctggagctgagcaacgagctggccagactggccaacatcgagaccgagttcaagttcgtggcccaccccaactgccagcagcagctgctgaccatgtggtacgagaacctgagcggcctgagacagcagagcatcgccgtgaagttcctggccgtgttcggcgtgagcatcggcctgcccttcctggccatcgcctactggatcgccccctgcagcaagctgggcagaaccctgagaagccccttcatgaagttcgtggcccacgccgtgagcttcaccatcttcctgggcctgctggtggtgaacgccagcgacagattcgagggcgtgaagaccctgcccaacgagaccttcaccgactaccccaagcagatcttcagagtgaagaccacccagttcagctggaccgagatgctgatcatgaagtgggtgctgggcatgatctggagcgagtgcaaggagatctgggaggagggccccagagagtacgtgctgcacctgtggaacctgctggacttcggcatgctgagcatcttcgtggccagcttcaccgccagattcatggccttcctgaaggccaccgaggcccagctgtacgtggaccagcacgtgcaggacgacaccctgcacaacgtgagcctgccccccgaggtggcctacttcacctacgccagagacaagtggtggcccagcgacccccagatcatcagcgagggcctgtacgccatcgccgtggtgctgagcttcagcagaatcgcctacatcctgcccgccaacgagagcttcggccccctgcagatcagcctgggcagaaccgtgaaggacatcttcaagttcatggtgatcttcatcatggtgttcgtggccttcatgatcggcatgttcaacctgtacagctactacagaggcgccaagtacaaccccgccttcaccaccgtggaggagagcttcaagaccctgttctggagcatcttcggcctgagcgaggtgatcagcgtggtgctgaagtacgaccacaagttcatcgagaacatcggctacgtgctgtacggcgtgtacaacgtgaccatggtggtggtgctgctgaacatgctgatcgccatgatcaacaacagctaccaggagatcgaggaggacgccgacgtggagtggaagttcgccagagccaagctgtggctgagctacttcgacgagggcagaaccctgcccgcccccttcaacctggtgcccagccccaagagcttctactacctgatcatgagaatcaagatgtgcctgatcaagctgtgcaagagcaaggccaagagctgcgagaacgacctggagatgggcatgctgaacagcaagttcaagaagaccagataccaggccggcatgagaaacagcgagaacctgaccgccaacaacaccctgagcaagcccaccagataccagaagatcatgaagagactgatcaagagatacgtgctgaaggcccaggtggacagagagaacgacgaggtgaacgagggcgagctgaaggagatcaagcaggacatcagcagcctgagatacgagctgctggaggagaagagccaggccaccggcgagctggccgacctgatccagcagctgagcgagaagttcggcaagaacctgaacaaggaccacctgagagtgaacaagggcaaggacatctag

SEQ ID NO: 103008 - DNA, 2241 bp, Artificial Sequence
  Description of Artificial Sequence: Synthetic coding sequence
atgctgagaaacagcaccttcaagaacatgcagagaagacacaccaccctgagagagaagggcagaagacaggccatcagaggccccgcctacatgttcaacgagaagggcaccagcctgacccccgaggaggagagattcctggacagcgccgagtacggcaacatccccgtggtgagaaagatgctggaggagagcaagaccctgaacttcaactgcgtggactacatgggccagaacgccctgcagctggccgtgggcaacgagcacctggaggtgaccgagctgctgctgaagaaggagaacctggccagagtgggcgacgccctgctgctggccatcagcaagggctacgtgagaatcgtggaggccatcctgaaccaccccgccttcgcccagggccagagactgaccctgagccccctggagcaggagctgagagacgacgacttctacgcctacgacgaggacggcaccagattcagccacgacatcacccccatcatcctggccgcccactgccaggagtacgagatcgtgcacatcctgctgctgaagggcgccagaatcgagagaccccacgactacttctgcaagtgcaacgagtgcaccgagaagcagagaaaggacagcttcagccacagcagaagcagaatgaacgcctacaagggcctggccagcgccgcctacctgagcctgagcagcgaggaccccgtgctgaccgccctggagctgagcaacgagctggccagactggccaacatcgagaccgagttcaagctgggcagaaccctgagaagccccttcatgaagttcgtggcccacgccgtgagcttcaccatcttcctgggcctgctggtggtgaacgccagcgacagattcgagggcgtgaagaccctgcccaacgagaccttcaccgactaccccaagcagatcttcagagtgaagaccacccagttcagctggaccgagatgctgatcatgaagtgggtgctgggcatgatctggagcgagtgcaaggagatctgggaggagggccccagagagtacgtgctgcacctgtggaacctgctggacttcggcatgctgagcatcttcgtggccagcttcaccgccagattcatggccttcctgaaggccaccgaggcccagctgtacgtggaccagcacgtgcaggacgacaccctgcacaacgtgagcctgccccccgaggtggcctacttcacctacgccagagacaagtggtggcccagcgacccccagatcatcagcgagggcctgtacgccatcgccgtggtgctgagcttcagcagaatcgcctacatcctgcccgccaacgagagcttcggccccctgcagatcagcctgggcagaaccgtgaaggacatcttcaagttcatggtgatcttcatcatggtgttcgtggccttcatgatcggcatgttcaacctgtacagctactacagaggcgccaagtacaaccccgccttcaccaccgtggaggagagcttcaagaccctgttctggagcatcttcggcctgagcgaggtgatcagcgtggtgctgaagtacgaccacaagttcatcgagaacatcggctacgtgctgtacggcgtgtacaacgtgaccatggtggtggtgctgctgaacatgctgatcgccatgatcaacaacagctaccaggagatcgaggaggacgccgacgtggagtggaagttcgccagagccaagctgtggctgagctacttcgacgagggcagaaccctgcccgcccccttcaacctggtgcccagccccaagagcttctactacctgatcatgagaatcaagatgtgcctgatcaagctgtgcaagagcaaggccaagagctgcgagaacgacctggagatgggcatgctgaacagcaagttcaagaagaccagataccaggccggcatgagaaacagcgagaacctgaccgccaacaacaccctgagcaagcccaccagataccagaagatcatgaagagactgatcaagagatacgtgctgaaggcccaggtggacagagagaacgacgaggtgaacgagggcgagctgaaggagatcaagcaggacatcagcagcctgagatacgagctgctggaggagaagagccaggccaccggcgagctggccgacctgatccagcagctgagcgagaagttcggcaagaacctgaacaaggaccacctgagagtgaacaagggcaaggacatctag

SEQ ID NO: 103009 - DNA, 2589 bp, Artificial Sequence
  Description of Artificial Sequence: Synthetic coding sequence
atgctgagaaacagcaccttcaagaacatgcagagaagacacaccaccctgagagagaagggcagaagacaggccatcagaggccccgcctacatgttcaacgagaagggcaccagcctgacccccgaggaggagagattcctggacagcgccgagtacggcaacatccccgtggtgagaaagatgctggaggagagcaagaccctgaacttcaactgcgtggactacatgggccagaacgccctgcagctggccgtgggcaacgagcacctggaggtgaccgagctgctgctgaagaaggagaacctggccagagtgggcgacgccctgctgctggccatcagcaagggctacgtgagaatcgtggaggccatcctgaaccaccccgccttcgcccagggccagagactgaccctgagccccctggagcaggagctgagagacgacgacttctacgcctacgacgaggacggcaccagattcagccacgacatcacccccatcatcctggccgcccactgccaggagtacgagatcgtgcacatcctgctgctgaagggcgccagaatcgagagaccccacgactacttctgcaagtgcaacgagtgcaccgagaagcagagaaaggacagcttcagccacagcagaagcagaatgaacgcctacaagggcctggccagcgccgcctacctgagcctgagcagcgaggaccccgtgctgaccgccctggagctgagcaacgagctggccagactggccaacatcgagaccgagttcaagaacgactacagaaagctgagcatgcagtgcaaggacttcgtggtgggcgtgctggacctgtgcagagacaccgaggaggtggaggccatcctgaacggcgacgtgaacttccaggtgtggagcgaccaccacagacccagcctgagcagaatcaagctggccatcaagtacgaggtgaagaagttcgtggcccaccccaactgccagcagcagctgctgaccatgtggtacgagaacctgagcggcctgagacagcagagcatcgccgtgaagttcctggccgtgttcggcgtgagcatcggcctgcccttcctggccatcgcctactggatcgccccctgcagcaagctgggcagaaccctgagaagccccttcatgaagttcgtggcccacgccgtgagcttcaccatcttcctgggcctgctggtggtgaacgccagcgacagattcgagggcgtgaagaccctgcccaacgagaccttcaccgactaccccaagcagatcttcagagtgaagaccacccagttcagctggaccgagatgctgatcatgaagtgggtgctgggcatgatctggagcgagtgcaaggagatctgggaggagggccccagagagtacgtgctgcacctgtggaacctgctggacttcggcatgctgagcatcttcgtggccagcttcaccgccagattcatggccttcctgaaggccaccgaggcccagctgtacgtggaccagcacgtgcaggacgacaccctgcacaacgtgagcctgccccccgaggtggcctacttcacctacgccagagacaagtggtggcccagcgacccccagatcatcagcgagggcctgtacgccatcgccgtggtgctgagcttcagcagaatcgcctacatcctgcccgccaacgagagcttcggccccctgcagatcagcctgggcagaaccgtgaaggacatcttcaagttcatggtgatcttcatcatggtgttcgtggccttcatgatcggcatgttcaacctgtacagctactacagaggcgccaagtacaaccccgccttcaccaccgtggaggagagcttcaagaccctgttctggagcatcttcggcctgagcgaggtgatcagcgtggtgctgaagtacgaccacaagttcatcgagaacatcggctacgtgctgtacggcgtgtacaacgtgaccatggtggtggtgctgctgaacatgctgatcgccatgatcaacaacagctaccaggagatcgaggaggacgccgacgtggagtggaagttcgccagagccaagctgtggctgagctacttcgacgagggcagaaccctgcccgcccccttcaacctggtgcccagccccaagagcttctactacctgatcatgagaatcaagatgtgcctgatcaagctgtgcaagagcaaggccaagagctgcgagaacgacctggagatgggcatgctgaacagcaagttcaagaagaccagataccaggccggcatgagaaacagcgagaacctgaccgccaacaacaccctgagcaagcccaccagataccagaagatcatgaagagactgatcaagagatacgtgctgaaggcccaggtggacagagagaacgacgaggtgaacgagggcgagctgaaggagatcaagcaggacatcagcagcctgagatacgagctgctggaggagaagagccaggccaccggcgagctggccgacctgatccagcagctgagcgagaagttcggcaagaacctgaacaaggaccacctgagagtgaacaagggcaaggacatctag

SEQ ID NO: 103010 - DNA, 4350 bp, Artificial Sequence
  Description of Artificial Sequence: Synthetic coding sequence
atggagcccagcgccctgagaaaggccggcagcgagcaggaggagggcttcgagggcctgcccagaagagtgaccgacctgggcatggtgagcaacctgagaagaagcaacagcagcctgttcaagagctggagactgcagtgccccttcggcaacaacgacaagcaggagagcctgagcagctggatccccgagaacatcaagaagaaggagtgcgtgtacttcgtggagagcagcaagctgagcgacgccggcaaggtggtgtgccagtgcggctacacccacgagcagcacctggaggaggccaccaagccccacaccttccagggcacccagtgggaccccaagaagcacgtgcaggagatgcccaccgacgccttcggcgacatcgtgttcaccggcctgagccagaaggtgaagaagtacgtgagagtgagccaggacacccccagcagcgtgatctaccacctgatgacccagcactggggcctggacgtgcccaacctgctgatcagcgtgaccggcggcgccaagaacttcaacatgaagcccagactgaagagcatcttcagaagaggcctggtgaaggtggcccagaccaccggcgcctggatcatcaccggcggcagccacaccggcgtgatgaagcaggtgggcgaggccgtgagagacttcagcctgagcagcagctacaaggagggcgagctgatcaccatcggcgtggccacctggggcaccgtgcacagaagagagggcctgatccaccccaccggcagcttccccgccgagtacatcctggacgaggacggccagggcaacctgacctgcctggacagcaaccacagccacttcatcctggtggacgacggcacccacggccagtacggcgtggagatccccctgagaaccagactggagaagttcatcagcgagcagaccaaggagagaggcggcgtggccatcaagatccccatcgtgtgcgtggtgctggagggcggccccggcaccctgcacaccatcgacaacgccaccaccaacggcaccccctgcgtggtggtggagggcagcggcagagtggccgacgtgatcgcccaggtggccaacctgcccgtgagcgacatcaccatcagcctgatccagcagaagctgagcgtgttcttccaggagatgttcgagaccttcaccgagagcagaatcgtggagtggaccaagaagatccaggacatcgtgagaagaagacagctgctgaccgtgttcagagagggcaaggacggccagcaggacgtggacgtggccatcctgcaggccctgctgaaggccagcagaagccaggaccacttcggccacgagaactgggaccaccagctgaagctggccgtggcctggaacagagtggacatcgccagaagcgagatcttcatggacgagtggcagtggaagcccagcgacctgcaccccaccatgaccgccgccctgatcagcaacaagcccgagttcgtgaagctgttcctggagaacggcgtgcagctgaaggagttcgtgacctgggacaccctgctgtacctgtacgagaacctggaccccagctgcctgttccacagcaagctgcagatgcaccacgtggcccaggtgctgagagagctgctgggcgacttcacccagcccctgtaccccagacccagacacaacgacagactgagactgctgctgcccgtgccccacgtgaagctgaacgtgcagggcgtgagcctgagaagcctgtacaagagaagcagcggccacgtgaccttcaccatggaccccatcagagacctgctgatctgggccatcgtgcagaacagaagagagctggccggcatcatctgggcccagagccaggactgcatcgccgccgccctggcctgcagcaagatcctgaaggagctgagcaaggaggaggaggacaccgacagcagcgaggagatgctggccctggccgaggagtacgagcacagagccatcggcgtgttcaccgagtgctacagaaaggacgaggagagagcccagaagctgctgaccagagtgagcgaggcctggggcaagaccacctgcctgcagctggccctggaggccaaggacatgaagttcgtgagccacggcggcatccaggccttcctgaccaaggtgtggtggggccagctgagcgtggacaacggcctgtggagagtgaccctgtgcatgctggccttccccctgctgctgaccggcctgatcagcttcagagagaagagactgcaggacgtgggcacccccgccgccagagccagagccttcttcaccgcccccgtggtggtgttccacctgaacatcctgagctacttcgccttcctgtgcctgttcgcctacgtgctgatggtggacttccagcccgtgcccagctggtgcgagtgcgccatctacctgtggctgttcagcctggtgtgcgaggagatgagacagctgttctacgaccccgacgagtgcggcctgatgaagaaggccgccctgtacttcagcgacttctggaacaagctggacgtgggcgccatcctgctgttcgtggccggcctgacctgcagactgatccccgccaccctgtaccccggcagagtgatcctgagcctggacttcatcctgttctgcctgagactgatgcacatcttcaccatcagcaagaccctgggccccaagatcatcatcgtgaagagaatgatgaaggacgtgttcttcttcctgttcctgctggccgtgtgggtggtgagcttcggcgtggccaagcaggccatcctgatccacaacgagagaagagtggactggctgttcagaggcgccgtgtaccacagctacctgaccatcttcggccagatccccggctacatcgacggcgtgaacttcaaccccgagcactgcagccccaacggcaccgacccctacaagcccaagtgccccgagagcgacgccacccagcagagacccgccttccccgagtggctgaccgtgctgctgctgtgcctgtacctgctgttcaccaacatcctgctgctgaacctgctgatcgccatgttcaactacaccttccagcaggtgcaggagcacaccgaccagatctggaagttccagagacacgacctgatcgaggagtaccacggcagacccgccgcccccccccccttcatcctgctgagccacctgcagctgttcatcaagagagtggtgctgaagacccccgccaagagacacaagcagctgaagaacaagctggagaagaacgaggaggccgccctgctgagctgggagatctacctgaaggagaactacctgcagaacagacagttccagcagaagcagagacccgagcagaagatcgaggacatcagcaacaaggtggacgccatggtggacctgctggacctggaccccctgaagagaagcggcagcatggagcagagactggccagcctggaggagcaggtggcccagaccgcccaggccctgcactggatcgtgagaaccctgagagccagcggcttcagcagcgaggccgacgtgcccaccctggccagccagaaggccgccgaggagcccgacgccgagcccggcggcagaaagaagaccgaggagcccggcgacagctaccacgtgaacgccagacacctgctgtaccccaactgccccgtgaccagattccccgtgcccaacgagaaggtgccctgggagaccgagttcctgatctacgacccccccttctacaccgccgagagaaaggacgccgccgccatggaccccatgggcgagaaccccatgggcagaaccggcctgagaggcagaggcagcctgagctgcttcggccccaaccacaccctgtaccccatggtgaccagatggagaagaaacgaggacggcgccatctgcagaaagagcatcaagaagatgctggaggtgctggtggtgaagctgcccctgagcgagcactgggccctgcccggcggcagcagagagcccggcgagatgctgcccagaaagctgaagagaatcctgagacaggagcactggcccagcttcgagaacctgctgaagtgcggcatggaggtgtacaagggctacatggacgaccccagaaacaccgacaacgcctggatcgagaccgtggccgtgagcgtgcacttccaggaccagaacgacgtggagctgaacagactgaacagcaacctgcacgcctgcgacagcggcgccagcatcagatggcaggtggtggacagaagaatccccctgtacgccaaccacaagaccctgctgcagaaggccgccgccgagttcggcgcccactactag

SEQ ID NO: 103011 - DNA, 4512 bp, Artificial Sequence
  Description of Artificial Sequence: Synthetic coding sequence
atggagcccagcgccctgagaaaggccggcagcgagcaggaggagggcttcgagggcctgcccagaagagtgaccgacctgggcatggtgagcaacctgagaagaagcaacagcagcctgttcaagagctggagactgcagtgccccttcggcaacaacgacaagcaggagagcctgagcagctggatccccgagaacatcaagaagaaggagtgcgtgtacttcgtggagagcagcaagctgagcgacgccggcaaggtggtgtgccagtgcggctacacccacgagcagcacctggaggaggccaccaagccccacaccttccagggcacccagtgggaccccaagaagcacgtgcaggagatgcccaccgacgccttcggcgacatcgtgttcaccggcctgagccagaaggtgaagaagtacgtgagagtgagccaggacacccccagcagcgtgatctaccacctgatgacccagcactggggcctggacgtgcccaacctgctgatcagcgtgaccggcggcgccaagaacttcaacatgaagcccagactgaagagcatcttcagaagaggcctggtgaaggtggcccagaccaccggcgcctggatcatcaccggcggcagccacaccggcgtgatgaagcaggtgggcgaggccgtgagagacttcagcctgagcagcagctacaaggagggcgagctgatcaccatcggcgtggccacctggggcaccgtgcacagaagagagggcctgatccaccccaccggcagcttccccgccgagtacatcctggacgaggacggccagggcaacctgacctgcctggacagcaaccacagccacttcatcctggtggacgacggcacccacggccagtacggcgtggagatccccctgagaaccagactggagaagttcatcagcgagcagaccaaggagagaggcggcgtggccatcaagatccccatcgtgtgcgtggtgctggagggcggccccggcaccctgcacaccatcgacaacgccaccaccaacggcaccccctgcgtggtggtggagggcagcggcagagtggccgacgtgatcgcccaggtggccaacctgcccgtgagcgacatcaccatcagcctgatccagcagaagctgagcgtgttcttccaggagatgttcgagaccttcaccgagagcagaatcgtggagtggaccaagaagatccaggacatcgtgagaagaagacagctgctgaccgtgttcagagagggcaaggacggccagcaggacgtggacgtggccatcctgcaggccctgctgaaggccagcagaagccaggaccacttcggccacgagaactgggaccaccagctgaagctggccgtggcctggaacagagtggacatcgccagaagcgagatcttcatggacgagtggcagtggaagcccagcgacctgcaccccaccatgaccgccgccctgatcagcaacaagcccgagttcgtgaagctgttcctggagaacggcgtgcagctgaaggagttcgtgacctgggacaccctgctgtacctgtacgagaacctggaccccagctgcctgttccacagcaagctgcagaaggtgctggtggaggaccccgagagacccgcctgcgcccccgccgcccccagactgcagatgcaccacgtggcccaggtgctgagagagctgctgggcgacttcacccagcccctgtaccccagacccagacacaacgacagactgagactgctgctgcccgtgccccacgtgaagctgaacgtgcagggcgtgagcctgagaagcctgtacaagagaagcagcggccacgtgaccttcaccatggaccccatcagagacctgctgatctgggccatcgtgcagaacagaagagagctggccggcatcatctgggcccagagccaggactgcatcgccgccgccctggcctgcagcaagatcctgaaggagctgagcaaggaggaggaggacaccgacagcagcgaggagatgctggccctggccgaggagtacgagcacagagccatcggcgtgttcaccgagtgctacagaaaggacgaggagagagcccagaagctgctgaccagagtgagcgaggcctggggcaagaccacctgcctgcagctggccctggaggccaaggacatgaagttcgtgagccacggcggcatccaggccttcctgaccaaggtgtggtggggccagctgagcgtggacaacggcctgtggagagtgaccctgtgcatgctggccttccccctgctgctgaccggcctgatcagcttcagagagaagagactgcaggacgtgggcacccccgccgccagagccagagccttcttcaccgcccccgtggtggtgttccacctgaacatcctgagctacttcgccttcctgtgcctgttcgcctacgtgctgatggtggacttccagcccgtgcccagctggtgcgagtgcgccatctacctgtggctgttcagcctggtgtgcgaggagatgagacagctgttctacgaccccgacgagtgcggcctgatgaagaaggccgccctgtacttcagcgacttctggaacaagctggacgtgggcgccatcctgctgttcgtggccggcctgacctgcagactgatccccgccaccctgtaccccggcagagtgatcctgagcctggacttcatcctgttctgcctgagactgatgcacatcttcaccatcagcaagaccctgggccccaagatcatcatcgtgaagagaatgatgaaggacgtgttcttcttcctgttcctgctggccgtgtgggtggtgagcttcggcgtggccaagcaggccatcctgatccacaacgagagaagagtggactggctgttcagaggcgccgtgtaccacagctacctgaccatcttcggccagatccccggctacatcgacggcgtgaacttcaaccccgagcactgcagccccaacggcaccgacccctacaagcccaagtgccccgagagcgacgccacccagcagagacccgccttccccgagtggctgaccgtgctgctgctgtgcctgtacctgctgttcaccaacatcctgctgctgaacctgctgatcgccatgttcaactacaccttccagcaggtgcaggagcacaccgaccagatctggaagttccagagacacgacctgatcgaggagtaccacggcagacccgccgcccccccccccttcatcctgctgagccacctgcagctgttcatcaagagagtggtgctgaagacccccgccaagagacacaagcagctgaagaacaagctggagaagaacgaggaggccgccctgctgagctgggagatctacctgaaggagaactacctgcagaacagacagttccagcagaagcagagacccgagcagaagatcgaggacatcagcaacaaggtggacgccatggtggacctgctggacctggaccccctgaagagaagcggcagcatggagcagagactggccagcctggaggagcaggtggcccagaccgcccaggccctgcactggatcgtgagaaccctgagagccagcggcttcagcagcgaggccgacgtgcccaccctggccagccagaaggccgccgaggagcccgacgccgagcccggcggcagaaagaagaccgaggagcccggcgacagctaccacgtgaacgccagacacctgctgtaccccaactgccccgtgaccagattccccgtgcccaacgagaaggtgccctgggagaccgagttcctgatctacgacccccccttctacaccgccgagagaaaggacgccgccgccatggaccccatgggcgacaccctggagcccctgagcaccatccagtacaacgtggtggacggcctgagagacagaagaagcttccacggcccctacaccgtgcaggccggcctgcccctgaaccccatgggcagaaccggcctgagaggcagaggcagcctgagctgcttcggccccaaccacaccctgtaccccatggtgaccagatggagaagaaacgaggacggcgccatctgcagaaagagcatcaagaagatgctggaggtgctggtggtgaagctgcccctgagcgagcactgggccctgcccggcggcagcagagagcccggcgagatgctgcccagaaagctgaagagaatcctgagacaggagcactggcccagcttcgagaacctgctgaagtgcggcatggaggtgtacaagggctacatggacgaccccagaaacaccgacaacgcctggatcgagaccgtggccgtgagcgtgcacttccaggaccagaacgacgtggagctgaacagactgaacagcaacctgcacgcctgcgacagcggcgccagcatcagatggcaggtggtggacagaagaatccccctgtacgccaaccacaagaccctgctgcagaaggccgccgccgagttcggcgcccactactag

SEQ ID NO: 103012 - DNA, 4512 bp, Artificial Sequence; identical to SEQ ID NO: 103011
  Description of Artificial Sequence: Synthetic coding sequence

SEQ ID NO: 103013 - DNA, 435 bp, Artificial Sequence
  Description of Artificial Sequence: Synthetic coding sequence
atggagcccagcgccctgagaaaggccggcagcgagcaggaggagggcttcgagggcctgcccagaagagtgaccgacctgggcatggtgagcaacctgagaagaagcaacagcagcctgttcaagagctggagactgcagtgccccttcggcaacaacgacaagcaggagagcctgagcagctggatccccgagaacatcaagaagaaggagtgcgtgtacttcgtggagagcagcaagctgagcgacgccggcaaggtggtgtgccagtgcggctacacccacgagcagcacctggaggaggccaccaagccccacaccttccagggcacccagtgggaccccaagaagcacgtgcaggagatgcccaccgacgccttcggcgacatcgtgttcaccggcctgagccagaaggtgaagaagtacgtgagatag

SEQ ID NO: 103014 - DNA, 744 bp, Artificial Sequence
  Description of Artificial Sequence: Synthetic coding sequence
atgctgagcagagagcaggaggaggacggcggcgccggcagacagtaccacgtgaacgccagacacctgctgtaccccaactgccccgtgaccagattccccgtgcccaacgagaaggtgccctgggagaccgagttcctgatctacgacccccccttctacaccgccgagagaaaggacgccgccgccatggaccccatgggcgagaaccccatgggcagaaccggcctgagaggcagaggcagcctgagctgcttcggccccaaccacaccctgtaccccatggtgaccagatggagaagaaacgaggacggcgccatctgcagaaagagcatcaagaagatgctggaggtgctggtggtgaagctgcccctgagcgagcactgggccctgcccggcggcagcagagagcccggcgagatgctgcccagaaagctgaagagaatcctgagacaggagcactggcccagcttcgagaacctgctgaagtgcggcatggaggtgtacaagggctacatggacgaccccagaaacaccgacaacgcctggatcgagaccgtggccgtgagcgtgcacttccaggaccagaacgacgtggagctgaacagactgaacagcaacctgcacgcctgcgacagcggcgccagcatcagatggcaggtggtggacagaagaatccccctgtacgccaaccacaagaccctgctgcagaaggccgccgccgagttcggcgcccactactag

SEQ ID NO: 103015 - DNA, 5136 bp, Artificial Sequence
  Description of Artificial Sequence: Synthetic coding sequence
atgggcaagaagtggagagacgccgccgagatggagagaggctgcagcgacagagaggacaacgccgagagcagaagaagaagcagaagcgccagcagaggcagattcgccgagagctggaagagactgagcagcaagcagggcagcaccaagagaagcggcctgcccagccagcagacccccgcccagaagagctggatcgagagagccttctacaagagagagtgcgtgcacatcatccccagcaccaaggacccccacagatgctgctgcggcagactgatcggccagcacgtgggcctgacccccagcatcagcgtgctgcagaacgagaagaacgagagcagactgagcagaaacgacatccagagcgagaagtggagcatcagcaagcacacccagctgagccccaccgacgccttcggcaccatcgagttccagggcggcggccacagcaacaaggccatgtacgtgagagtgagcttcgacaccaagcccgacctgctgctgcacctgatgaccaaggagtggcagctggagctgcccaagctgctgatcagcgtgcacggcggcctgcagaacttcgagctgcagcccaagctgaagcaggtgttcggcaagggcctgatcaaggccgccatgaccaccggcgcctggatcttcaccggcggcgtgaacaccggcgtgatcagacacgtgggcgacgccctgaaggaccacgccagcaagagcagaggcaagatctgcaccatcggcatcgccccctggggcatcgtggagaaccaggaggacctgatcggcagagacgtggtgagaccctaccagaccatgagcaaccccatgagcaagctgaccgtgctgaacagcatgcacagccacttcatcctggccgacaacggcaccaccggcaagtacggcgccgaggtgaagctgagaagacagctggagaagcacatcagcctgcagaagatcaacaccagaatcggccagggcgtgcccgtggtggccctgatcgtggagggcggccccaacgtgatcagcatcgtgctggagtacctgagagacaccccccccgtgcccgtggtggtgtgcgacggcagcggcagagccagcgacatcctggccttcggccacaagtacagcgaggagggcggcctgatcaacgagagcctgagagaccagctgctggtgaccatccagaagaccttcacctacaccagaacccaggcccagcacctgttcatcatcctgatggagtgcatgaagaagaaggagctgatcaccgtgttcagaatgggcagcgagggccaccaggacatcgacctggccatcctgaccgccctgctgaagggcgccaacgccagcgcccccgaccagctgagcctggccctggcctggaacagagtggacatcgccagaagccagatcttcatctacggccagcagtggcccgtgggcagcctggagcaggccatgctggacgccctggtgctggacagagtggacttcgtgaagctgctgatcgagaacggcgtgagcatgcacagattcctgaccatcagcagactggaggagctgtacaacaccagacacggccccagcaacaccctgtaccacctggtgagagacgtgaagaagagagagtaccccggcttcggctggatctacttcaagggcaacctgccccccgactacagaatcagcctgatcgacatcggcctggtgatcgagtacctgatgggcggcgcctacagatgcaactacaccagaaagagattcagaaccctgtaccacaacctgttcggccccaagagagacgacatccccctgagaagaggcagaaagaccaccaagaagagagaggaggaggtggacatcgacctggacgaccccgagatcaaccacttccccttccccttccacgagctgatggtgtgggccgtgctgatgaagagacagaagatggccctgttcttctggcagcacggcgaggaggccatggccaaggccctggtggcctgcaagctgtgcaaggccatggcccacgaggccagcgagaacgacatggtggacgacatcagccaggagctgaaccacaacagcagagacttcggccagctggccgtggagctgctggaccagagctacaagcaggacgagcagctggccatgaagctgctgacctacgagctgaagaactggagcaacgccacctgcctgcagctggccgtggccgccaagcacagagacttcatcgcccacacctgcagccagatgctgctgaccgacatgtggatgggcagactgagaatgagaaagaacagcggcctgaaggtgatcctgggcatcctgctgccccccagcatcctgagcctggagttcaagaacaaggacgacatgccctacatgagccaggcccaggagatccacctgcaggagaaggaggccgaggagcccgagaagcccaccaaggagaaggaggaggaggacatggagctgaccgccatgctgggcagaaacaacggcgagagcagcagaaagaaggacgaggaggaggtgcagagcaagcacagactgatccccctgggcagaaagatctacgagttctacaacgcccccatcgtgaagttctggttctacaccctggcctacatcggctacctgatgctgttcaactacatcgtgctggtgaagatggagagatggcccagcacccaggagtggatcgtgatcagctacatcttcaccctgggcatcgagaagatgagagagatcctgatgagcgagcccggcaagctgctgcagaaggtgaaggtgtggctgcaggagtactggaacgtgaccgacctgatcgccatcctgctgttcagcgtgggcatgatcctgagactgcaggaccagcccttcagaagcgacggcagagtgatctactgcgtgaacatcatctactggtacatcagactgctggacatcttcggcgtgaacaagtacctgggcccctacgtgatgatgatcggcaagatgatgatcgacatgatgtacttcgtgatcatcatgctggtggtgctgatgagcttcggcgtggccagacaggccatcctgttccccaacgaggagcccagctggaagctggccaagaacatcttctacatgccctactggatgatctacggcgaggtgttcgccgaccagatcgaccccccctgcggccagaacgagaccagagaggacggcaagatcatccagctgcccccctgcaagaccggcgcctggatcgtgcccgccatcatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgagagacccgtgctgcccccccccctgatcatcttcagccacatgaccatgatcttccagcacctgtgctgcagatggagaaagcacgagagcgaccccgacgagagagactacggcctgaagctgttcatcaccgacgacgagctgaagaaggtgcacgacttcgaggagcagtgcatcgaggagtacttcagagagaaggacgacagattcaacagcagcaacgacgagagaatcagagtgaccagcgagagagtggagaacatgagcatgagactggaggaggtgaacgagagagagcacagcatgaaggccagcctgcagaccgtggacatcagactggcccagctggaggacctgatcggcagaatggccaccgccctggagagactgaccggcctggagagagccgagagcaacaagatcagaagcagaaccagcagcgactgcaccgacgccgcctacatcgtgagacagagcagcttcaacagccaggagggcaacaccttcaagctgcaggagagcatcgaccccgccggcgaggagaccatgagccccaccagccccaccctgatgcccagaatgagaagccacagcttctacagcgtgaacatgaaggacaagggcggcatcgagaagctggagagcatcttcaaggagagaagcctgagcctgcacagagccaccagcagccacagcgtggccaaggagcccaaggcccccgccgcccccgccaacaccctggccatcgtgcccgacagcagaagacccagcagctgcatcgacatctacgtgagcgccatggacgagctgcactgcgacatcgaccccctggacaacagcgtgaacatcctgggcctgggcgagcccagcttcagcacccccgtgcccagcaccgcccccagcagcagcgcctacgccaccctggcccccaccgacagaccccccagcagaagcatcgacttcgaggacatcaccagcatggacaccagaagcttcagcagcgactacacccacctgcccgagtgccagaacccctgggacagcgagccccccatgtaccacaccatcgagagaagcaagagcagcagatacctggccaccacccccttcctgctggaggaggcccccatcgtgaagagccacagcttcatgttcagccccagcagaagctactacgccaacttcggcgtgcccgtgaagaccgccgagtacaccagcatcaccgactgcatcgacaccagatgcgtgaacgccccccaggccatcgccgacagagccgccttccccggcggcctgggcgacaaggtggaggacctgacctgctgccaccccgagagagaggccgagctgagccaccccagcagcgacagcgaggagaacgaggccaagggcagaagagccaccatcgccatcagcagccaggagggcgacaacagcgagagaaccctgagcaacaacatcaccgtgcccaagatcgagagagccaacagctacagcgccgaggagcccagcgccccctacgcccacaccagaaagagcttcagcatcagcgacaagctggacagacagagaaacaccgccagcctgagaaaccccttccagagaagcaagagcagcaagcccgagggcagaggcgacagcctgagcatgagaagactgagcagaaccagcgccttccagagcttcgagagcaagcacaactag

SEQ ID NO: 103016 - DNA, 4710 bp, Artificial Sequence
  Description of Artificial Sequence: Synthetic coding sequence
atgtacgtgagagtgagcttcgacaccaagcccgacctgctgctgcacctgatgaccaaggagtggcagctggagctgcccaagctgctgatcagcgtgcacggcggcctgcagaacttcgagctgcagcccaagctgaagcaggtgttcggcaagggcctgatcaaggccgccatgaccaccggcgcctggatcttcaccggcggcgtgaacaccggcgtgatcagacacgtgggcgacgccctgaaggaccacgccagcaagagcagaggcaagatctgcaccatcggcatcgccccctggggcatcgtggagaaccaggaggacctgatcggcagagacgtggtgagaccctaccagaccatgagcaaccccatgagcaagctgaccgtgctgaacagcatgcacagccacttcatcctggccgacaacggcaccaccggcaagtacggcgccgaggtgaagctgagaagacagctggagaagcacatcagcctgcagaagatcaacaccagatgcctgcccttcttcagcctggacagcagactgttctacagcttctggggcagctgccagctggacagcgtgggcatcggccagggcgtgcccgtggtggccctgatcgtggagggcggccccaacgtgatcagcatcgtgctggagtacctgagagacaccccccccgtgcccgtggtggtgtgcgacggcagcggcagagccagcgacatcctggccttcggccacaagtacagcgaggagggcggcctgatcaacgagagcctgagagaccagctgctggtgaccatccagaagaccttcacctacaccagaacccaggcccagcacctgttcatcatcctgatggagtgcatgaagaagaaggagctgatcaccgtgttcagaatgggcagcgagggccaccaggacatcgacctggccatcctgaccgccctgctgaagggcgccaacgccagcgcccccgaccagctgagcctggccctggcctggaacagagtggacatcgccagaagccagatcttcatctacggccagcagtggcccgtgggcagcctggagcaggccatgctggacgccctggtgctggacagagtggacttcgtgaagctgctgatcgagaacggcgtgagcatgcacagattcctgaccatcagcagactggaggagctgtacaacaccagacacggccccagcaacaccctgtaccacctggtgagagacgtgaagaagggcaacctgccccccgactacagaatcagcctgatcgacatcggcctggtgatcgagtacctgatgggcggcgcctacagatgcaactacaccagaaagagattcagaaccctgtaccacaacctgttcggccccaagagagacgacatccccctgagaagaggcagaaagaccaccaagaagagagaggaggaggtggacatcgacctggacgaccccgagatcaaccacttccccttccccttccacgagctgatggtgtgggccgtgctgatgaagagacagaagatggccctgttcttctggcagcacggcgaggaggccatggccaaggccctggtggcctgcaagctgtgcaaggccatggcccacgaggccagcgagaacgacatggtggacgacatcagccaggagctgaaccacaacagcagagacttcggccagctggccgtggagctgctggaccagagctacaagcaggacgagcagctggccatgaagctgctgacctacgagctgaagaactggagcaacgccacctgcctgcagctggccgtggccgccaagcacagagacttcatcgcccacacctgcagccagatgctgctgaccgacatgtggatgggcagactgagaatgagaaagaacagcggcctgaaggtgatcctgggcatcctgctgccccccagcatcctgagcctggagttcaagaacaaggacgacatgccctacatgagccaggcccaggagatccacctgcaggagaaggaggccgaggagcccgagaagcccaccaaggagaaggaggaggaggacatggagctgaccgccatgctgggcagaaacaacggcgagagcagcagaaagaaggacgaggaggaggtgcagagcaagcacagactgatccccctgggcagaaagatctacgagttctacaacgcccccatcgtgaagttctggttctacaccctggcctacatcggctacctgatgctgttcaactacatcgtgctggtgaagatggagagatggcccagcacccaggagtggatcgtgatcagctacatcttcaccctgggcatcgagaagatgagagagatcctgatgagcgagcccggcaagctgctgcagaaggtgaaggtgtggctgcaggagtactggaacgtgaccgacctgatcgccatcctgctgttcagcgtgggcatgatcctgagactgcaggaccagcccttcagaagcgacggcagagtgatctactgcgtgaacatcatctactggtacatcagactgctggacatcttcggcgtgaacaagtacctgggcccctacgtgatgatgatcggcaagatgatgatcgacatgatgtacttcgtgatcatcatgctggtggtgctgatgagcttcggcgtggccagacaggccatcctgttccccaacgaggagcccagctggaagctggccaagaacatcttctacatgccctactggatgatctacggcgaggtgttcgccgaccagatcgaccccccctgcggccagaacgagaccagagaggacggcaagatcatccagctgcccccctgcaagaccggcgcctggatcgtgcccgccatcatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgagagacccgtgctgcccccccccctgatcatcttcagccacatgaccatgatcttccagcacctgtgctgcagatggagaaagcacgagagcgaccccgacgagagagactacggcctgaagctgttcatcaccgacgacgagctgaagaaggtgcacgacttcgaggagcagtgcatcgaggagtacttcagagagaaggacgacagattcaacagcagcaacgacgagagaatcagagtgaccagcgagagagtggagaacatgagcatgagactggaggaggtgaacgagagagagcacagcatgaaggccagcctgcagaccgtggacatcagactggcccagctggaggacctgatcggcagaatggccaccgccctggagagactgaccggcctggagagagccgagagcaacaagatcagaagcagaaccagcagcgactgcaccgacgccgcctacatcgtgagacagagcagcttcaacagccaggagggcaacaccttcaagctgcaggagagcatcgaccccgccggcgaggagaccatgagccccaccagccccaccctgatgcccagaatgagaagccacagcttctacagcgtgaacatgaaggacaagggcggcatcgagaagctggagagcatcttcaaggagagaagcctgagcctgcacagagccaccagcagccacagcgtggccaaggagcccaaggcccccgccgcccccgccaacaccctggccatcgtgcccgacagcagaagacccagcagctgcatcgacatctacgtgagcgccatggacgagctgcactgcgacatcgaccccctggacaacagcgtgaacatcctgggcctgggcgagcccagcttcagcacccccgtgcccagcaccgcccccagcagcagcgcctacgccaccctggcccccaccgacagaccccccagcagaagcatcgacttcgaggacatcaccagcatggacaccagaagcttcagcagcgactacacccacctgcccgagtgccagaacccctgggacagcgagccccccatgtaccacaccatcgagagaagcaagagcagcagatacctggccaccacccccttcctgctggaggaggcccccatcgtgaagagccacagcttcatgttcagccccagcagaagctactacgccaacttcggcgtgcccgtgaagaccgccgagtacaccagcatcaccgactgcatcgacaccagatgcgtgaacgccccccaggccatcgccgacagagccgccttccccggcggcctgggcgacaaggtggaggacctgacctgctgccaccccgagagagaggccgagctgagccaccccagcagcgacagcgaggagaacgaggccaagggcagaagagccaccatcgccatcagcagccaggagggcgacaacagcgagagaaccctgagcaacaacatcaccgtgcccaagatcgagagagccaacagctacagcgccgaggagcccagcgccccctacgcccacaccagaaagagcttcagcatcagcgacaagctggacagacagagaaacaccgccagcctgagaaaccccttccagagaagcaagagcagcaagcccgagggcagaggcgacagcctgagcatgagaagactgagcagaaccagcgccttccagagcttcgagagcaagcacaactag

SEQ ID NO: 103017 - DNA, 4710 bp, Artificial Sequence; identical to SEQ ID NO: 103016
  Description of Artificial Sequence: Synthetic coding sequence

SEQ ID NO: 103018 - DNA, 4701 bp, Artificial Sequence
  Description of Artificial Sequence: Synthetic coding sequence
atgtacgtgagagtgagcttcgacaccaagcccgacctgctgctgcacctgatgaccaaggagtggcagctggagctgcccaagctgctgatcagcgtgcacggcggcctgcagaacttcgagctgcagcccaagctgaagcaggtgttcggcaagggcctgatcaaggccgccatgaccaccggcgcctggatcttcaccggcggcgtgaacaccggcgtgatcagacacgtgggcgacgccctgaaggaccacgccagcaagagcagaggcaagatctgcaccatcggcatcgccccctggggcatcgtggagaaccaggaggacctgatcggcagagacgtggtgagaccctaccagaccatgagcaaccccatgagcaagctgaccgtgctgaacagcatgcacagccacttcatcctggccgacaacggcaccaccggcaagtacggcgccgaggtgaagctgagaagacagctggagaagcacatcagcctgcagaagatcaacaccagaatcggccagggcgtgcccgtggtggccctgatcgtggagggcggccccaacgtgatcagcatcgtgctggagtacctgagagacaccccccccgtgcccgtggtggtgtgcgacggcagcggcagagccagcgacatcctggccttcggccacaagtacagcgaggagggcggcctgatcaacgagagcctgagagaccagctgctggtgaccatccagaagaccttcacctacaccagaacccaggcccagcacctgttcatcatcctgatggagtgcatgaagaagaaggagctgatcaccgtgttcagaatgggcagcgagggccaccaggacatcgacctggccatcctgaccgccctgctgaagggcgccaacgccagcgcccccgaccagctgagcctggccctggcctggaacagagtggacatcgccagaagccagatcttcatctacggccagcagtggcccgtgggcagcctggagcaggccatgctggacgccctggtgctggacagagtggacttcgtgaagctgctgatcgagaacggcgtgagcatgcacagattcctgaccatcagcagactggaggagctgtacaacaccagacacggccccagcaacaccctgtaccacctggtgagagacgtgaagaagagagagtaccccggcttcggctggatctacttcaagggcaacctgccccccgactacagaatcagcctgatcgacatcggcctggtgatcgagtacctgatgggcggcgcctacagatgcaactacaccagaaagagattcagaaccctgtaccacaacctgttcggccccaagagacccaaggccctgaagctgctgggcatggaggacgacatccccctgagaagaggcagaaagaccaccaagaagagagaggaggaggtggacatcgacctggacgaccccgagatcaaccacttccccttccccttccacgagctgatggtgtgggccgtgctgatgaagagacagaagatggccctgttcttctggcagcacggcgaggaggccatggccaaggccctggtggcctgcaagctgtgcaaggccatggcccacgaggccagcgagaacgacatggtggacgacatcagccaggagctgaaccacaacagcagagacttcggccagctggccgtggagctgctggaccagagctacaagcaggacgagcagctggccatgaagctgctgacctacgagctgaagaactggagcaacgccacctgcctgcagctggccgtggccgccaagcacagagacttcatcgcccacacctgcagccagatgctgctgaccgacatgtggatgggcagactgagaatgagaaagaacagcggcctgaaggtgatcctgggcatcctgctgccccccagcatcctgagcctggagttcaagaacaaggacgacatgccctacatgagccaggcccaggagatccacctgcaggagaaggaggccgaggagcccgagaagcccaccaaggagaaggaggaggaggacatggagctgaccgccatgctgggcagaaacaacggcgagagcagcagaaagaaggacgaggaggaggtgcagagcaagcacagactgatccccctgggcagaaagatctacgagttctacaacgcccccatcgtgaagttctggttctacaccctggcctacatcggctacctgatgctgttcaactacatcgtgctggtgaagatggagagatggcccagcacccaggagtggatcgtgatcagctacatcttcaccctgggcatcgagaagatgagagagatcctgatgagcgagcccggcaagctgctgcagaaggtgaaggtgtggctgcaggagtactggaacgtgaccgacctgatcgccatcctgctgttcagcgtgggcatgatcctgagactgcaggaccagcccttcagaagcgacggcagagtgatctactgcgtgaacatcatctactggtacatcagactgctggacatcttcggcgtgaacaagtacctgggcccctacgtgatgatgatcggcaagatgatgatcgacatgatgtacttcgtgatcatcatgctggtggtgctgatgagcttcggcgtggccagacaggccatcctgttccccaacgaggagcccagctggaagctggccaagaacatcttctacatgccctactggatgatctacggcgaggtgttcgccgaccagatcgaccccccctgcggccagaacgagaccagagaggacggcaagatcatccagctgcccccctgcaagaccggcgcctggatcgtgcccgccatcatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgagagacccgtgctgcccccccccctgatcatcttcagccacatgaccatgatcttccagcacctgtgctgcagatggagaaagcacgagagcgaccccgacgagagagactacggcctgaagctgttcatcaccgacgacgagctgaagaaggtgcacgacttcgaggagcagtgcatcgaggagtacttcagagagaaggacgacagattcaacagcagcaacgacgagagaatcagagtgaccagcgagagagtggagaacatgagcatgagactggaggaggtgaacgagagagagcacagcatgaaggccagcctgcagaccgtggacatcagactggcccagctggaggacctgatcggcagaatggccaccgccctggagagactgaccggcctggagagagccgagagcaacaagatcagaagcagaaccagcagcgactgcaccgacgccgcctacatcgtgagacagagcagcttcaacagccaggagggcaacaccttcaagctgcaggagagcatcgaccccgccggcgaggagaccatgagccccaccagccccaccctgatgcccagaatgagaagccacagcttctacagcgtgaacatgaaggacaagggcggcatcgagaagctggagagcatcttcaaggagagaagcctgagcctgcacagagccaccagcagccacagcgtggccaaggagcccaaggcccccgccgcccccgccaacaccctggccatcgtgcccgacagcagaagacccagcagctgcatcgacatctacgtgagcgccatggacgagctgcactgcgacatcgaccccctggacaacagcgtgaacatcctgggcctgggcgagcccagcttcagcacccccgtgcccagcaccgcccccagcagcagcgcctacgccaccctggcccccaccgacagaccccccagcagaagcatcgacttcgaggacatcaccagcatggacaccagaagcttcagcagcgactacacccacctgcccgagtgccagaacccctgggacagcgagccccccatgtaccacaccatcgagagaagcaagagcagcagatacctggccaccacccccttcctgctggaggaggcccccatcgtgaagagccacagcttcatgttcagccccagcagaagctactacgccaacttcggcgtgcccgtgaagaccgccgagtacaccagcatcaccgactgcatcgacaccagatgcgtgaacgccccccaggccatcgccgacagagccgccttccccggcggcctgggcgacaaggtggaggacctgacctgctgccaccccgagagagaggccgagctgagccaccccagcagcgacagcgaggagaacgaggccaagggcagaagagccaccatcgccatcagcagccaggagggcgacaacagcgagagaaccctgagcaacaacatcaccgtgcccaagatcgagagagccaacagctacagcgccgaggagcccagcgccccctacgcccacaccagaaagagcttcagcatcagcgacaagctggacagacagagaaacaccgccagcctgagaaaccccttccagagaagcaagagcagcaagcccgagggcagaggcgacagcctgagcatgagaagactgagcagaaccagcgccttccagagcttcgagagcaagcacaactag

SEQ ID NO: 103019 - DNA, 4740 bp, Artificial Sequence
  Description of Artificial Sequence: Synthetic coding sequence
atgtacgtgagagtgagcttcgacaccaagcccgacctgctgctgcacctgatgaccaaggagtggcagctggagctgcccaagctgctgatcagcgtgcacggcggcctgcagaacttcgagctgcagcccaagctgaagcaggtgttcggcaagggcctgatcaaggccgccatgaccaccggcgcctggatcttcaccggcggcgtgaacaccggcgtgatcagacacgtgggcgacgccctgaaggaccacgccagcaagagcagaggcaagatctgcaccatcggcatcgccccctggggcatcgtggagaaccaggaggacctgatcggcagagacgtggtgagaccctaccagaccatgagcaaccccatgagcaagctgaccgtgctgaacagcatgcacagccacttcatcctggccgacaacggcaccaccggcaagtacggcgccgaggtgaagctgagaagacagctggagaagcacatcagcctgcagaagatcaacaccagatgcctgcccttcttcagcctggacagcagactgttctacagcttctggggcagctgccagctggacagcgtgggcatcggccagggcgtgcccgtggtggccctgatcgtggagggcggccccaacgtgatcagcatcgtgctggagtacctgagagacaccccccccgtgcccgtggtggtgtgcgacggcagcggcagagccagcgacatcctggccttcggccacaagtacagcgaggagggcggcctgatcaacgagagcctgagagaccagctgctggtgaccatccagaagaccttcacctacaccagaacccaggcccagcacctgttcatcatcctgatggagtgcatgaagaagaaggagctgatcaccgtgttcagaatgggcagcgagggccaccaggacatcgacctggccatcctgaccgccctgctgaagggcgccaacgccagcgcccccgaccagctgagcctggccctggcctggaacagagtggacatcgccagaagccagatcttcatctacggccagcagtggcccgtgggcagcctggagcaggccatgctggacgccctggtgctggacagagtggacttcgtgaagctgctgatcgagaacggcgtgagcatgcacagattcctgaccatcagcagactggaggagctgtacaacaccagacacggccccagcaacaccctgtaccacctggtgagagacgtgaagaagggcaacctgccccccgactacagaatcagcctgatcgacatcggcctggtgatcgagtacctgatgggcggcgcctacagatgcaactacaccagaaagagattcagaaccctgtaccacaacctgttcggccccaagagacccaaggccctgaagctgctgggcatggaggacgacatccccctgagaagaggcagaaagaccaccaagaagagagaggaggaggtggacatcgacctggacgaccccgagatcaaccacttccccttccccttccacgagctgatggtgtgggccgtgctgatgaagagacagaagatggccctgttcttctggcagcacggcgaggaggccatggccaaggccctggtggcctgcaagctgtgcaaggccatggcccacgaggccagcgagaacgacatggtggacgacatcagccaggagctgaaccacaacagcagagacttcggccagctggccgtggagctgctggaccagagctacaagcaggacgagcagctggccatgaagctgctgacctacgagctgaagaactggagcaacgccacctgcctgcagctggccgtggccgccaagcacagagacttcatcgcccacacctgcagccagatgctgctgaccgacatgtggatgggcagactgagaatgagaaagaacagcggcctgaaggtgatcctgggcatcctgctgccccccagcatcctgagcctggagttcaagaacaaggacgacatgccctacatgagccaggcccaggagatccacctgcaggagaaggaggccgaggagcccgagaagcccaccaaggagaaggaggaggaggacatggagctgaccgccatgctgggcagaaacaacggcgagagcagcagaaagaaggacgaggaggaggtgcagagcaagcacagactgatccccctgggcagaaagatctacgagttctacaacgcccccatcgtgaagttctggttctacaccctggcctacatcggctacctgatgctgttcaactacatcgtgctggtgaagatggagagatggcccagcacccaggagtggatcgtgatcagctacatcttcaccctgggcatcgagaagatgagagagatcctgatgagcgagcccggcaagctgctgcagaaggtgaaggtgtggctgcaggagtactggaacgtgaccgacctgatcgccatcctgctgttcagcgtgggcatgatcctgagactgcaggaccagcccttcagaagcgacggcagagtgatctactgcgtgaacatcatctactggtacatcagactgctggacatcttcggcgtgaacaagtacctgggcccctacgtgatgatgatcggcaagatgatgatcgacatgatgtacttcgtgatcatcatgctggtggtgctgatgagcttcggcgtggccagacaggccatcctgttccccaacgaggagcccagctggaagctggccaagaacatcttctacatgccctactggatgatctacggcgaggtgttcgccgaccagatcgaccccccctgcggccagaacgagaccagagaggacggcaagatcatccagctgcccccctgcaagaccggcgcctggatcgtgcccgccatcatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgagagacccgtgctgcccccccccctgatcatcttcagccacatgaccatgatcttccagcacctgtgctgcagatggagaaagcacgagagcgaccccgacgagagagactacggcctgaagctgttcatcaccgacgacgagctgaagaaggtgcacgacttcgaggagcagtgcatcgaggagtacttcagagagaaggacgacagattcaacagcagcaacgacgagagaatcagagtgaccagcgagagagtggagaacatgagcatgagactggaggaggtgaacgagagagagcacagcatgaaggccagcctgcagaccgtggacatcagactggcccagctggaggacctgatcggcagaatggccaccgccctggagagactgaccggcctggagagagccgagagcaacaagatcagaagcagaaccagcagcgactgcaccgacgccgcctacatcgtgagacagagcagcttcaacagccaggagggcaacaccttcaagctgcaggagagcatcgaccccgccggcgaggagaccatgagccccaccagccccaccctgatgcccagaatgagaagccacagcttctacagcgtgaacatgaaggacaagggcggcatcgagaagctggagagcatcttcaaggagagaagcctgagcctgcacagagccaccagcagccacagcgtggccaaggagcccaaggcccccgccgcccccgccaacaccctggccatcgtgcccgacagcagaagacccagcagctgcatcgacatctacgtgagcgccatggacgagctgcactgcgacatcgaccccctggacaacagcgtgaacatcctgggcctgggcgagcccagcttcagcacccccgtgcccagcaccgcccccagcagcagcgcctacgccaccctggcccccaccgacagaccccccagcagaagcatcgacttcgaggacatcaccagcatggacaccagaagcttcagcagcgactacacccacctgcccgagtgccagaacccctgggacagcgagccccccatgtaccacaccatcgagagaagcaagagcagcagatacctggccaccacccccttcctgctggaggaggcccccatcgtgaagagccacagcttcatgttcagccccagcagaagctactacgccaacttcggcgtgcccgtgaagaccgccgagtacaccagcatcaccgactgcatcgacaccagatgcgtgaacgccccccaggccatcgccgacagagccgccttccccggcggcctgggcgacaaggtggaggacctgacctgctgccaccccgagagagaggccgagctgagccaccccagcagcgacagcgaggagaacgaggccaagggcagaagagccaccatcgccatcagcagccaggagggcgacaacagcgagagaaccctgagcaacaacatcaccgtgcccaagatcgagagagccaacagctacagcgccgaggagcccagcgccccctacgcccacaccagaaagagcttcagcatcagcgacaagctggacagacagagaaacaccgccagcctgagaaaccccttccagagaagcaagagcagcaagcccgagggcagaggcgacagcctgagcatgagaagactgagcagaaccagcgccttccagagcttcgagagcaagcacaactag

SEQ ID NO: 103020 - DNA, 5124 bp, Artificial Sequence
  Description of Artificial Sequence: Synthetic coding sequence
atgcccgagccctggggcaccgtgtacttcctgggcatcgcccaggtgttcagcttcctgttcagctggtggaacctggagggcgtgatgaaccaggccgacgcccccagacccctgaactggaccatcagaaagctgtgccacgccgccttcctgcccagcgtgagactgctgaaggcccagaagagctggatcgagagagccttctacaagagagagtgcgtgcacatcatccccagcaccaaggacccccacagatgctgctgcggcagactgatcggccagcacgtgggcctgacccccagcatcagcgtgctgcagaacgagaagaacgagagcagactgagcagaaacgacatccagagcgagaagtggagcatcagcaagcacacccagctgagccccaccgacgccttcggcaccatcgagttccagggcggcggccacagcaacaaggccatgtacgtgagagtgagcttcgacaccaagcccgacctgctgctgcacctgatgaccaaggagtggcagctggagctgcccaagctgctgatcagcgtgcacggcggcctgcagaacttcgagctgcagcccaagctgaagcaggtgttcggcaagggcctgatcaaggccgccatgaccaccggcgcctggatcttcaccggcggcgtgaacaccggcgtgatcagacacgtgggcgacgccctgaaggaccacgccagcaagagcagaggcaagatctgcaccatcggcatcgccccctggggcatcgtggagaaccaggaggacctgatcggcagagacgtggtgagaccctaccagaccatgagcaaccccatgagcaagctgaccgtgctgaacagcatgcacagccacttcatcctggccgacaacggcaccaccggcaagtacggcgccgaggtgaagctgagaagacagctggagaagcacatcagcctgcagaagatcaacaccagaatcggccagggcgtgcccgtggtggccctgatcgtggagggcggccccaacgtgatcagcatcgtgctggagtacctgagagacaccccccccgtgcccgtggtggtgtgcgacggcagcggcagagccagcgacatcctggccttcggccacaagtacagcgaggagggcggcctgatcaacgagagcctgagagaccagctgctggtgaccatccagaagaccttcacctacaccagaacccaggcccagcacctgttcatcatcctgatggagtgcatgaagaagaaggagctgatcaccgtgttcagaatgggcagcgagggccaccaggacatcgacctggccatcctgaccgccctgctgaagggcgccaacgccagcgcccccgaccagctgagcctggccctggcctggaacagagtggacatcgccagaagccagatcttcatctacggccagcagtggcccgtgggcagcctggagcaggccatgctggacgccctggtgctggacagagtggacttcgtgaagctgctgatcgagaacggcgtgagcatgcacagattcctgaccatcagcagactggaggagctgtacaacaccagacacggccccagcaacaccctgtaccacctggtgagagacgtgaagaagggcaacctgccccccgactacagaatcagcctgatcgacatcggcctggtgatcgagtacctgatgggcggcgcctacagatgcaactacaccagaaagagattcagaaccctgtaccacaacctgttcggccccaagagacccaaggccctgaagctgctgggcatggaggacgacatccccctgagaagaggcagaaagaccaccaagaagagagaggaggaggtggacatcgacctggacgaccccgagatcaaccacttccccttccccttccacgagctgatggtgtgggccgtgctgatgaagagacagaagatggccctgttcttctggcagcacggcgaggaggccatggccaaggccctggtggcctgcaagctgtgcaaggccatggcccacgaggccagcgagaacgacatggtggacgacatcagccaggagctgaaccacaacagcagagacttcggccagctggccgtggagctgctggaccagagctacaagcaggacgagcagctggccatgaagctgctgacctacgagctgaagaactggagcaacgccacctgcctgcagctggccgtggccgccaagcacagagacttcatcgcccacacctgcagccagatgctgctgaccgacatgtggatgggcagactgagaatgagaaagaacagcggcctgaaggtgatcctgggcatcctgctgccccccagcatcctgagcctggagttcaagaacaaggacgacatgccctacatgagccaggcccaggagatccacctgcaggagaaggaggccgaggagcccgagaagcccaccaaggagaaggaggaggaggacatggagctgaccgccatgctgggcagaaacaacggcgagagcagcagaaagaaggacgaggaggaggtgcagagcaagcacagactgatccccctgggcagaaagatctacgagttctacaacgcccccatcgtgaagttctggttctacaccctggcctacatcggctacctgatgctgttcaactacatcgtgctggtgaagatggagagatggcccagcacccaggagtggatcgtgatcagctacatcttcaccctgggcatcgagaagatgagagagatcctgatgagcgagcccggcaagctgctgcagaaggtgaaggtgtggctgcaggagtactggaacgtgaccgacctgatcgccatcctgctgttcagcgtgggcatgatcctgagactgcaggaccagcccttcagaagcgacggcagagtgatctactgcgtgaacatcatctactggtacatcagactgctggacatcttcggcgtgaacaagtacctgggcccctacgtgatgatgatcggcaagatgatgatcgacatgatgtacttcgtgatcatcatgctggtggtgctgatgagcttcggcgtggccagacaggccatcctgttccccaacgaggagcccagctggaagctggccaagaacatcttctacatgccctactggatgatctacggcgaggtgttcgccgaccagatcgaccccccctgcggccagaacgagaccagagaggacggcaagatcatccagctgcccccctgcaagaccggcgcctggatcgtgcccgccatcatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgagagacccgtgctgcccccccccctgatcatcttcagccacatgaccatgatcttccagcacctgtgctgcagatggagaaagcacgagagcgaccccgacgagagagactacggcctgaagctgttcatcaccgacgacgagctgaagaaggtgcacgacttcgaggagcagtgcatcgaggagtacttcagagagaaggacgacagattcaacagcagcaacgacgagagaatcagagtgaccagcgagagagtggagaacatgagcatgagactggaggaggtgaacgagagagagcacagcatgaaggccagcctgcagaccgtggacatcagactggcccagctggaggacctgatcggcagaatggccaccgccctggagagactgaccggcctggagagagccgagagcaacaagatcagaagcagaaccagcagcgactgcaccgacgccgcctacatcgtgagacagagcagcttcaacagccaggagggcaacaccttcaagctgcaggagagcatcgaccccgccggcgaggagaccatgagccccaccagccccaccctgatgcccagaatgagaagccacagcttctacagcgtgaacatgaaggacaagggcggcatcgagaagctggagagcatcttcaaggagagaagcctgagcctgcacagagccaccagcagccacagcgtggccaaggagcccaaggcccccgccgcccccgccaacaccctggccatcgtgcccgacagcagaagacccagcagctgcatcgacatctacgtgagcgccatggacgagctgcactgcgacatcgaccccctggacaacagcgtgaacatcctgggcctgggcgagcccagcttcagcacccccgtgcccagcaccgcccccagcagcagcgcctacgccaccctggcccccaccgacagaccccccagcagaagcatcgacttcgaggacatcaccagcatggacaccagaagcttcagcagcgactacacccacctgcccgagtgccagaacccctgggacagcgagccccccatgtaccacaccatcgagagaagcaagagcagcagatacctggccaccacccccttcctgctggaggaggcccccatcgtgaagagccacagcttcatgttcagccccagcagaagctactacgccaacttcggcgtgcccgtgaagaccgccgagtacaccagcatcaccgactgcatcgacaccagatgcgtgaacgccccccaggccatcgccgacagagccgccttccccggcggcctgggcgacaaggtggaggacctgacctgctgccaccccgagagagaggccgagctgagccaccccagcagcgacagcgaggagaacgaggccaagggcagaagagccaccatcgccatcagcagccaggagggcgacaacagcgagagaaccctgagcaacaacatcaccgtgcccaagatcgagagagccaacagctacagcgccgaggagcccagcgccccctacgcccacaccagaaagagcttcagcatcagcgacaagctggacagacagagaaacaccgccagcctgagaaaccccttccagagaagcaagagcagcaagcccgagggcagaggcgacagcctgagcatgagaagactgagcagaaccagcgccttccagagcttcgagagcaagcacaactag

SEQ ID NO: 103021 - DNA, 3978 bp, Artificial Sequence
  Description of Artificial Sequence: Synthetic coding sequence
atgcccgagccctggggcaccgtgtacttcctgggcatcgcccaggtgttcagcttcctgttcagctggtggaacctggagggcgtgatgaaccaggccgacgcccccagacccctgaactggaccatcagaaagctgtgccacgccgccttcctgcccagcgtgagactgctgaaggcccagaagagctggatcgagagagccttctacaagagagagtgcgtgcacatcatccccagcaccaaggacccccacagatgctgctgcggcagactgatcggccagcacgtgggcctgacccccagcatcagcgtgctgcagaacgagaagaacgagagcagactgagcagaaacgacatccagagcgagaagtggagcatcagcaagcacacccagctgagccccaccgacgccttcggcaccatcgagttccagggcggcggccacagcaacaaggccatgtacgtgagagtgagcttcgacaccaagcccgacctgctgctgcacctgatgaccaaggagtggcagctggagctgcccaagctgctgatcagcgtgcacggcggcctgcagaacttcgagctgcagcccaagctgaagcaggtgttcggcaagggcctgatcaaggccgccatgaccaccggcgcctggatcttcaccggcggcgtgaacaccggcgtgatcagacacgtgggcgacgccctgaaggaccacgccagcaagagcagaggcaagatctgcaccatcggcatcgccccctggggcatcgtggagaaccaggaggacctgatcggcagagacgtggtgagaccctaccagaccatgagcaaccccatgagcaagctgaccgtgctgaacagcatgcacagccacttcatcctggccgacaacggcaccaccggcaagtacggcgccgaggtgaagctgagaagacagctggagaagcacatcagcctgcagaagatcaacaccagaatcggccagggcgtgcccgtggtggccctgatcgtggagggcggccccaacgtgatcagcatcgtgctggagtacctgagagacaccccccccgtgcccgtggtggtgtgcgacggcagcggcagagccagcgacatcctggccttcggccacaagtacagcgaggagggcggcctgatcaacgagagcctgagagaccagctgctggtgaccatccagaagaccttcacctacaccagaacccaggcccagcacctgttcatcatcctgatggagtgcatgaagaagaaggagctgatcaccgtgttcagaatgggcagcgagggccaccaggacatcgacctggccatcctgaccgccctgctgaagggcgccaacgccagcgcccccgaccagctgagcctggccctggcctggaacagagtggacatcgccagaagccagatcttcatctacggccagcagtggcccgtgggcagcctggagcaggccatgctggacgccctggtgctggacagagtggacttcgtgaagctgctgatcgagaacggcgtgagcatgcacagattcctgaccatcagcagactggaggagctgtacaacaccagacacggccccagcaacaccctgtaccacctggtgagagacgtgaagaagggcaacctgccccccgactacagaatcagcctgatcgacatcggcctggtgatcgagtacctgatgggcggcgcctacagatgcaactacaccagaaagagattcagaaccctgtaccacaacctgttcggccccaagagacccaaggccctgaagctgctgggcatggaggacgacatccccctgagaagaggcagaaagaccaccaagaagagagaggaggaggtggacatcgacctggacgaccccgagatcaaccacttccccttccccttccacgagctgatggtgtgggccgtgctgatgaagagacagaagatggccctgttcttctggcagcacggcgaggaggccatggccaaggccctggtggcctgcaagctgtgcaaggccatggcccacgaggccagcgagaacgacatggtggacgacatcagccaggagctgaaccacaacagcagagacttcggccagctggccgtggagctgctggaccagagctacaagcaggacgagcagctggccatgaagctgctgacctacgagctgaagaactggagcaacgccacctgcctgcagctggccgtggccgccaagcacagagacttcatcgcccacacctgcagccagatgctgctgaccgacatgtggatgggcagactgagaatgagaaagaacagcggcctgaaggtgatcctgggcatcctgctgccccccagcatcctgagcctggagttcaagaacaaggacgacatgccctacatgagccaggcccaggagatccacctgcaggagaaggaggccgaggagcccgagaagcccaccaaggagaaggaggaggaggacatggagctgaccgccatgctgggcagaaacaacggcgagagcagcagaaagaaggacgaggaggaggtgcagagcaagcacagactgatccccctgggcagaaagatctacgagttctacaacgcccccatcgtgaagttctggttctacaccctggcctacatcggctacctgatgctgttcaactacatcgtgctggtgaagatggagagatggcccagcacccaggagtggatcgtgatcagctacatcttcaccctgggcatcgagaagatgagagagatcctgatgagcgagcccggcaagctgctgcagaaggtgaaggtgtggctgcaggagtactggaacgtgaccgacctgatcgccatcctgctgttcagcgtgggcatgatcctgagactgcaggaccagcccttcagaagcgacggcagagtgatctactgcgtgaacatcatctactggtacatcagactgctggacatcttcggcgtgaacaagtacctgggcccctacgtgatgatgatcggcaagatgatgatcgacatgatgtacttcgtgatcatcatgctggtggtgctgatgagcttcggcgtggccagacaggccatcctgttccccaacgaggagcccagctggaagctggccaagaacatcttctacatgccctactggatgatctacggcgaggtgttcgccgaccagatcgaccccccctgcggccagaacgagaccagagaggacggcaagatcatccagctgcccccctgcaagaccggcgcctggatcgtgcccgccatcatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgagagacccgtgctgcccccccccctgatcatcttcagccacatgaccatgatcttccagcacctgtgctgcagatggagaaagcacgagagcgaccccgacgagagagactacggcctgaagctgttcatcaccgacgacgagctgaagaaggtgcacgacttcgaggagcagtgcatcgaggagtacttcagagagaaggacgacagattcaacagcagcaacgacgagagaatcagagtgaccagcgagagagtggagaacatgagcatgagactggaggaggtgaacgagagagagcacagcatgaaggccagcctgcagaccgtggacatcagactggcccagctggaggacctgatcggcagaatggccaccgccctggagagactgaccggcctggagagagccgagagcaacaagatcagaagcagaaccagcagcgactgcaccgacgccgcctacatcgtgagacagagcagcttcaacagccaggagggcaacaccttcaagctgcaggagagcatcgaccccgccgagcaccccctgtacagcgtgtag

SEQ ID NO: 103022 - DNA, 4671 bp, Artificial Sequence
  Description of Artificial Sequence: Synthetic coding sequence
tgatacgtgagagtgagcttcgacaccaagcccgacctgctgctgcacctgatgaccaaggagtggcagctggagctgcccaagctgctgatcagcgtgcacggcggcctgcagaacttcgagctgcagcccaagctgaagcaggtgttcggcaagggcctgatcaaggccgccatgaccaccggcgcctggatcttcaccggcggcgtgaacaccggcgtgatcagacacgtgggcgacgccctgaaggaccacgccagcaagagcagaggcaagatctgcaccatcggcatcgccccctggggcatcgtggagaaccaggaggacctgatcggcagagacgtggtgagaccctaccagaccatgagcaaccccatgagcaagctgaccgtgctgaacagcatgcacagccacttcatcctggccgacaacggcaccaccggcaagtacggcgccgaggtgaagctgagaagacagctggagaagcacatcagcctgcagaagatcaacaccagaatcggccagggcgtgcccgtggtggccctgatcgtggagggcggccccaacgtgatcagcatcgtgctggagtacctgagagacaccccccccgtgcccgtggtggtgtgcgacggcagcggcagagccagcgacatcctggccttcggccacaagtacagcgaggagggcggcctgatcaacgagagcctgagagaccagctgctggtgaccatccagaagaccttcacctacaccagaacccaggcccagcacctgttcatcatcctgatggagtgcatgaagaagaaggagctgatcaccgtgttcagaatgggcagcgagggccaccaggacatcgacctggccatcctgaccgccctgctgaagggcgccaacgccagcgcccccgaccagctgagcctggccctggcctggaacagagtggacatcgccagaagccagatcttcatctacggccagcagtggcccgtgggcagcctggagcaggccatgctggacgccctggtgctggacagagtggacttcgtgaagctgctgatcgagaacggcgtgagcatgcacagattcctgaccatcagcagactggaggagctgtacaacaccagacacggccccagcaacaccctgtaccacctggtgagagacgtgaagaagagagagtaccccggcttcggctggatctacttcaagggcaacctgccccccgactacagaatcagcctgatcgacatcggcctggtgatcgagtacctgatgggcggcgcctacagatgcaactacaccagaaagagattcagaaccctgtaccacaacctgttcggccccaagagagacgacatccccctgagaagaggcagaaagaccaccaagaagagagaggaggaggtggacatcgacctggacgaccccgagatcaaccacttccccttccccttccacgagctgatggtgtgggccgtgctgatgaagagacagaagatggccctgttcttctggcagcacggcgaggaggccatggccaaggccctggtggcctgcaagctgtgcaaggccatggcccacgaggccagcgagaacgacatggtggacgacatcagccaggagctgaaccacaacagcagagacttcggccagctggccgtggagctgctggaccagagctacaagcaggacgagcagctggccatgaagctgctgacctacgagctgaagaactggagcaacgccacctgcctgcagctggccgtggccgccaagcacagagacttcatcgcccacacctgcagccagatgctgctgaccgacatgtggatgggcagactgagaatgagaaagaacagcggcctgaaggtgatcctgggcatcctgctgccccccagcatcctgagcctggagttcaagaacaaggacgacatgccctacatgagccaggcccaggagatccacctgcaggagaaggaggccgaggagcccgagaagcccaccaaggagaaggaggaggaggacatggagctgaccgccatgctgggcagaaacaacggcgagagcagcagaaagaaggacgaggaggaggtgcagagcaagcacagactgatccccctgggcagaaagatctacgagttctacaacgcccccatcgtgaagttctggttctacaccctggcctacatcggctacctgatgctgttcaactacatcgtgctggtgaagatggagagatggcccagcacccaggagtggatcgtgatcagctacatcttcaccctgggcatcgagaagatgagagagatcctgatgagcgagcccggcaagctgctgcagaaggtgaaggtgtggctgcaggagtactggaacgtgaccgacctgatcgccatcctgctgttcagcgtgggcatgatcctgagactgcaggaccagcccttcagaagcgacggcagagtgatctactgcgtgaacatcatctactggtacatcagactgctggacatcttcggcgtgaacaagtacctgggcccctacgtgatgatgatcggcaagatgatgatcgacatgatgtacttcgtgatcatcatgctggtggtgctgatgagcttcggcgtggccagacaggccatcctgttccccaacgaggagcccagctggaagctggccaagaacatcttctacatgccctactggatgatctacggcgaggtgttcgccgaccagatcgaccccccctgcggccagaacgagaccagagaggacggcaagatcatccagctgcccccctgcaagaccggcgcctggatcgtgcccgccatcatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgagagacccgtgctgcccccccccctgatcatcttcagccacatgaccatgatcttccagcacctgtgctgcagatggagaaagcacgagagcgaccccgacgagagagactacggcctgaagctgttcatcaccgacgacgagctgaagaaggtgcacgacttcgaggagcagtgcatcgaggagtacttcagagagaaggacgacagattcaacagcagcaacgacgagagaatcagagtgaccagcgagagagtggagaacatgagcatgagactggaggaggtgaacgagagagagcacagcatgaaggccagcctgcagaccgtggacatcagactggcccagctggaggacctgatcggcagaatggccaccgccctggagagactgaccggcctggagagagccgagagcaacaagatcagaagcagaaccagcagcgactgcaccgacgccgcctacatcgtgagacagagcagcttcaacagccaggagggcaacaccttcaagctgcaggagagcatcgaccccgccggcgaggagaccatgagccccaccagccccaccctgatgcccagaatgagaagccacagcttctacagcgtgaacatgaaggacaagggcggcatcgagaagctggagagcatcttcaaggagagaagcctgagcctgcacagagccaccagcagccacagcgtggccaaggagcccaaggcccccgccgcccccgccaacaccctggccatcgtgcccgacagcagaagacccagcagctgcatcgacatctacgtgagcgccatggacgagctgcactgcgacatcgaccccctggacaacagcgtgaacatcctgggcctgggcgagcccagcttcagcacccccgtgcccagcaccgcccccagcagcagcgcctacgccaccctggcccccaccgacagaccccccagcagaagcatcgacttcgaggacatcaccagcatggacaccagaagcttcagcagcgactacacccacctgcccgagtgccagaacccctgggacagcgagccccccatgtaccacaccatcgagagaagcaagagcagcagatacctggccaccacccccttcctgctggaggaggcccccatcgtgaagagccacagcttcatgttcagccccagcagaagctactacgccaacttcggcgtgcccgtgaagaccgccgagtacaccagcatcaccgactgcatcgacaccagatgcgtgaacgccccccaggccatcgccgacagagccgccttccccggcggcctgggcgacaaggtggaggacctgacctgctgccaccccgagagagaggccgagctgagccaccccagcagcgacagcgaggagaacgaggccaagggcagaagagccaccatcgccatcagcagccaggagggcgacaacagcgagagaaccctgagcaacaacatcaccgtgcccaagatcgagagagccaacagctacagcgccgaggagcccagcgccccctacgcccacaccagaaagagcttcagcatcagcgacaagctggacagacagagaaacaccgccagcctgagaaaccccttccagagaagcaagagcagcaagcccgagggcagaggcgacagcctgagcatgagaagactgagcagaaccagcgccttccagagcttcgagagcaagcacaactag

SEQ ID NO: 103023 - DNA, 4701 bp, Artificial Sequence
  Description of Artificial Sequence: Synthetic coding sequence
atgtacgtgagagtgagcttcgacaccaagcccgacctgctgctgcacctgatgaccaaggagtggcagctggagctgcccaagctgctgatcagcgtgcacggcggcctgcagaacttcgagctgcagcccaagctgaagcaggtgttcggcaagggcctgatcaaggccgccatgaccaccggcgcctggatcttcaccggcggcgtgaacaccggcgtgatcagacacgtgggcgacgccctgaaggaccacgccagcaagagcagaggcaagatctgcaccatcggcatcgccccctggggcatcgtggagaaccaggaggacctgatcggcagagacgtggtgagaccctaccagaccatgagcaaccccatgagcaagctgaccgtgctgaacagcatgcacagccacttcatcctggccgacaacggcaccaccggcaagtacggcgccgaggtgaagctgagaagacagctggagaagcacatcagcctgcagaagatcaacaccagaatcggccagggcgtgcccgtggtggccctgatcgtggagggcggccccaacgtgatcagcatcgtgctggagtacctgagagacaccccccccgtgcccgtggtggtgtgcgacggcagcggcagagccagcgacatcctggccttcggccacaagtacagcgaggagggcggcctgatcaacgagagcctgagagaccagctgctggtgaccatccagaagaccttcacctacaccagaacccaggcccagcacctgttcatcatcctgatggagtgcatgaagaagaaggagctgatcaccgtgttcagaatgggcagcgagggccaccaggacatcgacctggccatcctgaccgccctgctgaagggcgccaacgccagcgcccccgaccagctgagcctggccctggcctggaacagagtggacatcgccagaagccagatcttcatctacggccagcagtggcccgtgggcagcctggagcaggccatgctggacgccctggtgctggacagagtggacttcgtgaagctgctgatcgagaacggcgtgagcatgcacagattcctgaccatcagcagactggaggagctgtacaacaccagacacggccccagcaacaccctgtaccacctggtgagagacgtgaagaagggcaacctgccccccgactacagaatcagcctgatcgacatcggcctggtgatcgagtacctgatgggcggcgcctacagatgcaactacaccagaaagagattcagaaccctgtaccacaacctgttcggccccaagagacccaaggccctgaagctgctgggcatggaggacgacatccccctgagaagaggcagaaagaccaccaagaagagagaggaggaggtggacatcgacctggacgaccccgagatcaaccacttccccttccccttccacgagctgatggtgtgggccgtgctgatgaagagacagaagatggccctgttcttctggcagcacggcgaggaggccatggccaaggccctggtggcctgcaagctgtgcaaggccatggcccacgaggccagcgagaacgacatggtggacgacatcagccaggagctgaaccacaacagcagagacttcggccagctggccgtggagctgctggaccagagctacaagcaggacgagcagctggccatgaagctgctgacctacgagctgaagaactggagcaacgccacctgcctgcagctggccgtggccgccaagcacagagacttcatcgcccacacctgcagccagatgctgctgaccgacatgtggatgggcagactgagaatgagaaagaacagcggcctgaaggtgatcctgggcatcctgctgccccccagcatcctgagcctggagttcaagaacaaggacgacatgccctacatgagccaggcccaggagatccacctgcaggagaaggaggccgaggagcccgagaagcccaccaaggagaaggaggaggaggacatggagctgaccgccatgctgggcagaaacaacggcgagagcagcagaaagaaggacgaggaggaggtgcagagcaagcacagactgatccccctgggcagaaagatctacgagttctacaacgcccccatcgtgaagttctggttctacaccctggcctacatcggctacctgatgctgttcaactacatcgtgctggtgaagatggagagatggcccagcacccaggagtggatcgtgatcagctacatcttcaccctgggcatcgagaagatgagagagatcctgatgagcgagcccggcaagctgctgcagaaggtgaaggtgtggctgcaggagtactggaacgtgaccgacctgatcgccatcctgctgttcagcgtgggcatgatcctgagactgcaggaccagcccttcagaagcgacggcagagtgatctactgcgtgaacatcatctactggtacatcagactgctggacatcttcggcgtgaacaagtacctgggcccctacgtgatgatgatcggcaagatgatgatcgacatgatgtacttcgtgatcatcatgctggtggtgctgatgagcttcggcgtggccagacaggccatcctgttccccaacgaggagcccagctggaagctggccaagaacatcttctacatgccctactggatgatctacggcgaggtgttcgccgaccagatcgacagaaagcaggtgtacgacagccacacccccaagagcgccccctgcggccagaacgagaccagagaggacggcaagatcatccagctgcccccctgcaagaccggcgcctggatcgtgcccgccatcatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgagagacccgtgctgcccccccccctgatcatcttcagccacatgaccatgatcttccagcacctgtgctgcagatggagaaagcacgagagcgaccccgacgagagagactacggcctgaagctgttcatcaccgacgacgagctgaagaaggtgcacgacttcgaggagcagtgcatcgaggagtacttcagagagaaggacgacagattcaacagcagcaacgacgagagaatcagagtgaccagcgagagagtggagaacatgagcatgagactggaggaggtgaacgagagagagcacagcatgaaggccagcctgcagaccgtggacatcagactggcccagctggaggacctgatcggcagaatggccaccgccctggagagactgaccggcctggagagagccgagagcaacaagatcagaagcagaaccagcagcgactgcaccgacgccgcctacatcgtgagacagagcagcttcaacagccaggagggcaacaccttcaagctgcaggagagcatcgaccccgccggcgaggagaccatgagccccaccagccccaccctgatgcccagaatgagaagccacagcttctacagcgtgaacatgaaggacaagggcggcatcgagaagctggagagcatcttcaaggagagaagcctgagcctgcacagagccaccagcagccacagcgtggccaaggagcccaaggcccccgccgcccccgccaacaccctggccatcgtgcccgacagcagaagacccagcagctgcatcgacatctacgtgagcgccatggacgagctgcactgcgacatcgaccccctggacaacagcgtgaacatcctgggcctgggcgagcccagcttcagcacccccgtgcccagcaccgcccccagcagcagcgcctacgccaccctggcccccaccgacagaccccccagcagaagcatcgacttcgaggacatcaccagcatggacaccagaagcttcagcagcgactacacccacctgcccgagtgccagaacccctgggacagcgagccccccatgtaccacaccatcgagagaagcaagagcagcagatacctggccaccacccccttcctgctggaggaggcccccatcgtgaagagccacagcttcatgttcagccccagcagaagctactacgccaacttcggcgtgcccgtgaagaccgccgagtacaccagcatcaccgactgcatcgacaccagatgcgtgaacgccccccaggccatcgccgacagagccgccttccccggcggcctgggcgacaaggtggaggacctgacctgctgccaccccgagagagaggccgagctgagccaccccagcagcgacagcgaggagaacgaggccaagggcagaagagccaccatcgccatcagcagccaggagggcgacaacagcgagagaaccctgagcaacaacatcaccgtgcccaagatcgagagagccaacagctacagcgccgaggagcccagcgccccctacgcccacaccagaaagagcttcagcatcagcgacaagctggacagacagagaaacaccgccagcctgagaaaccccttccagagaagcaagagcagcaagcccgagggcagaggcgacagcctgagcatgagaagactgagcagaaccagcgccttccagagcttcgagagcaagcacaactag

SEQ ID NO: 103024 - DNA, 4740 bp, Artificial Sequence; identical to SEQ ID NO: 103019
  Description of Artificial Sequence: Synthetic coding sequence

SEQ ID NO: 103025 - DNA, 4701 bp, Artificial Sequence; identical to SEQ ID NO: 103018
  Description of Artificial Sequence: Synthetic coding sequence

SEQ ID NO: 103026 - DNA, 5205 bp, Artificial Sequence
  Description of Artificial Sequence: Synthetic coding sequence
atgggcaagaagtggagagacgccgccgagatggagagaggctgcagcgacagagaggacaacgccgagagcagaagaagaagcagaagcgccagcagaggcagattcgccgagagctggaagagactgagcagcaagcagggcagcaccaagagaagcggcctgcccagccagcagacccccgcccagaagagctggatcgagagagccttctacaagagagagtgcgtgcacatcatccccagcaccaaggacccccacagatgctgctgcggcagactgatcggccagcacgtgggcctgacccccagcatcagcgtgctgcagaacgagaagaacgagagcagactgagcagaaacgacatccagagcgagaagtggagcatcagcaagcacacccagctgagccccaccgacgccttcggcaccatcgagttccagggcggcggccacagcaacaaggccatgtacgtgagagtgagcttcgacaccaagcccgacctgctgctgcacctgatgaccaaggagtggcagctggagctgcccaagctgctgatcagcgtgcacggcggcctgcagaacttcgagctgcagcccaagctgaagcaggtgttcggcaagggcctgatcaaggccgccatgaccaccggcgcctggatcttcaccggcggcgtgaacaccggcgtgatcagacacgtgggcgacgccctgaaggaccacgccagcaagagcagaggcaagatctgcaccatcggcatcgccccctggggcatcgtggagaaccaggaggacctgatcggcagagacgtggtgagaccctaccagaccatgagcaaccccatgagcaagctgaccgtgctgaacagcatgcacagccacttcatcctggccgacaacggcaccaccggcaagtacggcgccgaggtgaagctgagaagacagctggagaagcacatcagcctgcagaagatcaacaccagatgcctgcccttcttcagcctggacagcagactgttctacagcttctggggcagctgccagctggacagcgtgggcatcggccagggcgtgcccgtggtggccctgatcgtggagggcggccccaacgtgatcagcatcgtgctggagtacctgagagacaccccccccgtgcccgtggtggtgtgcgacggcagcggcagagccagcgacatcctggccttcggccacaagtacagcgaggagggcggcctgatcaacgagagcctgagagaccagctgctggtgaccatccagaagaccttcacctacaccagaacccaggcccagcacctgttcatcatcctgatggagtgcatgaagaagaaggagctgatcaccgtgttcagaatgggcagcgagggccaccaggacatcgacctggccatcctgaccgccctgctgaagggcgccaacgccagcgcccccgaccagctgagcctggccctggcctggaacagagtggacatcgccagaagccagatcttcatctacggccagcagtggcccgtgggcagcctggagcaggccatgctggacgccctggtgctggacagagtggacttcgtgaagctgctgatcgagaacggcgtgagcatgcacagattcctgaccatcagcagactggaggagctgtacaacaccagacacggccccagcaacaccctgtaccacctggtgagagacgtgaagaagggcaacctgccccccgactacagaatcagcctgatcgacatcggcctggtgatcgagtacctgatgggcggcgcctacagatgcaactacaccagaaagagattcagaaccctgtaccacaacctgttcggccccaagagacccaaggccctgaagctgctgggcatggaggacgacatccccctgagaagaggcagaaagaccaccaagaagagagaggaggaggtggacatcgacctggacgaccccgagatcaaccacttccccttccccttccacgagctgatggtgtgggccgtgctgatgaagagacagaagatggccctgttcttctggcagcacggcgaggaggccatggccaaggccctggtggcctgcaagctgtgcaaggccatggcccacgaggccagcgagaacgacatggtggacgacatcagccaggagctgaaccacaacagcagagacttcggccagctggccgtggagctgctggaccagagctacaagcaggacgagcagctggccatgaagctgctgacctacgagctgaagaactggagcaacgccacctgcctgcagctggccgtggccgccaagcacagagacttcatcgcccacacctgcagccagatgctgctgaccgacatgtggatgggcagactgagaatgagaaagaacagcggcctgaaggtgatcctgggcatcctgctgccccccagcatcctgagcctggagttcaagaacaaggacgacatgccctacatgagccaggcccaggagatccacctgcaggagaaggaggccgaggagcccgagaagcccaccaaggagaaggaggaggaggacatggagctgaccgccatgctgggcagaaacaacggcgagagcagcagaaagaaggacgaggaggaggtgcagagcaagcacagactgatccccctgggcagaaagatctacgagttctacaacgcccccatcgtgaagttctggttctacaccctggcctacatcggctacctgatgctgttcaactacatcgtgctggtgaagatggagagatggcccagcacccaggagtggatcgtgatcagctacatcttcaccctgggcatcgagaagatgagagagatcctgatgagcgagcccggcaagctgctgcagaaggtgaaggtgtggctgcaggagtactggaacgtgaccgacctgatcgccatcctgctgttcagcgtgggcatgatcctgagactgcaggaccagcccttcagaagcgacggcagagtgatctactgcgtgaacatcatctactggtacatcagactgctggacatcttcggcgtgaacaagtacctgggcccctacgtgatgatgatcggcaagatgatgatcgacatgatgtacttcgtgatcatcatgctggtggtgctgatgagcttcggcgtggccagacaggccatcctgttccccaacgaggagcccagctggaagctggccaagaacatcttctacatgccctactggatgatctacggcgaggtgttcgccgaccagatcgaccccccctgcggccagaacgagaccagagaggacggcaagatcatccagctgcccccctgcaagaccggcgcctggatcgtgcccgccatcatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgagagacccgtgctgcccccccccctgatcatcttcagccacatgaccatgatcttccagcacctgtgctgcagatggagaaagcacgagagcgaccccgacgagagagactacggcctgaagctgttcatcaccgacgacgagctgaagaaggtgcacgacttcgaggagcagtgcatcgaggagtacttcagagagaaggacgacagattcaacagcagcaacgacgagagaatcagagtgaccagcgagagagtggagaacatgagcatgagactggaggaggtgaacgagagagagcacagcatgaaggccagcctgcagaccgtggacatcagactggcccagctggaggacctgatcggcagaatggccaccgccctggagagactgaccggcctggagagagccgagagcaacaagatcagaagcagaaccagcagcgactgcaccgacgccgcctacatcgtgagacagagcagcttcaacagccaggagggcaacaccttcaagctgcaggagagcatcgaccccgccggcgaggagaccatgagccccaccagccccaccctgatgcccagaatgagaagccacagcttctacagcgtgaacatgaaggacaagggcggcatcgagaagctggagagcatcttcaaggagagaagcctgagcctgcacagagccaccagcagccacagcgtggccaaggagcccaaggcccccgccgcccccgccaacaccctggccatcgtgcccgacagcagaagacccagcagctgcatcgacatctacgtgagcgccatggacgagctgcactgcgacatcgaccccctggacaacagcgtgaacatcctgggcctgggcgagcccagcttcagcacccccgtgcccagcaccgcccccagcagcagcgcctacgccaccctggcccccaccgacagaccccccagcagaagcatcgacttcgaggacatcaccagcatggacaccagaagcttcagcagcgactacacccacctgcccgagtgccagaacccctgggacagcgagccccccatgtaccacaccatcgagagaagcaagagcagcagatacctggccaccacccccttcctgctggaggaggcccccatcgtgaagagccacagcttcatgttcagccccagcagaagctactacgccaacttcggcgtgcccgtgaagaccgccgagtacaccagcatcaccgactgcatcgacaccagatgcgtgaacgccccccaggccatcgccgacagagccgccttccccggcggcctgggcgacaaggtggaggacctgacctgctgccaccccgagagagaggccgagctgagccaccccagcagcgacagcgaggagaacgaggccaagggcagaagagccaccatcgccatcagcagccaggagggcgacaacagcgagagaaccctgagcaacaacatcaccgtgcccaagatcgagagagccaacagctacagcgccgaggagcccagcgccccctacgcccacaccagaaagagcttcagcatcagcgacaagctggacagacagagaaacaccgccagcctgagaaaccccttccagagaagcaagagcagcaagcccgagggcagaggcgacagcctgagcatgagaagactgagcagaaccagcgccttccagagcttcgagagcaagcacaactag

SEQ ID NO: 103027 - DNA, 645 bp, Artificial Sequence
  Description of Artificial Sequence: Synthetic coding sequence
atgtacgtgagagtgagcttcgacaccaagcccgacctgctgctgcacctgatgaccaaggagtggcagctggagctgcccaagctgctgatcagcgtgcacggcggcctgcagaacttcgagctgcagcccaagctgaagcaggtgttcggcaagggcctgatcaaggccgccatgaccaccggcgcctggatcttcaccggcggcgtgaacaccggcgtgatcagacacgtgggcgacgccctgaaggaccacgccagcaagagcagaggcaagatctgcaccatcggcatcgccccctggggcatcgtggagaaccaggaggacctgatcggcagagacgtggtgagaccctaccagaccatgagcaaccccatgagcaagctgaccgtgctgaacagcatgcacagccacttcatcctggccgacaacggcaccaccggcaagtacggcgccgaggtgaagctgagaagacagctggagaagcacatcagcctgcagaagatcaacaccagcttccacagctacaagaccgcccacgtggacctgcaggacaagagacaggtgaagaccgccctggagcaggccgagtggcagcccggcagaggcatgttcgaccacgacaacctgatgcagagcacctag

SEQ ID NO: 103028 - DNA, 3645 bp, Artificial Sequence
  Description of Artificial Sequence: Synthetic coding sequence
atggtggtgcccgagaaggagcagagctggatccccaagatcttcaagaagaagacctgcaccaccttcatcgtggacagcaccgaccccggcggcaccctgtgccagtgcggcagacccagaaccgcccaccccgccgtggccatggaggacgccttcggcgccgccgtggtgaccgtgtgggacagcgacgcccacaccaccgagaagcccaccgacgcctacggcgagctggacttcaccggcgccggcagaaagcacagcaacttcctgagactgagcgacagaaccgaccccgccgccgtgtacagcctggtgaccagaacctggggcttcagagcccccaacctggtggtgagcgtgctgggcggcagcggcggccccgtgctgcagacctggctgcaggacctgctgagaagaggcctggtgagagccgcccagagcaccggcgcctggatcgtgaccggcggcctgcacaccggcatcggcagacacgtgggcgtggccgtgagagaccaccagatggccagcaccggcggcaccaaggtggtggccatgggcgtggccccctggggcgtggtgagaaacagagacaccctgatcaaccccaagggcagcttccccgccagatacagatggagaggcgaccccgaggacggcgtgcagttccccctggactacaactacagcgccttcttcctggtggacgacggcacccacggctgcctgggcggcgagaacagattcagactgagactggagagctacatcagccagcagaagaccggcgtgggcggcaccggcatcgacatccccgtgctgctgctgctgatcgacggcgacgagaagatgctgaccagaatcgagaacgccacccaggcccagctgccctgcctgctggtggccggcagcggcggcgccgccgactgcctggccgagaccctggaggacaccctggcccccggcagcggcggcgccagacagggcgaggccagagacagaatcagaagattcttccccaagggcgacctggaggtgctgcaggcccaggtggagagaatcatgaccagaaaggagctgctgaccgtgtacagcagcgaggacggcagcgaggagttcgagaccatcgtgctgaaggccctggtgaaggcctgcggcagcagcgaggccagcgcctacctggacgagctgagactggccgtggcctggaacagagtggacatcgcccagagcgagctgttcagaggcgacatccagtggagaagcttccacctggaggccagcctgatggacgccctgctgaacgacagacccgagttcgtgagactgctgatcagccacggcctgagcctgggccacttcctgacccccatgagactggcccagctgtacagcgccgcccccagcaacagcctgatcagaaacctgctggaccaggccagccacagcgccggcaccaaggcccccgccctgaagggcggcgccgccgagctgagaccccccgacgtgggccacgtgctgagaatgctgctgggcaagatgtgcgcccccagataccccagcggcggcgcctgggacccccaccccggccagggcttcggcgagagcatgtacctgctgagcgacaaggccaccagccccctgagcctggacgccggcctgggccaggccccctggagcgacctgctgctgtgggccctgctgctgaacagagcccagatggccatgtacttctgggagatgggcagcaacgccgtgagcagcgccctgggcgcctgcctgctgctgagagtgatggccagactggagcccgacgccgaggaggccgccagaagaaaggacctggccttcaagttcgagggcatgggcgtggacctgttcggcgagtgctacagaagcagcgaggtgagagccgccagactgctgctgagaagatgccccctgtggggcgacgccacctgcctgcagctggccatgcaggccgacgccagagccttcttcgcccaggacggcgtgcagagcctgctgacccagaagtggtggggcgacatggccagcaccacccccatctgggccctggtgctggccttcttctgcccccccctgatctacaccagactgatcaccttcagaaagagcgaggaggagcccaccagagaggagctggagttcgacatggacagcgtgatcaacggcgagggccccgtgggcaccgccgaccccgccgagaagacccccctgggcgtgcccagacagagcggcagacccggctgctgcggcggcagatgcggcggcagaagatgcctgagaagatggttccacttctggggcgcccccgtgaccatcttcatgggcaacgtggtgagctacctgctgttcctgctgctgttcagcagagtgctgctggtggacttccagcccgccccccccggcagcctggagctgctgctgtacttctgggccttcaccctgctgtgcgaggagctgagacagggcctgagcggcggcggcggcagcctggccagcggcggccccggccccggccacgccagcctgagccagagactgagactgtacctggccgacagctggaaccagtgcgacctggtggccctgacctgcttcctgctgggcgtgggctgcagactgacccccggcctgtaccacctgggcagaaccgtgctgtgcatcgacttcatggtgttcaccgtgagactgctgcacatcttcaccgtgaacaagcagctgggccccaagatcgtgatcgtgagcaagatgatgaaggacgtgttcttcttcctgttcttcctgggcgtgtggctggtggcctacggcgtggccaccgagggcctgctgagacccagagacagcgacttccccagcatcctgagaagagtgttctacagaccctacctgcagatcttcggccagatcccccaggaggacatggacgtggccctgatggagcacagcaactgcagcagcgagcccggcttctgggcccacccccccggcgcccaggccggcacctgcgtgagccagtacgccaactggctggtggtgctgctgctggtgatcttcctgctggtggccaacatcctgctggtgaacctgctgatcgccatgttcagctacaccttcggcaaggtgcagggcaacagcgacctgtactggaaggcccagagatacagactgatcagagagttccacagcagacccgccctggccccccccttcatcgtgatcagccacctgagactgctgctgagacagctgtgcagaagacccagaagcccccagcccagcagccccgccctggagcacttcagagtgtacctgagcaaggaggccgagagaaagctgctgacctgggagagcgtgcacaaggagaacttcctgctggccagagccagagacaagagagagagcgacagcgagagactgaagagaaccagccagaaggtggacctggccctgaagcagctgggccacatcagagagtacgagcagagactgaaggtgctggagagagaggtgcagcagtgcagcagagtgctgggctgggtggccgaggccctgagcagaagcgccctgctgccccccggcggcccccccccccccgacctgcccggcagcaaggactag

SEQ ID NO: 103029 - DNA, 2583 bp, Artificial Sequence
  Description of Artificial Sequence: Synthetic coding sequence
atgctgaccagaatcgagaacgccacccaggcccagctgccctgcctgctggtggccggcagcggcggcgccgccgactgcctggccgagaccctggaggacaccctggcccccggcagcggcggcgccagacagggcgaggccagagacagaatcagaagattcttccccaagggcgacctggaggtgctgcaggcccagagcttccacctggaggccagcctgatggacgccctgctgaacgacagacccgagttcgtgagactgctgatcagccacggcctgagcctgggccacttcctgacccccatgagactggcccagctgtacagcgccgcccccagcaacagcctgatcagaaacctgctggaccaggccagccacagcgccggcaccaaggcccccgccctgaagggcggcgccgccgagctgagaccccccgacgtgggccacgtgctgagaatgctgctgggcaagatgtgcgcccccagataccccagcggcggcgcctgggacccccaccccggccagggcttcggcgagagcatgtacctgctgagcgacaaggccaccagccccctgagcctggacgccggcctgggccaggccccctggagcgacctgctgctgtgggccctgctgctgaacagagcccagatggccatgtacttctgggagatgggcagcaacgccgtgagcagcgccctgggcgcctgcctgctgctgagagtgatggccagactggagcccgacgccgaggaggccgccagaagaaaggacctggccttcaagttcgagggcatgggcgtggacctgttcggcgagtgctacagaagcagcgaggtgagagccgccagactgctgctgagaagatgccccctgtggggcgacgccacctgcctgcagctggccatgcaggccgacgccagagccttcttcgcccaggacggcgtgcagagcctgctgacccagaagtggtggggcgacatggccagcaccacccccatctgggccctggtgctggccttcttctgcccccccctgatctacaccagactgatcaccttcagaaagagcgaggaggagcccaccagagaggagctggagttcgacatggacagcgtgatcaacggcgagggccccgtgggcaccgccgaccccgccgagaagacccccctgggcgtgcccagacagagcggcagacccggctgctgcggcggcagatgcggcggcagaagatgcctgagaagatggttccacttctggggcgcccccgtgaccatcttcatgggcaacgtggtgagctacctgctgttcctgctgctgttcagcagagtgctgctggtggacttccagcccgccccccccggcagcctggagctgctgctgtacttctgggccttcaccctgctgtgcgaggagctgagacagggcctgagcggcggcggcggcagcctggccagcggcggccccggccccggccacgccagcctgagccagagactgagactgtacctggccgacagctggaaccagtgcgacctggtggccctgacctgcttcctgctgggcgtgggctgcagactgacccccggcctgtaccacctgggcagaaccgtgctgtgcatcgacttcatggtgttcaccgtgagactgctgcacatcttcaccgtgaacaagcagctgggccccaagatcgtgatcgtgagcaagatgatgaaggacgtgttcttcttcctgttcttcctgggcgtgtggctggtggcctacggcgtggccaccgagggcctgctgagacccagagacagcgacttccccagcatcctgagaagagtgttctacagaccctacctgcagatcttcggccagatcccccaggaggacatggacgtggccctgatggagcacagcaactgcagcagcgagcccggcttctgggcccacccccccggcgcccaggccggcacctgcgtgagccagtacgccaactggctggtggtgctgctgctggtgatcttcctgctggtggccaacatcctgctggtgaacctgctgatcgccatgttcagctacaccttcggcaaggtgcagggcaacagcgacctgtactggaaggcccagagatacagactgatcagagagttccacagcagacccgccctggccccccccttcatcgtgatcagccacctgagactgctgctgagacagctgtgcagaagacccagaagcccccagcccagcagccccgccctggagcacttcagagtgtacctgagcaaggaggccgagagaaagctgctgacctgggagagcgtgcacaaggagaacttcctgctggccagagccagagacaagagagagagcgacagcgagagactgaagagaaccagccagaaggtggacctggccctgaagcagctgggccacatcagagagtacgagcagagactgaaggtgctggagagagaggtgcagcagtgcagcagagtgctgggctgggtggccgaggccctgagcagaagcgccctgctgccccccggcggcccccccccccccgacctgcccggcagcaaggactag

SEQ ID NO: 103030 - DNA, 3210 bp, Artificial Sequence
  Description of Artificial Sequence: Synthetic coding sequence
atggtggtgcccgagaaggagcagagctggatccccaagatcttcaagaagaagacctgcaccaccttcatcgtggacagcaccgaccccggcggcaccctgtgccagtgcggcagacccagaaccgcccaccccgccgtggccatggaggacgccttcggcgccgccgtggtgaccgtgtgggacagcgacgcccacaccaccgagaagcccaccgacgcctacggcgagctggacttcaccggcgccggcagaaagcacagcaacttcctgagactgagcgacagaaccgaccccgccgccgtgtacagcctggtgaccagaacctggggcttcagagcccccaacctggtggtgagcgtgctgggcggcagcggcggccccgtgctgcagacctggctgcaggacctgctgagaagaggcctggtgagagccgcccagagcaccggcgcctggatcgtgaccggcggcctgcacaccggcatcggcagacacgtgggcgtggccgtgagagaccaccagatggccagcaccggcggcaccaaggtggtggccatgggcgtggccccctggggcgtggtgagaaacagagacaccctgatcaaccccaagggcagcttccccgccagatacagatggagaggcgaccccgaggacggcgtgcagttccccctggactacaactacagcgccttcttcctggtggacgacggcacccacggctgcctgggcggcgagaacagattcagactgagactggagagctacatcagccagcagaagaccggcgtgggcggcaccggcatcgacatccccgtgctgctgctgctgatcgacggcgacgagaagatgctgaccagaatcgagaacgccacccaggcccagctgccctgcctgctggtggccggcagcggcggcgccgccgactgcctggccgagaccctggaggacaccctggcccccggcagcggcggcgccagacagggcgaggccagagacagaatcagaagattcttccccaagggcgacctggaggtgctgcaggcccaggtggagagaatcatgaccagaaaggagctgctgaccgtgtacagcagcgaggacggcagcgaggagttcgagaccatcgtgctgaaggccctggtgaaggcctgcggcagcagcgaggccagcgcctacctggacgagctgagactggccgtggcctggaacagagtggacatcgcccagagcgagctgttcagaggcgacatccagtggagaagcttccacctggaggccagcctgatggacgccctgctgaacgacagacccgagttcgtgagactgctgatcagccacggcctgagcctgggccacttcctgacccccatgagactggcccagctgtacagcgccgcccccagcaacagcctgatcagaaacctgctggaccaggccagccacagcgccggcaccaaggcccccgccctgaagggcggcgccgccgagctgagaccccccgacgtgggccacgtgctgagaatgctgctgggcaagatgtgcgcccccagataccccagcggcggcgcctgggacccccaccccggccagggcttcggcgagagcatgtacctgctgagcgacaaggccaccagccccctgagcctggacgccggcctgggccaggccccctggagcgacctgctgctgtgggccctgctgctgaacagagcccagatggccatgtacttctgggagatgggcagcaacgccgtgagcagcgccctgggcgcctgcctgctgctgagagtgatggccagactggagcccgacgccgaggaggccgccagaagaaaggacctggccttcaagttcgagggcatgggcgtggacctgttcggcgagtgctacagaagcagcgaggtgagagccgccagactgctgctgagaagatgccccctgtggggcgacgccacctgcctgcagctggccatgcaggccgacgccagagccttcttcgcccaggacggcgtgcagagcctgctgacccagaagtggtggggcgacatggccagcaccacccccatctgggccctggtgctggccttcttctgcccccccctgatctacaccagactgatcaccttcagaaagagcgaggaggagcccaccagagaggagctggagttcgacatggacagcgtgatcaacggcgagggccccgtgggcctgacccccggcctgtaccacctgggcagaaccgtgctgtgcatcgacttcatggtgttcaccgtgagactgctgcacatcttcaccgtgaacaagcagctgggccccaagatcgtgatcgtgagcaagatgatgaaggacgtgttcttcttcctgttcttcctgggcgtgtggctggtggcctacggcgtggccaccgagggcctgctgagacccagagacagcgacttccccagcatcctgagaagagtgttctacagaccctacctgcagatcttcggccagatcccccaggaggacatggacgtggccctgatggagcacagcaactgcagcagcgagcccggcttctgggcccacccccccggcgcccaggccggcacctgcgtgagccagtacgccaactggctggtggtgctgctgctggtgatcttcctgctggtggccaacatcctgctggtgaacctgctgatcgccatgttcagctacaccttcggcaaggtgcagggcaacagcgacctgtactggaaggcccagagatacagactgatcagagagttccacagcagacccgccctggccccccccttcatcgtgatcagccacctgagactgctgctgagacagctgtgcagaagacccagaagcccccagcccagcagccccgccctggagcacttcagagtgtacctgagcaaggaggccgagagaaagctgctgacctgggagagcgtgcacaaggagaacttcctgctggccagagccagagacaagagagagagcgacagcgagagactgaagagaaccagccagaaggtggacctggccctgaagcagctgggccacatcagagagtacgagcagagactgaaggtgctggagagagaggtgcagcagtgcagcagagtgctgggctgggtggccgaggccctgagcagaagcgccctgctgccccccggcggcccccccccccccgacctgcccggcagcaaggactag

SEQ ID NO: 103031 - DNA, 3498 bp, Artificial Sequence
  Description of Artificial Sequence: Synthetic coding sequence
atgcaggacgtgcagggccccagacccggcagccccggcgacgccgaggacagaagagagctgggcctgcacagaggcgaggtgaacttcggcggcagcggcaagaagagaggcaagttcgtgagagtgcccagcggcgtggcccccagcgtgctgttcgacctgctgctggccgagtggcacctgcccgcccccaacctggtggtgagcctggtgggcgaggagcagcccttcgccatgaagagctggctgagagacgtgctgagaaagggcctggtgaaggccgcccagagcaccggcgcctggatcctgaccagcgccctgagagtgggcctggccagacacgtgggccaggccgtgagagaccacagcctggccagcaccagcaccaaggtgagagtggtggccgtgggcatggccagcctgggcagagtgctgcacagaagaatcctggaggaggcccaggaggacttccccgtgcactaccccgaggacgacggcggcagccagggccccctgtgcagcctggacagcaacctgagccacttcatcctggtggagcccggcccccccggcaagggcgacggcctgaccgagctgagactgagactggagaagcacatcagcgagcagagagccggctacggcggcaccggcagcatcgagatccccgtgctgtgcctgctggtgaacggcgaccccaacaccctggagagaatcagcagagccgtggagcaggccgccccctggctgatcctggtgggcagcggcggcatcgccgacgtgctggccgccctggtgaaccagccccacctgctggtgcccaaggtggccgagaagcagttcaaggagaagttccccagcaagcacttcagctgggaggacatcgtgagatggaccaagctgctgcagaacatcaccagccaccagcacctgctgaccgtgtacgacttcgagcaggagggcagcgaggagctggacaccgtgatcctgaaggccctggtgaaggcctgcaagagccacagccaggagccccaggactacctggacgagctgaagctggccgtggcctgggacagagtggacatcgccaagagcgagatcttcaacggcgacgtggagtggaagagctgcgacctggaggaggtgatggtggacgccctggtgagcaacaagcccgagttcgtgagactgttcgtggacaacggcgccgacgtggccgacttcctgacctacggcagactgcaggagctgtacagaagcgtgagcagaaagagcctgctgttcgacctgctgcagagaaagcaggaggaggccagactgaccctggccggcctgggcacccagcaggccagagagccccccgccggcccccccgccttcagcctgcacgaggtgagcagagtgctgaaggacttcctgcaggacgcctgcagaggcttctaccaggacggcagacccggcgacagaagaagagccgagaagggccccgccaagagacccaccggccagaagtggctgctggacctgaaccagaagagcgagaacccctggagagacctgttcctgtgggccgtgctgcagaacagacacgagatggccacctacttctgggccatgggccaggagggcgtggccgccgccctggccgcctgcaagatcctgaaggagatgagccacctggagaccgaggccgaggccgccagagccaccagagaggccaagtacgagagactggccctggacctgttcagcgagtgctacagcaacagcgaggccagagccttcgccctgctggtgagaagaaacagatgctggagcaagaccacctgcctgcacctggccaccgaggccgacgccaaggccttcttcgcccacgacggcgtgcaggccttcctgaccagaatctggtggggcgacatggccgccggcacccccatcctgagactgctgggcgccttcctgtgccccgccctggtgtacaccaacctgatcaccttcagcgaggaggcccccctgagaaccggcctggaggacctgcaggacctggacagcctggacaccgagaagagccccctgtacggcctgcagagcagagtggaggagctggtggaggcccccagagcccagggcgacagaggccccagagccgtgttcctgctgaccagatggagaaagttctggggcgcccccgtgaccgtgttcctgggcaacgtggtgatgtacttcgccttcctgttcctgttcacctacgtgctgctggtggacttcagaccccccccccagggccccagcggccccgaggtgaccctgtacttctgggtgttcaccctggtgctggaggagatcagacagggcttcttcaccgacgaggacacccacctggtgaagaagttcaccctgtacgtgggcgacaactggaacaagtgcgacatggtggccatcttcctgttcatcgtgggcgtgacctgcagaatgctgcccagcgccttcgaggccggcagaaccgtgctggccatggacttcatggtgttcaccctgagactgatccacatcttcgccatccacaagcagctgggccccaagatcatcgtggtggagagaatgatgaaggacgtgttcttcttcctgttcttcctgagcgtgtggctggtggcctacggcgtgaccacccaggccctgctgcacccccacgacggcagactggagtggatcttcagaagagtgctgtacagaccctacctgcagatcttcggccagatccccctggacgagatcgacgaggccagagtgaactgcagcacccaccccctgctgctggaggacagccccagctgccccagcctgtacgccaactggctggtgatcctgctgctggtgaccttcctgctggtgaccaacgtgctgctgatgaacctgctgatcgccatgttcagctacaccttccaggtggtgcagggcaacgccgacatgttctggaagttccagagatacaacctgatcgtggagtaccacgagagacccgccctggccccccccttcatcctgctgagccacctgagcctgaccctgagaagagtgttcaagaaggaggccgagcacaagagagagcacctggagagagacctgcccgaccccctggaccagaaggtggtgacctgggagaccgtgcagaaggagaacttcctgagcaagatggagaagagaagaagagacagcgagggcgaggtgctgagaaagaccgcccacagagtggacttcatcgccaagtacctgggcggcctgagagagcaggagaagagaatcaagtgcctggagagccagatcaactactgcagcgtgctggtgagcagcgtggccgacgtgctggcccagggcggcggccccagaagcagccagcactgcggcgagggcagccagctggtggccgccgaccacagaggcggcctggacggctgggagcagcccggcgccggccagccccccagcgacacctag

SEQ ID NO: 103032 - DNA, 2619 bp, Artificial Sequence
  Description of Artificial Sequence: Synthetic coding sequence
atgcaggacgtgcagggccccagacccggcagccccggcgacgccgaggacagaagagagctgggcctgcacagaggcgaggtgaacttcggcggcagcggcaagaagagaggcaagttcgtgagagtgcccagcggcgtggcccccagcgtgctgttcgacctgctgctggccgagtggcacctgcccgcccccaacctggtggtgagcctggtgggcgaggagcagcccttcgccatgaagagctggctgagagacgtgctgagaaagggcctggtgaaggccgcccagagcaccggcgcctggatcctgaccagcgccctgagagtgggcctggccagacacgtgggccaggccgtgagagaccacagcctggccagcaccagcaccaaggtgagagtggtggccgtgggcatggccagcctgggcagagtgctgcacagaagaatcctggaggaggcccaggaggacttccccgtgcactaccccgaggacgacggcggcagccagggccccctgtgcagcctggacagcaacctgagccacttcatcctggtggagcccggcccccccggcaagggcgacggcctgaccgagctgagactgagactggagaagcacatcagcgagcagagagccggctacggcggcaccggcagcatcgagatccccgtgctgtgcctgctggtgaacggcgaccccaacaccctggagagaatcagcagagccgtggagcaggccgccccctggctgatcctggtgggcagcggcggcatcgccgacgtgctggccgccctggtgaaccagccccacctgctggtgcccaaggtggccgagaagcagttcaaggagaagttccccagcaagcacttcagctgggaggacatcgtgagatggaccaagctgctgcagaacatcaccagccaccagcacctgctgaccgtgtacgacttcgagcaggagggcagcgaggagctggacaccgtgatcctgaaggccctggtgaaggcctgcaagagccacagccaggagccccaggactacctggacgagctgaagctggccgtggcctgggacagagtggacatcgccaagagcgagatcttcaacggcgacgtggagtggaagagctgcgacctggaggaggtgatggtggacgccctggtgagcaacaagcccgagttcgtgagactgttcgtggacaacggcgccgacgtggccgacttcctgacctacggcagactgcaggagctgtacagaagcgtgagcagaaagagcctgctgttcgacctgctgcagagaaagcaggaggaggccagactgaccctggccggcctgggcacccagcaggccagagagccccccgccggcccccccgccttcagcctgcacgaggtgagcagagtgctgaaggacttcctgcaggacgcctgcagaggcttctaccaggacggcagacccggcgacagaagaagagccgagaagggccccgccaagagacccaccggccagaagtggctgctggacctgaaccagaagagcgagaacccctggagagacctgttcctgtgggccgtgctgcagaacagacacgagatggccacctacttctgggccatgggccaggagggcgtggccgccgccctggccgcctgcaagatcctgaaggagatgagccacctggagaccgaggccgaggccgccagagccaccagagaggccaagtacgagagactggccctggacctgttcagcgagtgctacagcaacagcgaggccagagccttcgccctgctggtgagaagaaacagatgctggagcaagaccacctgcctgcacctggccaccgaggccgacgccaaggccttcttcgcccacgacggcgtgcaggccttcctgaccagaatctggtggggcgacatggccgccggcacccccatcctgagactgctgggcgccttcctgtgccccgccctggtgtacaccaacctgatcaccttcagcgaggaggcccccctgagaaccggcctggaggacctgcaggacctggacagcctggacaccgagaagagccccctgtacggcctgcagagcagagtggaggagctggtggaggcccccagagcccagggcgacagaggccccagagccgtgttcctgctgaccagatggagaaagttctggggcgcccccgtgaccgtgttcctgggcaacgtggtgatgtacttcgccttcctgttcctgttcacctacgtgctgctggtggacttcagaccccccccccagggccccagcggccccgaggtgaccctgtacttctgggtgttcaccctggtgctggaggagatcagacagggcttcttcaccgacgaggacacccacctggtgaagaagttcaccctgtacgtgggcgacaactggaacaagtgcgacatggtggccatcttcctgttcatcgtgggcgtgacctgcagaatgctgcccagcgccttcgaggccggcagaaccgtgctggccatggacttcatggtgttcaccctgagactgatccacatcttcgccatccacaagcagctgggccccaagatcatcgtggtggagagaatgaagcccgtgtag

SEQ ID NO: 103033 - DNA, 3504 bp, Artificial Sequence
  Description of Artificial Sequence: Synthetic coding sequence
atgcaggacgtgcagggccccagacccggcagccccggcgacgccgaggacagaagagagctgggcctgcacagaggcgaggtgaacttcggcggcagcggcaagaagagaggcaagttcgtgagagtgcccagcggcgtggcccccagcgtgctgttcgacctgctgctggccgagtggcacctgcccgcccccaacctggtggtgagcctggtgggcgaggagcagcccttcgccatgaagagctggctgagagacgtgctgagaaagggcctggtgaaggccgcccagagcaccggcgcctggatcctgaccagcgccctgagagtgggcctggccagacacgtgggccaggccgtgagagaccacagcctggccagcaccagcaccaaggtgagagtggtggccgtgggcatggccagcctgggcagagtgctgcacagaagaatcctggaggaggcccaggtgcacgaggacttccccgtgcactaccccgaggacgacggcggcagccagggccccctgtgcagcctggacagcaacctgagccacttcatcctggtggagcccggcccccccggcaagggcgacggcctgaccgagctgagactgagactggagaagcacatcagcgagcagagagccggctacggcggcaccggcagcatcgagatccccgtgctgtgcctgctggtgaacggcgaccccaacaccctggagagaatcagcagagccgtggagcaggccgccccctggctgatcctggtgggcagcggcggcatcgccgacgtgctggccgccctggtgaaccagccccacctgctggtgcccaaggtggccgagaagcagttcaaggagaagttccccagcaagcacttcagctgggaggacatcgtgagatggaccaagctgctgcagaacatcaccagccaccagcacctgctgaccgtgtacgacttcgagcaggagggcagcgaggagctggacaccgtgatcctgaaggccctggtgaaggcctgcaagagccacagccaggagccccaggactacctggacgagctgaagctggccgtggcctgggacagagtggacatcgccaagagcgagatcttcaacggcgacgtggagtggaagagctgcgacctggaggaggtgatggtggacgccctggtgagcaacaagcccgagttcgtgagactgttcgtggacaacggcgccgacgtggccgacttcctgacctacggcagactgcaggagctgtacagaagcgtgagcagaaagagcctgctgttcgacctgctgcagagaaagcaggaggaggccagactgaccctggccggcctgggcacccagcaggccagagagccccccgccggcccccccgccttcagcctgcacgaggtgagcagagtgctgaaggacttcctgcaggacgcctgcagaggcttctaccaggacggcagacccggcgacagaagaagagccgagaagggccccgccaagagacccaccggccagaagtggctgctggacctgaaccagaagagcgagaacccctggagagacctgttcctgtgggccgtgctgcagaacagacacgagatggccacctacttctgggccatgggccaggagggcgtggccgccgccctggccgcctgcaagatcctgaaggagatgagccacctggagaccgaggccgaggccgccagagccaccagagaggccaagtacgagagactggccctggacctgttcagcgagtgctacagcaacagcgaggccagagccttcgccctgctggtgagaagaaacagatgctggagcaagaccacctgcctgcacctggccaccgaggccgacgccaaggccttcttcgcccacgacggcgtgcaggccttcctgaccagaatctggtggggcgacatggccgccggcacccccatcctgagactgctgggcgccttcctgtgccccgccctggtgtacaccaacctgatcaccttcagcgaggaggcccccctgagaaccggcctggaggacctgcaggacctggacagcctggacaccgagaagagccccctgtacggcctgcagagcagagtggaggagctggtggaggcccccagagcccagggcgacagaggccccagagccgtgttcctgctgaccagatggagaaagttctggggcgcccccgtgaccgtgttcctgggcaacgtggtgatgtacttcgccttcctgttcctgttcacctacgtgctgctggtggacttcagaccccccccccagggccccagcggccccgaggtgaccctgtacttctgggtgttcaccctggtgctggaggagatcagacagggcttcttcaccgacgaggacacccacctggtgaagaagttcaccctgtacgtgggcgacaactggaacaagtgcgacatggtggccatcttcctgttcatcgtgggcgtgacctgcagaatgctgcccagcgccttcgaggccggcagaaccgtgctggccatggacttcatggtgttcaccctgagactgatccacatcttcgccatccacaagcagctgggccccaagatcatcgtggtggagagaatgatgaaggacgtgttcttcttcctgttcttcctgagcgtgtggctggtggcctacggcgtgaccacccaggccctgctgcacccccacgacggcagactggagtggatcttcagaagagtgctgtacagaccctacctgcagatcttcggccagatccccctggacgagatcgacgaggccagagtgaactgcagcacccaccccctgctgctggaggacagccccagctgccccagcctgtacgccaactggctggtgatcctgctgctggtgaccttcctgctggtgaccaacgtgctgctgatgaacctgctgatcgccatgttcagctacaccttccaggtggtgcagggcaacgccgacatgttctggaagttccagagatacaacctgatcgtggagtaccacgagagacccgccctggccccccccttcatcctgctgagccacctgagcctgaccctgagaagagtgttcaagaaggaggccgagcacaagagagagcacctggagagagacctgcccgaccccctggaccagaaggtggtgacctgggagaccgtgcagaaggagaacttcctgagcaagatggagaagagaagaagagacagcgagggcgaggtgctgagaaagaccgcccacagagtggacttcatcgccaagtacctgggcggcctgagagagcaggagaagagaatcaagtgcctggagagccagatcaactactgcagcgtgctggtgagcagcgtggccgacgtgctggcccagggcggcggccccagaagcagccagcactgcggcgagggcagccagctggtggccgccgaccacagaggcggcctggacggctgggagcagcccggcgccggccagccccccagcgacacctag

SEQ ID NO: 103034 - DNA, 3480 bp, Artificial Sequence
  Description of Artificial Sequence: Synthetic coding sequence
cccggcagccccggcgacgccgaggacagaagagagctgggcctgcacagaggcgaggtgaacttcggcggcagcggcaagaagagaggcaagttcgtgagagtgcccagcggcgtggcccccagcgtgctgttcgacctgctgctggccgagtggcacctgcccgcccccaacctggtggtgagcctggtgggcgaggagcagcccttcgccatgaagagctggctgagagacgtgctgagaaagggcctggtgaaggccgcccagagcaccggcgcctggatcctgaccagcgccctgagagtgggcctggccagacacgtgggccaggccgtgagagaccacagcctggccagcaccagcaccaaggtgagagtggtggccgtgggcatggccagcctgggcagagtgctgcacagaagaatcctggaggaggcccaggtgcacgaggacttccccgtgcactaccccgaggacgacggcggcagccagggccccctgtgcagcctggacagcaacctgagccacttcatcctggtggagcccggcccccccggcaagggcgacggcctgaccgagctgagactgagactggagaagcacatcagcgagcagagagccggctacggcggcaccggcagcatcgagatccccgtgctgtgcctgctggtgaacggcgaccccaacaccctggagagaatcagcagagccgtggagcaggccgccccctggctgatcctggtgggcagcggcggcatcgccgacgtgctggccgccctggtgaaccagccccacctgctggtgcccaaggtggccgagaagcagttcaaggagaagttccccagcaagcacttcagctgggaggacatcgtgagatggaccaagctgctgcagaacatcaccagccaccagcacctgctgaccgtgtacgacttcgagcaggagggcagcgaggagctggacaccgtgatcctgaaggccctggtgaaggcctgcaagagccacagccaggagccccaggactacctggacgagctgaagctggccgtggcctgggacagagtggacatcgccaagagcgagatcttcaacggcgacgtggagtggaagagctgcgacctggaggaggtgatggtggacgccctggtgagcaacaagcccgagttcgtgagactgttcgtggacaacggcgccgacgtggccgacttcctgacctacggcagactgcaggagctgtacagaagcgtgagcagaaagagcctgctgttcgacctgctgcagagaaagcaggaggaggccagactgaccctggccggcctgggcacccagcaggccagagagccccccgccggcccccccgccttcagcctgcacgaggtgagcagagtgctgaaggacttcctgcaggacgcctgcagaggcttctaccaggacggcagacccggcgacagaagaagagccgagaagggccccgccaagagacccaccggccagaagtggctgctggacctgaaccagaagagcgagaacccctggagagacctgttcctgtgggccgtgctgcagaacagacacgagatggccacctacttctgggccatgggccaggagggcgtggccgccgccctggccgcctgcaagatcctgaaggagatgagccacctggagaccgaggccgaggccgccagagccaccagagaggccaagtacgagagactggccctggacctgttcagcgagtgctacagcaacagcgaggccagagccttcgccctgctggtgagaagaaacagatgctggagcaagaccacctgcctgcacctggccaccgaggccgacgccaaggccttcttcgcccacgacggcgtgcaggccttcctgaccagaatctggtggggcgacatggccgccggcacccccatcctgagactgctgggcgccttcctgtgccccgccctggtgtacaccaacctgatcaccttcagcgaggaggcccccctgagaaccggcctggaggacctgcaggacctggacagcctggacaccgagaagagccccctgtacggcctgcagagcagagtggaggagctggtggaggcccccagagcccagggcgacagaggccccagagccgtgttcctgctgaccagatggagaaagttctggggcgcccccgtgaccgtgttcctgggcaacgtggtgatgtacttcgccttcctgttcctgttcacctacgtgctgctggtggacttcagaccccccccccagggccccagcggccccgaggtgaccctgtacttctgggtgttcaccctggtgctggaggagatcagacagggcttcttcaccgacgaggacacccacctggtgaagaagttcaccctgtacgtgggcgacaactggaacaagtgcgacatggtggccatcttcctgttcatcgtgggcgtgacctgcagaatgctgcccagcgccttcgaggccggcagaaccgtgctggccatggacttcatggtgttcaccctgagactgatccacatcttcgccatccacaagcagctgggccccaagatcatcgtggtggagagaatgatgaaggacgtgttcttcttcctgttcttcctgagcgtgtggctggtggcctacggcgtgaccacccaggccctgctgcacccccacgacggcagactggagtggatcttcagaagagtgctgtacagaccctacctgcagatcttcggccagatccccctggacgagatcgacgaggccagagtgaactgcagcacccaccccctgctgctggaggacagccccagctgccccagcctgtacgccaactggctggtgatcctgctgctggtgaccttcctgctggtgaccaacgtgctgctgatgaacctgctgatcgccatgttcagctacaccttccaggtggtgcagggcaacgccgacatgttctggaagttccagagatacaacctgatcgtggagtaccacgagagacccgccctggccccccccttcatcctgctgagccacctgagcctgaccctgagaagagtgttcaagaaggaggccgagcacaagagagagcacctggagagagacctgcccgaccccctggaccagaaggtggtgacctgggagaccgtgcagaaggagaacttcctgagcaagatggagaagagaagaagagacagcgagggcgaggtgctgagaaagaccgcccacagagtggacttcatcgccaagtacctgggcggcctgagagagcaggagaagagaatcaagtgcctggagagccagatcaactactgcagcgtgctggtgagcagcgtggccgacgtgctggcccagggcggcggccccagaagcagccagcactgcggcgagggcagccagctggtggccgccgaccacagaggcggcctggacggctgggagcagcccggcgccggccagccccccagcgacacctag

SEQ ID NO: 103035 - DNA, 3402 bp, Artificial Sequence
  Description of Artificial Sequence: Synthetic coding sequence
atgctgagaccccaggtgaaggaggagatcatctgcatgatccagaacaccttcaacttcagcctgaagcagagcaagcacctgttccagatcctgatggagtgcatggtgcacagagactgcatcaccatcttcgacgccgacagcgaggagcagcaggacctggacctggccatcctgaccgccctgctgaagggcaccaacctgagcgccagcgagcagctgaacctggccatggcctgggacagagtggacatcgccaagaagcacatcctgatctacgagcagcactggaagcccgacgccctggagcaggccatgagcgacgccctggtgatggacagagtggacttcgtgaagctgctgatcgagtacggcgtgaacctgcacagattcctgaccatccccagactggaggagctgtacaacaccaagcagggccccaccaacaccctgctgcaccacctggtgcaggacgtgaagcagcacaccctgctgagcggctacagaatcaccctgatcgacatcggcctggtggtggagtacctgatcggcagagcctacagaagcaactacaccagaaagcacttcagagccctgtacaacaacctgtacagaaagtacaagcaccagagacacagcagcggcaacagaaacgagagcgccgagagcaccctgcacagccagttcatcagaaccgcccagccctacaagttcaaggagaagagcatcgtgctgcacaagagcagaaagaagagcaaggagcagaacgtgagcgacgaccccgagagcaccggcttcctgtacccctacaacgacctgctggtgtgggccgtgctgatgaagagacagaagatggccatgttcttctggcagcacggcgaggaggccaccgtgaaggccgtgatcgcctgcatcctgtacagagccatggcccacgaggccaaggagagccacatggtggacgacgccagcgaggagctgaagaactacagcaagcagttcggccagctggccctggacctgctggagaaggccttcaagcagaacgagagaatggccatgaccctgctgacctacgagctgagaaactggagcaacagcacctgcctgaagctggccgtgagcggcggcctgagacccttcgtgagccacacctgcacccagatgctgctgaccgacatgtggatgggcagactgaagatgagaaagaacagctggctgaagatcatcatcagcatcatcctgccccccaccatcctgaccctggagttcaagagcaaggccgagatgagccacgtgccccagagccaggacttccagttcatgtggtactacagcgaccagaacgccagcagcagcaaggagagcgccagcgtgaaggagtacgacctggagagaggccacgacgagaagctggacgagaaccagcacttcggcctggagagcggccaccagcacctgccctggaccagaaaggtgtacgagttctacagcgcccccatcgtgaagttctggttctacaccatggcctacctggccttcctgatgctgttcacctacaccgtgctggtggagatgcagccccagcccagcgtgcaggagtggctggtgagcatctacatcttcaccaacgccatcgaggtggtgagagagatctgcatcagcgagcccggcaagttcacccagaaggtgaaggtgtggatcagcgagtactggaacctgaccgagaccgtggccatcggcctgttcagcgccggcttcgtgctgagatggggcgacccccccttccacaccgccggcagactgatctactgcatcgacatcatcttctggttcagcagactgctggacttcttcgccgtgaaccagcacgccggcccctacgtgaccatgatcgccaagatgaccgccaacatgttctacatcgtgatcatcatggccatcgtgctgctgagcttcggcgtggccagaaaggccatcctgagccccaaggagccccccagctggagcctggccagagacatcgtgttcgagccctactggatgatctacggcgaggtgtacgccggcgagatcgacgtgtgcagcagccagcccagctgcccccccggcagcttcctgacccccttcctgcaggccgtgtacctgttcgtgcagtacatcatcatggtgaacctgctgatcgccttcttcaacaacgtgtacctggacatggagagcatcagcaacaacctgtggaagtacaacagatacagatacatcatgacctaccacgagaagccctggctgcccccccccctgatcctgctgagccacgtgggcctgctgctgagaagactgtgctgccacagagccccccacgaccaggaggagggcgacgtgggcctgaagctgtacctgagcaaggaggacctgaagaagctgcacgacttcgaggagcagtgcgtggagaagtacttccacgagaagatggaggacgtgaactgcagctgcgaggagagaatcagagtgaccagcgagagagtgaccgagatgtacttccagctgaaggagatgaacgagaaggtgagcttcatcaaggacagcctgctgagcctggacagccaggtgggccacctgcaggacctgagcgccctgaccgtggacaccctgaaggtgctgagcgccgtggacaccctgcaggaggacgaggccctgctggccaagagaaagcacagcacctgcaagaagctgccccacagctggagcaacgtgatctgcgccgaggtgctgggcagcatggagatcgccggcgagaagaagtaccagtactacagcatgcccagcagcctgctgagaagcctggccggcggcagacacccccccagagtgcagagaggcgccctgctggagatcaccaacagcaagagagaggccaccaacgtgagaaacgaccaggagagacaggagacccagagcagcatcgtggtgagcggcgtgagccccaacagacaggcccacagcaagtacggccagttcctgctggtgcccagcaacctgaagagagtgcccttcagcgccgagaccgtgctgcccctgagcagacccagcgtgcccgacgtgctggccaccgagcaggacatccagaccgaggtgctggtgcacctgaccggccagacccccgtggtgagcgactgggccagcgtggacgagcccaaggagaagcacgagcccatcgcccacctgctggacggccaggacaaggccgagcaggtgctgcccaccctgagctgcacccccgagcccatgaccatgagcagccccctgagaagatacagacccttcgccagaagccacagcttcagattccacaaggaggagaagctgatgaagatctgcaagatcaagagcaaggagtag

SEQ ID NO: 103036 - DNA, 912 bp, Artificial Sequence
  Description of Artificial Sequence: Synthetic coding sequence
atgaaggagcagcccgtgctggagagactgcagagccagaagagctggatcaagggcgtgttcgacaagagagagtgcagcaccatcatccccagcagcaagaacccccacagatgcacccccgtgtgccaggtgtgccagaacctgatcagatgctactgcggcagactgatcggcgaccacgccggcatcgactacagctggaccatcagcgccgccaagggcaaggagagcgagcagtggagcgtggagaagcacaccaccaagagccccaccgacaccttcggcaccatcaacttccaggacggcgagcacacccaccacgccaagtacatcagaaccagctacgacaccaagctggaccacctgctgcacctgatgctgaaggagtggaagatggagctgcccaagctggtgatcagcgtgcacggcggcatccagaacttcaccatgcccagcaagttcaaggagatcttcagccagggcctggtgaaggccgccgagaccaccggcgcctggatcatcaccgagggcatcaacaccggcgtgagcaagcacgtgggcgacgccctgaagagccacagcagccacagcctgagaaagatctggaccgtgggcatccccccctggggcgtgatcgagaaccagagagacctgatcggcaaggacgtggtgtgcctgtaccagaccctggacaaccccctgagcaagctgaccaccctgaacagcatgcacagccacttcatcctgagcgacgacggcaccgtgggcaagtacggcaacgagatgaagctgagaagaaacctggagaagtacctgagcctgcagaagatccactgcagagagtaccacagaggcagcgtgacccagagcggctgcagacccgccgaggtgttccacggcctgccctag

SEQ ID NO: 103037 - DNA, 6069 bp, Artificial Sequence
  Description of Artificial Sequence: Synthetic coding sequence
atgaaggagcagcccgtgctggagagactgcagagccagaagagctggatcaagggcgtgttcgacaagagagagtgcagcaccatcatccccagcagcaagaacccccacagatgcacccccgtgtgccaggtgtgccagaacctgatcagatgctactgcggcagactgatcggcgaccacgccggcatcgactacagctggaccatcagcgccgccaagggcaaggagagcgagcagtggagcgtggagaagcacaccaccaagagccccaccgacaccttcggcaccatcaacttccaggacggcgagcacacccaccacgccaagtacatcagaaccagctacgacaccaagctggaccacctgctgcacctgatgctgaaggagtggaagatggagctgcccaagctggtgatcagcgtgcacggcggcatccagaacttcaccatgcccagcaagttcaaggagatcttcagccagggcctggtgaaggccgccgagaccaccggcgcctggatcatcaccgagggcatcaacaccggcgtgagcaagcacgtgggcgacgccctgaagagccacagcagccacagcctgagaaagatctggaccgtgggcatccccccctggggcgtgatcgagaaccagagagacctgatcggcaaggacgtggtgtgcctgtaccagaccctggacaaccccctgagcaagctgaccaccctgaacagcatgcacagccacttcatcctgagcgacgacggcaccgtgggcaagtacggcaacgagatgaagctgagaagaaacctggagaagtacctgagcctgcagaagatccactgcagaagcagacagggcgtgcccgtggtgggcctggtggtggagggcggccccaacgtgatcctgagcgtgtgggagaccgtgaaggacaaggaccccgtggtggtgtgcgagggcaccggcagagccgccgacctgctggccttcacccacaagcacctggccgacgagggcatgctgagaccccaggtgaaggaggagatcatctgcatgatccagaacaccttcaacttcagcctgaagcagagcaagcacctgttccagatcctgatggagtgcatggtgcacagagactgcatcaccatcttcgacgccgacagcgaggagcagcaggacctggacctggccatcctgaccgccctgctgaagggcaccaacctgagcgccagcgagcagctgaacctggccatggcctgggacagagtggacatcgccaagaagcacatcctgatctacgagcagcactggaagcccgacgccctggagcaggccatgagcgacgccctggtgatggacagagtggacttcgtgaagctgctgatcgagtacggcgtgaacctgcacagattcctgaccatccccagactggaggagctgtacaacaccaagcagggccccaccaacaccctgctgcaccacctggtgcaggacgtgaagcagcacaccctgctgagcggctacagaatcaccctgatcgacatcggcctggtggtggagtacctgatcggcagagcctacagaagcaactacaccagaaagcacttcagagccctgtacaacaacctgtacagaaagtacaagcaccagagacacagcagcggcaacagaaacgagagcgccgagagcaccctgcacagccagttcatcagaaccgcccagccctacaagttcaaggagaagagcatcgtgctgcacaagagcagaaagaagagcaaggagcagaacgtgagcgacgaccccgagagcaccggcttcctgtacccctacaacgacctgctggtgtgggccgtgctgatgaagagacagaagatggccatgttcttctggcagcacggcgaggaggccaccgtgaaggccgtgatcgcctgcatcctgtacagagccatggcccacgaggccaaggagagccacatggtggacgacgccagcgaggagctgaagaactacagcaagcagttcggccagctggccctggacctgctggagaaggccttcaagcagaacgagagaatggccatgaccctgctgacctacgagctgagaaactggagcaacagcacctgcctgaagctggccgtgagcggcggcctgagacccttcgtgagccacacctgcacccagatgctgctgaccgacatgtggatgggcagactgaagatgagaaagaacagctggctgaagatcatcatcagcatcatcctgccccccaccatcctgaccctggagttcaagagcaaggccgagatgagccacgtgccccagagccaggacttccagttcatgtggtactacagcgaccagaacgccagcagcagcaaggagagcgccagcgtgaaggagtacgacctggagagaggccacgacgagaagctggacgagaaccagcacttcggcctggagagcggccaccagcacctgccctggaccagaaaggtgtacgagttctacagcgcccccatcgtgaagttctggttctacaccatggcctacctggccttcctgatgctgttcacctacaccgtgctggtggagatgcagccccagcccagcgtgcaggagtggctggtgagcatctacatcttcaccaacgccatcgaggtggtgagagagatctgcatcagcgagcccggcaagttcacccagaaggtgaaggtgtggatcagcgagtactggaacctgaccgagaccgtggccatcggcctgttcagcgccggcttcgtgctgagatggggcgacccccccttccacaccgccggcagactgatctactgcatcgacatcatcttctggttcagcagactgctggacttcttcgccgtgaaccagcacgccggcccctacgtgaccatgatcgccaagatgaccgccaacatgttctacatcgtgatcatcatggccatcgtgctgctgagcttcggcgtggccagaaaggccatcctgagccccaaggagccccccagctggagcctggccagagacatcgtgttcgagccctactggatgatctacggcgaggtgtacgccggcgagatcgacgtgtgcagcagccagcccagctgcccccccggcagcttcctgacccccttcctgcaggccgtgtacctgttcgtgcagtacatcatcatggtgaacctgctgatcgccttcttcaacaacgtgtacctggacatggagagcatcagcaacaacctgtggaagtacaacagatacagatacatcatgacctaccacgagaagccctggctgcccccccccctgatcctgctgagccacgtgggcctgctgctgagaagactgtgctgccacagagccccccacgaccaggaggagggcgacgtgggcctgaagctgtacctgagcaaggaggacctgaagaagctgcacgacttcgaggagcagtgcgtggagaagtacttccacgagaagatggaggacgtgaactgcagctgcgaggagagaatcagagtgaccagcgagagagtgaccgagatgtacttccagctgaaggagatgaacgagaaggtgagcttcatcaaggacagcctgctgagcctggacagccaggtgggccacctgcaggacctgagcgccctgaccgtggacaccctgaaggtgctgagcgccgtggacaccctgcaggaggacgaggccctgctggccaagagaaagcacagcacctgcaagaagctgccccacagctggagcaacgtgatctgcgccgaggtgctgggcagcatggagatcgccggcgagaagaagtaccagtactacagcatgcccagcagcctgctgagaagcctggccggcggcagacacccccccagagtgcagagaggcgccctgctggagatcaccaacagcaagagagaggccaccaacgtgagaaacgaccaggagagacaggagacccagagcagcatcgtggtgagcggcgtgagccccaacagacaggcccacagcaagtacggccagttcctgctggtgcccagcaacctgaagagagtgcccttcagcgccgagaccgtgctgcccctgagcagacccagcgtgcccgacgtgctggccaccgagcaggacatccagaccgaggtgctggtgcacctgaccggccagacccccgtggtgagcgactgggccagcgtggacgagcccaaggagaagcacgagcccatcgcccacctgctggacggccaggacaaggccgagcaggtgctgcccaccctgagctgcacccccgagcccatgaccatgagcagccccctgagccaggccaagatcatgcagaccggcggcggctacgtgaactgggccttcagcgagggcgacgagaccggcgtgttcagcatcaagaagaagtggcagacctgcctgcccagcacctgcgacagcgacagcagcagaagcgagcagcaccagaagcaggcccaggacagcagcctgagcgacaacagcaccagaagcgcccagagcagcgagtgcagcgaggtgggcccctggctgcagcccaacaccagcttctggatcaaccccctgagaagatacagacccttcgccagaagccacagcttcagattccacaaggaggagaagctgatgaagatctgcaagatcaagaacctgagcggcagcagcgagatcggccagggcgcctgggtgaaggccaagatgctgaccaaggacagaagactgagcaagaagaagaagaacacccagggcctgcaggtgcccatcatcaccgtgaacgcctgcagccagagcgaccagctgaaccccgagcccggcgagaacagcatcagcgaggaggagtacagcaagaactggttcaccgtgagcaagttcagccacaccggcgtggagccctacatccaccagaagatgaagaccaaggagatcggccagtgcgccatccagatcagcgactacctgaagcagagccaggaggacctgagcaagaacagcctgtggaacagcagaagcaccaacctgaacagaaacagcctgctgaagagcagcatcggcgtggacaagatcagcgccagcctgaagagcccccaggagccccaccaccactacagcgccatcgagagaaacaacctgatgagactgagccagaccatccccttcacccccgtgcagctgttcgccggcgaggagatcaccgtgtacagactggaggagagcagccccctgaacctggacaagagcatgagcagctggagccagagaggcagagccgccatgatccaggtgctgagcagagaggagatggacggcggcctgagaaaggccatgagagtggtgagcacctggagcgaggacgacatcctgaagcccggccaggtgttcatcgtgaagagcttcctgcccgaggtggtgagaacctggcacaagatcttccaggagagcaccgtgctgcacctgtgcctgagagagatccagcagcagagagccgcccagaagctgatctacaccttcaaccaggtgaagccccagaccatcccctacacccccagattcctggaggtgttcctgatctactgccacagcgccaaccagtggctgaccatcgagaagtacatgaccggcgagttcagaaagtacaacaacaacaacggcgacgagatcacccccaccaacaccctggaggagctgatgctggccttcagccactggacctacgagtacaccagaggcgagctgctggtgctggacctgcagggcgtgggcgagaacctgaccgaccccagcgtgatcaagcccgaggtgaagcagagcagaggcatggtgttcggccccgccaacctgggcgaggacgccatcagaaacttcatcgccaagcaccactgcaacagctgctgcagaaagctgaagctgcccgacctgaagagaaacgactacagccccgagagaatcaacagcaccttcggcctggagatcaagatcgagagcgccgaggagccccccgccagagagaccggcagaaacagccccgaggacgacatgcagctgtag

SEQ ID NO: 103038 - DNA, 6054 bp, Artificial Sequence
  Description of Artificial Sequence: Synthetic coding sequence
atgaccgcccccgtgaccagccagaagagctggatcaagggcgtgttcgacaagagagagtgcagcaccatcatccccagcagcaagaacccccacagatgcacccccgtgtgccaggtgtgccagaacctgatcagatgctactgcggcagactgatcggcgaccacgccggcatcgactacagctggaccatcagcgccgccaagggcaaggagagcgagcagtggagcgtggagaagcacaccaccaagagccccaccgacaccttcggcaccatcaacttccaggacggcgagcacacccaccacgccaagtacatcagaaccagctacgacaccaagctggaccacctgctgcacctgatgctgaaggagtggaagatggagctgcccaagctggtgatcagcgtgcacggcggcatccagaacttcaccatgcccagcaagttcaaggagatcttcagccagggcctggtgaaggccgccgagaccaccggcgcctggatcatcaccgagggcatcaacaccggcgtgagcaagcacgtgggcgacgccctgaagagccacagcagccacagcctgagaaagatctggaccgtgggcatccccccctggggcgtgatcgagaaccagagagacctgatcggcaaggacgtggtgtgcctgtaccagaccctggacaaccccctgagcaagctgaccaccctgaacagcatgcacagccacttcatcctgagcgacgacggcaccgtgggcaagtacggcaacgagatgaagctgagaagaaacctggagaagtacctgagcctgcagaagatccactgcagaagcagacagggcgtgcccgtggtgggcctggtggtggagggcggccccaacgtgatcctgagcgtgtgggagaccgtgaaggacaaggaccccgtggtggtgtgcgagggcaccggcagagccgccgacctgctggccttcacccacaagcacctggccgacgagggcatgctgagaccccaggtgaaggaggagatcatctgcatgatccagaacaccttcaacttcagcctgaagcagagcaagcacctgttccagatcctgatggagtgcatggtgcacagagactgcatcaccatcttcgacgccgacagcgaggagcagcaggacctggacctggccatcctgaccgccctgctgaagggcaccaacctgagcgccagcgagcagctgaacctggccatggcctgggacagagtggacatcgccaagaagcacatcctgatctacgagcagcactggaagcccgacgccctggagcaggccatgagcgacgccctggtgatggacagagtggacttcgtgaagctgctgatcgagtacggcgtgaacctgcacagattcctgaccatccccagactggaggagctgtacaacaccaagcagggccccaccaacaccctgctgcaccacctggtgcaggacgtgaagcagcacaccctgctgagcggctacagaatcaccctgatcgacatcggcctggtggtggagtacctgatcggcagagcctacagaagcaactacaccagaaagcacttcagagccctgtacaacaacctgtacagaaagtacaagcaccagagacacagcagcggcaacagaaacgagagcgccgagagcaccctgcacagccagttcatcagaaccgcccagccctacaagttcaaggagaagagcatcgtgctgcacaagagcagaaagaagagcaaggagcagaacgtgagcgacgaccccgagagcaccggcttcctgtacccctacaacgacctgctggtgtgggccgtgctgatgaagagacagaagatggccatgttcttctggcagcacggcgaggaggccaccgtgaaggccgtgatcgcctgcatcctgtacagagccatggcccacgaggccaaggagagccacatggtggacgacgccagcgaggagctgaagaactacagcaagcagttcggccagctggccctggacctgctggagaaggccttcaagcagaacgagagaatggccatgaccctgctgacctacgagctgagaaactggagcaacagcacctgcctgaagctggccgtgagcggcggcctgagacccttcgtgagccacacctgcacccagatgctgctgaccgacatgtggatgggcagactgaagatgagaaagaacagctggctgaagatcatcatcagcatcatcctgccccccaccatcctgaccctggagttcaagagcaaggccgagatgagccacgtgccccagagccaggacttccagttcatgtggtactacagcgaccagaacgccagcagcagcaaggagagcgccagcgtgaaggagtacgacctggagagaggccacgacgagaagctggacgagaaccagcacttcggcctggagagcggccaccagcacctgccctggaccagaaaggtgtacgagttctacagcgcccccatcgtgaagttctggttctacaccatggcctacctggccttcctgatgctgttcacctacaccgtgctggtggagatgcagccccagcccagcgtgcaggagtggctggtgagcatctacatcttcaccaacgccatcgaggtggtgagagagatctgcatcagcgagcccggcaagttcacccagaaggtgaaggtgtggatcagcgagtactggaacctgaccgagaccgtggccatcggcctgttcagcgccggcttcgtgctgagatggggcgacccccccttccacaccgccggcagactgatctactgcatcgacatcatcttctggttcagcagactgctggacttcttcgccgtgaaccagcacgccggcccctacgtgaccatgatcgccaagatgaccgccaacatgttctacatcgtgatcatcatggccatcgtgctgctgagcttcggcgtggccagaaaggccatcctgagccccaaggagccccccagctggagcctggccagagacatcgtgttcgagccctactggatgatctacggcgaggtgtacgccggcgagatcgacgtgtgcagcagccagcccagctgcccccccggcagcttcctgacccccttcctgcaggccgtgtacctgttcgtgcagtacatcatcatggtgaacctgctgatcgccttcttcaacaacgtgtacctggacatggagagcatcagcaacaacctgtggaagtacaacagatacagatacatcatgacctaccacgagaagccctggctgcccccccccctgatcctgctgagccacgtgggcctgctgctgagaagactgtgctgccacagagccccccacgaccaggaggagggcgacgtgggcctgaagctgtacctgagcaaggaggacctgaagaagctgcacgacttcgaggagcagtgcgtggagaagtacttccacgagaagatggaggacgtgaactgcagctgcgaggagagaatcagagtgaccagcgagagagtgaccgagatgtacttccagctgaaggagatgaacgagaaggtgagcttcatcaaggacagcctgctgagcctggacagccaggtgggccacctgcaggacctgagcgccctgaccgtggacaccctgaaggtgctgagcgccgtggacaccctgcaggaggacgaggccctgctggccaagagaaagcacagcacctgcaagaagctgccccacagctggagcaacgtgatctgcgccgaggtgctgggcagcatggagatcgccggcgagaagaagtaccagtactacagcatgcccagcagcctgctgagaagcctggccggcggcagacacccccccagagtgcagagaggcgccctgctggagatcaccaacagcaagagagaggccaccaacgtgagaaacgaccaggagagacaggagacccagagcagcatcgtggtgagcggcgtgagccccaacagacaggcccacagcaagtacggccagttcctgctggtgcccagcaacctgaagagagtgcccttcagcgccgagaccgtgctgcccctgagcagacccagcgtgcccgacgtgctggccaccgagcaggacatccagaccgaggtgctggtgcacctgaccggccagacccccgtggtgagcgactgggccagcgtggacgagcccaaggagaagcacgagcccatcgcccacctgctggacggccaggacaaggccgagcaggtgctgcccaccctgagctgcacccccgagcccatgaccatgagcagccccctgagccaggccaagatcatgcagaccggcggcggctacgtgaactgggccttcagcgagggcgacgagaccggcgtgttcagcatcaagaagaagtggcagacctgcctgcccagcacctgcgacagcgacagcagcagaagcgagcagcaccagaagcaggcccaggacagcagcctgagcgacaacagcaccagaagcgcccagagcagcgagtgcagcgaggtgggcccctggctgcagcccaacaccagcttctggatcaaccccctgagaagatacagacccttcgccagaagccacagcttcagattccacaaggaggagaagctgatgaagatctgcaagatcaagaacctgagcggcagcagcgagatcggccagggcgcctgggtgaaggccaagatgctgaccaaggacagaagactgagcaagaagaagaagaacacccagggcctgcaggtgcccatcatcaccgtgaacgcctgcagccagagcgaccagctgaaccccgagcccggcgagaacagcatcagcgaggaggagtacagcaagaactggttcaccgtgagcaagttcagccacaccggcgtggagccctacatccaccagaagatgaagaccaaggagatcggccagtgcgccatccagatcagcgactacctgaagcagagccaggaggacctgagcaagaacagcctgtggaacagcagaagcaccaacctgaacagaaacagcctgctgaagagcagcatcggcgtggacaagatcagcgccagcctgaagagcccccaggagccccaccaccactacagcgccatcgagagaaacaacctgatgagactgagccagaccatccccttcacccccgtgcagctgttcgccggcgaggagatcaccgtgtacagactggaggagagcagccccctgaacctggacaagagcatgagcagctggagccagagaggcagagccgccatgatccaggtgctgagcagagaggagatggacggcggcctgagaaaggccatgagagtggtgagcacctggagcgaggacgacatcctgaagcccggccaggtgttcatcgtgaagagcttcctgcccgaggtggtgagaacctggcacaagatcttccaggagagcaccgtgctgcacctgtgcctgagagagatccagcagcagagagccgcccagaagctgatctacaccttcaaccaggtgaagccccagaccatcccctacacccccagattcctggaggtgttcctgatctactgccacagcgccaaccagtggctgaccatcgagaagtacatgaccggcgagttcagaaagtacaacaacaacaacggcgacgagatcacccccaccaacaccctggaggagctgatgctggccttcagccactggacctacgagtacaccagaggcgagctgctggtgctggacctgcagggcgtgggcgagaacctgaccgaccccagcgtgatcaagcccgaggtgaagcagagcagaggcatggtgttcggccccgccaacctgggcgaggacgccatcagaaacttcatcgccaagcaccactgcaacagctgctgcagaaagctgaagctgcccgacctgaagagaaacgactacagccccgagagaatcaacagcaccttcggcctggagatcaagatcgagagcgccgaggagccccccgccagagagaccggcagaaacagccccgaggacgacatgcagctgtag

SEQ ID NO: 103039 - DNA, 5844 bp, Artificial Sequence
  Description of Artificial Sequence: Synthetic coding sequence
atgaaggagcagcccgtgctggagagactgcagagccagaagagctggatcaagggcgtgttcgacaagagagagtgcagcaccatcatccccagcagcaagaacccccacagatgcacccccgtgtgccaggtgtgccagaacctgatcagatgctactgcggcagactgatcggcgaccacgccggcatcgactacagctggaccatcagcgccgccaagggcaaggagagcgagcagtggagcgtggagaagcacaccaccaagagccccaccgacaccttcggcaccatcaacttccaggacggcgagcacacccaccacgccaagtacatcagaaccagctacgacaccaagctggaccacctgctgcacctgatgctgaaggagtggaagatggagctgcccaagctggtgatcagcgtgcacggcggcatccagaacttcaccatgcccagcaagttcaaggagatcttcagccagggcctggtgaaggccgccgagaccaccggcgcctggatcatcaccgagggcatcaacaccggcgtgagcaagcacgtgggcgacgccctgaagagccacagcagccacagcctgagaaagatctggaccgtgggcatccccccctggggcgtgatcgagaaccagagagacctgatcggcaaggacgtggtgtgcctgtaccagaccctggacaaccccctgagcaagctgaccaccctgaacagcatgcacagccacttcatcctgagcgacgacggcaccgtgggcaagtacggcaacgagatgaagctgagaagaaacctggagaagtacctgagcctgcagaagatccactgcagaagcagacagggcgtgcccgtggtgggcctggtggtggagggcggccccaacgtgatcctgagcgtgtgggagaccgtgaaggacaaggaccccgtggtggtgtgcgagggcaccggcagagccgccgacctgctggccttcacccacaagcacctggccgacgagggcatgctgagaccccaggtgaaggaggagatcatctgcatgatccagaacaccttcaacttcagcctgaagcagagcaagcacctgttccagatcctgatggagtgcatggtgcacagagactgcatcaccatcttcgacgccgacagcgaggagcagcaggacctggacctggccatcctgaccgccctgctgaagggcaccaacctgagcgccagcgagcagctgaacctggccatggcctgggacagagtggacatcgccaagaagcacatcctgatctacgagcagcactggaagcccgacgccctggagcaggccatgagcgacgccctggtgatggacagagtggacttcgtgaagctgctgatcgagtacggcgtgaacctgcacagattcctgaccatccccagactggaggagctgtacaacaccaagcagggccccaccaacaccctgctgcaccacctggtgcaggacgtgaagcagcacaccctgctgagcggctacagaatcaccctgatcgacatcggcctggtggtggagtacctgatcggcagagcctacagaagcaactacaccagaaagcacttcagagccctgtacaacaacctgtacagaaagtacaagcaccagagacacagcagcggcaacagaaacgagagcgccgagagcaccctgcacagccagttcatcagaaccgcccagccctacaagttcaaggagaagagcatcgtgctgcacaagagcagaaagaagagcaaggagcagaacgtgagcgacgaccccgagagcaccggcttcctgtacccctacaacgacctgctggtgtgggccgtgctgatgaagagacagaagatggccatgttcttctggcagcacggcgaggaggccaccgtgaaggccgtgatcgcctgcatcctgtacagagccatggcccacgaggccaaggagagccacatggtggacgacgccagcgaggagctgaagaactacagcaagcagttcggccagctggccctggacctgctggagaaggccttcaagcagaacgagagaatggccatgaccctgctgacctacgagctgagaaactggagcaacagcacctgcctgaagctggccgtgagcggcggcctgagacccttcgtgagccacacctgcacccagatgctgctgaccgacatgtggatgggcagactgaagatgagaaagaacagctggctgaagatcatcatcagcatcatcctgccccccaccatcctgaccctggagttcaagagcaaggccgagatgagccacgtgccccagagccaggacttccagttcatgtggtactacagcgaccagaacgccagcagcagcaaggagagcgccagcgtgaaggagtacgacctggagagaggccacgacgagaagctggacgagaaccagcacttcggcctggagagcggccaccagcacctgccctggaccagaaaggtgtacgagttctacagcgcccccatcgtgaagttctggttctacaccatggcctacctggccttcctgatgctgttcacctacaccgtgctggtggagatgcagccccagcccagcgtgcaggagtggctggtgagcatctacatcttcaccaacgccatcgaggtggtgagagagatctgcatcagcgagcccggcaagttcacccagaaggtgaaggtgtggatcagcgagtactggaacctgaccgagaccgtggccatcggcctgttcagcgccggcttcgtgctgagatggggcgacccccccttccacaccgccggcagactgatctactgcatcgacatcatcttctggttcagcagactgctggacttcttcgccgtgaaccagcacgccggcccctacgtgaccatgatcgccaagatgaccgccaacatgttctacatcgtgatcatcatggccatcgtgctgctgagcttcggcgtggccagaaaggccatcctgagccccaaggagccccccagctggagcctggccagagacatcgtgttcgagccctactggatgatctacggcgaggtgtacgccggcgagatcgacgtgtgcagcagccagcccagctgcccccccggcagcttcctgacccccttcctgcaggccgtgtacctgttcgtgcagtacatcatcatggtgaacctgctgatcgccttcttcaacaacgtgtacctggacatggagagcatcagcaacaacctgtggaagtacaacagatacagatacatcatgacctaccacgagaagccctggctgcccccccccctgatcctgctgagccacgtgggcctgctgctgagaagactgtgctgccacagagccccccacgaccaggaggagggcgacgtgggcctgaagctgtacctgagcaaggaggacctgaagaagctgcacgacttcgaggagcagtgcgtggagaagtacttccacgagaagatggaggacgtgaactgcagctgcgaggagagaatcagagtgaccagcgagagagtgaccgagatgtacttccagctgaaggagatgaacgagaaggtgagcttcatcaaggacagcctgctgagcctggacagccaggtgggccacctgcaggacctgagcgccctgaccgtggacaccctgaaggtgctgagcgccgtggacaccctgcaggaggacgaggccctgctggccaagagaaagcacagcacctgcaagaagctgccccacagctggagcaacgtgatctgcgccgaggtgctgggcagcatggagatcgccggcgagaagaagtaccagtactacagcatgcccagcagcctgctgagaagcctggccggcggcagacacccccccagagtgcagagaggcgccctgctggagatcaccaacagcaagagagaggccaccaacgtgagaaacgaccaggagagacaggagacccagagcagcatcgtggtgagcggcgtgagccccaacagacaggcccacagcaagtacggccagttcctgctggtgcccagcaacctgaagagagtgcccttcagcgccgagaccgtgctgcccctgagcagacccagcgtgcccgacgtgctggccaccgagcaggacatccagaccgaggtgctggtgcacctgaccggccagacccccgtggtgagcgactgggccagcgtggacgagcccaaggagaagcacgagcccatcgcccacctgctggacggccaggacaaggccgagcaggtgctgcccaccctgagctgcacccccgagcccatgaccatgagcagccccctgagccaggccaagatcatgcagaccggcggcggctacgtgaactgggccttcagcgagggcgacgagaccggcgtgttcagcatcaagaagaagtggcagacctgcctgcccagcacctgcgacagcgacagcagcagaagcgagcagcaccagaagcaggcccaggacagcagcctgagcgacaacagcaccagaagcgcccagagcagcgagtgcagcgaggtgggcccctggctgcagcccaacaccagcttctggatcaaccccctgagaagatacagacccttcgccagaagccacagcttcagattccacaaggaggagaagctgatgaagatctgcaagatcaagaacctgagcggcagcagcgagatcggccagggcgcctgggtgaaggccaagatgctgaccaaggacagaagactgagcaagaagaagaagaacacccagggcctgcaggtgcccatcatcaccgtgaacgcctgcagccagagcgaccagctgaaccccgagcccggcgagaacagcatcagcgaggaggagtacagcaagaactggttcaccgtgagcaagttcagccacaccggcgtggagccctacatccaccagaagatgaagaccaaggagatcggccagtgcgccatccagatcagcgactacctgaagcagagccaggaggacctgagcaagaacagcctgtggaacagcagaagcaccaacctgaacagaaacagcctgcacgtgatcaagatgcccatcagcagcctgatcagcgagatcagcgccagcctgaagagcccccaggagccccaccaccactacagcgccatcgagagaaacaacctgatgagactgagccagaccatccccttcacccccgtgcagctgttcgccggcgaggagatcaccgtgtacagactggaggagagcagccccctgaacctggacaagagcatgagcagctggagccagagaggcagagccgccatgatccaggtgctgagcagagaggagatggacggcggcctgagaaaggccatgagagtggtgagcacctggagcgaggacgacatcctgaagcccggccaggtgttcatcgtgaagagcttcctgcccgaggtggtgagaacctggcacaagatcttccaggagagcaccgtgctgcacctgtgcctgagagagatccagcagcagagagccgcccagaagctgatctacaccttcaaccaggtgaagccccagaccatcccctacacccccagattcctggaggtgttcctgatctactgccacagcgccaaccagtggctgaccatcgagaagtacatgaccggcgagttcagaaagtacaacaacaacaacggcgacgagatcacccccaccaacaccctggaggagctgatgctggccttcagccactggacctacgagtacaccagaggcgagctgctggtgctggacctgcaggccctgtggttctgggacagcatgctgaaggccagactgggcggctggagaatgtag

SEQ ID NO: 103040 - DNA, 1707 bp, Artificial Sequence
  Description of Artificial Sequence: Synthetic coding sequence
agagagagcccccaccccgccctgctgcagagccagaagagctggatcaagggcgtgttcgacaagagagagtgcagcaccatcatccccagcagcaagaacccccacagatgcacccccgtgtgccaggtgtgccagaacctgatcagatgctactgcggcagactgatcggcgaccacgccggcatcgactacagctggaccatcagcgccgccaagggcaaggagagcgagcagtggagcgtggagaagcacaccaccaagagccccaccgacaccttcggcaccatcaacttccaggacggcgagcacacccaccacgccaagtacatcagaaccagctacgacaccaagctggaccacctgctgcacctgatgctgaaggagtggaagatggagctgcccaagctggtgatcagcgtgcacggcggcatccagaacttcaccatgcccagcaagttcaaggagatcttcagccagggcctggtgaaggccgccgagaccaccggcgcctggatcatcaccgagggcatcaacaccggcgtgagcaagcacgtgggcgacgccctgaagagccacagcagccacagcctgagaaagatctggaccgtgggcatccccccctggggcgtgatcgagaaccagagagacctgatcggcaaggacgtggtgtgcctgtaccagaccctggacaaccccctgagcaagctgaccaccctgaacagcatgcacagccacttcatcctgagcgacgacggcaccgtgggcaagtacggcaacgagatgaagctgagaagaaacctggagaagtacctgagcctgcagaagatccactgccccggcgaggagatcaccgtgtacagactggaggagagcagccccctgaacctggacaagagcatgagcagctggagccagagaggcagagccgccatgatccaggtgctgagcagagaggagatggacggcggcctgagaaaggccatgagagtggtgagcacctggagcgaggacgacatcctgaagcccggccaggtgttcatcgtgaagagcttcctgcccgaggtggtgagaacctggcacaagatcttccaggagagcaccgtgctgcacctgtgcctgagagagatccagcagcagagagccgcccagaagctgatctacaccttcaaccaggtgaagccccagaccatcccctacacccccagattcctggaggtgttcctgatctactgccacagcgccaaccagtggctgaccatcgagaagtacatgaccggcgagttcagaaagtacaacaacaacaacggcgacgagatcacccccaccaacaccctggaggagctgatgctggccttcagccactggacctacgagtacaccagaggcgagctgctggtgctggacctgcagggcgtgggcgagaacctgaccgaccccagcgtgatcaagcccgaggtgaagcagagcagaggcatggtgttcggccccgccaacctgggcgaggacgccatcagaaacttcatcgccaagcaccactgcaacagctgctgcagaaagctgaagctgcccgacctgaagagaaacgactacagccccgagagaatcaacagcaccttcggcctggagatcaagatcgagagcgccgaggagccccccgccagagagaccggcagaaacagccccgaggacgacatgcagctgtag

SEQ ID NO: 103041 - DNA, 2580 bp, Artificial Sequence
  Description of Artificial Sequence: Synthetic coding sequence
atgaaggagcagcccgtgctggagagactgcagagccagaagagctggatcaagggcgtgttcgacaagagagagtgcagcaccatcatccccagcagcaagaacccccacagatgcacccccgtgtgccaggtgtgccagaacctgatcagatgctactgcggcagactgatcggcgaccacgccggcatcgactacagctggaccatcagcgccgccaagggcaaggagagcgagcagtggagcgtggagaagcacaccaccaagagccccaccgacaccttcggcaccatcaacttccaggacggcgagcacacccaccacgccaagtacatcagaaccagctacgacaccaagctggaccacctgctgcacctgatgctgaaggagtggaagatggagctgcccaagctggtgatcagcgtgcacggcggcatccagaacttcaccatgcccagcaagttcaaggagatcttcagccagggcctggtgaaggccgccgagaccaccggcgcctggatcatcaccgagggcatcaacaccggcgtgagcaagcacgtgggcgacgccctgaagagccacagcagccacagcctgagaaagatctggaccgtgggcatccccccctggggcgtgatcgagaaccagagagacctgatcggcaaggacgtggtgtgcctgtaccagaccctggacaaccccctgagcaagctgaccaccctgaacagcatgcacagccacttcatcctgagcgacgacggcaccgtgggcaagtacggcaacgagatgaagctgagaagaaacctggagaagtacctgagcctgcagaagatccactgcagaagcagacagggcgtgcccgtggtgggcctggtggtggagggcggccccaacgtgatcctgagcgtgtgggagaccgtgaaggacaaggaccccgtggtggtgtgcgagggcaccggcagagccgccgacctgctggccttcacccacaagcacctggccgacgagggcatgctgagaccccaggtgaaggaggagatcatctgcatgatccagaacaccttcaacttcagcctgaagcagagcaagcacctgttccagatcctgatggagtgcatggtgcacagagactgcatcaccatcttcgacgccgacagcgaggagcagcaggacctggacctggccatcctgaccgccctgctgaagggcaccaacctgagcgccagcgagcagctgaacctggccatggcctgggacagagtggacatcgccaagaagcacatcctgatctacgagcagcactggaagcccgacgccctggagcaggccatgagcgacgccctggtgatggacagagtggacttcgtgaagctgctgatcgagtacggcgtgaacctgcacagattcctgaccatccccagactggaggagctgtacaacaccaagcagggccccaccaacaccctgctgcaccacctggtgcaggacgtgaagcaggacctgagcaagaacagcctgtggaacagcagaagcaccaacctgaacagaaacagcctgcacgtgatcaagatgcccatcagcagcctgatcagcgagatcagcgccagcctgaagagcccccaggagccccaccaccactacagcgccatcgagagaaacaacctgatgagactgagccagaccatccccttcacccccgtgcagctgttcgccggcgaggagatcaccgtgtacagactggaggagagcagccccctgaacctggacaagagcatgagcagctggagccagagaggcagagccgccatgatccaggtgctgagcagagaggagatggacggcggcctgagaaaggccatgagagtggtgagcacctggagcgaggacgacatcctgaagcccggccaggtgttcatcgtgaagagcttcctgcccgaggtggtgagaacctggcacaagatcttccaggagagcaccgtgctgcacctgtgcctgagagagatccagcagcagagagccgcccagaagctgatctacaccttcaaccaggtgaagccccagaccatcccctacacccccagattcctggaggtgttcctgatctactgccacagcgccaaccagtggctgaccatcgagaagtacatgaccggcgagttcagaaagtacaacaacaacaacggcgacgagatcacccccaccaacaccctggaggagctgatgctggccttcagccactggacctacgagtacaccagaggcgagctgctggtgctggacctgcagggcgtgggcgagaacctgaccgaccccagcgtgatcaagcccgaggtgaagcagagcagaggcatggtgttcggccccgccaacctgggcgaggacgccatcagaaacttcatcgccaagcaccactgcaacagctgctgcagaaagctgaagctgcccgacctgaagagaaacgactacagccccgagagaatcaacagcaccttcggcctggagatcaagatcgagagcgccgaggagccccccgccagagagaccggcagaaacagccccgaggacgacatgcagctgtag

SEQ ID NO: 103042 - DNA, 2934 bp, Artificial Sequence
  Description of Artificial Sequence: Synthetic coding sequence
atgaaggagcagcccgtgctggagagactgcagagccagaagagctggatcaagggcgtgttcgacaagagagagtgcagcaccatcatccccagcagcaagaacccccacagatgcacccccgtgtgccaggtgtgccagaacctgatcagatgctactgcggcagactgatcggcgaccacgccggcatcgactacagctggaccatcagcgccgccaagggcaaggagagcgagcagtggagcgtggagaagcacaccaccaagagccccaccgacaccttcggcaccatcaacttccaggacggcgagcacacccaccacgccaagtacatcagaaccagctacgacaccaagctggaccacctgctgcacctgatgctgaaggagtggaagatggagctgcccaagctggtgatcagcgtgcacggcggcatccagaacttcaccatgcccagcaagttcaaggagatcttcagccagggcctggtgaaggccgccgagaccaccggcgcctggatcatcaccgagggcatcaacaccggcgtgagcaagcacgtgggcgacgccctgaagagccacagcagccacagcctgagaaagatctggaccgtgggcatccccccctggggcgtgatcgagaaccagagagacctgatcggcaaggacgtggtgtgcctgtaccagaccctggacaaccccctgagcaagctgaccaccctgaacagcatgcacagccacttcatcctgagcgacgacggcaccgtgggcaagtacggcaacgagatgaagctgagaagaaacctggagaagtacctgagcctgcagaagatccactgcagaagcagacagggcgtgcccgtggtgggcctggtggtggagggcggccccaacgtgatcctgagcgtgtgggagaccgtgaaggacaaggaccccgtggtggtgtgcgagggcaccggcagagccgccgacctgctggccttcacccacaagcacctggccgacgagggcatgctgagaccccaggtgaaggaggagatcatctgcatgatccagaacaccttcaacttcagcctgaagcagagcaagcacctgttccagatcctgatggagtgcatggtgcacagagactgcatcaccatcttcgacgccgacagcgaggagcagcaggacctggacctggccatcctgaccgccctgctgaagggcaccaacctgagcgccagcgagcagctgaacctggccatggcctgggacagagtggacatcgccaagaagcacatcctgatctacgagcagcactggaagcccgacgccctggagcaggccatgagcgacgccctggtgatggacagagtggacttcgtgaagctgctgatcgagtacggcgtgaacctgcacagattcctgaccatccccagactggaggagctgtacaacaccaagcagggccccaccaacaccctgctgcaccacctggtgcaggacgtgaagcagcacaccctgctgagcggctacagaatcaccctgatcgacatcggcctggtggtggagtacctgatcggcagagcctacagaagcaactacaccagaaagcacttcagagccctgtacaacaacctgtacagaaagtacaagatcatcaccgtgaacgcctgcagccagagcgaccagctgaaccccgagcccggcgagaacagcatcagcgaggaggagtacagcaagaactggttcaccgtgagcaagttcagccacaccggcgtggagccctacatccaccagaagatgaagaccaaggagatcggccagtgcgccatccagatcagcgactacctgaagcagagccaggaggacctgagcaagaacagcctgtggaacagcagaagcaccaacctgaacagaaacagcctgcacgtgatcaagatgcccatcagcagcctgatcagcgagatcagcgccagcctgaagagcccccaggagccccaccaccactacagcgccatcgagagaaacaacctgatgagactgagccagaccatccccttcacccccgtgcagctgttcgccggcgaggagatcaccgtgtacagactggaggagagcagccccctgaacctggacaagagcatgagcagctggagccagagaggcagagccgccatgatccaggtgctgagcagagaggagatggacggcggcctgagaaaggccatgagagtggtgagcacctggagcgaggacgacatcctgaagcccggccaggtgttcatcgtgaagagcttcctgcccgaggtggtgagaacctggcacaagatcttccaggagagcaccgtgctgcacctgtgcctgagagagatccagcagcagagagccgcccagaagctgatctacaccttcaaccaggtgaagccccagaccatcccctacacccccagattcctggaggtgttcctgatctactgccacagcgccaaccagtggctgaccatcgagaagtacatgaccggcgagttcagaaagtacaacaacaacaacggcgacgagatcacccccaccaacaccctggaggagctgatgctggccttcagccactggacctacgagtacaccagaggcgagctgctggtgctggacctgcagggcgtgggcgagaacctgaccgaccccagcgtgatcaagcccgaggtgaagcagagcagaggcatggtgttcggccccgccaacctgggcgaggacgccatcagaaacttcatcgccaagcaccactgcaacagctgctgcagaaagctgaagctgcccgacctgaagagaaacgactacagccccgagagaatcaacagcaccttcggcctggagatcaagatcgagagcgccgaggagccccccgccagagagaccggcagaaacagccccgaggacgacatgcagctgtag

SEQ ID NO: 103043 - DNA, 3402 bp, Artificial Sequence
  Description of Artificial Sequence: Synthetic coding sequence
atgctgagaccccaggtgaaggaggagatcatctgcatgatccagaacaccttcaacttcagcctgaagcagagcaagcacctgttccagatcctgatggagtgcatggtgcacagagactgcatcaccatcttcgacgccgacagcgaggagcagcaggacctggacctggccatcctgaccgccctgctgaagggcaccaacctgagcgccagcgagcagctgaacctggccatggcctgggacagagtggacatcgccaagaagcacatcctgatctacgagcagcactggaagcccgacgccctggagcaggccatgagcgacgccctggtgatggacagagtggacttcgtgaagctgctgatcgagtacggcgtgaacctgcacagattcctgaccatccccagactggaggagctgtacaacaccaagcagggccccaccaacaccctgctgcaccacctggtgcaggacgtgaagcagcacaccctgctgagcggctacagaatcaccctgatcgacatcggcctggtggtggagtacctgatcggcagagcctacagaagcaactacaccagaaagcacttcagagccctgtacaacaacctgtacagaaagtacaagcaccagagacacagcagcggcaacagaaacgagagcgccgagagcaccctgcacagccagttcatcagaaccgcccagccctacaagttcaaggagaagagcatcgtgctgcacaagagcagaaagaagagcaaggagcagaacgtgagcgacgaccccgagagcaccggcttcctgtacccctacaacgacctgctggtgtgggccgtgctgatgaagagacagaagatggccatgttcttctggcagcacggcgaggaggccaccgtgaaggccgtgatcgcctgcatcctgtacagagccatggcccacgaggccaaggagagccacatggtggacgacgccagcgaggagctgaagaactacagcaagcagttcggccagctggccctggacctgctggagaaggccttcaagcagaacgagagaatggccatgaccctgctgacctacgagctgagaaactggagcaacagcacctgcctgaagctggccgtgagcggcggcctgagacccttcgtgagccacacctgcacccagatgctgctgaccgacatgtggatgggcagactgaagatgagaaagaacagctggctgaagatcatcatcagcatcatcctgccccccaccatcctgaccctggagttcaagagcaaggccgagatgagccacgtgccccagagccaggacttccagttcatgtggtactacagcgaccagaacgccagcagcagcaaggagagcgccagcgtgaaggagtacgacctggagagaggccacgacgagaagctggacgagaaccagcacttcggcctggagagcggccaccagcacctgccctggaccagaaaggtgtacgagttctacagcgcccccatcgtgaagttctggttctacaccatggcctacctggccttcctgatgctgttcacctacaccgtgctggtggagatgcagccccagcccagcgtgcaggagtggctggtgagcatctacatcttcaccaacgccatcgaggtggtgagagagatctgcatcagcgagcccggcaagttcacccagaaggtgaaggtgtggatcagcgagtactggaacctgaccgagaccgtggccatcggcctgttcagcgccggcttcgtgctgagatggggcgacccccccttccacaccgccggcagactgatctactgcatcgacatcatcttctggttcagcagactgctggacttcttcgccgtgaaccagcacgccggcccctacgtgaccatgatcgccaagatgaccgccaacatgttctacatcgtgatcatcatggccatcgtgctgctgagcttcggcgtggccagaaaggccatcctgagccccaaggagccccccagctggagcctggccagagacatcgtgttcgagccctactggatgatctacggcgaggtgtacgccggcgagatcgacgtgtgcagcagccagcccagctgcccccccggcagcttcctgacccccttcctgcaggccgtgtacctgttcgtgcagtacatcatcatggtgaacctgctgatcgccttcttcaacaacgtgtacctggacatggagagcatcagcaacaacctgtggaagtacaacagatacagatacatcatgacctaccacgagaagccctggctgcccccccccctgatcctgctgagccacgtgggcctgctgctgagaagactgtgctgccacagagccccccacgaccaggaggagggcgacgtgggcctgaagctgtacctgagcaaggaggacctgaagaagctgcacgacttcgaggagcagtgcgtggagaagtacttccacgagaagatggaggacgtgaactgcagctgcgaggagagaatcagagtgaccagcgagagagtgaccgagatgtacttccagctgaaggagatgaacgagaaggtgagcttcatcaaggacagcctgctgagcctggacagccaggtgggccacctgcaggacctgagcgccctgaccgtggacaccctgaaggtgctgagcgccgtggacaccctgcaggaggacgaggccctgctggccaagagaaagcacagcacctgcaagaagctgccccacagctggagcaacgtgatctgcgccgaggtgctgggcagcatggagatcgccggcgagaagaagtaccagtactacagcatgcccagcagcctgctgagaagcctggccggcggcagacacccccccagagtgcagagaggcgccctgctggagatcaccaacagcaagagagaggccaccaacgtgagaaacgaccaggagagacaggagacccagagcagcatcgtggtgagcggcgtgagccccaacagacaggcccacagcaagtacggccagttcctgctggtgcccagcaacctgaagagagtgcccttcagcgccgagaccgtgctgcccctgagcagacccagcgtgcccgacgtgctggccaccgagcaggacatccagaccgaggtgctggtgcacctgaccggccagacccccgtggtgagcgactgggccagcgtggacgagcccaaggagaagcacgagcccatcgcccacctgctggacggccaggacaaggccgagcaggtgctgcccaccctgagctgcacccccgagcccatgaccatgagcagccccctgagcagatacagacccttcgccagaagccacagcttcagattccacaaggaggagaagctgatgaagatctgcaagatcaagagcaaggagtag

SEQ ID NO: 103044 - DNA, 6054 bp, Artificial Sequence
  Description of Artificial Sequence: Synthetic coding sequence
atgatcatcctgagcaagagccagaagagctggatcaagggcgtgttcgacaagagagagtgcagcaccatcatccccagcagcaagaacccccacagatgcacccccgtgtgccaggtgtgccagaacctgatcagatgctactgcggcagactgatcggcgaccacgccggcatcgactacagctggaccatcagcgccgccaagggcaaggagagcgagcagtggagcgtggagaagcacaccaccaagagccccaccgacaccttcggcaccatcaacttccaggacggcgagcacacccaccacgccaagtacatcagaaccagctacgacaccaagctggaccacctgctgcacctgatgctgaaggagtggaagatggagctgcccaagctggtgatcagcgtgcacggcggcatccagaacttcaccatgcccagcaagttcaaggagatcttcagccagggcctggtgaaggccgccgagaccaccggcgcctggatcatcaccgagggcatcaacaccggcgtgagcaagcacgtgggcgacgccctgaagagccacagcagccacagcctgagaaagatctggaccgtgggcatccccccctggggcgtgatcgagaaccagagagacctgatcggcaaggacgtggtgtgcctgtaccagaccctggacaaccccctgagcaagctgaccaccctgaacagcatgcacagccacttcatcctgagcgacgacggcaccgtgggcaagtacggcaacgagatgaagctgagaagaaacctggagaagtacctgagcctgcagaagatccactgcagaagcagacagggcgtgcccgtggtgggcctggtggtggagggcggccccaacgtgatcctgagcgtgtgggagaccgtgaaggacaaggaccccgtggtggtgtgcgagggcaccggcagagccgccgacctgctggccttcacccacaagcacctggccgacgagggcatgctgagaccccaggtgaaggaggagatcatctgcatgatccagaacaccttcaacttcagcctgaagcagagcaagcacctgttccagatcctgatggagtgcatggtgcacagagactgcatcaccatcttcgacgccgacagcgaggagcagcaggacctggacctggccatcctgaccgccctgctgaagggcaccaacctgagcgccagcgagcagctgaacctggccatggcctgggacagagtggacatcgccaagaagcacatcctgatctacgagcagcactggaagcccgacgccctggagcaggccatgagcgacgccctggtgatggacagagtggacttcgtgaagctgctgatcgagtacggcgtgaacctgcacagattcctgaccatccccagactggaggagctgtacaacaccaagcagggccccaccaacaccctgctgcaccacctggtgcaggacgtgaagcagcacaccctgctgagcggctacagaatcaccctgatcgacatcggcctggtggtggagtacctgatcggcagagcctacagaagcaactacaccagaaagcacttcagagccctgtacaacaacctgtacagaaagtacaagcaccagagacacagcagcggcaacagaaacgagagcgccgagagcaccctgcacagccagttcatcagaaccgcccagccctacaagttcaaggagaagagcatcgtgctgcacaagagcagaaagaagagcaaggagcagaacgtgagcgacgaccccgagagcaccggcttcctgtacccctacaacgacctgctggtgtgggccgtgctgatgaagagacagaagatggccatgttcttctggcagcacggcgaggaggccaccgtgaaggccgtgatcgcctgcatcctgtacagagccatggcccacgaggccaaggagagccacatggtggacgacgccagcgaggagctgaagaactacagcaagcagttcggccagctggccctggacctgctggagaaggccttcaagcagaacgagagaatggccatgaccctgctgacctacgagctgagaaactggagcaacagcacctgcctgaagctggccgtgagcggcggcctgagacccttcgtgagccacacctgcacccagatgctgctgaccgacatgtggatgggcagactgaagatgagaaagaacagctggctgaagatcatcatcagcatcatcctgccccccaccatcctgaccctggagttcaagagcaaggccgagatgagccacgtgccccagagccaggacttccagttcatgtggtactacagcgaccagaacgccagcagcagcaaggagagcgccagcgtgaaggagtacgacctggagagaggccacgacgagaagctggacgagaaccagcacttcggcctggagagcggccaccagcacctgccctggaccagaaaggtgtacgagttctacagcgcccccatcgtgaagttctggttctacaccatggcctacctggccttcctgatgctgttcacctacaccgtgctggtggagatgcagccccagcccagcgtgcaggagtggctggtgagcatctacatcttcaccaacgccatcgaggtggtgagagagatctgcatcagcgagcccggcaagttcacccagaaggtgaaggtgtggatcagcgagtactggaacctgaccgagaccgtggccatcggcctgttcagcgccggcttcgtgctgagatggggcgacccccccttccacaccgccggcagactgatctactgcatcgacatcatcttctggttcagcagactgctggacttcttcgccgtgaaccagcacgccggcccctacgtgaccatgatcgccaagatgaccgccaacatgttctacatcgtgatcatcatggccatcgtgctgctgagcttcggcgtggccagaaaggccatcctgagccccaaggagccccccagctggagcctggccagagacatcgtgttcgagccctactggatgatctacggcgaggtgtacgccggcgagatcgacgtgtgcagcagccagcccagctgcccccccggcagcttcctgacccccttcctgcaggccgtgtacctgttcgtgcagtacatcatcatggtgaacctgctgatcgccttcttcaacaacgtgtacctggacatggagagcatcagcaacaacctgtggaagtacaacagatacagatacatcatgacctaccacgagaagccctggctgcccccccccctgatcctgctgagccacgtgggcctgctgctgagaagactgtgctgccacagagccccccacgaccaggaggagggcgacgtgggcctgaagctgtacctgagcaaggaggacctgaagaagctgcacgacttcgaggagcagtgcgtggagaagtacttccacgagaagatggaggacgtgaactgcagctgcgaggagagaatcagagtgaccagcgagagagtgaccgagatgtacttccagctgaaggagatgaacgagaaggtgagcttcatcaaggacagcctgctgagcctggacagccaggtgggccacctgcaggacctgagcgccctgaccgtggacaccctgaaggtgctgagcgccgtggacaccctgcaggaggacgaggccctgctggccaagagaaagcacagcacctgcaagaagctgccccacagctggagcaacgtgatctgcgccgaggtgctgggcagcatggagatcgccggcgagaagaagtaccagtactacagcatgcccagcagcctgctgagaagcctggccggcggcagacacccccccagagtgcagagaggcgccctgctggagatcaccaacagcaagagagaggccaccaacgtgagaaacgaccaggagagacaggagacccagagcagcatcgtggtgagcggcgtgagccccaacagacaggcccacagcaagtacggccagttcctgctggtgcccagcaacctgaagagagtgcccttcagcgccgagaccgtgctgcccctgagcagacccagcgtgcccgacgtgctggccaccgagcaggacatccagaccgaggtgctggtgcacctgaccggccagacccccgtggtgagcgactgggccagcgtggacgagcccaaggagaagcacgagcccatcgcccacctgctggacggccaggacaaggccgagcaggtgctgcccaccctgagctgcacccccgagcccatgaccatgagcagccccctgagccaggccaagatcatgcagaccggcggcggctacgtgaactgggccttcagcgagggcgacgagaccggcgtgttcagcatcaagaagaagtggcagacctgcctgcccagcacctgcgacagcgacagcagcagaagcgagcagcaccagaagcaggcccaggacagcagcctgagcgacaacagcaccagaagcgcccagagcagcgagtgcagcgaggtgggcccctggctgcagcccaacaccagcttctggatcaaccccctgagaagatacagacccttcgccagaagccacagcttcagattccacaaggaggagaagctgatgaagatctgcaagatcaagaacctgagcggcagcagcgagatcggccagggcgcctgggtgaaggccaagatgctgaccaaggacagaagactgagcaagaagaagaagaacacccagggcctgcaggtgcccatcatcaccgtgaacgcctgcagccagagcgaccagctgaaccccgagcccggcgagaacagcatcagcgaggaggagtacagcaagaactggttcaccgtgagcaagttcagccacaccggcgtggagccctacatccaccagaagatgaagaccaaggagatcggccagtgcgccatccagatcagcgactacctgaagcagagccaggaggacctgagcaagaacagcctgtggaacagcagaagcaccaacctgaacagaaacagcctgctgaagagcagcatcggcgtggacaagatcagcgccagcctgaagagcccccaggagccccaccaccactacagcgccatcgagagaaacaacctgatgagactgagccagaccatccccttcacccccgtgcagctgttcgccggcgaggagatcaccgtgtacagactggaggagagcagccccctgaacctggacaagagcatgagcagctggagccagagaggcagagccgccatgatccaggtgctgagcagagaggagatggacggcggcctgagaaaggccatgagagtggtgagcacctggagcgaggacgacatcctgaagcccggccaggtgttcatcgtgaagagcttcctgcccgaggtggtgagaacctggcacaagatcttccaggagagcaccgtgctgcacctgtgcctgagagagatccagcagcagagagccgcccagaagctgatctacaccttcaaccaggtgaagccccagaccatcccctacacccccagattcctggaggtgttcctgatctactgccacagcgccaaccagtggctgaccatcgagaagtacatgaccggcgagttcagaaagtacaacaacaacaacggcgacgagatcacccccaccaacaccctggaggagctgatgctggccttcagccactggacctacgagtacaccagaggcgagctgctggtgctggacctgcagggcgtgggcgagaacctgaccgaccccagcgtgatcaagcccgaggtgaagcagagcagaggcatggtgttcggccccgccaacctgggcgaggacgccatcagaaacttcatcgccaagcaccactgcaacagctgctgcagaaagctgaagctgcccgacctgaagagaaacgactacagccccgagagaatcaacagcaccttcggcctggagatcaagatcgagagcgccgaggagccccccgccagagagaccggcagaaacagccccgaggacgacatgcagctgtag

SEQ ID NO: 103045 - DNA, 6081 bp, Artificial Sequence
  Description of Artificial Sequence: Synthetic coding sequence
atgaaggagcagcccgtgctggagagactgcagagccagaagagctggatcaagggcgtgttcgacaagagagagtgcagcaccatcatccccagcagcaagaacccccacagatgcacccccgtgtgccaggtgtgccagaacctgatcagatgctactgcggcagactgatcggcgaccacgccggcatcgactacagctggaccatcagcgccgccaagggcaaggagagcgagcagtggagcgtggagaagcacaccaccaagagccccaccgacaccttcggcaccatcaacttccaggacggcgagcacacccaccacgccaagtacatcagaaccagctacgacaccaagctggaccacctgctgcacctgatgctgaaggagtggaagatggagctgcccaagctggtgatcagcgtgcacggcggcatccagaacttcaccatgcccagcaagttcaaggagatcttcagccagggcctggtgaaggccgccgagaccaccggcgcctggatcatcaccgagggcatcaacaccggcgtgagcaagcacgtgggcgacgccctgaagagccacagcagccacagcctgagaaagatctggaccgtgggcatccccccctggggcgtgatcgagaaccagagagacctgatcggcaaggacgtggtgtgcctgtaccagaccctggacaaccccctgagcaagctgaccaccctgaacagcatgcacagccacttcatcctgagcgacgacggcaccgtgggcaagtacggcaacgagatgaagctgagaagaaacctggagaagtacctgagcctgcagaagatccactgcagaagcagacagggcgtgcccgtggtgggcctggtggtggagggcggccccaacgtgatcctgagcgtgtgggagaccgtgaaggacaaggaccccgtggtggtgtgcgagggcaccggcagagccgccgacctgctggccttcacccacaagcacctggccgacgagggcatgctgagaccccaggtgaaggaggagatcatctgcatgatccagaacaccttcaacttcagcctgaagcagagcaagcacctgttccagatcctgatggagtgcatggtgcacagagactgcatcaccatcttcgacgccgacagcgaggagcagcaggacctggacctggccatcctgaccgccctgctgaagggcaccaacctgagcgccagcgagcagctgaacctggccatggcctgggacagagtggacatcgccaagaagcacatcctgatctacgagcagcactggaagcccgacgccctggagcaggccatgagcgacgccctggtgatggacagagtggacttcgtgaagctgctgatcgagtacggcgtgaacctgcacagattcctgaccatccccagactggaggagctgtacaacaccaagcagggccccaccaacaccctgctgcaccacctggtgcaggacgtgaagcagcacaccctgctgagcggctacagaatcaccctgatcgacatcggcctggtggtggagtacctgatcggcagagcctacagaagcaactacaccagaaagcacttcagagccctgtacaacaacctgtacagaaagtacaagcaccagagacacagcagcggcaacagaaacgagagcgccgagagcaccctgcacagccagttcatcagaaccgcccagccctacaagttcaaggagaagagcatcgtgctgcacaagagcagaaagaagagcaaggagcagaacgtgagcgacgaccccgagagcaccggcttcctgtacccctacaacgacctgctggtgtgggccgtgctgatgaagagacagaagatggccatgttcttctggcagcacggcgaggaggccaccgtgaaggccgtgatcgcctgcatcctgtacagagccatggcccacgaggccaaggagagccacatggtggacgacgccagcgaggagctgaagaactacagcaagcagttcggccagctggccctggacctgctggagaaggccttcaagcagaacgagagaatggccatgaccctgctgacctacgagctgagaaactggagcaacagcacctgcctgaagctggccgtgagcggcggcctgagacccttcgtgagccacacctgcacccagatgctgctgaccgacatgtggatgggcagactgaagatgagaaagaacagctggctgaagatcatcatcagcatcatcctgccccccaccatcctgaccctggagttcaagagcaaggccgagatgagccacgtgccccagagccaggacttccagttcatgtggtactacagcgaccagaacgccagcagcagcaaggagagcgccagcgtgaaggagtacgacctggagagaggccacgacgagaagctggacgagaaccagcacttcggcctggagagcggccaccagcacctgccctggaccagaaaggtgtacgagttctacagcgcccccatcgtgaagttctggttctacaccatggcctacctggccttcctgatgctgttcacctacaccgtgctggtggagatgcagccccagcccagcgtgcaggagtggctggtgagcatctacatcttcaccaacgccatcgaggtggtgagagagatctgcatcagcgagcccggcaagttcacccagaaggtgaaggtgtggatcagcgagtactggaacctgaccgagaccgtggccatcggcctgttcagcgccggcttcgtgctgagatggggcgacccccccttccacaccgccggcagactgatctactgcatcgacatcatcttctggttcagcagactgctggacttcttcgccgtgaaccagcacgccggcccctacgtgaccatgatcgccaagatgaccgccaacatgttctacatcgtgatcatcatggccatcgtgctgctgagcttcggcgtggccagaaaggccatcctgagccccaaggagccccccagctggagcctggccagagacatcgtgttcgagccctactggatgatctacggcgaggtgtacgccggcgagatcgacgtgtgcagcagccagcccagctgcccccccggcagcttcctgacccccttcctgcaggccgtgtacctgttcgtgcagtacatcatcatggtgaacctgctgatcgccttcttcaacaacgtgtacctggacatggagagcatcagcaacaacctgtggaagtacaacagatacagatacatcatgacctaccacgagaagccctggctgcccccccccctgatcctgctgagccacgtgggcctgctgctgagaagactgtgctgccacagagccccccacgaccaggaggagggcgacgtgggcctgaagctgtacctgagcaaggaggacctgaagaagctgcacgacttcgaggagcagtgcgtggagaagtacttccacgagaagatggaggacgtgaactgcagctgcgaggagagaatcagagtgaccagcgagagagtgaccgagatgtacttccagctgaaggagatgaacgagaaggtgagcttcatcaaggacagcctgctgagcctggacagccaggtgggccacctgcaggacctgagcgccctgaccgtggacaccctgaaggtgctgagcgccgtggacaccctgcaggaggacgaggccctgctggccaagagaaagcacagcacctgcaagaagctgccccacagctggagcaacgtgatctgcgccgaggtgctgggcagcatggagatcgccggcgagaagaagtaccagtactacagcatgcccagcagcctgctgagaagcctggccggcggcagacacccccccagagtgcagagaggcgccctgctggagatcaccaacagcaagagagaggccaccaacgtgagaaacgaccaggagagacaggagacccagagcagcatcgtggtgagcggcgtgagccccaacagacaggcccacagcaagtacggccagttcctgctggtgcccagcaacctgaagagagtgcccttcagcgccgagaccgtgctgcccctgagcagacccagcgtgcccgacgtgctggccaccgagcaggacatccagaccgaggtgctggtgcacctgaccggccagacccccgtggtgagcgactgggccagcgtggacgagcccaaggagaagcacgagcccatcgcccacctgctggacggccaggacaaggccgagcaggtgctgcccaccctgagctgcacccccgagcccatgaccatgagcagccccctgagccaggccaagatcatgcagaccggcggcggctacgtgaactgggccttcagcgagggcgacgagaccggcgtgttcagcatcaagaagaagtggcagacctgcctgcccagcacctgcgacagcgacagcagcagaagcgagcagcaccagaagcaggcccaggacagcagcctgagcgacaacagcaccagaagcgcccagagcagcgagtgcagcgaggtgggcccctggctgcagcccaacaccagcttctggatcaaccccctgagaagatacagacccttcgccagaagccacagcttcagattccacaaggaggagaagctgatgaagatctgcaagatcaagaacctgagcggcagcagcgagatcggccagggcgcctgggtgaaggccaagatgctgaccaaggacagaagactgagcaagaagaagaagaacacccagggcctgcaggtgcccatcatcaccgtgaacgcctgcagccagagcgaccagctgaaccccgagcccggcgagaacagcatcagcgaggaggagtacagcaagaactggttcaccgtgagcaagttcagccacaccggcgtggagccctacatccaccagaagatgaagaccaaggagatcggccagtgcgccatccagatcagcgactacctgaagcagagccaggaggacctgagcaagaacagcctgtggaacagcagaagcaccaacctgaacagaaacagcctgcacgtgatcaagatgcccatcagcagcctgatcagcgagatcagcgccagcctgaagagcccccaggagccccaccaccactacagcgccatcgagagaaacaacctgatgagactgagccagaccatccccttcacccccgtgcagctgttcgccggcgaggagatcaccgtgtacagactggaggagagcagccccctgaacctggacaagagcatgagcagctggagccagagaggcagagccgccatgatccaggtgctgagcagagaggagatggacggcggcctgagaaaggccatgagagtggtgagcacctggagcgaggacgacatcctgaagcccggccaggtgttcatcgtgaagagcttcctgcccgaggtggtgagaacctggcacaagatcttccaggagagcaccgtgctgcacctgtgcctgagagagatccagcagcagagagccgcccagaagctgatctacaccttcaaccaggtgaagccccagaccatcccctacacccccagattcctggaggtgttcctgatctactgccacagcgccaaccagtggctgaccatcgagaagtacatgaccggcgagttcagaaagtacaacaacaacaacggcgacgagatcacccccaccaacaccctggaggagctgatgctggccttcagccactggacctacgagtacaccagaggcgagctgctggtgctggacctgcagggcgtgggcgagaacctgaccgaccccagcgtgatcaagcccgaggtgaagcagagcagaggcatggtgttcggccccgccaacctgggcgaggacgccatcagaaacttcatcgccaagcaccactgcaacagctgctgcagaaagctgaagctgcccgacctgaagagaaacgactacagccccgagagaatcaacagcaccttcggcctggagatcaagatcgagagcgccgaggagccccccgccagagagaccggcagaaacagccccgaggacgacatgcagctgtag

SEQ ID NO: 103046 - DNA, 5598 bp, Artificial Sequence
  Description of Artificial Sequence: Synthetic coding sequence
atgagccagaagagctggatcgagagcaccctgaccaagagagagtgcgtgtacatcatccccagcagcaaggacccccacagatgcctgcccggctgccagatctgccagcagctggtgagatgcttctgcggcagactggtgaagcagcacgcctgcttcaccgccagcctggccatgaagtacagcgacgtgaagctgggcgaccacttcaaccaggccatcgaggagtggagcgtggagaagcacaccgagcagagccccaccgacgcctacggcgtgatcaacttccagggcggcagccacagctacagagccaagtacgtgagactgagctacgacaccaagcccgaggtgatcctgcagctgctgctgaaggagtggcagatggagctgcccaagctggtgatcagcgtgcacggcggcatgcagaagttcgagctgcaccccagaatcaagcagctgctgggcaagggcctgatcaaggccgccgtgaccaccggcgcctggatcctgaccggcggcgtgaacaccggcgtggccaagcacgtgggcgacgccctgaaggagcacgccagcagaagcagcagaaagatctgcaccatcggcatcgccccctggggcgtgatcgagaacagaaacgacctggtgggcagagacgtggtggccccctaccagaccctgctgaaccccctgagcaagctgaacgtgctgaacaacctgcacagccacttcatcctggtggacgacggcaccgtgggcaagtacggcgccgaggtgagactgagaagagagctggagaagaccatcaaccagcagagaatccacgccagaatcggccagggcgtgcccgtggtggccctgatcttcgagggcggccccaacgtgatcctgaccgtgctggagtacctgcaggagagcccccccgtgcccgtggtggtgtgcgagggcaccggcagagccgccgacctgctggcctacatccacaagcagaccgaggagggcggcaacctgcccgacgccgccgagcccgacatcatcagcaccatcaagaagaccttcaacttcggccagaacgaggccctgcacctgttccagaccctgatggagtgcatgaagagaaaggagctgatcaccgtgttccacatcggcagcgacgagcaccaggacatcgacgtggccatcctgaccgccctgctgaagggcaccaacgccagcgccttcgaccagctgatcctgaccctggcctgggacagagtggacatcgccaagaaccacgtgttcgtgtacggccagcagtggctggtgggcagcctggagcaggccatgctggacgccctggtgatggacagagtggccttcgtgaagctgctgatcgagaacggcgtgagcatgcacaagttcctgaccatccccagactggaggagctgtacaacaccaagcagggccccaccaaccccatgctgttccacctggtgagagacgtgaagcagggcaacctgccccccggctacaagatcaccctgatcgacatcggcctggtgatcgagtacctgatgggcggcacctacagatgcacctacaccagaaagagattcagactgatctacaacagcctgggcggcaacaacagaagaagcggcagaaacaccagcagcagcaccccccagctgagaaagagccacgagagcttcggcaacagagccgacaagaaggagaagatgagacacaaccacttcatcaagaccgcccagccctacagacccaagatcgacaccgtgatggaggagggcaagaagaagagaaccaaggacgagatcgtggacatcgacgaccccgagaccaagagattcccctaccccctgaacgagctgctgatctgggcctgcctgatgaagagacaggtgatggccagattcctgtggcagcacggcgaggagagcatggccaaggccctggtggcctgcaagatctacagaagcatggcctacgaggccaagcagagcgacctggtggacgacaccagcgaggagctgaagcagtacagcaacgacttcggccagctggccgtggagctgctggagcagagcttcagacaggacgagaccatggccatgaagctgctgacctacgagctgaagaactggagcaacagcacctgcctgaagctggccgtgagcagcagactgagacccttcgtggcccacacctgcacccagatgctgctgagcgacatgtggatgggcagactgaacatgagaaagaacagctggtacaaggtgatcctgagcatcctggtgccccccgccatcctgctgctggagtacaagaccaaggccgagatgagccacatcccccagagccaggacgcccaccagatgaccatggacgacagcgagaacaacttccagaacatcaccgaggagatccccatggaggtgttcaaggaggtgagaatcctggacagcaacgagggcaagaacgagatggagatccagatgaagagcaagaagctgcccatcaccagaaagttctacgccttctaccacgcccccatcgtgaagttctggttcaacaccctggcctacctgggcttcctgatgctgtacaccttcgtggtgctggtgcagatggagcagctgcccagcgtgcaggagtggatcgtgatcgcctacatcttcacctacgccatcgagaaggtgagagagatcttcatgagcgaggccggcaaggtgaaccagaagatcaaggtgtggttcagcgactacttcaacatcagcgacaccatcgccatcatcagcttcttcatcggcttcggcctgagattcggcgccaagtggaacttcgccaacgcctacgacaaccacgtgttcgtggccggcagactgatctactgcctgaacatcatcttctggtacgtgagactgctggacttcctggccgtgaaccagcaggccggcccctacgtgatgatgatcggcaagatggtggccaacatgttctacatcgtggtgatcatggccctggtgctgctgagcttcggcgtgcccagaaaggccatcctgtacccccacgaggcccccagctggaccctggccaaggacatcgtgttccacccctactggatgatcttcggcgaggtgtacgcctacgagatcgacgtgtgcgccaacgacagcgtgatcccccagatctgcggccccggcacctggctgacccccttcctgcaggccgtgtacctgttcgtgcagtacatcatcatggtgaacctgctgatcgccttcttcaacaacgtgtacctgcaggtgaaggccatcagcaacatcgtgtggaagtaccagagataccacttcatcatggcctaccacgagaagcccgtgctgcccccccccctgatcatcctgagccacatcgtgagcctgttctgctgcatctgcaagagaagaaagaaggacaagaccagcgacggccccaagctgttcctgaccgaggaggaccagaagaagctgcacgacttcgaggagcagtgcgtggagatgtacttcaacgagaaggacgacaagttccacagcggcagcgaggagagaatcagagtgaccttcgagagagtggagcagatgtgcatccagatcaaggaggtgggcgacagagtgaactacatcaagagaagcctgcagagcctggacagccagatcggccacctgcaggacctgagcgccctgaccgtggacaccctgaagaccctgaccgcccagaaggccagcgaggccagcaaggtgcacaacgagatcaccagagagctgagcatcagcaagcacctggcccagaacctgatcgacgacggccccgtgagacccagcgtgtggaagaagcacggcgtggtgaacaccctgagcagcagcctgccccagggcgacctggagagcaacaaccccttccactgcaacatcctgatgaaggacgacaaggacccccagtgcaacatcttcggccaggacctgcccgccgtgccccagagaaaggagttcaacttccccgaggccggcagcagcagcggcgccctgttccccagcgccgtgagcccccccgagctgagacagagactgcacggcgtggagctgctgaagatcttcaacaagaaccagaagctgggcagcagcagcaccagcatcccccacctgagcagcccccccaccaagttcttcgtgagcacccccagccagcccagctgcaagagccacctggagaccggcaccaaggaccaggagaccgtgtgcagcaaggccaccgagggcgacaacaccgagttcggcgccttcgtgggccacagagacagcatggacctgcagagattcaaggagaccagcaacaagatcaagatcctgagcaacaacaacaccagcgagaacaccctgaagagagtgagcagcctggccggcttcaccgactgccacagaaccagcatccccgtgcacagcaagcaggccgagaagatcagcagaagacccagcaccgaggacacccacgaggtggacagcaaggccgccctgatccccgactggctgcaggacagacccagcaacagagagatgcccagcgaggagggcaccctgaacggcctgaccagccccttcaagcccgccatggacaccaactactactacagcgccgtggagagaaacaacctgatgagactgagccagagcatccccttcacccccgtgccccccagaggcgagcccgtgaccgtgtacagactggaggagagcagccccaacatcctgaacaacagcatgagcagctggagccagctgggcctgtgcgccaagatcgagttcctgagcaaggaggagatgggcggcggcctgagaagagccgtgaaggtgcagtgcacctggagcgagcacgacatcctgaagagcggccacctgtacatcatcaagagcttcctgcccgaggtggtgaacacctggagcagcatctacaaggaggacaccgtgctgcacctgtgcctgagagagatccagcagcagagagccgcccagaagctgaccttcgccttcaaccagatgaagcccaagagcatcccctacagccccagattcctggaggtgttcctgctgtactgccacagcgccggccagtggttcgccgtggaggagtgcatgaccggcgagttcagaaagtacaacaacaacaacggcgacgagatcatccccaccaacaccctggaggagatcatgctggccttcagccactggacctacgagtacaccagaggcgagctgctggtgctggacctgcagggcgtgggcgagaacctgaccgaccccagcgtgatcaaggccgaggagaagagaagctgcgacatggtgttcggccccgccaacctgggcgaggacgccatcaagaacttcagagccaagcaccactgcaacagctgctgcagaaagctgaagctgcccgacctgaagagaaacgactacacccccgacaagatcatcttcccccaggacgagcccagcgacctgaacctgcagcccggcaacagcaccaaggagagcgagagcaccaacagcgtgagactgatgctgtag

SEQ ID NO: 103047 - DNA, 3315 bp, Artificial Sequence
  Description of Artificial Sequence: Synthetic coding sequence
atgagcttcagagccgccagactgagcatgagaaacagaagaaacgacaccctggacagcaccagaaccctgtacagcagcgccagcagaagcaccgacctgagctacagcgagagcgacctggtgaacttcatccaggccaacttcaagaagagagagtgcgtgttcttcaccaaggacagcaaggccaccgagaacgtgtgcaagtgcggctacgcccagagccagcacatggagggcacccagatcaaccagagcgagaagtggaactacaagaagcacaccaaggagttccccaccgacgccttcggcgacatccagttcgagaccctgggcaagaagggcaagtacatcagactgagctgcgacaccgacgccgagatcctgtacgagctgctgacccagcactggcacctgaagacccccaacctggtgatcagcgtgaccggcggcgccaagaacttcgccctgaagcccagaatgagaaagatcttcagcagactgatctacatcgcccagagcaagggcgcctggatcctgaccggcggcacccactacggcctgatgaagtacatcggcgaggtggtgagagacaacaccatcagcagaagcagcgaggagaacatcgtggccatcggcatcgccgcctggggcatggtgagcaacagagacaccctgatcagaaactgcgacgccgagggctacttcctggcccagtacctgatggacgacttcaccagagaccccctgtacatcctggacaacaaccacacccacctgctgctggtggacaacggctgccacggccaccccaccgtggaggccaagctgagaaaccagctggagaagtacatcagcgagagaaccatccaggacagcaactacggcggcaagatccccatcgtgtgcttcgcccagggcggcggcaaggagaccctgaaggccatcaacaccagcatcaagaacaagatcccctgcgtggtggtggagggcagcggccagatcgccgacgtgatcgccagcctggtggaggtggaggacgccctgaccagcagcgccgtgaaggagaagctggtgagattcctgcccagaaccgtgagcagactgcccgaggaggagaccgagagctggatcaagtggctgaaggagatcctggagtgcagccacctgctgaccgtgatcaagatggaggaggccggcgacgagatcgtgagcaacgccatcagctacgccctgtacaaggccttcagcaccagcgagcaggacaaggacaactggaacggccagctgaagctgctgctggagtggaaccagctggacctggccaacgacgagatcttcaccaacgacagaagatgggagagcgccgacctgcaggaggtgatgttcaccgccctgatcaaggacagacccaagttcgtgagactgttcctggagaacggcctgaacctgagaaagttcctgacccacgacgtgctgaccgagctgttcagcaaccacttcagcaccctggtgtacagaaacctgcagatcgccaagaacagctacaacgacgccctgctgaccttcgtgtggaagctggtggccaacttcagaagaggcttcagaaaggaggacagaaacggcagagacgagatggacatcgagctgcacgacgtgagccccatcaccagacaccccctgcaggccctgttcatctgggccatcctgcagaacaagaaggagctgagcaaggtgatctgggagcagaccagaggctgcaccctggccgccctgggcgccagcaagctgctgaagaccctggccaaggtgaagaacgacatcaacgccgccggcgagagcgaggagctggccaacgagtacgagaccagagccgtggagctgttcaccgagtgctacagcagcgacgaggacctggccgagcagctgctggtgtacagctgcgaggcctggggcggcagcaactgcctggagctggccgtggaggccaccgaccagcacttcatcgcccagcccggcgtgcagaacttcctgagcaagcagtggtacggcgagatcagcagagacaccaagaactggaagatcatcctgtgcctgttcatcatccccctggtgggctgcggcttcgtgagcttcagaaagaagcccgtggacaagcacaagaagctgctgtggtactacgtggccttcttcaccagccccttcgtggtgttcagctggaacgtggtgttctacatcgccttcctgctgctgttcgcctacgtgctgctgatggacttccacagcgtgccccacccccccgagctggtgctgtacagcctggtgttcgtgctgttctgcgacgaggtgagacagtggtacgtgaacggcgtgaactacttcaccgacctgtggaacgtgatggacaccctgggcctgttctacttcatcgccggcatcgtgttcagactgcacagcagcaacaagagcagcctgtacagcggcagagtgatcttctgcctggactacatcatcttcaccctgagactgatccacatcttcaccgtgagcagaaacctgggccccaagatcatcatgctgcagagaatgctgatcgacgtgttcttcttcctgttcctgttcgccgtgtggatggtggccttcggcgtggccagacagggcatcctgagacagaacgagcagagatggagatggatcttcagaagcgtgatctacgagccctacctggccatgttcggccaggtgcccagcgacgtggacggcaccacctacgacttcgcccactgcaccttcaccggcaacgagagcaagcccctgtgcgtggagctggacgagcacaacctgcccagattccccgagtggatcaccatccccctggtgtgcatctacatgctgagcaccaacatcctgctggtgaacctgctggtggccatgttcggctacaccgtgggcaccgtgcaggagaacaacgaccaggtgtggaagttccagagatacttcctggtgcaggagtactgcagcagactgaacatccccttccccttcatcgtgttcgcctacttctacatggtggtgaagaagtgcttcaagtgctgctgcaaggagaagaacatggagagcagcgtgtgctgcttcaagaacgaggacaacgagaccctggcctgggagggcgtgatgaaggagaactacctggtgaagatcaacaccaaggccaacgacaccagcgaggagatgagacacagattcagacagctggacaccaagctgaacgacctgaagggcctgctgaaggagatcgccaacaagatcaagtag

SEQ ID NO: 103048 - DNA, 579 bp, Artificial Sequence
  Description of Artificial Sequence: Synthetic coding sequence
atgaagagcttcctgcccgtgcacaccatcgtgctgatcagagagaacgtgtgcaagtgcggctacgcccagagccagcacatggagggcacccagatcaaccagagcgagaagtggaactacaagaagcacaccaaggagttccccaccgacgccttcggcgacatccagttcgagaccctgggcaagaagggcaagtacatcagactgagctgcgacaccgacgccgagatcctgtacgagctgctgacccagcactggcacctgaagacccccaacctggtgatcagcgtgaccggcggcgccaagaacttcgccctgaagcccagaatgagaaagatcttcagcagactgatctacatcgcccagagcaagggcgcctggatcctgaccggcggcacccactacggcctgatgaagtacatcggcgaggtggtgagagacaacaccatcagcagaagcagcgaggagaacatcgtggccatcggcatcgccgcctggggcatggtgagcaacagagacaccctgatcagaaactgcgacgccgaggtgcccgtgggccaggaggaggtgtgctag

SEQ ID NO: 103049 - DNA, 498 bp, Artificial Sequence
  Description of Artificial Sequence: Synthetic coding sequence
atggagggcacccagatcaaccagagcgagaagtggaactacaagaagcacaccaaggagttccccaccgacgccttcggcgacatccagttcgagaccctgggcaagaagggcaagtacatcagactgagctgcgacaccgacgccgagatcctgtacgagctgctgacccagcactggcacctgaagacccccaacctggtgatcagcgtgaccggcggcgccaagaacttcgccctgaagcccagaatgagaaagatcttcagcagactgatctacatcgcccagagcaagggcgcctggatcctgaccggcggcacccactacggcctgatgaagtacatcggcgaggtggtgagagacaacaccatcagcagaagcagcgaggagaacatcgtggccatcggcatcgccgcctggggcatggtgagcaacagagacaccctgatcagaaactgcgacgccgaggtgcccgtgggccaggaggaggtgtgctag

SEQ ID NO: 103050 - DNA, 2049 bp, Artificial Sequence
  Description of Artificial Sequence: Synthetic coding sequence
atgcaggccatcaacaccagcatcaagaacaagatcccctgcgtggtggtggagggcagcggccagatcgccgacgtgatcgccagcctggtggaggtggaggacgccctgaccagcagcgccgtgaaggagaagctggtgagattcctgcccagaaccgtgagcagactgcccgaggaggagaccgagagctggatcaagtggctgaaggagatcctggagtgcagccacctgctgaccgtgatcaagatggaggaggccggcgacgagatcgtgagcaacgccatcagctacgccctgtacaaggccttcagcaccagcgagcaggacaaggacaactggaacggccagctgaagctgctgctggagtggaaccagctggacctggccaacgacgagatcttcaccaacgacagaagatgggagagcgccgacctgcaggaggtgatgttcaccgccctgatcaaggacagacccaagttcgtgagactgttcctggagaacggcctgaacctgagaaagttcctgacccacgacgtgctgaccgagctgttcagcaaccacttcagcaccctggtgtacagaaacctgcagatcgccaagaacagctacaacgacgccctgctgaccttcgtgtggaagctggtggccaacttcagaagaggcttcagaaaggaggacagaaacggcagagacgagatggacatcgagctgcacgacgtgagccccatcaccagacaccccctgcaggccctgttcatctgggccatcctgcagaacaagaaggagctgagcaaggtgatctgggagcagaccagaggctgcaccctggccgccctgggcgccagcaagctgctgaagaccctggccaaggtgaagaacgacatcaacgccgccggcgagagcgaggagctggccaacgagtacgagaccagagccgtggagctgttcaccgagtgctacagcagcgacgaggacctggccgagcagctgctggtgtacagctgcgaggcctggggcggcagcaactgcctggagctggccgtggaggccaccgaccagcacttcatcgcccagcccggcgtgcagtggtacgtgaacggcgtgaactacttcaccgacctgtggaacgtgatggacaccctgggcctgttctacttcatcgccggcatcgtgttcagactgcacagcagcaacaagagcagcctgtacagcggcagagtgatcttctgcctggactacatcatcttcaccctgagactgatccacatcttcaccgtgagcagaaacctgggccccaagatcatcatgctgcagagaatgctgatcgacgtgttcttcttcctgttcctgttcgccgtgtggatggtggccttcggcgtggccagacagggcatcctgagacagaacgagcagagatggagatggatcttcagaagcgtgatctacgagccctacctggccatgttcggccaggtgcccagcgacgtggacggcaccacctacgacttcgcccactgcaccttcaccggcaacgagagcaagcccctgtgcgtggagctggacgagcacaacctgcccagattccccgagtggatcaccatccccctggtgtgcatctacatgctgagcaccaacatcctgctggtgaacctgctggtggccatgttcggctacaccgtgggcaccgtgcaggagaacaacgaccaggtgtggaagttccagagatacttcctggtgcaggagtactgcagcagactgaacatccccttccccttcatcgtgttcgcctacttctacatggtggtgaagaagtgcttcaagtgctgctgcaaggagaagaacatggagagcagcgtgtgctgcttcaagaacgaggacaacgagaccctggcctgggagggcgtgatgaaggagaactacctggtgaagatcaacaccaaggccaacgacaccagcgaggagatgagacacagattcagacagctggacaccaagctgaacgacctgaagggcctgctgaaggagatcgccaacaagatcaagtag

SEQ ID NO: 103051 - DNA, 2514 bp, Artificial Sequence
  Description of Artificial Sequence: Synthetic coding sequence
atggagaccctgacccccggccacctgcagcccagccccagcagccccagacccagagccgcccccggcagcctgggcagagtgaccagaagaagactgagcagatggatcgccctgaccagaaaggtgagctggacccccgccagacccagccagagcgccctgctgagccccagcagaggccaggagaccgccccccccgtgcccggctgctgccccagaaccctgagcccccccgcccccagaagacccagcggcagcatgatcgccggcgtgagcctgaagcccctgctgagaatcaccgccagaatctggagagcctgctgcagcagctgcagaagagccagaagcaccagccagaccaccagcagcaaggtggcccccgccctgggcagcggcagagcccccgccctggcctgccccgacccccccctgtgcctgagcgaccccgagaccggcaagacctgcctgctgaaggccatgctgaacctgcacgacggccagaacaccaccatccccctgctgctggagatcgccagacagaccgacagcctgaaggagctggtgaacgccagctacaccgacagctactacaagggccagaccgccctgcacatcgccatcgagagaagaaacatggccctggtgaccctgctggtggagaacggcgccgacgtgcaggccgccgcccacggcgacttcttcaagaagaccaagggcagacccggcttctacttcggcgagctgcccctgagcctggccgcctgcaccaaccagctgggcatcgtgaagttcctgctgcagaacagctggcagaccgccgacatcagcgccagagacagcgtgggcaacaccgtgctgcacgccctggtggaggtggccgacaacaccgccgacaacaccaagttcgtgaccagcatgtacaacgagatcctgatgctgggcgccaagctgcaccccaccctgaagctggaggagctgaccaacaagaagggcatgacccccctggccctggccgccggcaccggcaagatcggcgtgctggcctacatcctgcagagagagatccaggagcccgagtgcagacacctgagcagaaagttcaccgagtgggcctacggccccgtgcacagcagcctgtacgacctgagctgcatcgacacctgcgagaagaacagcgtgctggaggtgatcgcctacagcagcagcgagacccccaacagacacgacatgctgctggtggagcccctgaacagactgctgcaggacaagtgggacagattcgtgaagagaatcttctacttcaacttcctggtgtactgcctgtacatgatcatcttcaccatggccgcctactacagacccgtggacggcctgccccccttcaagatggagaagaccggcgactacttcagagtgaccggcgagatcctgagcgtgctgggcggcgtgtacttcttcttcagaggcatccagtacttcctgcagagaagacccagcatgaagaccctgttcgtggacagctacagcgagatgctgttcttcctgcagagcctgttcatgctggccaccgtggtgctgtacttcagccacctgaaggagtacgtggccagcatggtgttcagcctggccctgggctggaccaacatgctgtactacaccagaggcttccagcagatgggcatctacgccgtgatgatcgagaagatgatcctgagagacctgtgcagattcatgttcgtgtacatcgtgttcctgttcggcttcagcaccgccgtggtgaccctgatcgaggacggcaagaacgacagcctgcccagcgagagcaccagccacagatggagaggccccgcctgcagaccccccgacagcagctacaacagcctgtacagcacctgcctggagctgttcaagttcaccatcggcatgggcgacctggagttcaccgagaactacgacttcaaggccgtgttcatcatcctgctgctggcctacgtgatcctgacctacatcctgctgctgaacatgctgatcgccctgatgggcgagaccgtgaacaagatcgcccaggagagcaagaacatctggaagctgcagagagccatcaccatcctggacaccgagaagagcttcctgaagtgcatgagaaaggccttcagaagcggcaagctgctgcaggtgggctacacccccgacggcaaggacgactacagatggtgcttcagagtggacgaggtgaactggaccacctggaacaccaacgtgggcatcatcaacgaggaccccggcaactgcgagggcgtgaagagaaccctgagcttcagcctgagaagcagcagagtgagcggcagacactggaagaacttcgccctggtgcccctgctgagagaggccagcgccagagacagacagagcgcccagcccgaggaggtgtacctgagacagttcagcggcagcctgaagcccgaggacgccgaggtgttcaagagccccgccgccagcggcgagaagtag

SEQ ID NO: 103052 - DNA, 2340 bp, Artificial Sequence
  Description of Artificial Sequence: Synthetic coding sequence
atgaagaagtggagcagcaccgacctgggcgccgccgccgaccccctgcagaaggacacctgccccgaccccctggacggcgaccccaacagcagacccccccccgccaagccccagctgagcaccgccaagagcagaaccagactgttcggcaagggcgacagcgaggaggccttccccgtggactgcccccacgaggagggcgagctggacagctgccccaccatcaccgtgagccccgtgatcaccatccagagacccggcgacggccccaccggcgccagactgctgagccaggacagcgtggccgccagcaccgagaagaccctgagactgtacgacagaagaagcatcttcgaggccgtggcccagaacaactgccaggacctggagagcctgctgctgttcctgcagaagagcaagaagcacctgaccgacaacgagttcaaggaccccgagaccggcaagacctgcctgctgaaggccatgctgaacctgcacgacggccagaacaccaccatccccctgctgctggagatcgccagacagaccgacagcctgaaggagctggtgaacgccagctacaccgacagctactacaagggccagaccgccctgcacatcgccatcgagagaagaaacatggccctggtgaccctgctggtggagaacggcgccgacgtgcaggccgccgcccacggcgacttcttcaagaagaccaagggcagacccggcttctacttcggcgagctgcccctgagcctggccgcctgcaccaaccagctgggcatcgtgaagttcctgctgcagaacagctggcagaccgccgacatcagcgccagagacagcgtgggcaacaccgtgctgcacgccctggtggaggtggccgacaacaccgccgacaacaccaagttcgtgaccagcatgtacaacgagatcctgatgctgggcgccaagctgcaccccaccctgaagctggaggagctgaccaacaagaagggcatgacccccctggccctggccgccggcaccggcaagatcggcaacagacacgacatgctgctggtggagcccctgaacagactgctgcaggacaagtgggacagattcgtgaagagaatcttctacttcaacttcctggtgtactgcctgtacatgatcatcttcaccatggccgcctactacagacccgtggacggcctgccccccttcaagatggagaagaccggcgactacttcagagtgaccggcgagatcctgagcgtgctgggcggcgtgtacttcttcttcagaggcatccagtacttcctgcagagaagacccagcatgaagaccctgttcgtggacagctacagcgagatgctgttcttcctgcagagcctgttcatgctggccaccgtggtgctgtacttcagccacctgaaggagtacgtggccagcatggtgttcagcctggccctgggctggaccaacatgctgtactacaccagaggcttccagcagatgggcatctacgccgtgatgatcgagaagatgatcctgagagacctgtgcagattcatgttcgtgtacatcgtgttcctgttcggcttcagcaccgccgtggtgaccctgatcgaggacggcaagaacgacagcctgcccagcgagagcaccagccacagatggagaggccccgcctgcagaccccccgacagcagctacaacagcctgtacagcacctgcctggagctgttcaagttcaccatcggcatgggcgacctggagttcaccgagaactacgacttcaaggccgtgttcatcatcctgctgctggcctacgtgatcctgacctacatcctgctgctgaacatgctgatcgccctgatgggcgagaccgtgaacaagatcgcccaggagagcaagaacatctggaagctgcagagagccatcaccatcctggacaccgagaagagcttcctgaagtgcatgagaaaggccttcagaagcggcaagctgctgcaggtgggctacacccccgacggcaaggacgactacagatggtgcttcagagtggacgaggtgaactggaccacctggaacaccaacgtgggcatcatcaacgaggaccccggcaactgcgagggcgtgaagagaaccctgagcttcagcctgagaagcagcagagtgagcggcagacactggaagaacttcgccctggtgcccctgctgagagaggccagcgccagagacagacagagcgcccagcccgaggaggtgtacctgagacagttcagcggcagcctgaagcccgaggacgccgaggtgttcaagagccccgccgccagcggcgagaagtag

SEQ ID NO: 103053 - DNA, 2520 bp, Artificial Sequence; identical to SEQ ID NO: 102983
  Description of Artificial Sequence: Synthetic coding sequence

SEQ ID NO: 103054 - DNA, 2520 bp, Artificial Sequence; identical to SEQ ID NO: 102983
  Description of Artificial Sequence: Synthetic coding sequence

SEQ ID NO: 103055 - DNA, 2553 bp, Artificial Sequence
  Description of Artificial Sequence: Synthetic coding sequence
atgaagaagtggagcagcaccgacctgggcgccgccgccgaccccctgcagaaggacacctgccccgaccccctggacggcgaccccaacagcagacccccccccgccaagccccagctgagcaccgccaagagcagaaccagactgttcggcaagggcgacagcgaggaggccttccccgtggactgcccccacgaggagggcgagctggacagctgccccaccatcaccgtgagccccgtgatcaccatccagagacccggcgacggccccaccggcgccagactgctgagccaggacagcgtggccgccagcaccgagaagaccctgagactgtacgacagaagaagcatcttcgaggccgtggcccagaacaactgccaggacctggagagcctgctgctgttcctgcagaagagcaagaagcacctgaccgacaacgagttcaaggaccccgagaccggcaagacctgcctgctgaaggccatgctgaacctgcacgacggccagaacaccaccatccccctgctgctggagatcgccagacagaccgacagcctgaaggagctggtgaacgccagctacaccgacagctactacaagggccagaccgccctgcacatcgccatcgagagaagaaacatggccctggtgaccctgctggtggagaacggcgccgacgtgcaggccgccgcccacggcgacttcttcaagaagaccaagggcagacccggcttctacttcggcgagctgcccctgagcctggccgcctgcaccaaccagctgggcatcgtgaagttcctgctgcagaacagctggcagaccgccgacatcagcgccagagacagcgtgggcaacaccgtgctgcacgccctggtggaggtggccgacaacaccgccgacaacaccaagttcgtgaccagcatgtacaacgagatcctgatgctgggcgccaagctgcaccccaccctgaagctggaggagctgaccaacaagaagggcatgacccccctggccctggccgccggcaccggcaagatcggcgtgatcgagaacggcccccccctgagcttcatggtgctggcctacatcctgcagagagagatccaggagcccgagtgcagacacctgagcagaaagttcaccgagtgggcctacggccccgtgcacagcagcctgtacgacctgagctgcatcgacacctgcgagaagaacagcgtgctggaggtgatcgcctacagcagcagcgagacccccaacagacacgacatgctgctggtggagcccctgaacagactgctgcaggacaagtgggacagattcgtgaagagaatcttctacttcaacttcctggtgtactgcctgtacatgatcatcttcaccatggccgcctactacagacccgtggacggcctgccccccttcaagatggagaagaccggcgactacttcagagtgaccggcgagatcctgagcgtgctgggcggcgtgtacttcttcttcagaggcatccagtacttcctgcagagaagacccagcatgaagaccctgttcgtggacagctacagcgagatgctgttcttcctgcagagcctgttcatgctggccaccgtggtgctgtacttcagccacctgaaggagtacgtggccagcatggtgttcagcctggccctgggctggaccaacatgctgtactacaccagaggcttccagcagatgggcatctacgccgtgatgatcgagaagatgatcctgagagacctgtgcagattcatgttcgtgtacatcgtgttcctgttcggcttcagcaccgccgtggtgaccctgatcgaggacggcaagaacgacagcctgcccagcgagagcaccagccacagatggagaggccccgcctgcagaccccccgacagcagctacaacagcctgtacagcacctgcctggagctgttcaagttcaccatcggcatgggcgacctggagttcaccgagaactacgacttcaaggccgtgttcatcatcctgctgctggcctacgtgatcctgacctacatcctgctgctgaacatgctgatcgccctgatgggcgagaccgtgaacaagatcgcccaggagagcaagaacatctggaagctgcagagagccatcaccatcctggacaccgagaagagcttcctgaagtgcatgagaaaggccttcagaagcggcaagctgctgcaggtgggctacacccccgacggcaaggacgactacagatggtgcttcagagtggacgaggtgaactggaccacctggaacaccaacgtgggcatcatcaacgaggaccccggcaactgcgagggcgtgaagagaaccctgagcttcagcctgagaagcagcagagtgagcggcagacactggaagaacttcgccctggtgcccctgctgagagaggccagcgccagagacagacagagcgcccagcccgaggaggtgtacctgagacagttcagcggcagcctgaagcccgaggacgccgaggtgttcaagagccccgccgccagcggcgagaagtag

SEQ ID NO: 103056 - DNA, 2295 bp, Artificial Sequence
  Description of Artificial Sequence: Synthetic coding sequence
atgaccagccccagcagcagccccgtgttcagactggagaccctggacggcggccaggaggacggcagcgaggccgacagaggcaagctggacttcggcagcggcctgccccccatggagagccagttccagggcgaggacagaaagttcgccccccagatcagagtgaacctgaactacagaaagggcaccggcgccagccagcccgaccccaacagattcgacagagacagactgttcaacgccgtgagcagaggcgtgcccgaggacctggccggcctgcccgagtacctgagcaagaccagcaagtacctgaccgacagcgagtacaccgagggcagcaccggcaagacctgcctgatgaaggccgtgctgaacctgaaggacggcgtgaacgcctgcatcctgcccctgctgcagatcgacagagacagcggcaacccccagcccctggtgaacgcccagtgcaccgacgactactacagaggccacagcgccctgcacatcgccatcgagaagagaagcctgcagtgcgtgaagctgctggtggagaacggcgccaacgtgcacgccagagcctgcggcagattcttccagaagggccagggcacctgcttctacttcggcgagctgcccctgagcctggccgcctgcaccaagcagtgggacgtggtgagctacctgctggagaacccccaccagcccgccagcctgcaggccaccgacagccagggcaacaccgtgctgcacgccctggtgatgatcagcgacaacagcgccgagaacatcgccctggtgaccagcatgtacgacggcctgctgcaggccggcgccagactgtgccccaccgtgcagctggaggacatcagaaacctgcaggacctgacccccctgaagctggccgccaaggagggcaagatcgagatcttcagacacatcctgcagagagagttcagcggcctgagccacctgagcagaaagttcaccgagtggtgctacggccccgtgagagtgagcctgtacgacctggccagcgtggacagctgcgaggagaacagcgtgctggagatcatcgccttccactgcaagagcccccacagacacagaatggtggtgctggagcccctgaacaagctgctgcaggccaagtgggacctgctgatccccaagttcttcctgaacttcctgtgcaacctgatctacatgttcatcttcaccgccgtggcctaccaccagcccaccctgaagaagcaggccgccccccacctgaaggccgaggtgggcaacagcatgctgctgaccggccacatcctgatcctgctgggcggcatctacctgctggtgggccagctgtggtacttctggagaagacacgtgttcatctggatcagcttcatcgacagctacttcgagatcctgttcctgttccaggccctgctgaccgtggtgagccaggtgctgtgcttcctggccatcgagtggtacctgcccctgctggtgagcgccctggtgctgggctggctgaacctgctgtactacaccagaggcttccagcacaccggcatctacagcgtgatgatccagaaggtgatcctgagagacctgctgagattcctgctgatctacctggtgttcctgttcggcttcgccgtggccctggtgagcctgagccaggaggcctggagacccgaggcccccaccggccccaacgccaccgagagcgtgcagcccatggagggccaggaggacgagggcaacggcgcccagtacagaggcatcctggaggccagcctggagctgttcaagttcaccatcggcatgggcgagctggccttccaggagcagctgcacttcagaggcatggtgctgctgctgctgctggcctacgtgctgctgacctacatcctgctgctgaacatgctgatcgccctgatgagcgagaccgtgaacagcgtggccaccgacagctggagcatctggaagctgcagaaggccatcagcgtgctggagatggagaacggctactggtggtgcagaaagaagcagagagccggcgtgatgctgaccgtgggcaccaagcccgacggcagccccgacgagagatggtgcttcagagtggaggaggtgaactgggccagctgggagcagaccctgcccaccctgtgcgaggaccccagcggcgccggcgtgcccagaaccctggagaaccccgtgctggccagcccccccaaggaggacgaggacggcgccagcgaggagaactacgtgcccgtgcagctgctgcagagcaactag

SEQ ID NO: 103057 - DNA, 801 bp, Artificial Sequence
  Description of Artificial Sequence: Synthetic coding sequence
tgagacttcagcctgggcgtgcccagctggtggtgcctgatctgcttcaacatcggccccagcgtgggccccagccagcccgaccccaacagattcgacagagacagactgttcaacgccgtgagcagaggcgtgcccgaggacctggccggcctgcccgagtacctgagcaagaccagcaagtacctgaccgacagcgagtacaccgagggcagcaccggcaagacctgcctgatgaaggccgtgctgaacctgaaggacggcgtgaacgcctgcatcctgcccctgctgcagatcgacagagacagcggcaacccccagcccctggtgaacgcccagtgcaccgacgactactacagaggccacagcgccctgcacatcgccatcgagaagagaagcctgcagtgcgtgaagctgctggtggagaacggcgccaacgtgcacgccagagcctgcggcagattcttccagaagggccagggcacctgcttctacttcggcgagctgcccctgagcctggccgcctgcaccaagcagtgggacgtggtgagctacctgctggagaacccccaccagcccgccagcctgcaggccaccgacagccagggcaacaccgtgctgcacgccctggtgatgatcagcgacaacagcgccgagaacatcgccctggtgaccagcatgtacgacggcctgctgcaggccggcgccagactgtgccccaccgtgcagctggaggacatcagaaacctgcaggacctgacccccctgaagctggccgccaaggagggcaagatcgagtag

SEQ ID NO: 103058 - DNA, 2373 bp, Artificial Sequence; identical to SEQ ID NO: 102984
  Description of Artificial Sequence: Synthetic coding sequence

SEQ ID NO: 103059 - DNA, 2376 bp, Artificial Sequence
  Description of Artificial Sequence: Synthetic coding sequence
atgaaggcccaccccaaggagatggtgcccctgatgggcaagagagtggccgcccccagcggcaaccccgccatcctgcccgagaagagacccgccgagatcacccccaccaagaagagcgcccacttcttcctggagatcgagggcttcgagcccaaccccaccgtggccaagaccagcccccccgtgttcagcaagcccatggacagcaacatcagacagtgcatcagcggcaactgcgacgacatggacagcccccagagcccccaggacgacgtgaccgagacccccagcaaccccaacagccccagcgcccagctggccaaggaggagcagagaagaaagaagagaagactgaagaagagaatcttcgccgccgtgagcgagggctgcgtggaggagctggtggagctgctggtggagctgcaggagctgtgcagaagaagacacgacgaggacgtgcccgacttcctgatgcacaagctgaccgccagcgacaccggcaagacctgcctgatgaaggccctgctgaacatcaaccccaacaccaaggagatcgtgagaatcctgctggccttcgccgaggagaacgacatcctgggcagattcatcaacgccgagtacaccgaggaggcctacgagggccagaccgccctgaacatcgccatcgagagaagacagggcgacatcgccgccctgctgatcgccgccggcgccgacgtgaacgcccacgccaagggcgccttcttcaaccccaagtaccagcacgagggcttctacttcggcgagacccccctggccctggccgcctgcaccaaccagcccgagatcgtgcagctgctgatggagcacgagcagaccgacatcaccagcagagacagcagaggcaacaacatcctgcacgccctggtgaccgtggccgaggacttcaagacccagaacgacttcgtgaagagaatgtacgacatgatcctgctgagaagcggcaactgggagctggagaccaccagaaacaacgacggcctgacccccctgcagctggccgccaagatgggcaaggccgagatcctgaagtacatcctgagcagagagatcaaggagaagagactgagaagcctgagcagaaagttcaccgactgggcctacggccccgtgagcagcagcctgtacgacctgaccaacgtggacaccaccaccgacaacagcgtgctggagatcaccgtgtacaacaccaacatcgacaacagacacgagatgctgaccctggagcccctgcacaccctgctgcacatgaagtggaagaagttcgccaagcacatgttcttcctgagcttctgcttctacttcttctacaacatcaccctgaccctggtgagctactacagacccagagaggaggaggccatcccccaccccctggccctgacccacaagatgggctggctgcagctgctgggcagaatgttcgtgctgatctgggccatgtgcatcagcgtgaaggagggcatcgccatcttcctgctgagacccagcgacctgcagagcatcctgagcgacgcctggttccacttcgtgttcttcatccaggccgtgctggtgatcctgagcgtgttcctgtacctgttcgcctacaaggagtacctggcctgcctggtgctggccatggccctgggctgggccaacatgctgtactacaccagaggcttccagagcatgggcatgtacagcgtgatgatccagaaggtgatcctgcacgacgtgctgaagttcctgttcgtgtacatcgtgttcctgctgggcttcggcgtggccctggccagcctgatcgagaagtgccccaaggacaacaaggactgcagcagctacggcagcttcagcgacgccgtgctggagctgttcaagctgaccatcggcctgggcgacctgaacatccagcagaacagcaagtaccccatcctgttcctgttcctgctgatcacctacgtgatcctgaccttcgtgctgctgctgaacatgctgatcgccctgatgggcgagaccgtggagaacgtgagcaaggagagcgagagaatctggagactgcagagagccagaaccatcctggagttcgagaagatgctgcccgagtggctgagaagcagattcagaatgggcgagctgtgcaaggtggccgaggacgacttcagactgtgcctgagaatcaacgaggtgaagtggaccgagtggaagacccacgtgagcttcctgaacgaggaccccggccccgtgagaagaaccgccgacttcaacaagatccaggacagcagcagaaacaacagcaagaccaccctgaacgccttcgaggaggtggaggagttccccgagaccagcgtgtag

SEQ ID NO: 103060 - DNA, 2328 bp, Artificial Sequence
  Description of Artificial Sequence: Synthetic coding sequence
atgagccaccacacctggcccagccccgccctgaacctggacttcgccacctacctgctgagagacctgggcgcccacttcttcctggagatcgagggcttcgagcccaaccccaccgtggccaagaccagcccccccgtgttcagcaagcccatggacagcaacatcagacagtgcatcagcggcaactgcgacgacatggacagcccccagagcccccaggacgacgtgaccgagacccccagcaaccccaacagccccagcgcccagctggccaaggaggagcagagaagaaagaagagaagactgaagaagagaatcttcgccgccgtgagcgagggctgcgtggaggagctggtggagctgctggtggagctgcaggagctgtgcagaagaagacacgacgaggacgtgcccgacttcctgatgcacaagctgaccgccagcgacaccggcaagacctgcctgatgaaggccctgctgaacatcaaccccaacaccaaggagatcgtgagaatcctgctggccttcgccgaggagaacgacatcctgggcagattcatcaacgccgagtacaccgaggaggcctacgagggccagaccgccctgaacatcgccatcgagagaagacagggcgacatcgccgccctgctgatcgccgccggcgccgacgtgaacgcccacgccaagggcgccttcttcaaccccaagtaccagcacgagggcttctacttcggcgagacccccctggccctggccgcctgcaccaaccagcccgagatcgtgcagctgctgatggagcacgagcagaccgacatcaccagcagagacagcagaggcaacaacatcctgcacgccctggtgaccgtggccgaggacttcaagacccagaacgacttcgtgaagagaatgtacgacatgatcctgctgagaagcggcaactgggagctggagaccaccagaaacaacgacggcctgacccccctgcagctggccgccaagatgggcaaggccgagatcctgaagtacatcctgagcagagagatcaaggagaagagactgagaagcctgagcagaaagttcaccgactgggcctacggccccgtgagcagcagcctgtacgacctgaccaacgtggacaccaccaccgacaacagcgtgctggagatcaccgtgtacaacaccaacatcgacaacagacacgagatgctgaccctggagcccctgcacaccctgctgcacatgaagtggaagaagttcgccaagcacatgttcttcctgagcttctgcttctacttcttctacaacatcaccctgaccctggtgagctactacagacccagagaggaggaggccatcccccaccccctggccctgacccacaagatgggctggctgcagctgctgggcagaatgttcgtgctgatctgggccatgtgcatcagcgtgaaggagggcatcgccatcttcctgctgagacccagcgacctgcagagcatcctgagcgacgcctggttccacttcgtgttcttcatccaggccgtgctggtgatcctgagcgtgttcctgtacctgttcgcctacaaggagtacctggcctgcctggtgctggccatggccctgggctgggccaacatgctgtactacaccagaggcttccagagcatgggcatgtacagcgtgatgatccagaaggtgatcctgcacgacgtgctgaagttcctgttcgtgtacatcgtgttcctgctgggcttcggcgtggccctggccagcctgatcgagaagtgccccaaggacaacaaggactgcagcagctacggcagcttcagcgacgccgtgctggagctgttcaagctgaccatcggcctgggcgacctgaacatccagcagaacagcaagtaccccatcctgttcctgttcctgctgatcacctacgtgatcctgaccttcgtgctgctgctgaacatgctgatcgccctgatgggcgagaccgtggagaacgtgagcaaggagagcgagagaatctggagactgcagagagccagaaccatcctggagttcgagaagatgctgcccgagtggctgagaagcagattcagaatgggcgagctgtgcaaggtggccgaggacgacttcagactgtgcctgagaatcaacgaggtgaagtggaccgagtggaagacccacgtgagcttcctgaacgaggaccccggccccgtgagaagaaccgccgacttcaacaagatccaggacagcagcagaaacaacagcaagaccaccctgaacgccttcgaggaggtggaggagttccccgagaccagcgtgtag

SEQ ID NO: 103061 - DNA, 2616 bp, Artificial Sequence
  Description of Artificial Sequence: Synthetic coding sequence
atggccgacagcagcgagggccccagagccggccccggcgaggtggccgagctgcccggcgacgagagcggcacccccggcggcgaggccttccccctgagcagcctggccaacctgttcgagggcgaggacggcagcctgagccccagccccgccgacgccagcagacccgccggccccggcgacggcagacccaacctgagaatgaagttccagggcgccttcagaaagggcgtgcccaaccccatcgacctgctggagagcaccctgtacgagagcagcgtggtgcccggccccaagaaggcccccatggacagcctgttcgactacggcacctacagacaccacagcagcgacaacaagagatggagaaagaagatcatcgagaagcagccccagagccccaaggcccccgccccccagcccccccccatcctgaaggtgttcaacagacccatcctgttcgacatcgtgagcagaggcagcaccgccgacctggacggcctgctgcccttcctgctgacccacaagaagagactgaccgacgaggagttcagagagcccagcaccggcaagacctgcctgcccaaggccctgctgaacctgagcaacggcagaaacgacaccatccccgtgctgctggacatcgccgagagaaccggcaacatgagagagttcatcaacagccccttcagagacatctactacagaggccagaccgccctgcacatcgccatcgagagaagatgcaagcactacgtggagctgctggtggcccagggcgccgacgtgcacgcccaggccagaggcagattcttccagcccaaggacgagggcggctacttctacttcggcgagctgcccctgagcctggccgcctgcaccaaccagccccacatcgtgaactacctgaccgagaacccccacaagaaggccgacatgagaagacaggacagcagaggcaacaccgtgctgcacgccctggtggccatcgccgacaacaccagagagaacaccaagttcgtgaccaagatgtacgacctgctgctgctgaagtgcgccagactgttccccgacagcaacctggaggccgtgctgaacaacgacggcctgagccccctgatgatggccgccaagaccggcaagatcggcatcttccagcacatcatcagaagagaggtgaccgacgaggacaccagacacctgagcagaaagttcaaggactgggcctacggccccgtgtacagcagcctgtacgacctgagcagcctggacacctgcggcgaggaggccagcgtgctggagatcctggtgtacaacagcaagatcgagaacagacacgagatgctggccgtggagcccatcaacgagctgctgagagacaagtggagaaagttcggcgccgtgagcttctacatcaacgtggtgagctacctgtgcgccatggtgatcttcaccctgaccgcctactaccagcccctggagggcacccccccctacccctacagaaccaccgtggactacctgagactggccggcgaggtgatcaccctgttcaccggcgtgctgttcttcttcaccaacatcaaggacctgttcatgaagaagtgccccggcgtgaacagcctgttcatcgacggcagcttccagctgctgtacttcatctacagcgtgctggtgatcgtgagcgccgccctgtacctggccggcatcgaggcctacctggccgtgatggtgttcgccctggtgctgggctggatgaacgccctgtacttcaccagaggcctgaagctgaccggcacctacagcatcatgatccagaagatcctgttcaaggacctgttcagattcctgctggtgtacctgctgttcatgatcggctacgccagcgccctggtgagcctgctgaacccctgcgccaacatgaaggtgtgcaacgaggaccagaccaactgcaccgtgcccacctaccccagctgcagagacagcgagaccttcagcaccttcctgctggacctgttcaagctgaccatcggcatgggcgacctggagatgctgagcagcaccaagtaccccgtggtgttcatcatcctgctggtgacctacatcatcctgaccttcgtgctgctgctgaacatgctgatcgccctgatgggcgagaccgtgggccaggtgagcaaggagagcaagcacatctggaagctgcagtgggccaccaccatcctggacatcgagagaagcttccccgtgttcctgagaaaggccttcagaagcggcgagatggtgaccgtgggcaagagcagcgacggcacccccgacagaagatggtgcttcagagtggacgaggtgaactggagccactggaaccagaacctgggcatcatcaacgaggaccccggcaagaacgagacctaccagtactacggcttcagccacaccgtgggcagactgagaagagacagatggagcagcgtggtgcccagagtggtggagctgaacaagaacagcaaccccgacgaggtggtggtgcccctggacagcatgggcaaccccagatgcgacggccaccagcagggctaccccagaaagtggagaaccgacgacgcccccctgtag

SEQ ID NO: 103062 - DNA, 2436 bp, Artificial Sequence
  Description of Artificial Sequence: Synthetic coding sequence
atggccgacagcagcgagggccccagagccggccccggcgaggtggccgagctgcccggcgacgagagcggcacccccggcggcgaggccttccccctgagcagcctggccaacctgttcgagggcgaggacggcagcctgagccccagccccgccgacgccagcagacccgccggccccggcgacggcagacccaacctgagaatgaagttccagggcgccttcagaaagggcgtgcccaaccccatcgacctgctggagagcaccctgtacgagagcagcgtggtgcccggccccaagaaggcccccatggacagcctgttcgactacggcacctacagacaccacagcagcgacaacaagagatggagaaagaagatcatcgagaagcagccccagagccccaaggcccccgccccccagcccccccccatcctgaaggtgttcaacagacccatcctgttcgacatcgtgagcagaggcagcaccgccgacctggacggcctgctgcccttcctgctgacccacaagaagagactgaccgacgaggagttcagagagcccagcaccggcaagacctgcctgcccaaggccctgctgaacctgagcaacggcagaaacgacaccatccccgtgctgctggacatcgccgagagaaccggcaacatgagagagttcatcaacagccccttcagagacatctactacagaggccagaccgccctgcacatcgccatcgagagaagatgcaagcactacgtggagctgctggtggcccagggcgccgacgtgcacgcccaggccagaggcagattcttccagcccaaggacgagggcggctacttctacttcggcgagctgcccctgagcctggccgcctgcaccaaccagccccacatcgtgaactacctgaccgagaacccccacaagaaggccgacatgagaagacaggacagcagaggcaacaccgtgctgcacgccctggtggccatcgccgacaacaccagagagaacaccaagttcgtgaccaagatgtacgacctgctgctgctgaagtgcgccagactgttccccgacagcaacctggaggccgtgctgaacaacgacggcctgagccccctgatgatggccgccaagaccggcaagatcggcaacagacacgagatgctggccgtggagcccatcaacgagctgctgagagacaagtggagaaagttcggcgccgtgagcttctacatcaacgtggtgagctacctgtgcgccatggtgatcttcaccctgaccgcctactaccagcccctggagggcacccccccctacccctacagaaccaccgtggactacctgagactggccggcgaggtgatcaccctgttcaccggcgtgctgttcttcttcaccaacatcaaggacctgttcatgaagaagtgccccggcgtgaacagcctgttcatcgacggcagcttccagctgctgtacttcatctacagcgtgctggtgatcgtgagcgccgccctgtacctggccggcatcgaggcctacctggccgtgatggtgttcgccctggtgctgggctggatgaacgccctgtacttcaccagaggcctgaagctgaccggcacctacagcatcatgatccagaagatcctgttcaaggacctgttcagattcctgctggtgtacctgctgttcatgatcggctacgccagcgccctggtgagcctgctgaacccctgcgccaacatgaaggtgtgcaacgaggaccagaccaactgcaccgtgcccacctaccccagctgcagagacagcgagaccttcagcaccttcctgctggacctgttcaagctgaccatcggcatgggcgacctggagatgctgagcagcaccaagtaccccgtggtgttcatcatcctgctggtgacctacatcatcctgaccttcgtgctgctgctgaacatgctgatcgccctgatgggcgagaccgtgggccaggtgagcaaggagagcaagcacatctggaagctgcagtgggccaccaccatcctggacatcgagagaagcttccccgtgttcctgagaaaggccttcagaagcggcgagatggtgaccgtgggcaagagcagcgacggcacccccgacagaagatggtgcttcagagtggacgaggtgaactggagccactggaaccagaacctgggcatcatcaacgaggaccccggcaagaacgagacctaccagtactacggcttcagccacaccgtgggcagactgagaagagacagatggagcagcgtggtgcccagagtggtggagctgaacaagaacagcaaccccgacgaggtggtggtgcccctggacagcatgggcaaccccagatgcgacggccaccagcagggctaccccagaaagtggagaaccgacgacgcccccctgtag

SEQ ID NO: 103063 - DNA, 2475 bp, Artificial Sequence
  Description of Artificial Sequence: Synthetic coding sequence
atggccgacagcagcgagggccccagagccggccccggcgaggtggccgagctgcccggcgacgagagcggcacccccggcggcgaggccttccccctgagcagcctggccaacctgttcgagggcgaggacggcagcctgagccccagccccgccgacgccagcagacccgccggccccggcgacggcagacccaacctgagaatgaagttccagggcgccttcagaaagggcgtgcccaaccccatcgacctgctggagagcaccctgtacgagagcagcgtggtgcccggccccaagaaggcccccatggacagcctgttcgactacggcacctacagacaccacagcagcgacaacaagagatggagaaagaagatcatcgagaagcagccccagagccccaaggcccccgccccccagcccccccccatcctgaaggtgttcaacagacccatcctgttcgacatcgtgagcagaggcagcaccgccgacctggacggcctgctgcccttcctgctgacccacaagaagagactgaccgacgaggagttcagagagcccagcaccggcaagacctgcctgcccaaggccctgctgaacctgagcaacggcagaaacgacaccatccccgtgctgctggacatcgccgagagaaccggcaacatgagagagttcatcaacagccccttcagagacatctactacagaggcgagctgcccctgagcctggccgcctgcaccaaccagccccacatcgtgaactacctgaccgagaacccccacaagaaggccgacatgagaagacaggacagcagaggcaacaccgtgctgcacgccctggtggccatcgccgacaacaccagagagaacaccaagttcgtgaccaagatgtacgacctgctgctgctgaagtgcgccagactgttccccgacagcaacctggaggccgtgctgaacaacgacggcctgagccccctgatgatggccgccaagaccggcaagatcggcatcttccagcacatcatcagaagagaggtgaccgacgaggacaccagacacctgagcagaaagttcaaggactgggcctacggccccgtgtacagcagcctgtacgacctgagcagcctggacacctgcggcgaggaggccagcgtgctggagatcctggtgtacaacagcaagatcgagaacagacacgagatgctggccgtggagcccatcaacgagctgctgagagacaagtggagaaagttcggcgccgtgagcttctacatcaacgtggtgagctacctgtgcgccatggtgatcttcaccctgaccgcctactaccagcccctggagggcacccccccctacccctacagaaccaccgtggactacctgagactggccggcgaggtgatcaccctgttcaccggcgtgctgttcttcttcaccaacatcaaggacctgttcatgaagaagtgccccggcgtgaacagcctgttcatcgacggcagcttccagctgctgtacttcatctacagcgtgctggtgatcgtgagcgccgccctgtacctggccggcatcgaggcctacctggccgtgatggtgttcgccctggtgctgggctggatgaacgccctgtacttcaccagaggcctgaagctgaccggcacctacagcatcatgatccagaagatcctgttcaaggacctgttcagattcctgctggtgtacctgctgttcatgatcggctacgccagcgccctggtgagcctgctgaacccctgcgccaacatgaaggtgtgcaacgaggaccagaccaactgcaccgtgcccacctaccccagctgcagagacagcgagaccttcagcaccttcctgctggacctgttcaagctgaccatcggcatgggcgacctggagatgctgagcagcaccaagtaccccgtggtgttcatcatcctgctggtgacctacatcatcctgaccttcgtgctgctgctgaacatgctgatcgccctgatgggcgagaccgtgggccaggtgagcaaggagagcaagcacatctggaagctgcagtgggccaccaccatcctggacatcgagagaagcttccccgtgttcctgagaaaggccttcagaagcggcgagatggtgaccgtgggcaagagcagcgacggcacccccgacagaagatggtgcttcagagtggacgaggtgaactggagccactggaaccagaacctgggcatcatcaacgaggaccccggcaagaacgagacctaccagtactacggcttcagccacaccgtgggcagactgagaagagacagatggagcagcgtggtgcccagagtggtggagctgaacaagaacagcaaccccgacgaggtggtggtgcccctggacagcatgggcaaccccagatgcgacggccaccagcagggctaccccagaaagtggagaaccgacgacgcccccctgtag

SEQ ID NO: 103064 - DNA, 2616 bp, Artificial Sequence; identical to SEQ ID NO: 103061
  Description of Artificial Sequence: Synthetic coding sequence

SEQ ID NO: 103065 - DNA, 2514 bp, Artificial Sequence
  Description of Artificial Sequence: Synthetic coding sequence
atggccgacagcagcgagggccccagagccggccccggcgaggtggccgagctgcccggcgacgagagcggcacccccggcgacggcagacccaacctgagaatgaagttccagggcgccttcagaaagggcgtgcccaaccccatcgacctgctggagagcaccctgtacgagagcagcgtggtgcccggccccaagaaggcccccatggacagcctgttcgactacggcacctacagacaccacagcagcgacaacaagagatggagaaagaagatcatcgagaagcagccccagagccccaaggcccccgccccccagcccccccccatcctgaaggtgttcaacagacccatcctgttcgacatcgtgagcagaggcagcaccgccgacctggacggcctgctgcccttcctgctgacccacaagaagagactgaccgacgaggagttcagagagcccagcaccggcaagacctgcctgcccaaggccctgctgaacctgagcaacggcagaaacgacaccatccccgtgctgctggacatcgccgagagaaccggcaacatgagagagttcatcaacagccccttcagagacatctactacagaggccagaccgccctgcacatcgccatcgagagaagatgcaagcactacgtggagctgctggtggcccagggcgccgacgtgcacgcccaggccagaggcagattcttccagcccaaggacgagggcggctacttctacttcggcgagctgcccctgagcctggccgcctgcaccaaccagccccacatcgtgaactacctgaccgagaacccccacaagaaggccgacatgagaagacaggacagcagaggcaacaccgtgctgcacgccctggtggccatcgccgacaacaccagagagaacaccaagttcgtgaccaagatgtacgacctgctgctgctgaagtgcgccagactgttccccgacagcaacctggaggccgtgctgaacaacgacggcctgagccccctgatgatggccgccaagaccggcaagatcggcatcttccagcacatcatcagaagagaggtgaccgacgaggacaccagacacctgagcagaaagttcaaggactgggcctacggccccgtgtacagcagcctgtacgacctgagcagcctggacacctgcggcgaggaggccagcgtgctggagatcctggtgtacaacagcaagatcgagaacagacacgagatgctggccgtggagcccatcaacgagctgctgagagacaagtggagaaagttcggcgccgtgagcttctacatcaacgtggtgagctacctgtgcgccatggtgatcttcaccctgaccgcctactaccagcccctggagggcacccccccctacccctacagaaccaccgtggactacctgagactggccggcgaggtgatcaccctgttcaccggcgtgctgttcttcttcaccaacatcaaggacctgttcatgaagaagtgccccggcgtgaacagcctgttcatcgacggcagcttccagctgctgtacttcatctacagcgtgctggtgatcgtgagcgccgccctgtacctggccggcatcgaggcctacctggccgtgatggtgttcgccctggtgctgggctggatgaacgccctgtacttcaccagaggcctgaagctgaccggcacctacagcatcatgatccagaagatcctgttcaaggacctgttcagattcctgctggtgtacctgctgttcatgatcggctacgccagcgccctggtgagcctgctgaacccctgcgccaacatgaaggtgtgcaacgaggaccagaccaactgcaccgtgcccacctaccccagctgcagagacagcgagaccttcagcaccttcctgctggacctgttcaagctgaccatcggcatgggcgacctggagatgctgagcagcaccaagtaccccgtggtgttcatcatcctgctggtgacctacatcatcctgaccttcgtgctgctgctgaacatgctgatcgccctgatgggcgagaccgtgggccaggtgagcaaggagagcaagcacatctggaagctgcagtgggccaccaccatcctggacatcgagagaagcttccccgtgttcctgagaaaggccttcagaagcggcgagatggtgaccgtgggcaagagcagcgacggcacccccgacagaagatggtgcttcagagtggacgaggtgaactggagccactggaaccagaacctgggcatcatcaacgaggaccccggcaagaacgagacctaccagtactacggcttcagccacaccgtgggcagactgagaagagacagatggagcagcgtggtgcccagagtggtggagctgaacaagaacagcaaccccgacgaggtggtggtgcccctggacagcatgggcaaccccagatgcgacggccaccagcagggctaccccagaaagtggagaaccgacgacgcccccctgtag

SEQ ID NO: 103066 - DNA, 2436 bp, Artificial Sequence; identical to SEQ ID NO: 103062
  Description of Artificial Sequence: Synthetic coding sequence

SEQ ID NO: 103067 - DNA, 2475 bp, Artificial Sequence; identical to SEQ ID NO: 103063
  Description of Artificial Sequence: Synthetic coding sequence

SEQ ID NO: 103068 - DNA, 2295 bp, Artificial Sequence
  Description of Artificial Sequence: Synthetic coding sequence
atggccgacagcagcgagggccccagagccggccccggcgaggtggccgagctgcccggcgacgagagcggcacccccggcggcgaggccttccccctgagcagcctggccaacctgttcgagggcgaggacggcagcctgagccccagccccgccgacgccagcagacccgccggccccggcgacggcagacccaacctgagaatgaagttccagggcgccttcagaaagggcgtgcccaaccccatcgacctgctggagagcaccctgtacgagagcagcgtggtgcccggccccaagaaggcccccatggacagcctgttcgactacggcacctacagacaccacagcagcgacaacaagagatggagaaagaagatcatcgagaagcagccccagagccccaaggcccccgccccccagcccccccccatcctgaaggtgttcaacagacccatcctgttcgacatcgtgagcagaggcagcaccgccgacctggacggcctgctgcccttcctgctgacccacaagaagagactgaccgacgaggagttcagagagcccagcaccggcaagacctgcctgcccaaggccctgctgaacctgagcaacggcagaaacgacaccatccccgtgctgctggacatcgccgagagaaccggcaacatgagagagttcatcaacagccccttcagagacatctactacagaggcgagctgcccctgagcctggccgcctgcaccaaccagccccacatcgtgaactacctgaccgagaacccccacaagaaggccgacatgagaagacaggacagcagaggcaacaccgtgctgcacgccctggtggccatcgccgacaacaccagagagaacaccaagttcgtgaccaagatgtacgacctgctgctgctgaagtgcgccagactgttccccgacagcaacctggaggccgtgctgaacaacgacggcctgagccccctgatgatggccgccaagaccggcaagatcggcaacagacacgagatgctggccgtggagcccatcaacgagctgctgagagacaagtggagaaagttcggcgccgtgagcttctacatcaacgtggtgagctacctgtgcgccatggtgatcttcaccctgaccgcctactaccagcccctggagggcacccccccctacccctacagaaccaccgtggactacctgagactggccggcgaggtgatcaccctgttcaccggcgtgctgttcttcttcaccaacatcaaggacctgttcatgaagaagtgccccggcgtgaacagcctgttcatcgacggcagcttccagctgctgtacttcatctacagcgtgctggtgatcgtgagcgccgccctgtacctggccggcatcgaggcctacctggccgtgatggtgttcgccctggtgctgggctggatgaacgccctgtacttcaccagaggcctgaagctgaccggcacctacagcatcatgatccagaagatcctgttcaaggacctgttcagattcctgctggtgtacctgctgttcatgatcggctacgccagcgccctggtgagcctgctgaacccctgcgccaacatgaaggtgtgcaacgaggaccagaccaactgcaccgtgcccacctaccccagctgcagagacagcgagaccttcagcaccttcctgctggacctgttcaagctgaccatcggcatgggcgacctggagatgctgagcagcaccaagtaccccgtggtgttcatcatcctgctggtgacctacatcatcctgaccttcgtgctgctgctgaacatgctgatcgccctgatgggcgagaccgtgggccaggtgagcaaggagagcaagcacatctggaagctgcagtgggccaccaccatcctggacatcgagagaagcttccccgtgttcctgagaaaggccttcagaagcggcgagatggtgaccgtgggcaagagcagcgacggcacccccgacagaagatggtgcttcagagtggacgaggtgaactggagccactggaaccagaacctgggcatcatcaacgaggaccccggcaagaacgagacctaccagtactacggcttcagccacaccgtgggcagactgagaagagacagatggagcagcgtggtgcccagagtggtggagctgaacaagaacagcaaccccgacgaggtggtggtgcccctggacagcatgggcaaccccagatgcgacggccaccagcagggctaccccagaaagtggagaaccgacgacgcccccctgtag

SEQ ID NO: 103069 - DNA, 2190 bp, Artificial Sequence
  Description of Artificial Sequence: Synthetic coding sequence
atgggcggcttcctgcccaaggccgagggccccggcagccagctgcagaagctgctgcccagcttcctggtgagagagcaggactgggaccagcacctggacaagctgcacatgctgcagcagaagagaatcctggagagccccctgctgagagccagcaaggagaacgacctgagcgtgctgagacagctgctgctggactgcacctgcgacgtgagacagagaggcgccctgggcgagaccgccctgcacatcgccgccctgtacgacaacctggaggccgccctggtgctgatggaggccgcccccgagctggtgttcgagcccaccacctgcgaggccttcgccggccagaccgccctgcacatcgccgtggtgaaccagaacgtgaacctggtgagagccctgctgaccagaagagccagcgtgagcgccagagccaccggcaccgccttcagaagaagccccagaaacctgatctacttcggcgagcaccccctgagcttcgccgcctgcgtgaacagcgaggagatcgtgagactgctgatcgagcacggcgccgacatcagagcccaggacagcctgggcaacaccgtgctgcacatcctgatcctgcagcccaacaagaccttcgcctgccagatgtacaacctgctgctgagctacgacggccacggcgaccacctgcagcccctggacctggtgcccaaccaccagggcctgacccccttcaagctggccggcgtggagggcaacaccgtgatgttccagcacctgatgcagaagagaagacacatccagtggacctacggccccctgaccagcatcctgtacgacctgaccgagatcgacagctggggcgaggagctgagcttcctggagctggtggtgagcagcgacaagagagaggccagacagatcctggagcagacccccgtgaaggagctggtgagcttcaagtggaacaagtacggcagaccctacttctgcatcctggccgccctgtacctgctgtacatgatctgcttcaccacctgctgcgtgtacagacccctgaagttcagaggcggcaacagaacccacagcagagacatcaccatcctgcagcagaagctgctgcaggaggcctacgagaccagagaggacatcatcagactggtgggcgagctggtgagcatcgtgggcgccgtgatcatcctgctgctggagatccccgacatcttcagagtgggcgccagcagatacttcggcaagaccatcctgggcggccccttccacgtgatcatcatcacctacgccagcctggtgctggtgaccatggtgatgagactgaccaacaccaacggcgaggtggtgcccatgagcttcgccctggtgctgggctggtgcagcgtgatgtacttcaccagaggcttccagatgctgggccccttcaccatcatgatccagaagatgatcttcggcgacctgatgagattctgctggctgatggccgtggtgatcctgggcttcgccagcgccttctacatcatcttccagaccgaggaccccaccagcctgggccagttctacgactaccccatggccctgttcaccaccttcgagctgttcctgaccgtgatcgacgcccccgccaactacgacgtggacctgcccttcatgttcagcatcgtgaacttcgccttcgccatcatcgccaccctgctgatgctgaacctgttcatcgccatgatgggcgacacccactggagagtggcccaggagagagacgagctgtggagagcccaggtggtggccaccaccgtgatgctggagagaaagctgcccagatgcctgtggcccagaagcggcatctgcggctgcgagttcggcctgggcgacagatggttcctgagagtggagaaccacaacgaccagaaccccctgagagtgctgagatacgtggaggtgttcaagaacagcgacaaggaggacgaccaggagcaccccagcgagaagcagcccagcggcgccgagagcggcaccctggccagagccagcctggccctgcccaccagcagcctgagcagaaccgccagccagagcagcagccacagaggctgggagatcctgagacagaacaccctgggccacctgaacctgggcctgaacctgagcgagggcgacggcgaggaggtgtaccacttctag

SEQ ID NO: 103070 - DNA, 1146 bp, Artificial Sequence
  Description of Artificial Sequence: Synthetic coding sequence
atgggcggcttcctgcccaaggccgagggccccggcagccagctgcagaagctgctgcccagcttcctggtgagagagcaggactgggaccagcacctggacaagctgcacatgctgcagcagaagagaatcctggagagccccctgctgagagccagcaaggagaacgacctgagcgtgctgagacagctgctgctggactgcacctgcgacgtgagacagagaggcgccctgggcgagaccgccctgcacatcgccgccctgtacgacaacctggaggccgccctggtgctgatggaggccgcccccgagctggtgttcgagcccaccacctgcgaggccttcgccggccagaccgccctgcacatcgccgtggtgaaccagaacgtgaacctggtgagagccctgctgaccagaagagccagcgtgagcgccagagccaccggcaccgccttcagaagaagccccagaaacctgatctacttcggcgagcaccccctgagcttcgccgcctgcgtgaacagcgaggagatcgtgagactgctgatcgagcacggcgccgacatcagagcccaggacagcctgggcaacaccgtgctgcacatcctgatcctgcagcccaacaagaccttcgcctgccagatgtacaacctgctgctgagctacgacggccacggcgaccacctgcagcccctggacctggtgcccaaccaccagggcctgacccccttcaagctggccggcgtggagggcaacaccgtgatgttccagcacctgatgcagaagagaagacacatccagtggacctacggccccctgaccagcatcctgtacgacctgaccgagatcgacagctggggcgaggagctgagcttcctggagctggtggtgagcagcgacaagagagaggccagacagatcctggagcagacccccgtgaaggagctggtgagcttcaagtggaacaagtacggcagaccctacttctgcatcctggccgccctgtacctgctgtacatgatctgcttcaccacctgctgcgtgtacagacccctgaagttcagaggcggcaacagaacccacagcagagacatcaccatcctgcagcagaagctgctgcaggtgatcctgctgagaagaggctag

SEQ ID NO: 103071 - DNA, 1674 bp, Artificial Sequence
  Description of Artificial Sequence: Synthetic coding sequence
atgggcctgagcctgcccaaggagaagggcctgatcctgtgcctgtggagcaagttctgcagatggttccaggacagcctgggcaacaccgtgctgcacatcctgatcctgcagcccaacaagaccttcgcctgccagatgtacaacctgctgctgagctacgacagacacggcgaccacctgcagcccctggacctggtgcccaaccaccagggcctgacccccttcaagctggccggcgtggagggcaacaccgtgatgttccagcacctgatgcagaagagaaagcacacccagtggacctacggccccctgaccagcaccctgtacgacctgaccgagatcgacagcagcggcgacgagcagagcctgctggagctgatcatcaccaccaagaagagagaggccagacagatcctggaccagacccccgtgaaggagctggtgagcctgaagtggaagagatacggcagaccctacttctgcatgctgggcgccatctacctgctgtacatcatctgcttcaccatgtgctgcatctacagacccctgaagcccagaaccaacaacagaaccagccccagagacaacaccctgctgcagcagaagctgctgcaggaggcctacatgacccccaaggacgacatcagactggtgggcgagctggtgaccgtgatcggcgccatcatcatcctgctggtggaggtgcccgacatcttcagaatgggcgtgaccagattcttcggccagaccatcctgggcggccccttccacgtgctgatcatcacctacgccttcatggtgctggtgaccatggtgatgagactgatcagcgccagcggcgaggtggtgcccatgagcttcgccctggtgctgggctggtgcaacgtgatgtacttcgccagaggcttccagatgctgggccccttcaccatcatgatccagaagatgatcttcggcgacctgatgagattctgctggctgatggccgtggtgatcctgggcttcgccagcgccttctacatcatcttccagaccgaggaccccgaggagctgggccacttctacgactaccccatggccctgttcagcaccttcgagctgttcctgaccatcatcgacggccccgccaactacaacgtggacctgcccttcatgtacagcatcacctacgccgccttcgccatcatcgccaccctgctgatgctgaacctgctgatcgccatgatgggcgacacccactggagagtggcccacgagagagacgagctgtggagagcccagatcgtggccaccaccgtgatgctggagagaaagctgcccagatgcctgtggcccagaagcggcatctgcggcagagagtacggcctgggcgacagatggttcctgagagtggaggacagacaggacctgaacagacagagaatccagagatacgcccaggccttccacaccagaggcagcgaggacctggacaaggacagcgtggagaagctggagctgggctgccccttcagcccccacctgagcctgcccatgcccagcgtgagcagaagcaccagcagaagcagcgccaactgggagagactgagacagggcaccctgagaagagacctgagaggcatcatcaacagaggcctggaggacggcgagagctgggagtaccagatctag

SEQ ID NO: 103072 - DNA, 2178 bp, Artificial Sequence
  Description of Artificial Sequence: Synthetic coding sequence
atgggcctgagcctgcccaaggagaagggcctgatcctgtgcctgtggagcaagttctgcagatggttccagagaagagagagctgggcccagagcagagacgagcagaacctgctgcagcagaagagaatctgggagagccccctgctgctggccgccaaggacaacgacgtgcaggccctgaacaagctgctgaagtacgaggactgcaaggtgcaccagagaggcgccatgggcgagaccgccctgcacatcgccgccctgtacgacaacctggaggccgccatggtgctgatggaggccgcccccgagctggtgttcgagcccatgaccagcgagctgtacgagggccagaccgccctgcacatcgccgtggtgaaccagaacatgaacctggtgagagccctgctggccagaagagccagcgtgagcgccagagccaccggcaccgccttcagaagaagcccctgcaacctgatctacttcggcgagcaccccctgagcttcgccgcctgcgtgaacagcgaggagatcgtgagactgctgatcgagcacggcgccgacatcagagcccaggacagcctgggcaacaccgtgctgcacatcctgatcctgcagcccaacaagaccttcgcctgccagatgtacaacctgctgctgagctacgacagacacggcgaccacctgcagcccctggacctggtgcccaaccaccagggcctgacccccttcaagctggccggcgtggagggcaacaccgtgatgttccagcacctgatgcagaagagaaagcacacccagtggacctacggccccctgaccagcaccctgtacgacctgaccgagatcgacagcagcggcgacgagcagagcctgctggagctgatcatcaccaccaagaagagagaggccagacagatcctggaccagacccccgtgaaggagctggtgagcctgaagtggaagagatacggcagaccctacttctgcatgctgggcgccatctacctgctgtacatcatctgcttcaccatgtgctgcatctacagacccctgaagcccagaaccaacaacagaaccagccccagagacaacaccctgctgcagcagaagctgctgcaggaggcctacatgacccccaaggacgacatcagactggtgggcgagctggtgaccgtgatcggcgccatcatcatcctgctggtggaggtgcccgacatcttcagaatgggcgtgaccagattcttcggccagaccatcctgggcggccccttccacgtgctgatcatcacctacgccttcatggtgctggtgaccatggtgatgagactgatcagcgccagcggcgaggtggtgcccatgagcttcgccctggtgctgggctggtgcaacgtgatgtacttcgccagaggcttccagatgctgggccccttcaccatcatgatccagaagatgatcttcggcgacctgatgagattctgctggctgatggccgtggtgatcctgggcttcgccagcgccttctacatcatcttccagaccgaggaccccgaggagctgggccacttctacgactaccccatggccctgttcagcaccttcgagctgttcctgaccatcatcgacggccccgccaactacaacgtggacctgcccttcatgtacagcatcacctacgccgccttcgccatcatcgccaccctgctgatgctgaacctgctgatcgccatgatgggcgacacccactggagagtggcccacgagagagacgagctgtggagagcccagatcgtggccaccaccgtgatgctggagagaaagctgcccagatgcctgtggcccagaagcggcatctgcggcagagagtacggcctgggcgacagatggttcctgagagtggaggacagacaggacctgaacagacagagaatccagagatacgcccaggccttccacaccagaggcagcgaggacctggacaaggacagcgtggagaagctggagctgggctgccccttcagcccccacctgagcctgcccatgcccagcgtgagcagaagcaccagcagaagcagcgccaactgggagagactgagacagggcaccctgagaagagacctgagaggcatcatcaacagaggcctggaggacggcgagagctgggagtaccagatctag

SEQ ID NO: 103073 - DNA, 168 bp, Artificial Sequence
  Description of Artificial Sequence: Synthetic coding sequence
atgagcaccagcagaaagctgaagagccacggcatgagaagaagcaagagcagaagcccccacaagggcgtgaagagaggcggcagcaagagaaagtacagaaagggcaacctgaagagcagaaagagaggcgacgacgccaacagaaactacagaagccacctgtag

SEQ ID NO: 103074 - DNA, 417 bp, Artificial Sequence
  Description of Artificial Sequence: Synthetic coding sequence
atggacacccagacccacagcctgcccatcacccacacccagctgcacagcaacagccagccccagagcagaacctgcaccagacactgccagaccttcagccagagctgcagacagagccacagaggcagcagaagccagagcagcagccagagccccgccagccacagaaaccccaccggcgcccacagcagcagcggccaccagagccagagccccaacaccagccccccccccaagagacacaagaagaccatgaacagccaccacagccccatgagacccaccatcctgcactgcagatgccccaagaacagaaagaacctggagggcaagctgaagaagaagaagatggccaagagaatccagcaggtgtacaagaccaagaccagaagcagcggctggaagagcaactag

SEQ ID NO: 103075 - DNA, 1731 bp, Artificial Sequence
  Description of Artificial Sequence: Synthetic coding sequence
atggccgtgctgttcttccacaccatgagatacaagagccaggaccccagaaacccccacaacgacagattcgtgctgagcaagggccacgccgcccccatcctgtacgccgtgtgggccgaggccggcttcctggccgaggccgagctgctgaacctgagaaagatcagcagcgacctggacggccaccccgtgcccaagcaggccttcaccgacgtggccaccggcagcctgggccagggcctgggcgccgcctgcggcatggcctacaccggcaagtacttcgacaaggccagctacagagtgtactgcctgctgggcgacggcgagctgagcgagggcagcgtgtgggaggccatggccttcgccagcatctacaagctggacaacctggtggccatcctggacatcaacagactgggccagagcgaccccgcccccctgcagcaccagatggacatctaccagaagagatgcgaggccttcggctggcacgccatcatcgtggacggccacagcgtggaggagctgtgcaaggccttcggccaggccaagcaccagcccaccgccatcatcgccaagaccttcaagggcagaggcatcaccggcgtggaggacaaggagagctggcacggcaagcccctgcccaagaacatggccgagcagatcatccaggagatctacagccagatccagagcaagaagaagatcctggccacccccccccaggaggacgcccccagcgtggacatcgccaacatcagaatgcccagcctgcccagctacaaggtgggcgacaagatcgccaccagaaaggcctacggccaggccctggccaagctgggccacgccagcgacagaatcatcgccctggacggcgacaccaagaacagcaccttcagcgagatcttcaagaaggagcaccccgacagattcatcgagtgctacatcgccgagcagaacatggtgagcatcgccgtgggctgcgccaccagaaacagaaccgtgcccttctgcagcaccttcgccgccttcttcaccagagccttcgaccagatcagaatggccgccatcagcgagagcaacatcaacctgtgcggcagccactgcggcgtgagcatcggcgaggacggccccagccagatggccctggaggacctggccatgttcagaagcgtgcccaccagcaccgtgttctaccccagcgacggcgtggccaccgagaaggccgtggagctggccgccaacaccaagggcatctgcttcatcagaaccagcagacccgagaacgccatcatctacaacaacaacgaggacttccaggtgggccaggccaaggtggtgctgaagagcaaggacgaccaggtgaccgtgatcggcgccggcgtgaccctgcacgaggccctggccgccgccgagctgctgaagaaggagaagatcaacatcagagtgctggaccccttcaccatcaagcccctggacagaaagctgatcctggacagcgccagagccaccaagggcagaatcctgaccgtggaggaccactactacgagggcggcatcggcgaggccgtgagcagcgccgtggtgggcgagcccggcatcaccgtgacccacctggccgtgaacagagtgcccagaagcggcaagcccgccgagctgctgaagatgttcggcatcgacagagacgccatcgcccaggccgtgagaggcctgatcaccaaggcctag

SEQ ID NO: 103076 - DNA, 1374 bp, Artificial Sequence
  Description of Artificial Sequence: Synthetic coding sequence
atggccttcgccagcatctacaagctggacaacctggtggccatcctggacatcaacagactgggccagagcgaccccgcccccctgcagcaccagatggacatctaccagaagagatgcgaggccttcggctggcacgccatcatcgtggacggccacagcgtggaggagctgtgcaaggccttcggccaggccaagcaccagcccaccgccatcatcgccaagaccttcaagggcagaggcatcaccggcgtggaggacaaggagagctggcacggcaagcccctgcccaagaacatggccgagcagatcatccaggagatctacagccagatccagagcaagaagaagatcctggccacccccccccaggaggacgcccccagcgtggacatcgccaacatcagaatgcccagcctgcccagctacaaggtgggcgacaagatcgccaccagaaaggcctacggccaggccctggccaagctgggccacgccagcgacagaatcatcgccctggacggcgacaccaagaacagcaccttcagcgagatcttcaagaaggagcaccccgacagattcatcgagtgctacatcgccgagcagaacatggtgagcatcgccgtgggctgcgccaccagaaacagaaccgtgcccttctgcagcaccttcgccgccttcttcaccagagccttcgaccagatcagaatggccgccatcagcgagagcaacatcaacctgtgcggcagccactgcggcgtgagcatcggcgaggacggccccagccagatggccctggaggacctggccatgttcagaagcgtgcccaccagcaccgtgttctaccccagcgacggcgtggccaccgagaaggccgtggagctggccgccaacaccaagggcatctgcttcatcagaaccagcagacccgagaacgccatcatctacaacaacaacgaggacttccaggtgggccaggccaaggtggtgctgaagagcaaggacgaccaggtgaccgtgatcggcgccggcgtgaccctgcacgaggccctggccgccgccgagctgctgaagaaggagaagatcaacatcagagtgctggaccccttcaccatcaagcccctggacagaaagctgatcctggacagcgccagagccaccaagggcagaatcctgaccgtggaggaccactactacgagggcggcatcggcgaggccgtgagcagcgccgtggtgggcgagcccggcatcaccgtgacccacctggccgtgaacagagtgcccagaagcggcaagcccgccgagctgctgaagatgttcggcatcgacagagacgccatcgcccaggccgtgagaggcctgatcaccaaggcctag

SEQ ID NO: 103077 - DNA, 1872 bp, Artificial Sequence
  Description of Artificial Sequence: Synthetic coding sequence
atggagagctaccacaagcccgaccagcagaagctgcaggccctgaaggacaccgccaacagactgagaatcagcagcatccaggccaccaccgccgccggcagcggccaccccaccagctgctgcagcgccgccgagatcatggccgtgctgttcttccacaccatgagatacaagagccaggaccccagaaacccccacaacgacagattcgtgctgagcaagggccacgccgcccccatcctgtacgccgtgtgggccgaggccggcttcctggccgaggccgagctgctgaacctgagaaagatcagcagcgacctggacggccaccccgtgcccaagcaggccttcaccgacgtggccaccggcagcctgggccagggcctgggcgccgcctgcggcatggcctacaccggcaagtacttcgacaaggccagctacagagtgtactgcctgctgggcgacggcgagctgagcgagggcagcgtgtgggaggccatggccttcgccagcatctacaagctggacaacctggtggccatcctggacatcaacagactgggccagagcgaccccgcccccctgcagcaccagatggacatctaccagaagagatgcgaggccttcggctggcacgccatcatcgtggacggccacagcgtggaggagctgtgcaaggccttcggccaggccaagcaccagcccaccgccatcatcgccaagaccttcaagggcagaggcatcaccggcgtggaggacaaggagagctggcacggcaagcccctgcccaagaacatggccgagcagatcatccaggagatctacagccagatccagagcaagaagaagatcctggccacccccccccaggaggacgcccccagcgtggacatcgccaacatcagaatgcccagcctgcccagctacaaggtgggcgacaagatcgccaccagaaaggcctacggccaggccctggccaagctgggccacgccagcgacagaatcatcgccctggacggcgacaccaagaacagcaccttcagcgagatcttcaagaaggagcaccccgacagattcatcgagtgctacatcgccgagcagaacatggtgagcatcgccgtgggctgcgccaccagaaacagaaccgtgcccttctgcagcaccttcgccgccttcttcaccagagccttcgaccagatcagaatggccgccatcagcgagagcaacatcaacctgtgcggcagccactgcggcgtgagcatcggcgaggacggccccagccagatggccctggaggacctggccatgttcagaagcgtgcccaccagcaccgtgttctaccccagcgacggcgtggccaccgagaaggccgtggagctggccgccaacaccaagggcatctgcttcatcagaaccagcagacccgagaacgccatcatctacaacaacaacgaggacttccaggtgggccaggccaaggtggtgctgaagagcaaggacgaccaggtgaccgtgatcggcgccggcgtgaccctgcacgaggccctggccgccgccgagctgctgaagaaggagaagatcaacatcagagtgctggaccccttcaccatcaagcccctggacagaaagctgatcctggacagcgccagagccaccaagggcagaatcctgaccgtggaggaccactactacgagggcggcatcggcgaggccgtgagcagcgccgtggtgggcgagcccggcatcaccgtgacccacctggccgtgaacagagtgcccagaagcggcaagcccgccgagctgctgaagatgttcggcatcgacagagacgccatcgcccaggccgtgagaggcctgatcaccaaggcctag

SEQ ID NO: 103078 - DNA, 1872 bp, Artificial Sequence; identical to SEQ ID NO: 103077
  Description of Artificial Sequence: Synthetic coding sequence

SEQ ID NO: 103079 - DNA, 1896 bp, Artificial Sequence
  Description of Artificial Sequence: Synthetic coding sequence
atggagagctaccacaagcccgaccagcagaagctgcaggccctgaaggacaccgccaacagactgagaatcagcagcatccaggccaccaccgccgccggcagcggccaccccaccagctgctgcagcgccgccgagatcatggccgtgctgttcttccacaccatgagatacaagagccaggaccccagaaacccccacaacgacagattcgtgctgagcaagggccacgccgcccccatcctgtacgccgtgtgggccgaggccggcttcctggccgaggccgagctgctgaacctgagaaagatcagcagcgacctggacggccaccccgtgcccaagcaggccttcaccgacgtggccaccggcagcctgggccagggcctgggcgccgcctgcggcatggcctacaccggcaagtacttcgacaaggccagcctgcccagcagctgggactacagctacagagtgtactgcctgctgggcgacggcgagctgagcgagggcagcgtgtgggaggccatggccttcgccagcatctacaagctggacaacctggtggccatcctggacatcaacagactgggccagagcgaccccgcccccctgcagcaccagatggacatctaccagaagagatgcgaggccttcggctggcacgccatcatcgtggacggccacagcgtggaggagctgtgcaaggccttcggccaggccaagcaccagcccaccgccatcatcgccaagaccttcaagggcagaggcatcaccggcgtggaggacaaggagagctggcacggcaagcccctgcccaagaacatggccgagcagatcatccaggagatctacagccagatccagagcaagaagaagatcctggccacccccccccaggaggacgcccccagcgtggacatcgccaacatcagaatgcccagcctgcccagctacaaggtgggcgacaagatcgccaccagaaaggcctacggccaggccctggccaagctgggccacgccagcgacagaatcatcgccctggacggcgacaccaagaacagcaccttcagcgagatcttcaagaaggagcaccccgacagattcatcgagtgctacatcgccgagcagaacatggtgagcatcgccgtgggctgcgccaccagaaacagaaccgtgcccttctgcagcaccttcgccgccttcttcaccagagccttcgaccagatcagaatggccgccatcagcgagagcaacatcaacctgtgcggcagccactgcggcgtgagcatcggcgaggacggccccagccagatggccctggaggacctggccatgttcagaagcgtgcccaccagcaccgtgttctaccccagcgacggcgtggccaccgagaaggccgtggagctggccgccaacaccaagggcatctgcttcatcagaaccagcagacccgagaacgccatcatctacaacaacaacgaggacttccaggtgggccaggccaaggtggtgctgaagagcaaggacgaccaggtgaccgtgatcggcgccggcgtgaccctgcacgaggccctggccgccgccgagctgctgaagaaggagaagatcaacatcagagtgctggaccccttcaccatcaagcccctggacagaaagctgatcctggacagcgccagagccaccaagggcagaatcctgaccgtggaggaccactactacgagggcggcatcggcgaggccgtgagcagcgccgtggtgggcgagcccggcatcaccgtgacccacctggccgtgaacagagtgcccagaagcggcaagcccgccgagctgctgaagatgttcggcatcgacagagacgccatcgcccaggccgtgagaggcctgatcaccaaggcctag

SEQ ID NO: 103080 - DNA, 1182 bp, Artificial Sequence
  Description of Artificial Sequence: Synthetic coding sequence
atggccctgaaggtggccaccgtggccggcagcgccgccaaggccgtgctgggccccgccctgctgtgcagaccctgggaggtgctgggcgcccacgaggtgcccagcagaaacatcttcagcgagcagaccatcccccccagcgccaagtacggcggcagacacaccgtgaccatgatccccggcgacggcatcggccccgagctgatgctgcacgtgaagagcgtgttcagacacgcctgcgtgcccgtggacttcgaggaggtgcacgtgagcagcaacgccgacgaggaggacatcagaaacgccatcatggccatcagaagaaacagagtggccctgaagggcaacatcgagaccaaccacaacctgccccccagccacaagagcagaaacaacatcctgagaaccagcctggacctgtacgccaacgtgatccactgcaagagcctgcccggcgtggtgaccagacacaaggacatcgacatcctgatcgtgagagagaacaccgagggcgagtacagcagcctggagcacgagagcgtggccggcgtggtggagagcctgaagatcatcaccaaggccaagagcctgagaatcgccgagtacgccttcaagctggcccaggagagcggcagaaagaaggtgaccgccgtgcacaaggccaacatcatgaagctgggcgacggcctgttcctgcagtgctgcagagaggtggccgccagatacccccagatcaccttcgagaacatgatcgtggacaacaccaccatgcagctggtgagcagaccccagcagttcgacgtgatggtgatgcccaacctgtacggcaacatcgtgaacaacgtgtgcgccggcctggtgggcggccccggcctggtggccggcgccaactacggccacgtgtacgccgtgttcgagaccgccaccagaaacaccggcaagagcatcgccaacaagaacatcgccaaccccaccgccaccctgctggccagctgcatgatgctggaccacctgaagctgcacagctacgccaccagcatcagaaaggccgtgctggccagcatggacaacgagaacatgcacacccccgacatcggcggccagggcaccaccagcgaggccatccaggacgtgatcagacacatcagagtgatcaacggcagagccgtggaggcctag

SEQ ID NO: 103081 - DNA, 1791 bp, Artificial Sequence
  Description of Artificial Sequence: Synthetic coding sequence
atggccgacgccgaggccagagccgagttccccgaggaggccagacccgacagaggcaccctgcaggtgctgcaggacatggccagcagactgagaatccacagcatcagagccacctgcagcaccagcagcggccaccccaccagctgcagcagcagcagcgagatcatgagcgtgctgttcttctacatcatgagatacaagcagagcgaccccgagaaccccgacaacgacagattcgtgctggccaagagactgagcttcgtggacgtggccaccggctggctgggccagggcctgggcgtggcctgcggcatggcctacaccggcaagtacttcgacagagccagctacagagtgttctgcctgatgagcgacggcgagagcagcgagggcagcgtgtgggaggccatggccttcgccagctactacagcctggacaacctggtggccatcttcgacgtgaacagactgggccacagcggcgccctgcccgccgagcactgcatcaacatctaccagagaagatgcgaggccttcggctggaacacctacgtggtggacggcagagacgtggaggccctgtgccaggtgttctggcaggccagccaggtgaagcacaagcccaccgccgtggtggccaagaccttcaagggcagaggcacccccagcatcgaggacgccgagagctggcacgccaagcccatgcccagagagagagccgacgccatcatcaagctgatcgagagccagatccagaccagcagaaacctggacccccagccccccatcgaggacagccccgaggtgaacatcaccgacgtgagaatgaccagcccccccgactacagagtgggcgacaagatcgccaccagaaaggcctgcggcctggccctggccaagctgggctacgccaacaacagagtggtggtgctggacggcgacaccagatacagcaccttcagcgagatcttcaacaaggagtaccccgagagattcatcgagtgcttcatggccgagcagaacatggtgagcgtggccctgggctgcgccagcagaggcagaaccatcgccttcgccagcaccttcgccgccttcctgaccagagccttcgaccacatcagaatcggcggcctggccgagagcaacatcaacatcatcggcagccactgcggcgtgagcgtgggcgacgacggcgccagccagatggccctggaggacatcgccatgttcagaaccatccccaagtgcaccatcttctaccccaccgacgccgtgagcaccgagcacgccgtggccctggccgccaacgccaagggcatgtgcttcatcagaaccaccagacccgagaccatggtgatctacaccccccaggagagattcgagatcggccaggccaaggtgctgagacactgcgtgagcgacaaggtgaccgtgatcggcgccggcatcaccgtgtacgaggccctggccgccgccgacgagctgagcaagcaggacatcttcatcagagtgatcgacctgttcaccatcaagcccctggacgtggccaccatcgtgagcagcgccaaggccaccgagggcagaatcatcaccgtggaggaccactacccccagggcggcatcggcgaggccgtgtgcgccgccgtgagcatggaccccgacatccaggtgcacagcctggccgtgagcggcgtgccccagagcggcaagagcgaggagctgctggacatgtacggcatcagcgccagacacatcatcgtggccgtgaagtgcatgctgctgaactag

SEQ ID NO: 103082 - DNA, 1674 bp, Artificial Sequence
  Description of Artificial Sequence: Synthetic coding sequence
atgagcgtgctgttcttctacatcatgagatacaagcagagcgaccccgagaaccccgacaacgacagattcgtgctggccaagagactgagcttcgtggacgtggccaccggctggctgggccagggcctgggcgtggcctgcggcatggcctacaccggcaagtacttcgacagagccagctacagagtgttctgcctgatgagcgacggcgagagcagcgagggcagcgtgtgggaggccatggccttcgccagctactacagcctggacaacctggtggccatcttcgacgtgaacagactgggccacagcggcgccctgcccgccgagcactgcatcaacatctaccagagaagatgcgaggccttcggctggaacacctacgtggtggacggcagagacgtggaggccctgtgccaggtgttctggcaggccagccaggtgaagcacaagcccaccgccgtggtggccaagaccttcaagggcagaggcacccccagcatcgaggacgccgagagctggcacgccaagcccatgcccagagagagagccgacgccatcatcaagctgatcgagagccagatccagaccagcagaaacctggacccccagccccccatcgaggacagccccgaggtgaacatcaccgacgtgagaatgaccagcccccccgactacagagtgggcgacaagatcgccaccagaaaggcctgcggcctggccctggccaagctgggctacgccaacaacagagtggtggtgctggacggcgacaccagatacagcaccttcagcgagatcttcaacaaggagtaccccgagagattcatcgagtgcttcatggccgagcagaacatggtgagcgtggccctgggctgcgccagcagaggcagaaccatcgccttcgccagcaccttcgccgccttcctgaccagagccttcgaccacatcagaatcggcggcctggccgagagcaacatcaacatcatcggcagccactgcggcgtgagcgtgggcgacgacggcgccagccagatggccctggaggacatcgccatgttcagaaccatccccaagtgcaccatcttctaccccaccgacgccgtgagcaccgagcacgccgtggccctggccgccaacgccaagggcatgtgcttcatcagaaccaccagacccgagaccatggtgatctacaccccccaggagagattcgagatcggccaggccaagggcgtgagcatgctgcaggacagctggagcagcgtgatcagctaccagaaggtgctgagacactgcgtgagcgacaaggtgaccgtgatcggcgccggcatcaccgtgtacgaggccctggccgccgccgacgagctgagcaagcaggacatcttcatcagagtgatcgacctgttcaccatcaagcccctggacgtggccaccatcgtgagcagcgccaaggccaccgagggcagaatcatcaccgtggaggaccactacccccagggcggcatcggcgaggccgtgtgcgccgccgtgagcatggaccccgacatccaggtgcacagcctggccgtgagcggcgtgccccagagcggcaagagcgaggagctgctggacatgtacggcatcagcgccagacacatcatcgtggccgtgaagtgcatgctgctgaactag

SEQ ID NO: 103083 - DNA, 1623 bp, Artificial Sequence
  Description of Artificial Sequence: Synthetic coding sequence
atgagcgtgctgttcttctacatcatgagatacaagcagagcgaccccgagaaccccgacaacgacagattcgtgctggccaagagactgagcttcgtggacgtggccaccggctggctgggccagggcctgggcgtggcctgcggcatggcctacaccggcaagtacttcgacagagccagctacagagtgttctgcctgatgagcgacggcgagagcagcgagggcagcgtgtgggaggccatggccttcgccagctactacagcctggacaacctggtggccatcttcgacgtgaacagactgggccacagcggcgccctgcccgccgagcactgcatcaacatctaccagagaagatgcgaggccttcggctggaacacctacgtggtggacggcagagacgtggaggccctgtgccaggtgttctggcaggccagccaggtgaagcacaagcccaccgccgtggtggccaagaccttcaagggcagaggcacccccagcatcgaggacgccgagagctggcacgccaagcccatgcccagagagagagccgacgccatcatcaagctgatcgagagccagatccagaccagcagaaacctggacccccagccccccatcgaggacagccccgaggtgaacatcaccgacgtgagaatgaccagcccccccgactacagagtgggcgacaagatcgccaccagaaaggcctgcggcctggccctggccaagctgggctacgccaacaacagagtggtggtgctggacggcgacaccagatacagcaccttcagcgagatcttcaacaaggagtaccccgagagattcatcgagtgcttcatggccgagcagaacatggtgagcgtggccctgggctgcgccagcagaggcagaaccatcgccttcgccagcaccttcgccgccttcctgaccagagccttcgaccacatcagaatcggcggcctggccgagagcaacatcaacatcatcggcagccactgcggcgtgagcgtgggcgacgacggcgccagccagatggccctggaggacatcgccatgttcagaaccatccccaagtgcaccatcttctaccccaccgacgccgtgagcaccgagcacgccgtggccctggccgccaacgccaagggcatgtgcttcatcagaaccaccagacccgagaccatggtgatctacaccccccaggagagattcgagatcggccaggccaaggtgctgagacactgcgtgagcgacaaggtgaccgtgatcggcgccggcatcaccgtgtacgaggccctggccgccgccgacgagctgagcaagcaggacatcttcatcagagtgatcgacctgttcaccatcaagcccctggacgtggccaccatcgtgagcagcgccaaggccaccgagggcagaatcatcaccgtggaggaccactacccccagggcggcatcggcgaggccgtgtgcgccgccgtgagcatggaccccgacatccaggtgcacagcctggccgtgagcggcgtgccccagagcggcaagagcgaggagctgctggacatgtacggcatcagcgccagacacatcatcgtggccgtgaagtgcatgctgctgaactag

SEQ ID NO: 103084 - DNA, 894 bp, Artificial Sequence
  Description of Artificial Sequence: Synthetic coding sequence
atgagcgcctgggccgccgccagcctgagcagagccgccgccagatgcctgctggccagaggccccggcgtgagagccgccccccccagagaccccagacccagccaccccgagcccagaggctgcggcgccgcccccggcagaaccctgcacttcaccgccgccgtgcccgccggccacaacaagtggagcaaggtgagacacatcaagggccccaaggacgtggagagaagcagaatcttcagcaagctgtgcctgaacatcagactggccgtgaaggagggcggccccaaccccgagcacaacagcaacctggccaacatcctggaggtgtgcagaagcaagcacatgcccaagagcaccatcgagaccgccctgaagatggagaagagcaaggacacctacctgctgtacgagggcagaggccccggcggcagcagcctgctgatcgaggccctgagcaacagcagccacaagtgccaggccgacatcagacacatcctgaacaagaacggcggcgtgatggccgtgggcgccagacacagcttcgacaagaagggcgtgatcgtggtggaggtggaggacagagagaagaaggccgtgaacctggagagagccctggagatggccatcgaggccggcgccgaggacgtgaaggagaccgaggacgaggaggagagaaacgtgttcaagttcatctgcgacgccagcagcctgcaccaggtgagaaagaagctggacagcctgggcctgtgcagcgtgagctgcgccctggagttcatccccaacagcaaggtgcagctggccgagcccgacctggagcaggccgcccacctgatccaggccctgagcaaccacgaggacgtgatccacgtgtacgacaacatcgagtag

SEQ ID NO: 103085 - DNA, 687 bp, Artificial Sequence
  Description of Artificial Sequence: Synthetic coding sequence
atgagcgtgagcgagatcttcgtggagctgcagggcttcctggccgccgagcaggacatcagagaggagatcagaaaggtggtgcagagcctggagcagaccgccagagagatcctgaccctgctgcagggcgtgcaccagggcgccggcttccaggacatccccaagagatgcctgaaggccagagagcacttcggcaccgtgaagacccacctgaccagcctgaagaccaagttccccgccgagcagtactacagattccacgagcactggagattcgtgctgcagagactggtgttcctggccgccttcgtggtgtacctggagaccgagaccctggtgaccagagaggccgtgaccgagatcctgggcatcgagcccgacagagagaagggcttccacctggacgtggaggactacctgagcggcgtgctgatcctggccagcgagctgagcagactgagcgtgaacagcgtgaccgccggcgactacagcagacccctgcacatcagcaccttcatcaacgagctggacagcggcttcagactgctgaacctgaagaacgacagcctgagaaagagatacgacggcctgaagtacgacgtgaagaaggtggaggaggtggtgtacgacctgagcatcagaggcttcaacaaggagaccgccgccgcctgcgtggagaagtag

SEQ ID NO: 103086 - DNA, 585 bp, Artificial Sequence
  Description of Artificial Sequence: Synthetic coding sequence
atgagcgtgagcgagatcttcgtggagctgcagggcttcctggccgccgagcaggacatccccaagagatgcctgaaggccagagagcacttcggcaccgtgaagacccacctgaccagcctgaagaccaagttccccgccgagcagtactacagattccacgagcactggagattcgtgctgcagagactggtgttcctggccgccttcgtggtgtacctggagaccgagaccctggtgaccagagaggccgtgaccgagatcctgggcatcgagcccgacagagagaagggcttccacctggacgtggaggactacctgagcggcgtgctgatcctggccagcgagctgagcagactgagcgtgaacagcgtgaccgccggcgactacagcagacccctgcacatcagcaccttcatcaacgagctggacagcggcttcagactgctgaacctgaagaacgacagcctgagaaagagatacgacggcctgaagtacgacgtgaagaaggtggaggaggtggtgtacgacctgagcatcagaggcttcaacaaggagaccgccgccgcctgcgtggagaagtag

SEQ ID NO: 103087 - DNA, 447 bp, Artificial Sequence
  Description of Artificial Sequence: Synthetic coding sequence
atgagcgtgagcgagatcttcgtggagctgcagggcttcctggccgccgagcaggacatcagagaggagatcagaaaggtggtgcagagcctggagcagaccgccagagagatcctgaccctgctgcagggcgtgcaccagggcgccggcttccaggacatccccaagagatgcctgaaggccagagagcacttcggcaccgtgaagacccacctgaccagcctgaagaccaagttccccgccgagcagtactacagattccacgagcactggagattcgtgctgcagagactggtgttcctggccgccttcgtggtgtacctggagaccgagaccctggtgaccagagaggccgtgaccgagatcctgggcatcgaggccgtgtgccagcagagagactgctggagactgctgcccacccccccccacctgcacctgcaccagtag

SEQ ID NO: 103088 - DNA, 873 bp, Artificial Sequence
  Description of Artificial Sequence: Synthetic coding sequence
atgagcaacaaggagggcagcggcggcttcagaaagagaaagcacgacaacttcccccacaaccagagaagagagggcaaggacgtgaacagcagcagccccgtgatgctggccttcaagagcttccagcaggagctggacgccagacacgacaagtacgagagactggtgaagctgagcagagacatcaccgtggagagcaagagaaccatcttcctgctgcacagaatcaccagcgcccccgacatggaggacatcctgaccgagagcgagatcaagctggacggcgtgagacagaagatcttccaggtggcccaggagctgagcggcgaggacatgcaccagttccacagagccatcaccaccggcctgcaggagtacgtggaggccgtgagcttccagcacttcatcaagaccagaagcctgatcagcatggacgagatcaacaagcagctgatcttcaccaccgaggacaacggcaaggagaacaagacccccagcagcgacgcccaggacaagcagttcggcacctggagactgagagtgacccccgtggactacctgctgggcgtggccgacctgaccggcgagctgatgagaatgtgcatcaacagcgtgggcaacggcgacatcgacacccccttcgaggtgagccagttcctgagacaggtgtacgacggcttcagcttcatcggcaacaccggcccctacgaggtgagcaagaagctgtacaccctgaagcagagcctggccaaggtggagaacgcctgctacgccctgaaggtgagaggcagcgagatccccaagcacatgctggccgacgtgttcagcgtgaagaccgagatgatcgaccaggaggagggcatcagctag

SEQ ID NO: 103089 - DNA, 492 bp, Artificial Sequence
  Description of Artificial Sequence: Synthetic coding sequence
atgagcaacaaggagggcagcggcggcttcagaaagagaaagcacgacaacttcccccacaaccagagaagagagggcaaggacgtgaacagcagcagccccgtgatgctggccttcaagagcttccagcaggagctggacgccagacacgacaagtacgagagactggtgaagctgagcagagacatcaccgtggagagcaagagaaccatcttcctgctgcacagaatcaccagcagccagtacctggaccacagcgcccccgacatggaggacatcctgaccgagagcgagatcaagctggacggcgtgagacagaagatcttccaggtggcccaggagctgagcggcgaggacatgcaccagttccacagagccatcaccaccggcctgcaggagtacgtggaggccgtgagcttccagcacttcatcaagaccagaagcctgatcagcatggacgagatcaacaagcagctgatcttcaccacctag

SEQ ID NO: 103090 - DNA, 273 bp, Artificial Sequence
  Description of Artificial Sequence: Synthetic coding sequence
atggaccccctgagagcccagcagctggccgccgagctggaggtggagatgatggccgacatgtacaacagaatgaccagcgcctgccacagaaagtgcgtgcccccccactacaaggaggccgagctgagcaagggcgagagcgtgtgcctggacagatgcgtgagcaagtacctggacatccacgagagaatgggcaagaagctgaccgagctgagcatgcaggacgaggagctgatgaagagagtgcagcagagcagcggccccgcctag

SEQ ID NO: 103091 - DNA, 273 bp, Artificial Sequence; identical to SEQ ID NO: 103090
  Description of Artificial Sequence: Synthetic coding sequence

SEQ ID NO: 103092 - DNA, 273 bp, Artificial Sequence; identical to SEQ ID NO: 103090
  Description of Artificial Sequence: Synthetic coding sequence

SEQ ID NO: 103093 - DNA, 927 bp, Artificial Sequence
  Description of Artificial Sequence: Synthetic coding sequence
atgaagcactacgaggtggagatcctggacgccaagaccagagagaagctgtgcttcctggacaaggtggagccccacgccaccatcgccgagatcaagaacctgttcaccaagacccacccccagtggtaccccgccagacagagcctgagactggaccccaagggcaagagcctgaaggacgaggacgtgctgcagaagctgcccgtgggcaccaccgccaccctgtacttcagagacctgggcgcccagatcagctgggtgaccgtgttcctgaccgagtacgccggccccctgttcatctacctgctgttctacttcagagtgcccttcatctacggccacaagtacgacttcaccagcagcagacacaccgtggtgcacctggcctgcatctgccacagcttccactacatcaagagactgctggagaccctgttcgtgcacagattcagccacggcaccatgcccctgagaaacatcttcaagaactgcacctactactggggcttcgccgcctggatggcctactacatcaaccaccccctgtacaccccccccacctacggcgcccagcaggtgaagctggccctggccatcttcgtgatctgccagctgggcaacttcagcatccacatggccctgagagacctgagacccgccggcagcaagaccagaaagatcccctaccccaccaagaaccccttcacctggctgttcctgctggtgagctgccccaactacacctacgaggtgggcagctggatcggcttcgccatcatgacccagtgcctgcccgtggccctgttcagcctggtgggcttcacccagatgaccatctgggccaagggcaagcacagaagctacctgaaggagttcagagactacccccccctgagaatgcccatcatccccttcctgctgtag

SEQ ID NO: 103094 - DNA, 516 bp, Artificial Sequence
  Description of Artificial Sequence: Synthetic coding sequence
atggaggagtacgccagagagccctgcccctggagaatcgtggacgactgcggcggcgccttcaccatgggcaccatcggcggcggcatcttccaggccatcaagggcttcagaaacagccccgtgggcgtgaaccacagactgagaggcagcctgaccgccatcaagaccagagccccccagctgggcggcagcttcgccgtgtggggcggcctgttcagcatgatcgactgcagcatggtgcaggtgagaggcaaggaggacccctggaacagcatcaccagcggcgccctgaccggcgccatcctggccgccagaaacggccccgtggccatggtgggcagcgccgccatgggcggcatcctgctggccctgatcgagggcgccggcatcctgctgaccagattcgccagcgcccagttccccaacggcccccagttcgccgaggaccccagccagctgcccagcacccagctgcccagcagccccttcggcgactacagacagtaccagtag

SEQ ID NO: 103095 - DNA, 519 bp, Artificial Sequence
  Description of Artificial Sequence: Synthetic coding sequence
atggaggagtacgccagagagccctgcccctggagaatcgtggacgactgcggcggcgccttcaccatgggcgtgatcggcggcggcgtgttccaggccatcaagggcttcagaaacgcccccgtgggcatcagacacagactgagaggcagcgccaacgccgtgagaatcagagccccccagatcggcggcagcttcgccgtgtggggcggcctgttcagcaccatcgactgcggcctggtgagactgagaggcaaggaggacccctggaacagcatcaccagcggcgccctgaccggcgccgtgctggccgccagaagcggccccctggccatggtgggcagcgccatgatgggcggcatcctgctggccctgatcgagggcgtgggcatcctgctgaccagatacaccgcccagcagttcagaaacgccccccccttcctggaggaccccagccagctgccccccaaggacggcacccccgcccccggctaccccagctaccagcagtaccactag

SEQ ID NO: 103096 - DNA, 669 bp, Artificial Sequence
  Description of Artificial Sequence: Synthetic coding sequence
atggaggagtacgccagagagccctgcccctggagaatcgtggacgactgcggcggcgccttcaccatgggcgtgatcggcggcggcgtgttccaggccatcaagggcttcagaaacgcccccgtgtgcagactgctgagcgaggcccccctgttcatctacagctgcagcagaagcgtgagccccaccgtgaacgtgagcagcgagagagccgagagcagacccaccctgttcatggccgtgagcctgcacatggcctggtgcctggcccacatcggcatcagacacagactgagaggcagcgccaacgccgtgagaatcagagccccccagatcggcggcagcttcgccgtgtggggcggcctgttcagcaccatcgactgcggcctggtgagactgagaggcaaggaggacccctggaacagcatcaccagcggcgccctgaccggcgccgtgctggccgccagaagcggccccctggccatggtgggcagcgccatgatgggcggcatcctgctggccctgatcgagggcgtgggcatcctgctgaccagatacaccgcccagcagttcagaaacgccccccccttcctggaggaccccagccagctgccccccaaggacggcacccccgcccccggctaccccagctaccagcagtaccactag

SEQ ID NO: 103097 - DNA, 585 bp, Artificial Sequence
  Description of Artificial Sequence: Synthetic coding sequence
atggccgccgccgcccccaacgccggcggcagcgcccccgagaccgccggcagcgccgaggcccccctgcagtacagcctgctgctgcagtacctggtgggcgacaagagacagcccagactgctggagcccggcagcctgggcggcatccccagccccgccaagagcgaggagcagaagatgatcgagaaggccatggagagctgcgccttcaaggccgccctggcctgcgtgggcggcttcgtgctgggcggcgccttcggcgtgttcaccgccggcatcgacaccaacgtgggcttcgaccccaaggacccctacagaacccccaccgccaaggaggtgctgaaggacatgggccagagaggcatgagctacgccaagaacttcgccatcgtgggcgccatgttcagctgcaccgagtgcctgatcgagagctacagaggcaccagcgactggaagaacagcgtgatcagcggctgcatcaccggcggcgccatcggcttcagagccggcctgaaggccggcgccatcggctgcggcggcttcgccgccttcagcgccgccatcgactactacctgagatag

SEQ ID NO: 103098 - DNA, 630 bp, Artificial Sequence
  Description of Artificial Sequence: Synthetic coding sequence
atggagggcggcggcggcagcggcaacaagaccaccggcggcctggccggcttcttcggcgccggcggcgccggctacagccacgccgacctggccggcgtgcccctgaccggcatgaaccccctgagcccctacctgaacgtggaccccagatacctggtgcaggacaccgacgagttcatcctgcccaccggcgccaacaagaccagaggcagattcgagctggccttcttcaccatcggcggctgctgcatgaccggcgccgccttcggcgccatgaacggcctgagactgggcctgaaggagacccagaacatggcctggagcaagcccagaaacgtgcagatcctgaacatggtgaccagacagggcgccctgtgggccaacaccctgggcagcctggccctgctgtacagcgccttcggcgtgatcatcgagaagaccagaggcgccgaggacgacctgaacaccgtggccgccggcaccatgaccggcatgctgtacaagtgcaccggcggcctgagaggcatcgccagaggcggcctgaccggcctgaccctgaccagcctgtacgccctgtacaacaactgggagcacatgaagggcagcctgctgcagcagagcctgtag

SEQ ID NO: 103099 - DNA, 486 bp, Artificial Sequence
  Description of Artificial Sequence: Synthetic coding sequence
atggagggcggcggcggcagcggcaacaagaccaccggcggcctggccggcttcttcggcgccggcggcgccggctacagccacgccgacctggccggcgtgcccctgaccggcatgaaccccctgagcccctacctgaacgtggaccccagatacctggtgcaggacaccgacgagttcatcctgcccaccggcgccaacaagaccagaggcagattcgagctggccttcttcaccatcggcggctgctgcatgaccgccctgctgtacagcgccttcggcgtgatcatcgagaagaccagaggcgccgaggacgacctgaacaccgtggccgccggcaccatgaccggcatgctgtacaagtgcaccggcggcctgagaggcatcgccagaggcggcctgaccggcctgaccctgaccagcctgtacgccctgtacaacaactgggagcacatgaagggcagcctgctgcagcagagcctgtag

SEQ ID NO: 103100 - DNA, 519 bp, Artificial Sequence
  Description of Artificial Sequence: Synthetic coding sequence
atggagggcggcggcggcagcggcaacaagaccaccggcggcctggccggcttcttcggcgccggcggcgccggctacagccacgccgacctggccggcgtgcccctgaccggcatgaaccccctgagcccctacctgaacgtggaccccagatacctggtgcaggacaccgacgagttcatcctgcccaccggcgccaacaagaccagaggcagattcgagctggccttcttcaccatcggcggctgctgcatgaccggcgccctgtgggccaacaccctgggcagcctggccctgctgtacagcgccttcggcgtgatcatcgagaagaccagaggcgccgaggacgacctgaacaccgtggccgccggcaccatgaccggcatgctgtacaagtgcaccggcggcctgagaggcatcgccagaggcggcctgaccggcctgaccctgaccagcctgtacgccctgtacaacaactgggagcacatgaagggcagcctgctgcagcagagcctgtag

SEQ ID NO: 103101 - DNA, 381 bp, Artificial Sequence
  Description of Artificial Sequence: Synthetic coding sequence
atgaccggcgccgccttcggcgccatgaacggcctgagactgggcctgaaggagacccagaacatggcctggagcaagcccagaaacgtgcagatcctgaacatggtgaccagacagggcgccctgtgggccaacaccctgggcagcctggccctgctgtacagcgccttcggcgtgatcatcgagaagaccagaggcgccgaggacgacctgaacaccgtggccgccggcaccatgaccggcatgctgtacaagtgcaccgccagcgccagccagagcgccagaatcgccgacggcctgatcttcaccgagttctgcagcgtggccagactgcagggcagcggcaccatcctggcccactacaacctgcacctgccctag

SEQ ID NO: 103102 - DNA, 324 bp, Artificial Sequence
  Description of Artificial Sequence: Synthetic coding sequence
tgaggcggcagcggcaacaagaccaccggcggcctggccggcttcttcggcgccggcggcgccggctacagccacgccgacctggccggcgtgccccccctgctgtacagcgccttcggcgtgatcatcgagaagaccagaggcgccgaggacgacctgaacaccgtggccgccggcaccatgaccggcatgctgtacaagtgcaccggcggcctgagaggcatcgccagaggcggcctgaccggcctgaccctgaccagcctgtacgccctgtacaacaactgggagcacatgaagggcagcctgctgcagcagagcctgtag

SEQ ID NO: 103103 - DNA, 1359 bp, Artificial Sequence
  Description of Artificial Sequence: Synthetic coding sequence
atggccgccgccgccctgagaagcggctggtgcagatgccccagaagatgcctgggcagcggcatccagttcctgagcagccacaacctgccccacggcagcacctaccagatgagaagacccggcggcgagctgcccctgagcaagagctacagcagcggcaacagaaagggcttcctgagcggcctgctggacaacgtgaagcaggagctggccaagaacaaggagatgaaggagagcatcaagaagttcagagacgaggccagaagactggaggagagcgacgtgctgcaggaggccagaagaaagtacaagaccatcgagagcgagaccgtgagaaccagcgaggtgctgagaaagaagctgggcgagctgaccggcaccgtgaaggagagcctgcacgaggtgagcaagagcgacctgggcagaaagatcaaggagggcgtggaggaggccgccaagaccgccaagcagagcgccgagagcgtgagcaagggcggcgagaagctgggcagaaccgccgccttcagagccctgagccagggcgtggagagcgtgaagaaggagatcgacgacagcgtgctgggccagaccggcccctacagaagaccccagagactgagaaagagaaccgagttcgccggcgacaagttcaaggaggagaaggtgttcgagcccaacgaggaggccctgggcgtggtgctgcacaaggacagcaagtggtaccagcagtggaaggacttcaaggagaacaacgtggtgttcaacagattcttcgagatgaagatgaagtacgacgagagcgacaacgccttcatcagagccagcagagccctgaccgacaaggtgaccgacctgctgggcggcctgttcagcaagaccgagatgagcgaggtgctgaccgagatcctgagagtggaccccgccttcgacaaggacagattcctgaagcagtgcgagaacgacatcatccccaacgtgctggaggccatgatcagcggcgagctggacatcctgaaggactggtgctacgaggccacctacagccagctggcccaccccatccagcaggccaaggccctgggcctgcagttccacagcagaatcctggacatcgacaacgtggacctggccatgggcaagatgatggagcagggccccgtgctgatcatcaccttccaggcccagctggtgatggtggtgagaaaccccaagggcgaggtggtggagggcgaccccgacaaggtgctgagaatgctgtacgtgtgggccctgtgcagagaccaggacgagctgaacccctacgccgcctggagactgctggacatcagcgccagcagcaccgagcagatcctgtag

SEQ ID NO: 103104 - DNA, 294 bp, Artificial Sequence
  Description of Artificial Sequence: Synthetic coding sequence
atggacagcagcagcagcagcagcgccgccggcctgggcgccgtggacccccagctgcagcacttcatcgaggtggagacccagaagcagagattccagcagctggtgcaccagatgaccgagctgtgctgggagaagtgcatggacaagcccggccccaagctggacagcagagccgaggcctgcttcgtgaactgcgtggagagattcatcgacaccagccagttcatcctgaacagactggagcagacccagaagagcaagcccgtgttcagcgagagcctgagcgactag

SEQ ID NO: 103105 - DNA, 270 bp, Artificial Sequence
  Description of Artificial Sequence: Synthetic coding sequence
atggccgcccagatccccgagagcgaccagatcaagcagttcaaggagttcctgggcacctacaacaagctgaccgagacctgcttcctggactgcgtgaaggacttcaccaccagagaggtgaagcccgaggagaccacctgcagcgagcactgcctgcagaagtacctgaagatgacccagagaatcagcatgagattccaggagtaccacatccagcagaacgaggccctggccgccaaggccggcctgctgggccagcccagatag

SEQ ID NO: 103106 - DNA, 270 bp, Artificial Sequence; identical to SEQ ID NO: 103105
  Description of Artificial Sequence: Synthetic coding sequence

SEQ ID NO: 103107 - DNA, 135 bp, Artificial Sequence
  Description of Artificial Sequence: Synthetic coding sequence
atggccgcccagatccccgagagcgaccagatcaagcagttcaaggagttcctgggcacctacaacaagctgaccgagacctgcttcctggactgcgtgaaggacttcaccaccagagaggtgaagcccgagtag

SEQ ID NO: 103108 - DNA, 270 bp, Artificial Sequence; identical to SEQ ID NO: 103105
  Description of Artificial Sequence: Synthetic coding sequence

SEQ ID NO: 103109 - DNA, 270 bp, Artificial Sequence; identical to SEQ ID NO: 103105
  Description of Artificial Sequence: Synthetic coding sequence

SEQ ID NO: 103110 - DNA, 381 bp, Artificial Sequence
  Description of Artificial Sequence: Synthetic coding sequence
atgcccttcttcggcaacaccttcagccccaagaagaccccccccagaaagagcgccagcctgagcaacctgcacagcctggacagaagcaccagagaggtggagctgggcctggagtacggcagccccaccatgaacctggccggccagagcctgaagttcgagaacggccagtggatcgccgagaccggcgtgagcggcggcgtggacagaagagaggtgcagagactgagaagaagaaaccagcagctggaggaggagaacaacctgctgagactgaaggtggacatcctgctggacatgctgagcgagagcaccgccgagagccacctgatggagaaggagctggacgagctgagaatcagcagaaagagaaagtag

SEQ ID NO: 103111 - DNA, 1086 bp, Artificial Sequence
  Description of Artificial Sequence: Synthetic coding sequence
atgggcaacgtgctggccgccagcagcccccccgccggccccccccccccccccgcccccgccctggtgggcctgcccccccccccccccagcccccccggcttcaccctgccccccctgggcggcagcctgggcgccggcaccagcaccagcagaagcagcgagagaacccccggcgccgccaccgccagcgccagcggcgccgccgaggacggcgcctgcggctgcctgcccaaccccggcaccttcgaggagtgccacagaaagtgcaaggagctgttccccatccagatggagggcgtgaagctgaccgtgaacaagggcctgagcaaccacttccaggtgaaccacaccgtggccctgagcaccatcggcgagagcaactaccacttcggcgtgacctacgtgggcaccaagcagctgagccccaccgaggccttccccgtgctggtgggcgacatggacaacagcggcagcctgaacgcccaggtgatccaccagctgggccccggcctgagaagcaagatggccatccagacccagcagagcaagttcgtgaactggcaggtggacggcgagtacagaggcagcgacttcaccgccgccgtgaccctgggcaaccccgacgtgctggtgggcagcggcatcctggtggcccactacctgcagagcatcaccccctgcctggccctgggcggcgagctggtgtaccacagaagacccggcgaggagggcaccgtgatgagcctggccggcaagtacaccctgaacaactggctggccaccgtgaccctgggccaggccggcatgcacgccacctactaccacaaggccagcgaccagctgcaggtgggcgtggagttcgaggccagcaccagaatgcaggacaccagcgtgagcttcggctaccagctggacctgcccaaggccaacctgctgttcaagggcagcgtggacagcaactggatcgtgggcgccaccctggagaagaagctgccccccctgcccctgaccctggccctgggcgccttcctgaaccacagaaagaacaagttccagtgcggcttcggcctgaccatcggctag

SEQ ID NO: 103112 - DNA, 1086 bp, Artificial Sequence; identical to SEQ ID NO: 103111
  Description of Artificial Sequence: Synthetic coding sequence

SEQ ID NO: 103113 - DNA, 1086 bp, Artificial Sequence; identical to SEQ ID NO: 103111
  Description of Artificial Sequence: Synthetic coding sequence

SEQ ID NO: 103114 - DNA, 453 bp, Artificial Sequence
  Description of Artificial Sequence: Synthetic coding sequence
atgcccagcagcggcagcgtgagcagaagcagacagagaggcagaagcatggccagcagaggcttcgacggcagcagaagaggcagcctgagaagagccggcgccagagagccccccagcgaggtgatcgaggccgccgcccaggccagcggcagctgctggagcagccccttcttcagcgccagcacccccagcgccgccgccaccggcgtgcccggccccaccgacatggccgccgtgctgcagcaggtgctggagagaaccgagctgaacaagctgcccaagagcgtgcagaacaagctggagaagttcctggccgaccagcagagcgagatcgacggcctgaagggcagacacgagaagttcaaggtggagagcgagcagcagtacttcgagatcgagaagagactgagccacagccaggagagactggtgaacgagaccagagagtag

SEQ ID NO: 103115 - DNA, 7092 bp, Artificial Sequence
  Description of Artificial Sequence: Synthetic coding sequence
atggccgccgtgctgcagcaggtgctggagagaaccgagctgaacaagctgcccaagagcgtgcagaacaagctggagaagttcctggccgaccagcagagcgagatcgacggcctgaagggcagacacgagaagttcaaggtggagagcgagcagcagtacttcgagatcgagaagagactgagccacagccaggagagactggtgaacgagaccagagagtgccagagcctgagactggagctggagaagctgaacaaccagctgaaggccctgaccgagaagaacaaggagctggagatcgcccaggacagaaacatcgccatccagagccagttcaccagaaccaaggaggagctggaggccgagaagagagacctgatcagaaccaacgagagactgagccaggagctggagtacctgaccgaggacgtgaagagactgaacgagaagctgaaggagagcaacaccaccaagggcgagctgcagctgaagctggacgagctgcaggccagcgacgtgagcgtgaagtacagagagaagagactggagcaggagaaggagctgctgcacagccagaacacctggctgaacaccgagctgaagaccaagaccgacgagctgctggccctgggcagagagaagggcaacgagatcctggagctgaagtgcaacctggagaacaagaaggaggaggtgagcagactggaggagcagatgaacggcctgaagaccagcaacgagcacctgcagaagcacgtggaggacctgctgaccaagctgaaggaggccaaggagcagcaggccagcatggaggagaagttccacaacgagctgaacgcccacatcaagctgagcaacctgtacaagagcgccgccgacgacagcgaggccaagagcaacgagctgaccagagccgtggaggagctgcacaagctgctgaaggaggccggcgaggccaacaaggccatccaggaccacctgctggaggtggagcagagcaaggaccagatggagaaggagatgctggagaagatcggcagactggagaaggagctggagaacgccaacgacctgctgagcgccaccaagagaaagggcgccatcctgagcgaggaggagctggccgccatgagccccaccgccgccgccgtggccaagatcgtgaagcccggcatgaagctgaccgagctgtacaacgcctacgtggagacccaggaccagctgctgctggagaagctggagaacaagagaatcaacaagtacctggacgagatcgtgaaggaggtggaggccaaggcccccatcctgaagagacagagagaggagtacgagagagcccagaaggccgtggccagcctgagcgtgaagctggagcaggccatgaaggagatccagagactgcaggaggacaccgacaaggccaacaagcagagcagcgtgctggagagagacaacagaagaatggagatccaggtgaaggacctgagccagcagatcagagtgctgctgatggagctggaggaggccagaggcaaccacgtgatcagagacgaggaggtgagcagcgccgacatcagcagcagcagcgaggtgatcagccagcacctggtgagctacagaaacatcgaggagctgcagcagcagaaccagagactgctggtggccctgagagagctgggcgagaccagagagagagaggagcaggagaccaccagcagcaagatcaccgagctgcagctgaagctggagagcgccctgaccgagctggagcagctgagaaagagcagacagcaccagatgcagctggtggacagcatcgtgagacagagagacatgtacagaatcctgctgagccagaccaccggcgtggccatccccctgcacgccagcagcctggacgacgtgagcctggccagcacccccaagagacccagcaccagccagaccgtgagcacccccgcccccgtgcccgtgatcgagagcaccgaggccatcgaggccaaggccgccctgaagcagctgcaggagatcttcgagaactacaagaaggagaaggccgagaacgagaagatccagaacgagcagctggagaagctgcaggagcaggtgaccgacctgagaagccagaacaccaagatcagcacccagctggacttcgccagcaagagatacgagatgctgcaggacaacgtggagggctacagaagagagatcaccagcctgcacgagagaaaccagaagctgaccgccaccacccagaagcaggagcagatcatcaacaccatgacccaggacctgagaggcgccaacgagaagctggccgtggccgaggtgagagccgagaacctgaagaaggagaaggagatgctgaagctgagcgaggtgagactgagccagcagagagagagcctgctggccgagcagagaggccagaacctgctgctgaccaacctgcagaccatccagggcatcctggagagaagcgagaccgagaccaagcagagactgagcagccagatcgagaagctggagcacgagatcagccacctgaagaagaagctggagaacgaggtggagcagagacacaccctgaccagaaacctggacgtgcagctgctggacaccaagagacagctggacaccgagaccaacctgcacctgaacaccaaggagctgctgaagaacgcccagaaggagatcgccaccctgaagcagcacctgagcaacatggaggtgcaggtggccagccagagcagccagagaaccggcaagggccagcccagcaacaaggaggacgtggacgacctggtgagccagctgagacagaccgaggagcaggtgaacgacctgaaggagagactgaagaccagcaccagcaacgtggagcagtaccaggccatggtgaccagcctggaggagagcctgaacaaggagaagcaggtgaccgaggaggtgagaaagaacatcgaggtgagactgaaggagagcgccgagttccagacccagctggagaagaagctgatggaggtggagaaggagaagcaggagctgcaggacgacaagagaagagccatcgagagcatggagcagcagctgagcgagctgaagaagaccctgagcagcgtgcagaacgaggtgcaggaggccctgcagagagccagcaccgccctgagcaacgagcagcaggccagaagagactgccaggagcaggccaagatcgccgtggaggcccagaacaagtacgagagagagctgatgctgcacgccgccgacgtggaggccctgcaggccgccaaggagcaggtgagcaagatggccagcgtgagacagcacctggaggagaccacccagaaggccgagagccagctgctggagtgcaaggccagctgggaggagagagagagaatgctgaaggacgaggtgagcaagtgcgtgtgcagatgcgaggacctggagaagcagaacagactgctgcacgaccagatcgagaagctgagcgacaaggtggtggccagcgtgaaggagggcgtgcagggccccctgaacgtgagcctgagcgaggagggcaagagccaggagcagatcctggagatcctgagattcatcagaagagagaaggagatcgccgagaccagattcgaggtggcccaggtggagagcctgagatacagacagagagtggagctgctggagagagagctgcaggagctgcaggacagcctgaacgccgagagagagaaggtgcaggtgaccgccaagaccatggcccagcacgaggagctgatgaagaagaccgagaccatgaacgtggtgatggagaccaacaagatgctgagagaggagaaggagagactggagcaggacctgcagcagatgcaggccaaggtgagaaagctggagctggacatcctgcccctgcaggaggccaacgccgagctgagcgagaagagcggcatgctgcaggccgagaagaagctgctggaggaggacgtgaagagatggaaggccagaaaccagcacctggtgagccagcagaaggaccccgacaccgaggagtacagaaagctgctgagcgagaaggaggtgcacaccaagagaatccagcagctgaccgaggagatcggcagactgaaggccgagatcgccagaagcaacgccagcctgaccaacaaccagaacctgatccagagcctgaaggaggacctgaacaaggtgagaaccgagaaggagaccatccagaaggacctggacgccaagatcatcgacatccaggagaaggtgaagaccatcacccaggtgaagaagatcggcagaagatacaagacccagtacgaggagctgaaggcccagcaggacaaggtgatggagaccagcgcccagagcagcggcgaccaccaggagcagcacgtgagcgtgcaggagatgcaggagctgaaggagaccctgaaccaggccgagaccaagagcaagagcctggagagccaggtggagaacctgcagaagaccctgagcgagaaggagaccgaggccagaaacctgcaggagcagaccgtgcagctgcagagcgagctgagcagactgagacaggacctgcaggacagaaccacccaggaggagcagctgagacagcagatcaccgagaaggaggagaagaccagaaaggccatcgtggccgccaagagcaagatcgcccacctggccggcgtgaaggaccagctgaccaaggagaacgaggagctgaagcagagaaacggcgccctggaccagcagaaggacgagctggacgtgagaatcaccgccctgaagagccagtacgagggcagaatcagcagactggagagagagctgagagagcaccaggagagacacctggagcagagagacgagccccaggagcccagcaacaaggtgcccgagcagcagagacagatcaccctgaagaccacccccgccagcggcgagagaggcatcgccagcaccagcgacccccccaccgccaacatcaagcccacccccgtggtgagcacccccagcaaggtgaccgccgccgccatggccggcaacaagagcacccccagagccagcatcagacccatggtgacccccgccaccgtgaccaaccccaccaccacccccaccgccaccgtgatgcccaccacccaggtggagagccaggaggccatgcagagcgagggccccgtggagcacgtgcccgtgttcggcagcaccagcggcagcgtgagaagcaccagccccaacgtgcagcccagcatcagccagcccatcctgaccgtgcagcagcagacccaggccaccgccttcgtgcagcccacccagcagagccacccccagatcgagcccgccaaccaggagctgagcagcaacatcgtggaggtggtgcagagcagccccgtggagagacccagcaccagcaccgccgtgttcggcaccgtgagcgccacccccagcagcagcctgcccaagagaaccagagaggaggaggaggacagcaccatcgaggccagcgaccaggtgagcgacgacaccgtggagatgcccctgcccaagaagctgaagagcgtgacccccgtgggcaccgaggaggaggtgatggccgaggagagcaccgacggcgaggtggagacccaggtgtacaaccaggacagccaggacagcatcggcgagggcgtgacccagggcgactacacccccatggaggacagcgaggagaccagccagagcctgcagatcgacctgggccccctgcagagcgaccagcagaccaccaccagcagccaggacggccagggcaagggcgacgacgtgatcgtgatcgacagcgacgacgaggaggaggacgacgacgagaacgacggcgagcacgaggactacgaggaggacgaggaggacgacgacgacgacgaggacgacaccggcatgggcgacgagggcgaggacagcaacgagggcaccggcagcgccgacggcaacgacggctacgaggccgacgacgccgagggcggcgacggcaccgaccccggcaccgagaccgaggagagcatgggcggcggcgagggcaaccacagagccgccgacagccagaacagcggcgagggcaacaccggcgccgccgagagcagcttcagccaggaggtgagcagagagcagcagcccagcagcgccagcgagagacaggcccccagagccccccagagccccagaagacccccccaccccctgccccccagactgaccatccacgcccccccccaggagctgggcccccccgtgcagagaatccagatgaccagaagacagagcgtgggcagaggcctgcagctgacccccggcatcggcggcatgcagcagcacttcttcgacgacgaggacagaaccgtgcccagcacccccaccctggtggtgccccacagaaccgacggcttcgccgaggccatccacagcccccaggtggccggcgtgcccagattcagattcggcccccccgaggacatgccccagaccagcagcagccacagcgacctgggccagctggccagccagggcggcctgggcatgtacgagacccccctgttcctggcccacgaggaggagagcggcggcagaagcgtgcccaccacccccctgcaggtggccgcccccgtgaccgtgttcaccgagagcaccaccagcgacgccagcgagcacgccagccagagcgtgcccatggtgaccaccagcaccggcaccctgagcaccaccaacgagaccgccaccggcgacgacggcgacgaggtgttcgtggaggccgagagcgagggcatcagcagcgaggccggcctggagatcgacagccagcaggaggaggagcccgtgcaggccagcgacgagagcgacctgcccagcaccagccaggacccccccagcagcagcagcgtggacaccagcagcagccagcccaagcccttcagaagagtgagactgcagaccaccctgagacagggcgtgagaggcagacagttcaacagacagagaggcgtgagccacgccatgggcggcagaggcggcatcaacagaggcaacatcaactag

SEQ ID NO: 103116 - DNA, 453 bp, Artificial Sequence; identical to SEQ ID NO: 103114
  Description of Artificial Sequence: Synthetic coding sequence

SEQ ID NO: 103117 - DNA, 510 bp, Artificial Sequence
  Description of Artificial Sequence: Synthetic coding sequence
atggcccccccctgggtgcccgccatgggcttcaccctggcccccagcctgggctgcttcgtgggcagcagattcgtgcacggcgagggcctgagatggtacgccggcctgcagaagcccagctggcaccccccccactgggtgctgggccccgtgtggggcaccctgtacagcgccatgggctacggcagctacctggtgtggaaggagctgggcggcttcaccgagaaggccgtggtgcccctgggcctgtacaccggccagctggccctgaactgggcctggccccccatcttcttcggcgccagacagatgggctgggccctggtggacctgctgctggtgagcggcgccgccgccgccaccaccgtggcctggtaccaggtgagccccctggccgccagactgctgtacccctacctggcctggctggccttcaccaccaccctgaactactgcgtgtggagagacaaccacggctggagaggcggcagaagactgcccgagtag

SEQ ID NO: 103118 - DNA, 510 bp, Artificial Sequence; identical to SEQ ID NO: 103117
  Description of Artificial Sequence: Synthetic coding sequence

SEQ ID NO: 103119 - DNA, 309 bp, Artificial Sequence
  Description of Artificial Sequence: Synthetic coding sequence
atggccccccacctgctgtggtgccccaccaacggcctgggcctgggcggcagccccgccggccagtggggcggcggcagccactacagaggcctggtgcccggcgagcccgccggcagaccccccgccctgcccctgcccggcctggccggcctgcacgaccacacccagctgctgagaatggccggccagccctggctggcctggggcaccgccgccgccagagtgagcgccagacccaccagagactgcagctgcaccagcagatgccaccacgcctgcgacgtggtggccgtgaccctgagctag

SEQ ID NO: 103120 - DNA, 324 bp, Artificial Sequence
  Description of Artificial Sequence: Synthetic coding sequence
atggcccccccctgggtgcccgccatgggcttcaccctggcccccagcctgggctgcttcgtgggcagcagattcgtgcacggcgagggcctgagatggtacgccggcctgcagaagcccagctggcaccccccccactgggtgctgggccccgtgtggggcaccctgtacagcgccatgggctacggcagctacctggtgtggaaggagctgggcggcttcaccgagaaggccgtggtgcccctgggcctgtacaccggccagctggccctgaactgggcctggccccccatcttcttcggcgccagacagatgggctggtag

SEQ ID NO: 103121 - DNA, 609 bp, Artificial Sequence
  Description of Artificial Sequence: Synthetic coding sequence
atgtgctacggcaagtgcgccagatgcatcggccacagcctggtgggcctggccctgctgtgcatcgccgccaacatcctgctgtacttccccaacggcgagaccaagtacgccagcgagaaccacctgagcagattcgtgtggttcttcagcggcatcgtgggcggcggcctgctgatgctgctgcccgccttcgtgttcatcggcctggagcaggacgactgctgcggctgctgcggccacgagaactgcggcaagagatgcgccatgctgagcagcgtgctggccgccctgatcggcatcgccggcagcggctactgcgtgatcgtggccgccctgggcctggccgagggccccctgtgcctggacagcctgggccagtggaactacaccttcgccagcaccgagggccagtacctgctggacaccagcacctggagcgagtgcaccgagcccaagcacatcgtggagtggaacgtgagcctgttcagcatcctgctggccctgggcggcatcgagttcatcctgtgcctgatccaggtgatcaacggcgtgctgggcggcatctgcggcttctgctgcagccaccagcagcagtacgactgctag

SEQ ID NO: 103122 - DNA, 699 bp, Artificial Sequence
  Description of Artificial Sequence: Synthetic coding sequence
atgtgctacggcaagtgcgccagatgcatcggccacagcctggtgggcctggccctgctgtgcatcgccgccaacatcctgctgtacttccccaacggcgagaccaagtacgccagcgagaaccacctgagcagattcgtgtggttcttcagcggcatcgtgggcggcggcctgctgatgctgctgcccgccttcgtgttcatcggcctggagcaggacgactgctgcggctgctgcggccacgagaactgcggcaagagatgcgccatgctgagcagcgtgctggccgccctgatcggcatcgccggcagcggctactgcgtgatcgtggccgccctgggcctggccgagggccccctgtgcctggacagcctgggccagtggaactacaccttcgccagcaccgagggccagtacctgctggacaccagcacctggagcgagtgcaccgagcccaagcacatcgtggagtggaacgtgagcctgttcagcatcctgctggccctgggcggcatcgagttcatcctgtgcctgatccaggtgatcaacggcgtgctgggcggcatctgcggcttctgctgcagccaccagcagcagatgaccgccaagagaaccaaccccggccagagccacaacctgcccctgttccactgcaacctgtacatcagcctggtgttcatctgcaagaccctgtactag

SEQ ID NO: 103123 - DNA, 609 bp, Artificial Sequence
  Description of Artificial Sequence: Synthetic coding sequence
atgtgcaccggcggctgcgccagatgcctgggcggcaccctgatccccctggccttcttcggcttcctggccaacatcctgctgttcttccccggcggcaaggtgatcgacgacaacgaccacctgagccaggagatctggttcttcggcggcatcctgggcagcggcgtgctgatgatcttccccgccctggtgttcctgggcctgaagaacaacgactgctgcggctgctgcggcaacgagggctgcggcaagagattcgccatgttcaccagcaccatcttcgccgtggtgggcttcctgggcgccggctacagcttcatcatcagcgccatcagcatcaacaagggccccaagtgcctgatggccaacagcacctggggctaccccttccacgacggcgactacctgaacgacgaggccctgtggaacaagtgcagagagcccctgaacgtggtgccctggaacctgaccctgttcagcatcctgctggtggtgggcggcatccagatggtgctgtgcgccatccaggtggtgaacggcctgctgggcaccctgtgcggcgactgccagtgctgcggctgctgcggcggcgacggccccgtgtag

SEQ ID NO: 103124 - DNA, 594 bp, Artificial Sequence
  Description of Artificial Sequence: Synthetic coding sequence
atgtgcaccggcaagtgcgccagatgcgtgggcctgagcctgatcaccctgtgcctggtgtgcatcgtggccaacgccctgctgctggtgcccaacggcgagaccagctggaccaacaccaaccacctgagcctgcaggtgtggctgatgggcggcttcatcggcggcggcctgatggtgctgtgccccggcatcgccgccgtgagagccggcggcaagggctgctgcggcgccggctgctgcggcaacagatgcagaatgctgagaagcgtgttcagcagcgccttcggcgtgctgggcgccatctactgcctgagcgtgagcggcgccggcctgagaaacggccccagatgcctgatgaacggcgagtggggctaccacttcgaggacaccgccggcgcctacctgctgaacagaaccctgtgggacagatgcgaggccccccccagagtggtgccctggaacgtgaccctgttcagcctgctggtggccgccagctgcctggagatcgtgctgtgcggcatccagctggtgaacgccaccatcggcgtgttctgcggcgactgcagaaagaagcaggacaccccccactag

SEQ ID NO: 103125 - DNA, 438 bp, Artificial Sequence
  Description of Artificial Sequence: Synthetic coding sequence
atgagcgccagcgccgccaccggcgtgttcgtgctgagcctgagcgccatccccgtgacctacgtgttcaaccacctggccgcccagcacgacagctggaccatcgtgggcgtggccgccctgatcctgttcctggtggccctgctggccagagtgctggtgaagagaaagccccccagagaccccctgttctacgtgtacgccgtgttcggcttcaccagcgtggtgaacctgatcatcggcctggagcaggacggcatcatcgacggcttcatgacccactacctgagagagggcgagccctacctgaacaccgcctacggccacatgatctgctactgggacggcagcgcccactacctgatgtacctggtgatggtggccgccatcgcctgggagtgctggcacatctgcagcatcctgttcctgaccctgtag

SEQ ID NO: 103126 - DNA, 1113 bp, Artificial Sequence
  Description of Artificial Sequence: Synthetic coding sequence
atgagcgccagcgccgccaccggcgtgttcgtgctgagcctgagcgccatccccgtgacctacgtgttcaaccacctggccgcccagcacgacagctggaccatcgtgggcgtggccgccctgatcctgttcctggtggccctgctggccagagtgctggtgaagagaaagccccccagagaccccctgttctacgtgtacgccgtgttcggcttcaccagcgtggtgaacctgatcatcggcctggagcaggacggcatcatcgacggcttcatgacccactacctgagagagggcgagccctacctgaacaccgcctacggccacatgatctgctactgggacggcagcgcccactacctgatgtacctggtgatggtggccgccatcgcctgggaggagacctacagaaccatcggcctgtactgggtgggcagcatcatcatgagcgtggtggtgttcgtgcccggcaacatcgtgggcaagtacggcaccagaatctgccccgccttcttcctgagcatcccctacacctgcctgcccgtgtgggccggcttcagaatctacaaccagcccagcgagaactacaactaccccagcaaggtgatccaggaggcccaggccaaggacctgctgagaagacccttcgacctgatgctggtggtgtgcctgctgctggccaccggcttctgcctgttcagaggcctgatcgccctggactgccccagcgagctgtgcagactgtacacccagttccaggagccctacctgaaggaccccgccgcctaccccaagatccagatgctggcctacatgttctacagcgtgccctacttcgtgaccgccctgtacggcctggtggtgcccggctgcagctggatgcccgacatcaccctgatccacgccggcggcctggcccaggcccagttcagccacatcggcgccagcctgcacgccagaaccgcctacgtgtacagagtgcccgaggaggccaagatcctgttcctggccctgaacatcgcctacggcgtgctgccccagctgctggcctacagatgcatctacaagcccgagttcttcatcaagaccaaggccgaggagaaggtggagtag

SEQ ID NO: 103127 - DNA, 1020 bp, Artificial Sequence
  Description of Artificial Sequence: Synthetic coding sequence
atgagcgccagcgccgccaccggcgtgttcgtgctgagcctgagcgccatccccgtgacctacgtgttcaaccacctggccgcccagcacgacagctggaccatcgtgggcgtggccgccctgatcctgttcctggtggccctgctggccagagtgctggtgaagagaaagccccccagagaccccctgttctacgtgtacgccgtgttcggcttcaccagcgtggtgaacctgatcatcggcctggagcaggacggcatcatcgacggcttcatgacccactacctgagagagggcgagccctacctgaacaccgcctacggccacatgatctgctactgggacggcagcgcccactacctgatgtacctggtgatggtggccgccatcgcctgggaggagacctacagaaccatcggcctgtactgggtgggcagcatcatcatgagcgtggtggtgttcgtgcccggcaacatcgtgggcaagtacggcaccagaatctgccccgccttcttcctgagcatcccctacacctgcctgcccgtgtgggccggcttcagaatctacaaccagcccagcgagaactacaactaccccagcaaggtgatccaggaggcccaggccaaggacctgctgagaagacccttcgacctgatgctggtggtgtgcctgctgctggccaccggcttctgcctgttcagaggcctgatgctggcctacatgttctacagcgtgccctacttcgtgaccgccctgtacggcctggtggtgcccggctgcagctggatgcccgacatcaccctgatccacgccggcggcctggcccaggcccagttcagccacatcggcgccagcctgcacgccagaaccgcctacgtgtacagagtgcccgaggaggccaagatcctgttcctggccctgaacatcgcctacggcgtgctgccccagctgctggcctacagatgcatctacaagcccgagttcttcatcaagaccaaggccgaggagaaggtggagtag

SEQ ID NO: 103128 - DNA, 1122 bp, Artificial Sequence
  Description of Artificial Sequence: Synthetic coding sequence
atgagcgccagcgccgccaccggcgtgttcgtgctgagcctgagcgccatccccgtgacctacgtgttcaaccacctggccgcccagcacgacagctggaccatcgtgggcgtggccgccctgatcctgttcctggtggccctgctggccagagtgctggtgaagagaaagccccccagagaccccctgttctacgtgtacgccgtgttcggcttcaccagcgtggtgaacctgatcatcggcctggagcaggacggcatcatcgacggcttcatgacccactacctgagagagggcgagccctacctgaacaccgcctacggccacatgatctgctactgggacggcagcgcccactacctgatgtacctggtgatggtggccgccatcgcctgggactgctacagagagacctacagaaccatcggcctgtactgggtgggcagcatcatcatgagcgtggtggtgttcgtgcccggcaacatcatcggcaagtacggcaccagaatctgccccgccttcttcctgagcatcccctacacctgcctgcccgtgtgggccggcttcagaatctacaaccagcccagcgagaactacaactaccccagcaaggtgatccaggaggcccaggccaaggacctgctgagaagacccttcgacctgatgctggtggtgtgcctgctgctggccaccggcttctgcctgttcagaggcctgatcgccctggactgccccagcgagctgtgcagactgtacacccagttccaggagccctacctgaaggaccccgccgcctaccccaagatccagatgctggcctacatgttctacagcgtgccctacttcgtgaccgccctgtacggcctggtggtgcccggctgcagctggatgcccgacatcaccctgatccacgccggcggcctggcccaggcccagttcagccacatcggcgccagcctgcacgccagaaccgcctacgtgtacagagtgcccgaggaggccaagatcctgttcctggccctgaacatcgcctacggcgtgctgccccagctgctggcctacagatgcatctacaagcccgagttcttcatcaagaccaaggccgaggagaaggtggagtag

SEQ ID NO: 103129 - DNA, 567 bp, Artificial Sequence
  Description of Artificial Sequence: Synthetic coding sequence
atgagcgccagcgccgccaccggcgtgttcgtgctgagcctgagcgccatccccgtgacctacgtgttcaaccacctggccgcccagcacgacagctggaccatcgtgggcgtggccgccctgatcctgttcctggtggccctgctggccagagtgctggtgaagagaaagccccccagagaccccctgttctacgtgtacgccgtgttcggcttcaccagcgtggtgaacctgatcatcggcctggagcaggacggcatcatcgacggcttcatgacccactacctgagagagggcgagccctacctgaacaccgcctacggccacatgatctgctactgggacggcagcgcccactacctgatgtacctggtgatggtggccgccatcgcctgggaggagacctacagaaccatcggcctgtactgggtgggcagcatcatcatgagcgtggtggtgttcgtgcccggcaacatcgtggacgccggcatctacgtgctgttctgcagcctgctgtgcgactgcaccgtgtggctgagcggcagctggatgttcctggacgcctag

SEQ ID NO: 103130 - DNA, 1020 bp, Artificial Sequence; identical to SEQ ID NO: 103127
  Description of Artificial Sequence: Synthetic coding sequence

SEQ ID NO: 103131 - DNA, 1056 bp, Artificial Sequence
  Description of Artificial Sequence: Synthetic coding sequence
atggacatcccccccctggccggcaagatcgccgccctgagcctgagcgccctgcccgtgagctacgccctgaaccacgtgagcgccctgagccaccccctgtgggtggccctgatgagcgccctgatcctgggcctgctgttcgtggccgtgtacagcctgagccacggcgaggtgagctacgaccccctgtacgccgtgttcgccgtgttcgccttcaccagcgtggtggacctgatcatcgccctgcaggaggacagctacgtggtgggcttcatggagttctacaccaaggagggcgagccctacctgagaaccgcccacggcgtgttcatctgctactgggacggcaccgtgcactacctgctgtacctggccatggccggcgccatctgcagaagaaagagatacagaaacttcggcctgtactggctgggcagcttcgccatgagcatcctggtgttcctgaccggcaacatcctgggcaagtacagcagcgagatcagacccgccttcttcctgaccatcccctacctgctggtgccctgctgggccggcatgaaggtgttcagccagcccagagccctgaccagatgcaccgccaacatggtgcaggaggagcagagaaagggcctgctgcagagacccgccgacctggccctggtgatctacctgatcctggccggcttcttcaccctgttcagaggcctggtggtgctggactgccccaccgacgcctgcttcgtgtacatctaccagtacgagccctacctgagagaccccgtggcctaccccaaggtgcagatgctgatgtacatgttctacgtgctgcccttctgcggcctggccgcctacgccctgaccttccccggctgcagctggctgcccgactgggccctggtgttcgccggcggcatcggccaggcccagttcagccacatgggcgccagcatgcacctgagaacccccttcacctacagatgcctgcagtggcccgccttcttccaccagcccccccccagcgaccccctggccctgcacaagaagcagcactag

SEQ ID NO: 103132 - DNA, 1134 bp, Artificial Sequence
  Description of Artificial Sequence: Synthetic coding sequence
atggacatcccccccctggccggcaagatcgccgccctgagcctgagcgccctgcccgtgagctacgccctgaaccacgtgagcgccctgagccaccccctgtgggtggccctgatgagcgccctgatcctgggcctgctgttcgtggccgtgtacagcctgagccacggcgaggtgagctacgaccccctgtacgccgtgttcgccgtgttcgccttcaccagcgtggtggacctgatcatcgccctgcaggaggacagctacgtggtgggcttcatggagttctacaccaaggagggcgagccctacctgagaaccgcccacggcgtgttcatctgctactgggacggcaccgtgcactacctgctgtacctggccatggccggcgccatctgcagaagaaagagatacagaaacttcggcctgtactggctgggcagcttcgccatgagcatcctggtgttcctgaccggcaacatcctgggcaagtacagcagcgagatcagacccgccttcttcctgaccatcccctacctgctggtgccctgctgggccggcatgaaggtgttcagccagcccagagccctgaccagatgcaccgccaacatggtgcaggaggagcagagaaagggcctgctgcagagacccgccgacctggccctggtgatctacctgatcctggccggcttcttcaccctgttcagaggcctggtggtgctggactgccccaccgacgcctgcttcgtgtacatctaccagtacgagccctacctgagagaccccgtggcctaccccaaggtgcagatgctgatgtacatgttctacgtgctgcccttctgcggcctggccgcctacgccctgaccttccccggctgcagctggctgcccgactgggccctggtgttcgccggcggcatcggccaggcccagttcagccacatgggcgccagcatgcacctgagaacccccttcacctacagagtgcccgaggacacctggggctgcttcttcgtgtgcaacctgctgtacgccctgggcccccacctgctggcctacagatgcctgcagtggcccgccttcttccaccagcccccccccagcgaccccctggccctgcacaagaagcagcactag

SEQ ID NO: 103133 - DNA, 642 bp, Artificial Sequence
  Description of Artificial Sequence: Synthetic coding sequence
atggacatcccccccctggccggcaagatcgccgccctgagcctgagcgccctgcccgtgagctacgccctgaaccacgtgagcgccctgagccaccccctgtgggtggccctgatgagcgccctgatcctgggcctgctgttcgtggccgtgtacagcctgagccacggcgaggtgagctacgaccccctgtacgccgtgttcgccgtgttcgccttcaccagcgtggtggacctgatcatcgccctgcaggaggacagctacgtggtgggcttcatggagttctacaccaaggaggtgctgggcggcagacccggcagccccctgccccactgccccagcgagagccccacctgcccccacagagagagccacacctgcgcccagagaaccgagagcagcagcgccaccggcatggccctgttcaccaccagcagcacctggccctggcccgcccccagcgccgagggcgccggcggcagagagagagtggcccccgaccccggcagagaggtggccagcagcgacggcgtgcccggccagggcggcgccagaagcgtgtgcagaagaaaccaggacgccagcctgggcctgcagcccggcgtggccagaagaagattccagggcaccagccaggtgtag

SEQ ID NO: 103134 - DNA, 1257 bp, Artificial Sequence
  Description of Artificial Sequence: Synthetic coding sequence
atggcccccacccagggccccagagcccccctggagttcggcggccccctgggcgccgccgccctgctgctgctgctgcccgccaccatgttccacctgctgctggccgccagaagcggccccgccagactgctgggcccccccgccagcctgcccggcctggaggtgctgtggagccccagagccctgctgctgtggctggcctggctgggcctgcaggccgccctgtacctgctgcccgccagaaaggtggccgagggccaggagctgaaggacaagagcagactgagataccccatcaacggcttccaggccctggtgctgaccgccctgctggtgggcctgggcatgagcgccggcctgcccctgggcgccctgcccgagatgctgctgcccctggccttcgtggccaccctgaccgccttcatcttcagcctgttcctgtacatgaaggcccaggtggcccccgtgagcgccctggcccccggcggcaacagcggcaaccccatctacgacttcttcctgggcagagagctgaaccccagaatctgcttcttcgacttcaagtacttctgcgagctgagacccggcctgatcggctgggtgctgatcaacctggccctgctgatgaaggaggccgagctgagaggcagccccagcctggccatgtggctggtgaacggcttccagctgctgtacgtgggcgacgccctgtggcacgaggaggccgtgctgaccaccatggacatcacccacgacggcttcggcttcatgctggccttcggcgacatggcctgggtgcccttcacctacagcctgcaggcccagttcctgctgcaccacccccagcccctgggcctgcccatggccagcgtgatctgcctgatcaacgccaccggctactacatcttcagaggcgccaacagccagaagaacaccttcagaaagaaccccagcgaccccagagtggccggcctggagaccatcagcaccgccaccggcagaaagctgctggtgagcggctggtggggcatggtgagacaccccaactacctgggcgacctgatcatggccctggcctggagcctgccctgcggcgtgagccacctgctgccctacttctacctgctgtacttcaccgccctgctggtgcacagagaggccagagacgagagacagtgcctgcagaagtacggcctggcctggcaggagtactgcagaagagtgccctacagaatcatgccctacatctactag

SEQ ID NO: 103135 - DNA, 1176 bp, Artificial Sequence
  Description of Artificial Sequence: Synthetic coding sequence
atggcccccacccagggccccagagcccccctggagttcggcggccccctgggcgccgccgccctgctgctgctgctgcccgccaccatgttccacctgctgctggccgccagaagcggccccgccagactgctgggcccccccgccagcctgcccggcctggaggtgctgtggagccccagagccctgctgctgtggctggcctggctgggcctgcaggccgccctgtacctgctgcccgccagaaaggtggccgagggccaggagctgaaggacaagagcagactgagataccccatcaacggcttccaggccctggtgctgaccgccctgctggtgggcctgggcatgagcgccggcctgcccctgggcgccctgcccgagatgctgctgcccctggccttcgtggccaccctgaccgccttcatcttcagcctgttcctgtacatgaaggcccaggtggcccccgtgagcgccctggcccccggcggcaacagcggcaaccccatctacgacttcttcctgggcagagagctgaaccccagaatctgcttcttcgacttcaagtacttctgcgagctgagacccggcctgatcggctgggtgctgatcaacctggccctgctgatgaaggaggccgagctgagaggcagccccagcctggccatgtggctggtgaacggcttccagctgctgtacgtgggcgacgccctgtggcacgaggaggccgtgctgaccaccatggacatcacccacgacggcttcggcttcatgctggccttcggcgacatggcctgggtgcccttcacctacagcctgcaggcccagttcctgctgcaccacccccagcccctgggcctgcccatggccagcgtgatctgcctgatcaacggcctggagaccatcagcaccgccaccggcagaaagctgctggtgagcggctggtggggcatggtgagacaccccaactacctgggcgacctgatcatggccctggcctggagcctgccctgcggcgtgagccacctgctgccctacttctacctgctgtacttcaccgccctgctggtgcacagagaggccagagacgagagacagtgcctgcagaagtacggcctggcctggcaggagtactgcagaagagtgccctacagaatcatgccctacatctactag

SEQ ID NO: 103136 - DNA, 909 bp, Artificial Sequence
  Description of Artificial Sequence: Synthetic coding sequence
atgagcgccggcctgcccctgggcgccctgcccgagatgctgctgcccctggccttcgtggccaccctgaccgccttcatcttcagcctgttcctgtacatgaaggcccaggtggcccccgtgagcgccctggcccccggcggcaacagcggcaaccccatctacgacttcttcctgggcagagagctgaaccccagaatctgcttcttcgacttcaagtacttctgcgagctgagacccggcctgatcggctgggtgctgatcaacctggccctgctgatgaaggaggccgagctgagaggcagccccagcctggccatgtggctggtgaacggcttccagctgctgtacgtgggcgacgccctgtggcacgaggaggccgtgctgaccaccatggacatcacccacgacggcttcggcttcatgctggccttcggcgacatggcctgggtgcccttcacctacagcctgcaggcccagttcctgctgcaccacccccagcccctgggcctgcccatggccagcgtgatctgcctgatcaacgccaccggctactacatcttcagaggcgccaacagccagaagaacaccttcagaaagaaccccagcgaccccagagtggccggcctggagaccatcagcaccgccaccggcagaaagctgctggtgagcggctggtggggcatggtgagacaccccaactacctgggcgacctgatcatggccctggcctggagcctgccctgcggcgtgagccacctgctgccctacttctacctgctgtacttcaccgccctgctggtgcacagagaggccagagacgagagacagtgcctgcagaagtacggcctggcctggcaggagtactgcagaagagtgccctacagaatcatgccctacatctactag

SEQ ID NO: 103137 - DNA, 1713 bp, Artificial Sequence
  Description of Artificial Sequence: Synthetic coding sequence
atgggcttcctgcagctgctggtggtggccgtgctggccagcgagcacagagtggccggcgccgccgaggtgttcggcaacagcagcgagggcctgatcgagttcagcgtgggcaagttcagatacttcgagctgaacagacccttccccgaggaggccatcctgcacgacatcagcagcaacgtgaccttcctgatcttccagatccacagccagtaccagaacaccaccgtgagcttcagccccaccctgctgagcaacagcagcgagaccggcaccgccagcggcctggtgttcatcctgagacccgagcagagcacctgcacctggtacctgggcaccagcggcatccagcccgtgcagaacatggccatcctgctgagctacagcgagagagaccccgtgcccggcggctgcaacctggagttcgacctggacatcgaccccaacatctacctggagtacaacttcttcgagaccaccatcaagttcgcccccgccaacctgggctacgccagaggcgtggacccccccccctgcgacgccggcaccgaccaggacagcagatggagactgcagtacgacgtgtaccagtacttcctgcccgagaacgacctgaccgaggagatgctgctgaagcacctgcagagaatggtgagcgtgccccaggtgaaggccagcgccctgaaggtggtgaccctgaccgccaacgacaagaccagcgtgagcttcagcagcctgcccggccagggcgtgatctacaacgtgatcgtgtgggaccccttcctgaacaccagcgccgcctacatccccgcccacacctacgcctgcagcttcgaggccggcgagggcagctgcgccagcctgggcagagtgagcagcaaggtgttcttcaccctgttcgccctgctgggcttcttcatctgcttcttcggccacagattctggaagaccgagctgttcttcatcggcttcatcatcatgggcttcttcttctacatcctgatcaccagactgacccccatcaagtacgacgtgaacctgatcctgaccgccgtgaccggcagcgtgggcggcatgttcctggtggccgtgtggtggagattcggcatcctgagcatctgcatgctgtgcgtgggcctggtgctgggcttcctgatcagcagcgtgaccttcttcacccccctgggcaacctgaagatcttccacgacgacggcgtgttctgggtgaccttcagctgcatcgccatcctgatccccgtggtgttcatgggctgcctgagaatcctgaacatcctgacctgcggcgtgatcggcagctacagcgtggtgctggccatcgacagctactggagcaccagcctgagctacatcaccctgaacgtgctgaagagagccctgaacaaggacttccacagagccttcaccaacgtgcccttccagaccaacgacttcatcatcctggccgtgtggggcatgctggccgtgagcggcatcaccctgcagatcagaagagagagaggcagacccttcttccccccccacccctacaagctgtggaagcaggagagagagagaagagtgaccaacatcctggaccccagctaccacatcccccccctgagagagagactgtacggcagactgacccagatcaagggcctgttccagaaggagcagcccgccggcgagagaacccccctgctgctgtag

SEQ ID NO: 103138 - DNA, 351 bp, Artificial Sequence
  Description of Artificial Sequence: Synthetic coding sequence
atgggcttcctgcagctgctggtggtggccgtgctggccagcgagcacagagtggccggcgccgccgaggtgttcggcaacagcagcgaggtgtacctggtggtgggcctgatcgagttcagcgtgggcaagttcagatacttcgagctgaacagacccttccccgaggaggccatcctgcacgacatcagcagcaacgtgaccttcctgatcttccagatccacagccagtaccagaacaccaccgtgagcttcagccccaccctgctgagcaacagcagcgagaccggcaccgccagcggcctggtgttcatcctgagacccgagcagagcacctgcacctggtactag

SEQ ID NO: 103139 - DNA, 1413 bp, Artificial Sequence
  Description of Artificial Sequence: Synthetic coding sequence
atgggcatctggaccagcggcaccgacatcttcctgagcctgtgggagatctacgtgagccccagaagccccggctggatggacttcatccagcacctgggcgtgtgctgcctggtggccctgatcagcgtgggcctgctgagcgtggccgcctgctggttcctgcccagcatcatcgccgccgccgccagctggatcatcacctgcgtgctgctgtgctgcagcaagcacgccagatgcttcatcctgctggtgttcctgagctgcggcctgagagagggcagaaacgccctgatcgccgccggcaccggcatcgtgatcctgggccacgtggagaacatcttccacaacttcaagggcctgctggacggcatgacctgcaacctgagagccaagagcttcagcatccacttccccctgctgaagaagtacatcgaggccatccagtggatctacggcctggccacccccctgagcgtgttcgacgacctggtgagctggaaccagaccctggccgtgagcctgttcagccccagccacgtgctggaggcccagctgaacgacagcaagggcgaggtgctgagcgtgctgtaccagatggccaccaccaccgaggtgctgagcagcctgggccagaagctgctggccttcgccggcctgagcctggtgctgctgggcaccggcctgttcatgaagagattcctgggcccctgcggctggaagtacgagaacatctacatcaccagacagttcgtgcagttcgacgagagagagagacaccagcagagaccctgcgtgctgcccctgaacaaggaggagagaagaaagtacgtgatcatccccaccttctggcccacccccaaggagagaaagaacctgggcctgttcttcctgcccatcctgatccacctgtgcatctgggtgctgttcgccgccgtggactacctgctgtacagactgatcttcagcgtgagcaagcagttccagagcctgcccggcttcgaggtgcacctgaagctgcacggcgagaagcagggcacccaggacatcatccacgacagcagcttcaacatcagcgtgttcgagcccaactgcatccccaagcccaagttcctgctgagcgagacctgggtgcccctgagcgtgatcctgctgatcctggtgatgctgggcctgctgagcagcatcctgatgcagctgaagatcctggtgagcgccagcttctaccccagcgtggagagaaagagaatccagtacctgcacgccaagctgctgaagaagagaagcaagcagcccctgggcgaggtgaagagaagactgagcctgtacctgaccaagatccacttctggctgcccgtgctgaagatgatcagaaagaagcagatggacatggccagcgccgacaagagctag

SEQ ID NO: 103140 - DNA, 567 bp, Artificial Sequence
  Description of Artificial Sequence: Synthetic coding sequence
atgagcaccatgttcgccgacaccctgctgatcgtgttcatcagcgtgtgcaccgccctgctggccgagggcatcacctgggtgctggtgtacagaaccgacaagtacaagagactgaaggccgaggtggagaagcagagcaagaagctggagaagaagaaggagaccatcaccgagagcgccggcagacagcagaagaagaagatcgagagacaggaggagaagctgaagaacaacaacagagacctgagcatggtgagaatgaagagcatgttcgccatcggcttctgcttcaccgccctgatgggcatgttcaacagcatcttcgacggcagagtggtggccaagctgcccttcacccccctgagctacatccagggcctgagccacagaaacctgctgggcgacgacaccaccgactgcagcttcatcttcctgtacatcctgtgcaccatgagcatcagacagaacatccagaagatcctgggcctggcccccagcagagccgccaccaagcaggccggcggcttcctgggcccccccccccccagcggcaagttcagctag

SEQ ID NO: 103141 - DNA, 510 bp, Artificial Sequence
  Description of Artificial Sequence: Synthetic coding sequence
atgagcaccatgttcgccgacaccctgctgatcgtgttcatcagcgtgtgcaccgccctgctggccgagggcatcacctgggtgctggtgtacagaaccgacaagtacaagagactgaaggccgaggtggagaagcagagcaagaagctggagaagaagaaggagaccatcaccgagagcgccggcagacagcagaaggtgagaatgaagagcatgttcgccatcggcttctgcttcaccgccctgatgggcatgttcaacagcatcttcgacggcagagtggtggccaagctgcccttcacccccctgagctacatccagggcctgagccacagaaacctgctgggcgacgacaccaccgactgcagcttcatcttcctgtacatcctgtgcaccatgagcatcagacagaacatccagaagatcctgggcctggcccccagcagagccgccaccaagcaggccggcggcttcctgggcccccccccccccagcggcaagttcagctag

SEQ ID NO: 103142 - DNA, 603 bp, Artificial Sequence
  Description of Artificial Sequence: Synthetic coding sequence
atgatgcactacgtggactacagcatgatgtaccacctgatcagaggccagagcgtgatcaagctgtacatcatctacaacatgctggaggtggccgacagactgttcagcagcttcggccaggacatcctggacgccctgtactggaccgccaccgagcccaaggagagaaagagagcccacatcggcttcgtggagatcaagggcagcgtgttcaagaagttcgagaagaacaacctgttccagatgagcaacagcgacatcaaggagagattcaccaactacgtgctgctgctgatcgtgtgcctgagaaacatggagcagttcagctggaaccccgaccacctgtgggtgctgttccccgacgtgtgcatggtgatcgccagcgagatcgccgtggacatcgtgaagcacgccttcatcaccaagttcaacgacatcaccgccgacgtgtacagcgagtacagagccagcctggccttcgacctggtgagcagcagacagaagaacgcctacaccgactacagcgacagcgtggccagaagaatgggcttcatccccctgcccctggccgtgctggtggacatccccgagagcacctag

SEQ ID NO: 103143 - DNA, 1371 bp, Artificial Sequence
  Description of Artificial Sequence: Synthetic coding sequence
atggtgttcggcatcttcctgtgcctggacgccttcctgtacgtgttcaccctgctgcccctgagagtgttcctggccctgttcagactgctgaccctgccctgctacggcctgagagacagaagactgctgcagcccgcccaggtgtgcgacatcctgaagggcgtgatcctggtgatctgctacttcatgatgcactacgtggactacagcatgatgtaccacctgatcagaggccagagcgtgatcaagctgtacatcatctacaacatgctggaggtggccgacagactgttcagcagcttcggccaggacatcctggacgccctgtactggaccgccaccgagcccaaggagagaaagagagcccacatcggcgtgatcccccacttcttcatggccgtgctgtacgtgttcctgcacgccatcctgatcatggtgcaggccaccaccctgaacgtggccttcaacagccacaacaagagcctgctgaccatcatgatgagcaacaacttcgtggagatcaagggcagcgtgttcaagaagttcgagaagaacaacctgttccagatgagcaacagcgacatcaaggagagattcaccaactacgtgctgctgctgatcgtgtgcctgagaaacatggagcagttcagctggaaccccgaccacctgtgggtgctgttccccgacgtgtgcatggtgatcgccagcgagatcgccgtggacatcgtgaagcacgccttcatcaccaagttcaacgacatcaccgccgacgtgtacagcgagtacagagccagcctggccttcgacctggtgagcagcagacagaagaacgcctacaccgactacagcgacagcgtggccagaagaatgggcttcatccccctgcccctggccgtgctgctgatcagagtggtgaccagcagcatcaaggtgcagggcatcctgagctacgcctgcgtgatcctgttctacttcggcctgatcagcctgaaggtgctgaacagcatcgtgctgctgggcaagagctgccagtacgtgaaggaggccaagatggaggagaagctgagcaacccccccgccacctgcacccccggcaagcccagcagcaagagccagaacaagtgcaagcccagccagggcctgagcaccgaggagaacctgagcgccagcatcaccaagcagcccatccaccagaaggagaacatcatccccctgctggtgaccagcaacagcgaccagttcctgaccacccccgacggcgacgagaaggacatcacccaggacaacagcgagctgaagcacagaagcagcaagaaggacctgctggagatcgacagattcaccatctgcggcaacagaatcgactag

SEQ ID NO: 103144 - DNA, 1704 bp, Artificial Sequence
  Description of Artificial Sequence: Synthetic coding sequence
atggccggcgtgggcgacgccgccgcccccggcgagggcggcggcggcggcgtggacggcccccagagagacggcagaggcgaggccgagcagcccggcggcagcggcggccagggccccccccccgccccccagctgaccgagaccctgggcttctacgagagcgacagaagaagagagagaagaagaggcagaaccgagctgagcctgctgagattcctgagcgccgagctgaccagaggctacttcctggagcacaacgaggccaagtacaccgagagaagagagagagtgtacacctgcctgagaatccccagagagctggagaagctgatggtgttcggcatcttcctgtgcctggacgccttcctgtacgtgttcaccctgctgcccctgagagtgttcctggccctgttcagactgctgaccctgccctgctacggcctgagagacagaagactgctgcagcccgcccaggtgtgcgacatcctgaagggcgtgatcctggtgatctgctacttcatgatgcactacgtggactacagcatgatgtaccacctgatcagaggccagagcgtgatcaagctgtacatcatctacaacatgctggaggtggccgacagactgttcagcagcttcggccaggacatcctggacgccctgtactggaccgccaccgagcccaaggagagaaagagagcccacatcggcgtgatcccccacttcttcatggccgtgctgtacgtgttcctgcacgccatcctgatcatggtgcaggccaccaccctgaacgtggccttcaacagccacaacaagagcctgctgaccatcatgatgagcaacaacttcgtggagatcaagggcagcgtgttcaagaagttcgagaagaacaacctgttccagatgagcaacagcgacatcaaggagagattcaccaactacgtgctgctgctgatcgtgtgcctgagaaacatggagcagttcagctggaaccccgaccacctgtgggtgctgttccccgacgtgtgcatggtgatcgccagcgagatcgccgtggacatcgtgaagcacgccttcatcaccaagttcaacgacatcaccgccgacgtgtacagcgagtacagagccagcctggccttcgacctggtgagcagcagacagaagaacgcctacaccgactacagcgacagcgtggccagaagaatgggcttcatccccctgcccctggccgtgctgctgatcagagtggtgaccagcagcatcaaggtgcagggcatcctgagctacgcctgcgtgatcctgttctacttcggcctgatcagcctgaaggtgctgaacagcatcgtgctgctgggcaagagctgccagtacgtgaaggaggccaagatggaggagaagctgagcaacccccccgccacctgcacccccggcaagcccagcagcaagagccagaacaagtgcaagcccagccagggcctgagcaccgaggagaacctgagcgccagcatcaccaagcagcccatccaccagaaggagaacatcatccccctgctggtgaccagcaacagcgaccagttcctgaccacccccgacggcgacgagaaggacatcacccaggacaacagcgagctgaagcacagaagcagcaagaaggacctgctggagatcgacagattcaccatctgcggcaacagaatcgactag

SEQ ID NO: 103145 - DNA, 1689 bp, Artificial Sequence
  Description of Artificial Sequence: Synthetic coding sequence
atggccggcgtgggcgacgccgccgcccccggcgagggcggcggcggcggcgtggacggcccccagagagacggcagaggcgaggccgagcagcccggcggcagcggcggccagggccccccccccgccccccagctgaccgagaccctgggcttctacgagagcgacagaagaagagagagaagaagaggcagaaccgagctgagcctgctgagattcctgagcgccgagctgaccagaggctacttcctggagcacaacgaggccaagtacaccgagagaagagagagagtgtacacctgcctgagaatccccagagagctggagaagctgatggtgttcggcatcttcctgtgcctggacgccttcctgtacgtgttcaccctgctgcccctgagagtgttcctggccctgttcagactgctgaccctgccctgctacggcctgagagacagaagactgctgcagcccgcccaggtgtgcgacatcctgaagggcgtgatcctggtgatctgctacttcatgatgcactacgtggactacagcatgatgtaccacctgatcagaggccagagcgtgatcaagctgtacatcatctacaacatgctggaggtggccgacagactgttcagcagcttcggccaggacatcctggacgccctgtactggaccgccaccgagcccaaggagagaaagagagcccacatcggcgtgatcccccacttcttcatggccgtgctgtacgtgttcctgcacgccatcctgatcatggtgcaggccaccaccctgaacgtggccttcaacagccacaacaagagcctgctgaccatcatgatgagcaacaacttcgtggagatcaagggcagcgtgttcaagaagttcgagaagaacaacctgttccagatgagcaacagcgacatcaaggagagattcaccaactacgtgctgctgctgatcgtgtgcctgagaaacatggagcagttcagctggaaccccgaccacctgtgggtgctgttccccgacgtgtgcatggtgatcgccagcgagatcgccgtggacatcgtgaagcacgccttcatcaccaagttcaacgacatcaccgccgacgtgtacagcgagtacagagccagcctggccttcgacctggtgagcagcagacagaagaacgcctacaccgactacagcgacagcgtggccagaagaatgggcttcatccccctgcccctggccgtgctgctgatcagagtggtgaccagcagcatcaaggtgcagggcatcctgagctacgcctgcgtgatcctgttctacttcggcctgatcagcctgaaggtgctgaacagcatcgtgctgctgggcaagagctgccagtacgtgaaggaggccaagatggaggagaagctgagcaacccccccgccacctgcacccccggcaagcccagcagcaagagccagaacaagtgcaagcccagccagggcctgagcaccgaggagaacctgagcgccagcatcaccaagcagcccatccaccagaaggagaacatcatccccctgctggtgaccagcaacagcgaccagttcctgaccacccccgacggcgacgagaaggacatcacccaggacaacagcgagctgaagcacagaagcagcaagagcgtgctgctgtgccagagcggcctgcccgagtgctag

SEQ ID NO: 103146 - DNA, 2283 bp, Artificial Sequence
  Description of Artificial Sequence: Synthetic coding sequence
atgagccccaagaaggtgcagatcaaggtggaggagaaggaggacgagaccgaggagagcagcagcgaggaggaggaggaggtggaggacaagctgcccagaagagagagcctgagacccaagagaaagagaaccagagacgtgatcaacgaggacgaccccgagcccgagcccgaggacgaggagaccagaaaggccagagagaaggagagaagaagaagactgaagagaggcgccgaggaggaggagatcgacgaggaggagctggagagactgaaggccgagctggacgagaagagacagatcatcgccaccgtgaagtgcaagccctggaagatggagaagaagatcgaggtgctgaaggaggccaagaagttcgtgagcgagaacgagggcgccctgggcaagggcaagggcaagagatggttcgccttcaagatgatgatggccaagaagtgggccaagttcctgagagacttcgagaacttcaaggccgcctgcgtgccctgggagaacaagatcaaggccatcgagagccagttcggcagcagcgtggccagctacttcctgttcctgagatggatgtacggcgtgaacatggtgctgttcatcctgaccttcagcctgatcatgctgcccgagtacctgtggggcctgccctacggcagcctgcccagaaagaccgtgcccagagccgaggaggccagcgccgccaacttcggcgtgctgtacgacttcaacggcctggcccagtacagcgtgctgttctacggctactacgacaacaagagaaccatcggctggatgaacttcagactgcccctgagctacttcctggtgggcatcatgtgcatcggctacagcttcctggtggtgctgaaggccatgaccaagaacatcggcgacgacggcggcggcgacgacaacaccttcaacttcagctggaaggtgttcaccagctgggactacctgatcggcaaccccgagaccgccgacaacaagttcaacagcatcaccatgaacttcaaggaggccatcaccgaggagaaggccgcccaggtggaggagaacgtgcacctgatcagattcctgagattcctggccaacttcttcgtgttcctgaccctgggcggcagcggctacctgatcttctgggccgtgaagagaagccaggagttcgcccagcaggaccccgacaccctgggctggtgggagaagaacgagatgaacatggtgatgagcctgctgggcatgttctgccccaccctgttcgacctgttcgccgagctggaggactaccaccccctgatcgccctgaagtggctgctgggcagaatcttcgccctgctgctgggcaacctgtacgtgttcatcctggccctgatggacgagatcaacaacaagatcgaggaggagaagctggtgaaggccaacatcaccctgtgggaggccaacatgatcaaggcctacaacgccagcttcagcgagaacagcaccggcccccccttcttcgtgcaccccgccgacgtgcccagaggcccctgctgggagaccatggtgggccaggagttcgtgagactgaccgtgagcgacgtgctgaccacctacgtgaccatcctgatcggcgacttcctgagagcctgcttcgtgagattctgcaactactgctggtgctgggacctggagtacggctaccccagctacaccgagttcgacatcagcggcaacgtgctggccctgatcttcaaccagggcatgatctggatgggcagcttcttcgcccccagcctgcccggcatcaacatcctgagactgcacaccagcatgtacttccagtgctgggccgtgatgtgctgcaacgtgcccgaggccagagtgttcaaggccagcagaagcaacaacttctacctgggcatgctgctgctgatcctgttcctgagcaccatgcccgtgctgtacatgatcgtgagcctgccccccagcttcgactgcggccccttcagcggcaagaacagaatgttcgaggtgatcggcgagaccctggagcacgacttccccagctggatggccaagatcctgagacagctgagcaaccccggcctggtgatcgccgtgatcctggtgatggtgctggccatctactacctgaacgccaccgccaagggccagaaggccgccaacctggacctgaagaagaagatgaagatgcaggccctggagaacaagatgagaaacaagaagatggccgccgccagagccgccgccgccgccggcagacagtag

SEQ ID NO: 103147 - DNA, 2283 bp, Artificial Sequence; identical to SEQ ID NO: 103146
  Description of Artificial Sequence: Synthetic coding sequence

SEQ ID NO: 103148 - DNA, 2223 bp, Artificial Sequence
  Description of Artificial Sequence: Synthetic coding sequence
gtggagtggagcggcgagtgcctgagaagctgcagaagagaggtgcagatcaaggtggaggagaaggaggacgagaccgaggagagcagcagcgaggaggaggaggaggtggaggacaagctgcccagaagagagagcctgagacccaagagaaagagaaccagagacgtgatcaacgaggacgaccccgagcccgagcccgaggacgaggagaccagaaaggccagagagaaggagagaagaagaagactgaagagaggcgccgaggccaagaagttcgtgagcgagaacgagggcgccctgggcaagggcaagggcaagagatggttcgccttcaagatgatgatggccaagaagtgggccaagttcctgagagacttcgagaacttcaaggccgcctgcgtgccctgggagaacaagatcaaggccatcgagagccagttcggcagcagcgtggccagctacttcctgttcctgagatggatgtacggcgtgaacatggtgctgttcatcctgaccttcagcctgatcatgctgcccgagtacctgtggggcctgccctacggcagcctgcccagaaagaccgtgcccagagccgaggaggccagcgccgccaacttcggcgtgctgtacgacttcaacggcctggcccagtacagcgtgctgttctacggctactacgacaacaagagaaccatcggctggatgaacttcagactgcccctgagctacttcctggtgggcatcatgtgcatcggctacagcttcctggtggtgctgaaggccatgaccaagaacatcggcgacgacggcggcggcgacgacaacaccttcaacttcagctggaaggtgttcaccagctgggactacctgatcggcaaccccgagaccgccgacaacaagttcaacagcatcaccatgaacttcaaggaggccatcaccgaggagaaggccgcccaggtggaggagaacgtgcacctgatcagattcctgagattcctggccaacttcttcgtgttcctgaccctgggcggcagcggctacctgatcttctgggccgtgaagagaagccaggagttcgcccagcaggaccccgacaccctgggctggtgggagaagaacgagatgaacatggtgatgagcctgctgggcatgttctgccccaccctgttcgacctgttcgccgagctggaggactaccaccccctgatcgccctgaagtggctgctgggcagaatcttcgccctgctgctgggcaacctgtacgtgttcatcctggccctgatggacgagatcaacaacaagatcgaggaggagaagctggtgaaggccaacatcaccctgtgggaggccaacatgatcaaggcctacaacgccagcttcagcgagaacagcaccggcccccccttcttcgtgcaccccgccgacgtgcccagaggcccctgctgggagaccatggtgggccaggagttcgtgagactgaccgtgagcgacgtgctgaccacctacgtgaccatcctgatcggcgacttcctgagagcctgcttcgtgagattctgcaactactgctggtgctgggacctggagtacggctaccccagctacaccgagttcgacatcagcggcaacgtgctggccctgatcttcaaccagggcatgatctggatgggcagcttcttcgcccccagcctgcccggcatcaacatcctgagactgcacaccagcatgtacttccagtgctgggccgtgatgtgctgcaacgtgcccgaggccagagtgttcaaggccagcagaagcaacaacttctacctgggcatgctgctgctgatcctgttcctgagcaccatgcccgtgctgtacatgatcgtgagcctgccccccagcttcgactgcggccccttcagcggcaagaacagaatgttcgaggtgatcggcgagaccctggagcacgacttccccagctggatggccaagatcctgagacagctgagcaaccccggcctggtgatcgccgtgatcctggtgatggtgctggccatctactacctgaacgccaccgccaagggccagaaggccgccaacctggacctgaagaagaagatgaagatgctgcagctgctggtggccagcaacaagtaccccgagagccccgagaaggtgcacttcgccctgctgttcaagagcaacgccatctgcgagagacccgagaacaagcactgctag

SEQ ID NO: 103149 - DNA, 2283 bp, Artificial Sequence; identical to SEQ ID NO: 103146
  Description of Artificial Sequence: Synthetic coding sequence
